United States Patent 7,482,117 (GENETIC POLYMORPHISMS ASSOCIATED WITH MYOCARDIAL INFARCTION, METHODS OF DETECTION AND USES THEREOF) - sequence listing, part 14

SEQ ID NO: 39663 - DNA, 201 bp, Homo sapiens
atggcatctttacttttattttttcattgcagttgagtagatgtactggtgctgctcctttgtatgtgtgtatgtgtgtgataacgttaaagaaggctcartaacttgaagggaaaaaaatggtgtgtttatttaatgaccagaattttttttacttctcccaaaatcagggtcctactgagtctttcctgataaaaggta

SEQ ID NO: 39664 - DNA, 201 bp, Homo sapiens
ggtaaaaccccatcgctactaaaaatacaaaaaattagctggacgtggtggtgggtgcctgtaatcccacctactcaggaggctgagtcaggagaataacwtgaacccaggaggtggagattgcagtgagccgagatcgccattgcactccagcctgggcaacaagagtgaaacgtcatctcaaaaaaaaaagaaaaagaa

SEQ ID NO: 39665 - DNA, 201 bp, Homo sapiens
tggcacgatcatggctcactgcagccttgacctccccgggctcagatgatcctcctactttagcttcctgaatagctgggaccacggatccacgtgccacyacacctggctaatttttgcaggttttgtagagttggggttttaccgtgttgcccaggctggcctcaaactcctgagctcaagcgatcctccccaccgact

SEQ ID NO: 39666 - DNA, 201 bp, Homo sapiens
acctgagaagtggcatagctgctaagttgacttttaataaaaaactgtttgtgcctgagggaaatatatgcctttttaaaaagtacctcagaacatgttcstagatcgtctcatcggttttgtttggtgggactgggagttcagcaggaagtattgtctgtgtgtgatgacggggcagtattgccagtcggcaatgttgta

SEQ ID NO: 39667 - DNA, 201 bp, Homo sapiens
gacttcgtgatccgcccgccttggcctccaaagtgctgggattacaggcgtgagccaccgcgcccagccccagctttcttttctaaatattgcttcttcarctagaaacttcgaaagtgcagtattttagaaagacatgacagaaggagcgttaaagagaaatgcagtctctcatttgcatcacttcaagaaatgaacttc

SEQ ID NO: 39668 - DNA, 201 bp, Homo sapiens
ttagaagttgcctaaatgtgtctttggctctagcacttgcccagaaagaactttacagaaagggcccatccttgggttgacgcagagttcttctgagcttsagtgagaagctcttgtctgcagttctgagggaagccctgggggcacagcgaggggcctcccttccctttcctttagtgccatccctcctgatgttcatct

SEQ ID NO: 39669 - DNA, 201 bp, Homo sapiens
tccaactctggattctaataaaataatttggagaactttgagaaaaaggaaaactgttaaataagaaaagacctatttagaaattatactttagtctaacraagaggaggtacaatagtagtcttcaagaaaagaatatttaacaaatgatagatatcagctatagatattgttactaagtctagaataaaaaaggcttca

SEQ ID NO: 39670 - DNA, 201 bp, Homo sapiens
attctcctgcctcagcctcccgagtagctgggactacaggtgcccgccaccatgcccggctaatttttttgtatttttagtagagacggggtttcaccgtrttagccaggatggtctcgatctcctgacttcgtgatccgcccgccttggcctccaaagtgctgggattacaggcgtgagccaccgcgcccagccccagct

SEQ ID NO: 39671 - DNA, 201 bp, Homo sapiens
cttagaagttgcctaaatgtgtctttggctctagcacttgcccagaaagaactttacagaaagggcccatccttgggttgacgcagagttcttctgagctwcagtgagaagctcttgtctgcagttctgagggaagccctgggggcacagcgaggggcctcccttccctttcctttagtgccatccctcctgatgttcatc

SEQ ID NO: 39672 - DNA, 201 bp, Homo sapiens
aaatacattaaaattttactggttaatcataaaatattttatatttgaaaataggatggcaatctttatttttccaagatatttgttggaaaaaaatgatygttggtattattttttctttcagctatattccatggtatctttaaaattgttcagaatataggacttttactaaaaaaattcaattgtcagagtctaaaa

SEQ ID NO: 39673 - DNA, 201 bp, Homo sapiens
tgatgatgatactggtcaatgttccctattcttcagtttttaaaatattttttaaaattcaagttcaaactaatatatatgctaaaataaatatgaaactragcacatagtttgtattagcatctaatatcatgatgactttattttactttttctactttattttttcattctccatagttctttattcagcaaatgcac

SEQ ID NO: 39674 - DNA, 201 bp, Homo sapiens
tcttagaagttgcctaaatgtgtctttggctctagcacttgcccagaaagaactttacagaaagggcccatccttgggttgacgcagagttcttctgagcytcagtgagaagctcttgtctgcagttctgagggaagccctgggggcacagcgaggggcctcccttccctttcctttagtgccatccctcctgatgttcat

SEQ ID NO: 39675 - DNA, 201 bp, Homo sapiens
ttttccctcaagacagggcctcactctgccacccagattggagtgcagtgacaccatcagggctcactgcagccttgacctccctgggcccgagtgatcckcccacctcatcctcccgaatagctgggactataggtgcacgccaccacacctggctaattttcttattttttgtagagagagggtttcattatgttgccc

SEQ ID NO: 39676 - DNA, 201 bp, Homo sapiens
ctcttagaagttgcctaaatgtgtctttggctctagcacttgcccagaaagaactttacagaaagggcccatccttgggttgacgcagagttcttctgagsttcagtgagaagctcttgtctgcagttctgagggaagccctgggggcacagcgaggggcctcccttccctttcctttagtgccatccctcctgatgttca

SEQ ID NO: 39677 - DNA, 201 bp, Homo sapiens
gtgcacaccatcatgcccagctaattttttattttttgtaaagatgaggtctccctatgttgcccagtctggtctgaaagccctagactcaagcaatcctsctgccacagactcccaaagtgctgggattacacaggcatgagccaccatgcccagttgagtttcttaatttatgaatcaagtacacttaaatgctttaga

SEQ ID NO: 39678 - DNA, 201 bp, Homo sapiens
cctcttagaagttgcctaaatgtgtctttggctctagcacttgcccagaaagaactttacagaaagggcccatccttgggttgacgcagagttcttctgascttcagtgagaagctcttgtctgcagttctgagggaagccctgggggcacagcgaggggcctcccttccctttcctttagtgccatccctcctgatgttc

SEQ ID NO: 39679 - DNA, 201 bp, Homo sapiens
cttgcctcttagaagttgcctaaatgtgtctttggctctagcacttgcccagaaagaactttacagaaagggcccatccttgggttgacgcagagttcttytgagcttcagtgagaagctcttgtctgcagttctgagggaagccctgggggcacagcgaggggcctcccttccctttcctttagtgccatccctcctgat

SEQ ID NO: 39680 - DNA, 201 bp, Homo sapiens
tcttgcctcttagaagttgcctaaatgtgtctttggctctagcacttgcccagaaagaactttacagaaagggcccatccttgggttgacgcagagttctkctgagcttcagtgagaagctcttgtctgcagttctgagggaagccctgggggcacagcgaggggcctcccttccctttcctttagtgccatccctcctga

SEQ ID NO: 39681 - DNA, 201 bp, Homo sapiens
taactcaagggtctgttgtgaggattaaatgagtccttacatgtgacatacttgaaatagtacctggtgcagagttagggctgggtgagtgttagctattrtattattatttcattgctgtttgcatatatttttaaaatgtatttaggattttctttttttttttgagacagggtctcactctttgcccaggccggagtg

SEQ ID NO: 39682 - DNA, 201 bp, Homo sapiens
cccttatattcagttcatatgactatgttggtaatgtcagtcagaaacctatttttacaactttccttcactttaaaaatagaaaataatttgtaaatcayttattaccactttcacagatcccaacaactctagagacataaatagttagatctgttaaaaggtacatgacttcccttatgtttgcaagtattaatttta

SEQ ID NO: 39683 - DNA, 201 bp, Homo sapiens
tttgtttttccactctggtcactcagttctagccaagatagtccaccttattttagcacttgtactatgtctctgtctctgtctgtctgtctgtctgtctstctctctctctctctctctctctctctatatatatatatatatatgtaattttgagatggagtctcactctgtcgctctgactgaagtacagtggtgcga

SEQ ID NO: 39684 - DNA, 201 bp, Homo sapiens
ttagtgttcctctccaaagctgtatagttctgcgttaccttgcagtatgataaatctgatatcaactaataaaagatgtagatgattttgtatttaggagractgcttttgagagcaaaatgaaggcttgggatatgtagagcaaactgcctatcggctgcaggggacactgtattcagcaaatttgcttcatctgaaaca

SEQ ID NO: 39685 - DNA, 201 bp, Homo sapiens
gcagtagtgaggctgttgtgaattgttcctaaatttatgctaggtgctcttacctcaatttggatgccattatttgtttattgcaaatacagggtacaatraaaagcagtaagtgcgcatggagtaaatttgcattaaatgaagaaggaatcaattatagagtctctagaaatacatatttatttgccaacctcattcagt

SEQ ID NO: 39686 - DNA, 201 bp, Homo sapiens
ccagctcactcaagcatggctggtgcaagtttatccctgagagaagatccaactcatcttccccttttgttcatatctggaaggcacgggacatcaccggyacccattttagcctctgcgttctgtagcttggacaggcattatcttgatgtcactgtgggacactctcagctcctctgatcctgtatagcatctccagta

SEQ ID NO: 39687 - DNA, 201 bp, Homo sapiens
aatggatattataaataatggtctccaatattgactcttttgagtaattctatcagggacatgttgaaattccaatgaccattttttttttttttttttttgccttagaggcatcttttgtacataatgtatttctttttttttttttttccctcaagacagggcctcactctgccacccagattggagtgcagtgacacc

SEQ ID NO: 39688 - DNA, 201 bp, Homo sapiens
taatggatattataaataatggtctccaatattgactcttttgagtaattctatcagggacatgttgaaattccaatgaccattttttttttttttttttttgccttagaggcatcttttgtacataatgtatttctttttttttttttttccctcaagacagggcctcactctgccacccagattggagtgcagtgacac

SEQ ID NO: 39689 - DNA, 201 bp, Homo sapiens
ataatggatattataaataatggtctccaatattgactcttttgagtaattctatcagggacatgttgaaattccaatgaccattttttttttttttttttttgccttagaggcatcttttgtacataatgtatttctttttttttttttttccctcaagacagggcctcactctgccacccagattggagtgcagtgaca

SEQ ID NO: 39690 - DNA, 201 bp, Homo sapiens
cgatggtctatgggcaccccttgtgatctctgctttaaatcatttgatgtctgaattggtggaagggacacgggagcacacaccagcctggggagcccacyagagtacagaatgcaaactacagggacacatgcctttgagcaggtagtagatagccagggcctgtcaagttattaggtgtcccaggccaggtaataactc

SEQ ID NO: 39691 - DNA, 201 bp, Homo sapiens
tagcatctaatatcatgatgactttattttactttttctactttattttttcattctccatagttctttattcagcaaatgcacattgaacagcagaattstgttttaaacaccatgaaggaacactgaagcactatgaggagcaatgaggtggataaaaaagtacttactttctctaaggagattacagtgtacttgtgg

SEQ ID NO: 39692 - DNA, 201 bp, Homo sapiens
atcttgcctcttagaagttgcctaaatgtgtctttggctctagcacttgcccagaaagaactttacagaaagggcccatccttgggttgacgcagagttcktctgagcttcagtgagaagctcttgtctgcagttctgagggaagccctgggggcacagcgaggggcctcccttccctttcctttagtgccatccctcctg

SEQ ID NO: 39693 - DNA, 201 bp, Homo sapiens
ctctttgggagtacgtttatttgggtagcagccagggagactgaaacagttgaactgcccttcacaaaggctgagaaagatcgaattaccattacacttcrgggggctggagatggtacctgggtgaatgaccatgtgaagaaaggcggggtggcttccaagatggaagtgatggctggggaacttggcttgagctgggat

SEQ ID NO: 39694 - DNA, 201 bp, Homo sapiens
gtagatggaaaaggaacagccagtgctcacttacaggtgatttttgtgctctgtgaaggtgggcccagtgttgcctgaattatttatttatttttatttayttatttttagacggagtcttgctctgtcgcccaggctggagtgcagtggcgcgatctcggctcactgcaacctctgcttcctgggttcacgccattctcc

SEQ ID NO: 39695 - DNA, 201 bp, Homo sapiens
gtttacctaattaaaatgtctgtcttcatcaatagctgcctttttcgtcccatcatgaagcccattgtcaatcttgcctcttagaagttgcctaaatgtgkctttggctctagcacttgcccagaaagaactttacagaaagggcccatccttgggttgacgcagagttcttctgagcttcagtgagaagctcttgtctgc

SEQ ID NO: 39696 - DNA, 201 bp, Homo sapiens
ttggtcaggcactgtggctcacggctgtaatcccagctctttgggaggccaaggtgggaggaatgcttgagcccagggattggagaccagtctggtcgacmtaggaaaacctcatctccactaagaataaataaataaataaatactactactaattagctgagtgtggtggcatgggcctgtagttccagctagtggtgg

SEQ ID NO: 39697 - DNA, 201 bp, Homo sapiens
gccaccatgcccagctaaattttttttttttgtatttttagtagagacagggtttcactgtgttagccagtatggtcttgatctcctgacctcatgatccrcccaccccagcctcccaaagtgctgggattacaggcgcgagtcactgcgcccggcccaactttacagtatttaagcaggcctgaaagaaaccatgacaca

SEQ ID NO: 39698 - DNA, 201 bp, Homo sapiens
gggcctcactcagtatctcatcacatgaatctctctgctgggctgcctcatcacacaacagctgtcttccccagagcaagcagtttgagaaaaggggtgcrcccaagatggaagctgcagtcttttttgtaacctaatcccagaagagtcattactttcaccctgttctctttaacagaagcgagtcactcaatccagctc

SEQ ID NO: 39699 - DNA, 201 bp, Homo sapiens
agctctttgggaggccaaggtgggaggaatgcttgagcccagggattggagaccagtctggtcgacataggaaaacctcatctccactaagaataaataamtaaataaatactactactaattagctgagtgtggtggcatgggcctgtagttccagctagtggtggggctgaggcagtaagatcccttgagcccaggagg

SEQ ID NO: 39700 - DNA, 201 bp, Homo sapiens
agtgcagtggaagcaatcctggctcactgcaagctctgcctcccgggttcacgccattctcctgcctcagcctcctgagtagctgggactacaggcacccrccaccatgcccagctaaattttttttttttgtatttttagtagagacagggtttcactgtgttagccagtatggtcttgatctcctgacctcatgatcca

SEQ ID NO: 39701 - DNA, 201 bp, Homo sapiens
gcatctccccgaaccaataatagaagcttctgactccttcgcccacccttctgacttcttcttgcttctcccatggaagcaggtgtgggaaccgctgagcrgaacaccctcccccagcgggaaatccgggacacgcaggagcctcagtgaatccgaccattgtctcatctcaccaggcaggtgcctcctccatcctatgtg

SEQ ID NO: 39702 - DNA, 201 bp, Homo sapiens
gaggccaaggtgggaggaatgcttgagcccagggattggagaccagtctggtcgacataggaaaacctcatctccactaagaataaataaataaataaatactactactaattagctgagtgtggtggcatgggcctgtagttccagctagtggtggggctgaggcagtaagatcccttgagcccaggaggtcgaggctgc

SEQ ID NO: 39703 - DNA, 201 bp, Homo sapiens
aggtggtgggctggatttgctccggaggacatactatttttttttttttgagacagaggctcgctctgtcgcccaggctggagtgcaatggtgcgatctcrgctcactgcaagctctgcctcccgggttcacgccattctcctgcctcagcctcccaagtagctgggactacaggcacccgccaccatgcctggctaattt

SEQ ID NO: 39704 - DNA, 201 bp, Homo sapiens
taacatgccatcgtataggtcggaagtggaaatgggagaaagtgtggggtgcctagggaaggaggtgactgagtagggagcctggctgccatcctaacacmcagctcactgggcttgagagacttgagcctggtgccagggcagagtgggtgatgctggggcccaggctggcaccatacttgaggtctgccaggcaggtca

SEQ ID NO: 39705 - DNA, 201 bp, Homo sapiens
aggccaaggtgggaggaatgcttgagcccagggattggagaccagtctggtcgacataggaaaacctcatctccactaagaataaataaataaataaatamtactactaattagctgagtgtggtggcatgggcctgtagttccagctagtggtggggctgaggcagtaagatcccttgagcccaggaggtcgaggctgca

SEQ ID NO: 39706 - DNA, 201 bp, Homo sapiens
agatcacctgaggtctggagttcgagaccagcctgaccaacatagagaaaccccatctctactaaaaatacaaaattagccgggcgtggtggcacatgcckgtaatcccagctactagggaggctgaggcaggagaatcgcttgaacctgggaggcagagattgcagtgagccgagatcatgccattgcactccagcctgg

SEQ ID NO: 39707 - DNA, 201 bp, Homo sapiens
caccttggactgcagtgggcagggcctggggtggggatgagggtgcactgaccagcaccgcagcagcttggggaggttggggtgctgttaacatgccatcktataggtcggaagtggaaatgggagaaagtgtggggtgcctagggaaggaggtgactgagtagggagcctggctgccatcctaacacccagctcactggg

SEQ ID NO: 39708 - DNA, 201 bp, Homo sapiens
cctgctggcgattggctccagagaggaaggggtggaggcagccccggcctggcagctgcggtagcggctttgagtgagtgcgggagctgcagataccgagrcgctgcgactgccgcaggagtcgccgcagccaaactcgccgcgacgccgggagggagcgtaccgggaaggagagggagaggaggcactcgctgaggagac

SEQ ID NO: 39709 - DNA, 201 bp, Homo sapiens
gtggctcatgcctgtaatcccagcacttggggaggccgaggcgggcagatcacctgaggtctggagttcgagaccagcctgaccaacatagagaaaccccrtctctactaaaaatacaaaattagccgggcgtggtggcacatgcctgtaatcccagctactagggaggctgaggcaggagaatcgcttgaacctgggagg

SEQ ID NO: 39710 - DNA, 201 bp, Homo sapiens
atgacaactattaaaaaaaataagggatttctgaccagctaacaaccccacagaaaatctgccagggatccagaaatgagactgaggtggcctcagagagyggctccctcctgaaggggatgctgctgctgtcatcctgcccggcaccttggactgcagtgggcagggcctggggtggggatgagggtgcactgaccagca

SEQ ID NO: 39711 - DNA, 201 bp, Homo sapiens
cccttagctatgctgtcccttcccccagaggaccttgggcaggaacccgcctaccgccgagcttgtcctggaggtcacttctcagaaaattcagaaagtamaggtagaattctctttttctctctaacttttgttaggatttgaaaagaccagttttctagctactgaagcttaagcggcttcgctaaattcctgctttgg

SEQ ID NO: 39712 - DNA, 201 bp, Homo sapiens
gtctccacacagaactgggacagttccatccccgccccttcctccagggcagcagggctgaggatcccattctggctgtgtccacgtccgggccatggctrgagtctgggtttaggggaggaaggcatggcggcgcccgctaggatttccagttgtcctcttcttcctctgcctgtggctgctgggggttagcagacacgg

SEQ ID NO: 39713 - DNA, 201 bp, Homo sapiens
aaagggagttgtggcagtctacaaatcatttctgtaaggtagctctgctttttctcttttccattctttttttttttttttttttgagacgcagttttgckcttgtcccgcaggctggagtgcagtggcgcaatctcggctcactgcaacctctgcctcctggcttcaagattctcctgtctcagcctcccgagtagctgg

SEQ ID NO: 39714 - DNA, 201 bp, Homo sapiens
cgatggagcacaggcagatggaagcccccaccccagctgcgtggcctgaagccagcctcccgctccccgaaggtggtctccacacagaactgggacagttycatccccgccccttcctccagggcagcagggctgaggatcccattctggctgtgtccacgtccgggccatggctggagtctgggtttaggggaggaaggc

SEQ ID NO: 39715 - DNA, 201 bp, Homo sapiens
tggaagcctctttagggaatcgaggagcgcactggtgcaggggctgggtggagccatcctccgatggagcacaggcagatggaagcccccaccccagctgygtggcctgaagccagcctcccgctccccgaaggtggtctccacacagaactgggacagttccatccccgccccttcctccagggcagcagggctgaggat

SEQ ID NO: 39716 - DNA, 201 bp, Homo sapiens
agattttggtgattataactagagcttctataagcattcatgtacacttacgttttcgtgaagttttcatttttctagagtaaatacttaagagagtgggratactaggtcatatggtaagtgtatggttaagttttccagagcagctgtaccattttgctttcccactagcaatgtgtaaaagttcctgttgcccctatt

SEQ ID NO: 39717 - DNA, 201 bp, Homo sapiens
tctaaatctctgagatggctgtgttttagagctgcatgttctgcttatttactgcctgtcctttacatttcaaattcattcaatatttttccaaagtacasaatagttttgcctagttgcagtaattttcacctagacttcagggatcttccatcaactcttttatgtattttttctcctttgtttttccactctggtcac

SEQ ID NO: 39718 - DNA, 201 bp, Homo sapiens
aattaagtctataaaattgaggtgttgcaatacataatgtctatgatttttttttaccagctctaaatctctgagatggctgtgttttagagctgcatgtkctgcttatttactgcctgtcctttacatttcaaattcattcaatatttttccaaagtacagaatagttttgcctagttgcagtaattttcacctagactt

SEQ ID NO: 39719 - DNA, 201 bp, Homo sapiens
acccaaagtcatacaaatggtcagtggcagattttggaccagaagttaagcatttctaattccatgaaattgtcgtaatattatgactcccacctaaacawaacttattaattaattgattgattgataaattttcacctttctgcaatacggagcttctatctagacaggccagtcattttacctggtgctaaaataaac

SEQ ID NO: 39720 - DNA, 201 bp, Homo sapiens
gcagggtctttatgacctctatcttgtcctgctgacctatcttgtcctgtgactaagaatgcttaacctcctgggaatgcagcccagtaggtgttagcctyattttacccagaccttattcaagatggagtccctctggttccaatgcgtctgacaatactgctgccctgaggtgcctggtgctgattagaccgcgatcaa

SEQ ID NO: 39721 - DNA, 201 bp, Homo sapiens
aggaggcggaggttgcagtgagccgagatcacgccactgcactgcagcctgggtgacacagtgagactccgatccacctcaaaaaaaaaaaaaaaaaaaaagaggctgggcatggtggctcatgcctgtaatcccagcacttggggaggccgaggcgggcagatcacctgaggtctggagttcgagaccagcctgaccaac

SEQ ID NO: 39722 - DNA, 201 bp, Homo sapiens
ctaaaaatataaaaaagaaattagccgggcgtggtgacaggtgcctgtagtcctagctactcaggaggctgaggcaggagaatcgcttgaacccaggaggyggaggttgcagtgagccgagatcacgccactgcactgcagcctgggtgacacagtgagactccgatccacctcaaaaaaaaaaaaaaaaaaaaagaggct

SEQ ID NO: 39723 - DNA, 201 bp, Homo sapiens
atttcctccaatgtcaggtaataatatataagaatatcaccctgggtgcaatggctgatgcctggaatcccagcactttgggaggccgaggtgggcggatygcgaggtcaggagttcgagatcagtctggccaacatagtgaaaccctgtctctactaaaaatataaaaaagaaattagccgggcgtggtgacaggtgcct

SEQ ID NO: 39724 - DNA, 201 bp, Homo sapiens
atgtatcaccacgcctggctaattttttatatttttagtagagatggggtttcaacgtgttagccaggatggtctcgatctcctgacctcatgatctgccsgcctcagcctcccaaagtgctgagattataggtgtgagccaccacgcctgacctaagaagggtattttcttgtggtcctttttttggttattgatgaaac

SEQ ID NO: 39725 - DNA, 201 bp, Homo sapiens
tttttttttttttttttgagagacggagtctcgctctgtcaccaggctggagggcagtggcgcgatcttggctcactgcaacctctgcctcctgggttcargcgattctcctgcctcagcctcccgagtagctgggactacatgcatgtatcaccacgcctggctaattttttatatttttagtagagatggggtttcaac

SEQ ID NO: 39726 - DNA, 201 bp, Homo sapiens
tttgtaaagatgcttctcgaatactttttaaaataagaaggggttttttttttttttttttttttgagagacggagtctcgctctgtcaccaggctggagkgcagtggcgcgatcttggctcactgcaacctctgcctcctgggttcaggcgattctcctgcctcagcctcccgagtagctgggactacatgcatgtatca

SEQ ID NO: 39727 - DNA, 201 bp, Homo sapiens
aaaacccaaggccaaaacttccgtcccctgaaaggctcttagtcccctaggctttcgggttcctggcaatgactttgcctcttgggcagcatggtcttacragttagttacttgtgtttaagttttgggttcttttttttttttgcttgcctttgggcacctcctttattttgttatgagctcagccatgcatttgttgta

SEQ ID NO: 39728 - DNA, 201 bp, Homo sapiens
gacttagaaaaatacatttgtaaagatgcttctcgaatactttttaaaataagaaggggttttttttttttttttttttttgagagacggagtctcgctcygtcaccaggctggagggcagtggcgcgatcttggctcactgcaacctctgcctcctgggttcaggcgattctcctgcctcagcctcccgagtagctggga

SEQ ID NO: 39729 - DNA, 201 bp, Homo sapiens
tgggataagtgagctcacagtggagaaatgtagacttagaaaaatacatttgtaaagatgcttctcgaatactttttaaaataagaaggggtttttttttkttttttttttttgagagacggagtctcgctctgtcaccaggctggagggcagtggcgcgatcttggctcactgcaacctctgcctcctgggttcaggcga

SEQ ID NO: 39730 - DNA, 201 bp, Homo sapiens
aaactgaaatggcataaactctgtgtgtgtgtgtgtgtgtgtgtgtgtatgtatgtgtgtgtgtgtaggggtggagagagtgagaaagagaaaacaagtayggtgaaatgttcacaaactggtgaatcaggccaagggtctacgggagttctctgtgtaattcttgcacttttaaaaattatttaaaactaaaaactaagc

SEQ ID NO: 39731 - DNA, 201 bp, Homo sapiens
agagtcttgctgtgttgcccaggctggagtgcagtggcatgatctcagctcactgcaacctccacctcctggttcaagcaattctcctgcctcagcctccsgagtagctgggattacaggcatgagccaccacacccagctaatttttgtattttcagtaaagacagggttgtaccatgttggccaagctggtcttgaact

SEQ ID NO: 39732 - DNA, 201 bp, Homo sapiens
agagacagtctcactttgctcccaggctggaatgcagtggctattcagaggcttaatcattgggcactgcagccttgaactctgggcttttttttttttttgagatggagtctcagctctgtcgtccaggctggagtgcagtgactcatgtctcggctcactgtagcctccacctcccccaatcaagcgattgtcctgtct

SEQ ID NO: 39733 - DNA, 201 bp, Homo sapiens
attgatagatataagggttaagagggaaaagaaaaaaaatccagaagagaaaaatccatgtagtggcacaattaaaatttgatttcttttttttttttttkgcgacagagtcttgctgtgttgcccaggctggagtgcagtggcatgatctcagctcactgcaacctccacctcctggttcaagcaattctcctgcctcag

SEQ ID NO: 39734 - DNA, 201 bp, Homo sapiens
ctcagcctcctgagtagctgggactataggtgcctgccaccatgcctggctaatttttttttttttgcatttttagtagagatggggtttcaccgtgttaktcaggatggtctcaatctcctgacctcgtgatctgcccgtcttggcctcccaaagtgctaggattacaggcatgagccaccgcgcctggctgaaaacctt

SEQ ID NO: 39735 - DNA, 201 bp, Homo sapiens
actgcactctcgcctggcctgtctcaaaaacaaaacagaaaccggcaaaactcagtcttgttgttttcttttttctttctttcttttttttttttttttttggtagagacaggatcttgctatgttgtccaggctggtcttaaacatctggcctcctcaacctccccaagtgctggtattacagacatgagcctctgagcc

SEQ ID NO: 39736 - DNA, 201 bp, Homo sapiens
tccagttgcggcttttgacccccagatgcaaattctggtgggagagagctgacctgtggccccacagtgatccttactgggcaatctactggccaggaggccaagccctgtctaggtactaccctaatgaaacctttaaggcgctacagatctttgctgttttcagttccctccaacctctacaaaaaaccagagcaatgc

SEQ ID NO: 39737 - DNA, 201 bp, Homo sapiens
ttatgaaagaactttaaaggtacagttggcccacaatataacaatatagcaatataaaattacaacaataaaaataacacaaaaatagtgtaacaactacttatatagcatttacgttgtattaagtattatgagtcatccagagatgatttaaagtaaagtataccacagcatatgcctagtttatatacaaatatgatg

SEQ ID NO: 39738 - DNA, 201 bp, Homo sapiens
aaaccgtaacaagtccgtggggtttccatggttggagcacatgctaaaattctctctctctcttttattctcagggaaagtttcaaatggaagacttagtrtataatccggaacaagtgccacgttactaccaaaatgcctacctgcacctgcgacccttctacagcacaacccgcagcttccttggcatccaccggctaa

SEQ ID NO: 39739 - DNA, 201 bp, Homo sapiens
tttatgaaagaactttaaaggtacagttggcccacaatataacaatatagcaatataaaattacaacaataaaaataacacaaaaatagtgtaacaactacttatatagcatttacgttgtattaagtattatgagtcatccagagatgatttaaagtaaagtataccacagcatatgcctagtttatatacaaatatgat

SEQ ID NO: 39740 - DNA, 201 bp, Homo sapiens
atttatgaaagaactttaaaggtacagttggcccacaatataacaatatagcaatataaaattacaacaataaaaataacacaaaaatagtgtaacaactacttatatagcatttacgttgtattaagtattatgagtcatccagagatgatttaaagtaaagtataccacagcatatgcctagtttatatacaaatatga

SEQ ID NO: 39741 - DNA, 201 bp, Homo sapiens
tatgaattattagaaaagaaaggacattcattatgatttaatcgcagttgaatgtaggcagcacagagggcttatactgtgtcttttttttttttttttttaaatatacggtgtctattttgctcaccactctatgcccggtgcctggaagtgcgactggcacatagtaggtgttgcatagtttcagaatgaactttttag

SEQ ID NO: 39742 - DNA, 201 bp, Homo sapiens
ctaactttcaatttaataaaaaaaattaatttgtgcaattggttgttattttatagaagcctaatttctagaatatgggatataaacaatttaataatgtkttcaccagttagtttgattgctttctaaattaggaaaaatgaaaacaaataaacgatgggcaaaaaagctgactggggacagtaaggtctaagaaggcag

SEQ ID NO: 39743 - DNA, 201 bp, Homo sapiens
ctccacctccccagttcaagtgattttcctgcctcagcctcccgagtagctgagattataggcgcccaccaccatgcctggctaatttttgtatttttggkagagacagggtttcgccatgttgactaggctggtctcgagctcctacggatcggcctcccaaagtgctgggattacaggtgtgagccgctgcaccagccc

SEQ ID NO: 39744 - DNA, 201 bp, Homo sapiens
caaattccaagttaaagtggaacttgccacatgtcgttttgtatcactttccccaacccctttcttttcttttttttttttttttttgagacggaatttcrctcttgttgcccaggctggagtgcaatgttatgctctcagctcactgcagcctccacctccccagttcaagtgattttcctgcctcagcctcccgagtag

SEQ ID NO: 39745 - DNA, 201 bp, Homo sapiens
agcctccctaggagctgcagctacaggcacatgccaccatgcccagctaattctttatttattttattttattttttgagtcaaggtctcactgtgccacycaggctggagtgcagtggcatgatcaaggctcactgcagcctccacctcctgggtgcaaatgatcctcccacctctcagctccctgagtaccgggaccac

SEQ ID NO: 39746 - DNA, 201 bp, Homo sapiens
tttggcctcccaaagtgctaggattacaggctaactttcaatttaataaaaaaaattaatttgtgcaattggttgttattttatagaagcctaatttctakaatatgggatataaacaatttaataatgttttcaccagttagtttgattgctttctaaattaggaaaaatgaaaacaaataaacgatgggcaaaaaagct

SEQ ID NO: 39747 - DNA, 201 bp, Homo sapiens
actcacccaagggtctcacagatgcctttcctgttttctttgccccatttttcttttttctgctttgcttttacatactttctcttcttttgaacacatcygtccttctgcattcagcctcccaccatcatctgatatctcaaaagaagagacagccgtctccttcctcacagctgagtagcactgagaagtagttaaggg

SEQ ID NO: 39748 - DNA, 201 bp, Homo sapiens
ctattggctctttcgaggacactgagaggctcttttctttctctactctgggaagaaagaaggtagggccacataatctttaaataaagagactctaagcmagaagttttgtaggtgttaccttttctcctccctcagcatagtctgactttgggaagggcaaattcaaatcgtgagcagcactggtcacagtctaccagt

SEQ ID NO: 39749 - DNA, 201 bp, Homo sapiens
tcatgaaaagattggcataatacgtaggcatgttttcttaattattataaatagaaaagtatgattgcagtcatggaaaatattcattaaaattagaggamacttacaatgttagtgacattacaatgttaatggcagttggtcaaattaataataggtaatgtcttgtgtttttctctatatttttcaaattttctacag

SEQ ID NO: 39750 - DNA, 201 bp, Homo sapiens
tttcaacattaaaccatgtctaactcttttagcataggccccaattgagaactgctctgttttctgtcctaagccttacttagatcttttcattgcaattmgacaaaaatatcagagtattaagagtcagagaccaatcaacaggatgttctctgttccttcgtttcccaccaaatacagcactatgcacgaaggtggcat

SEQ ID NO: 39751 - DNA, 201 bp, Homo sapiens
ttttcttgtgaaggtaaatctctgaataaatactcacttagcacatacatccacttggaattcatcatctgaaatagttactgtttgtggtgcattgaccrtaacttcaaacttgggcagcactggaaacgaagagaaatatacgttagcctgcacaatcacaggcaagcaaaccttattgcagtcatatagcttactatg

SEQ ID NO: 39752 - DNA, 201 bp, Homo sapiens
tagcccaataaaataaattaatgaaaatgaagtaaatttctaagtgaaaaagctaaaaataacaacaaaatacagcaccagtaaggaaataataaagataraaatagaaattaatgtgatggagtagcaaaaaacctcacatcatattacatcacattaataaattaaaattatatgtttttggaaaactcggcaaaatag

SEQ ID NO: 39753 - DNA, 201 bp, Homo sapiens
aaacacctagcccaataaaataaattaatgaaaatgaagtaaatttctaagtgaaaaagctaaaaataacaacaaaatacagcaccagtaaggaaataatraagataaaaatagaaattaatgtgatggagtagcaaaaaacctcacatcatattacatcacattaataaattaaaattatatgtttttggaaaactcggc

SEQ ID NO: 39754 - DNA, 201 bp, Homo sapiens
gacacctctattctggtctaaacgctgttgccacctctcagttcagatcaacagcctatgtgccaggtgctgtgctaggttggacagacacaagaatccayagggcatgattcttgtcctctgtaaacttagaagccagcccagatgtatgcttttacctcactcccttcctgagttggtatctacatgatacactgattg

SEQ ID NO: 39755 - DNA, 201 bp, Homo sapiens
tttctgtaaattgctttcaaatcgtagaggggaatggattatgaagtataaatcaagaagagcaaaattataagaaaaagaggccgggcgtggtggttcaygcccgtaatcccagcactttgggaggccgaggcgggtggatcacctgaggtcaggagtttgagaccagtctggccaacatgatgaaaccccgtctctact

SEQ ID NO: 39756 - DNA, 201 bp, Homo sapiens
aacaagtgcccagacgatcctgatgtacaaccaggtttataagcttctgtgcatttccaaacatgggtaaaccccactttggtcctgaggacaggttgccragatttgcaggaataagacaaggaatgctatagattgtccctcaatacataatctgggccctctgcactttctggcatactttttgctcatttctgtttg

SEQ ID NO: 39757 - DNA, 201 bp, Homo sapiens
ggtctccctacaatcactggtctctcactcccttaaaattttttctgtaaattgctttcaaatcgtagaggggaatggattatgaagtataaatcaagaaragcaaaattataagaaaaagaggccgggcgtggtggttcatgcccgtaatcccagcactttgggaggccgaggcgggtggatcacctgaggtcaggagtt

SEQ ID NO: 39758 - DNA, 201 bp, Homo sapiens
tagcttcaagtgatccacctgcctcgacctcaccatcctagactttaaaccttgaaattttctagagctgcctcccagtgactttaacttactgtgtggayctgccttgctgccctcacttcttcatcttctcaccccgtcctcaccacttccttgtcttcttttggactggcttgtgtttacaacattggattagcagtt

SEQ ID NO: 39759 - DNA, 201 bp, Homo sapiens
agtagagacggggtttcaccatgttggccaggttggtctcaaactcctgacctcaggtgatccacctaccttgacctcccaaagtgctgggattacaggcrtgagccacagcgcccggcctttctcgtttcttaaaataattttataatgttccgttcaatggatgcatgataatgtgttccccaaatagcaaacgtttag

SEQ ID NO: 39760 - DNA, 201 bp, Homo sapiens
attcagcacctattttcagcccttcttaatttttctgtgacatttgtacctttttaaagctcttttcttggttctgatgacctgagatatcttgattttcytacctcattggttcttcaactttcttcctctggctttgccattttctcctttctcctcgtcttcattgggggtcccatctgccctctgggaaggttcagc

SEQ ID NO: 39761 - DNA, 201 bp, Homo sapiens
tagtagagacggggtttcaccatgttggccaggttggtctcaaactcctgacctcaggtgatccacctaccttgacctcccaaagtgctgggattacaggyatgagccacagcgcccggcctttctcgtttcttaaaataattttataatgttccgttcaatggatgcatgataatgtgttccccaaatagcaaacgttta

SEQ ID NO: 39762 - DNA, 201 bp, Homo sapiens
agtttctcctcattctttttttctgtttttgagatggagtcttgctctgttgcccaggctggagtgaagtggcctgatctcggctcactgcaacctccgcmtcccaggttcaagtgactctcctgcctcagcctcccaagtagctaggattacaggcgcccaccaccacgcctggctaattttttttttttttggtatttt

SEQ ID NO: 39763 - DNA, 201 bp, Homo sapiens
aatctatgacttgctttttacatttaataatatattgtgactacatttccattttagtacaataaagtttctcctcattctttttttctgtttttgagatrgagtcttgctctgttgcccaggctggagtgaagtggcctgatctcggctcactgcaacctccgcatcccaggttcaagtgactctcctgcctcagcctcc

SEQ ID NO: 39764 - DNA, 201 bp, Homo sapiens
ttcagtgaaagggttaatacaaacagaaattacggaatttctgaaaaataaaaatggtgcaattgctatgtatcaggatctatgagatacttcaaaagtasaaatcatggaaaaacttataggcttaaaaacacctagcccaataaaataaattaatgaaaatgaagtaaatttctaagtgaaaaagctaaaaataacaac

SEQ ID NO: 39765 - DNA, 201 bp, Homo sapiens
tgctgggattacaggcgtaagccaccgcacccagccccagagtctgttgtttatagaggatgattgggcgtagctttctagagctgggaaaaccacctttmaacagtattatataccaatatttactatttcataaattcaggcatatttgcttaaaataatctcctgtagagaggcaagaaacagaagcccatttttttg

SEQ ID NO: 39766 - DNA, 201 bp, Homo sapiens
ttaaaagaaaactctaaaataaattcctttttatatgaaaattataaagtactccagtaagtaaattttcagtgaaagggttaatacaaacagaaattacrgaatttctgaaaaataaaaatggtgcaattgctatgtatcaggatctatgagatacttcaaaagtagaaatcatggaaaaacttataggcttaaaaacac

SEQ ID NO: 39767 - DNA, 201 bp, Homo sapiens
tggtgcgatctcagctcactgcaacttctgcttcccaggttcaagtgattctcctgcttcagcctcccaagtagctaggactacaggcgcgtgccaccacrcccagctaatttttgtattcttagtagagacagggtttcaccatgttggccaggatggtttgatctctcgaacttgtgatccgcccaccttggcctccca

SEQ ID NO: 39768 - DNA, 201 bp, Homo sapiens
aggatgtttctcagcacctgtggacatggccacctttgacctcattggatatgcgtacagccatcaaatcaatattgtggctactgttgtggaggaagggwcaggtaagtagggtgctccttggctcattaagaaaagagaaagaaaaagggctggtcccagggacagatttactccaagtatacaagacctaccctcttg

SEQ ID NO: 39769 - DNA, 201 bp, Homo sapiens
agccaggtgtggtagcaggcacctgtaatcccagctacttgggagactgaggcacaagaatcacttgaacctgggaggcggaggttgcagtgagccaagaycatgccactgtactccagcctgggtgacagagcaagactctttcaaaaaaaaaaaaaattatagtaattttaacatgttcggtgttttctgtaattttgt

SEQ ID NO: 39770 - DNA, 201 bp, Homo sapiens
tccccttttgttcatatctggaaggcacgggacatcaccggtacccattttagcctctgcgttctgtagcttggacaggcattatcttgatgtcactgtgkgacactctcagctcctctgatcctgtatagcatctccagtaaacaactaaaagtgctttgtggagcagggattgccaagaggcaaatcaagagtgttcct

SEQ ID NO: 39771 - DNA, 201 bp, Homo sapiens
ctgggctcaagcaatcctcatgcctcagcccccaagtagctgggactacaggtgcacaccgccatgcctgactaatttttgtattttttttgtagacacasggttttgccatgtaagccaggttggtctagaactcttgagctaaggacagtccgcctgttttggcctcccaaagtgctaggattacaggctaactttcaa

SEQ ID NO: 39772 - DNA, 201 bp, Homo sapiens
agtgaaagagagacagaaagacaaagtcaaggagagaaaaagagatggaagtagtaaagaaaaaacagtgtaccctattcctttaaaagccggggtaaacktctatctacccagccaaggcatattctacttatgtggatcttcaacccatatctgcctctcagacagtttgcaagaaataacgaaatctatccttacttt

SEQ ID NO: 39773 - DNA, 201 bp, Homo sapiens
gagtgaaagagagacagaaagacaaagtcaaggagagaaaaagagatggaagtagtaaagaaaaaacagtgtaccctattcctttaaaagccggggtaaaygtctatctacccagccaaggcatattctacttatgtggatcttcaacccatatctgcctctcagacagtttgcaagaaataacgaaatctatccttactt

SEQ ID NO: 39774 - DNA, 201 bp, Homo sapiens
tgatgaatgccacttaaattacctagattcatctttaagcagaattgttttcccttcagatgcttagaaagattgttagtttcttttatatctttaagttstaaatcacaaaatcatatggcaagaaaaaccccagatttcttttccaatctatgaataaacataaagagacagttaatacttaattgatctatctgaact

SEQ ID NO: 39775 - DNA, 201 bp, Homo sapiens
agcagtcagagtgaaagagagacagaaagacaaagtcaaggagagaaaaagagatggaagtagtaaagaaaaaacagtgtaccctattcctttaaaagccrgggtaaacgtctatctacccagccaaggcatattctacttatgtggatcttcaacccatatctgcctctcagacagtttgcaagaaataacgaaatctat

SEQ ID NO: 39776 - DNA, 201 bp, Homo sapiens
aaataccacaaggaaattatagagttattgcacacaatgcaaaaacacaaagaggtgggaatcttacactgacaaagccatcaaaatgggaaggagagggragaacagcaacataagcagctggcagaggcagcagaaaggaaggaagagacaggaagtcaaagaaagagacagagagtaagaaacaaagagaagcagtca

SEQ ID NO: 39777 - DNA, 201 bp, Homo sapiens
gtattgcaagctcacatgtttcctgttacgttcttccaattagattgcccttctgtggttacttattatctctaaaattctgtttaattagtcttctaacktacagtcttctcatttcttatttatttttcttcaagttatccattatctgtcatcttggctgtcacagaggtttcttttggtctcattctattggactgc

SEQ ID NO: 39778 - DNA, 201 bp, Homo sapiens
agaaagaaaggaaggaagaaaggaaggaaagaaggaaggaaggaaggaaagaaggaaggaaagaaggaaggaaggaaggaaggaaggaaggaaggaaggamggaacggaaggaaggaaggaaagaaaaaagaaagcaaaacaacgtgcagaacctttgaaggagcctgtgcatatgaagagccctgaagcttcattagcca

SEQ ID NO: 39779 - DNA, 201 bp, Homo sapiens
cctctcacagggggtcaggtagttttttctcttgtgtctaagcaactccagtcatgaaatgttgtccgagacaatgggttaaatacacctgttccaccgtrtattggtttattgtgatgatctcttttccattatcttgtattgcaagctcacatgtttcctgttacgttcttccaattagattgcccttctgtggttact

SEQ ID NO: 39780 - DNA, 201 bp, Homo sapiens
aggaatttgggtatagtttagggaagatacaaccatatttacaataggcagcacacttactgtttggggcaagggaggaagtgggttgaaaagcatgaacktagaaatcatatctaacctgtcatttaatagccatgtgaccctgaacaagttagtgaacagttctgggccttctttcctcttctgtaaaacagtgataat

SEQ ID NO: 39781 - DNA, 201 bp, Homo sapiens
tacatagtaatttcttagggaatagctgttggaagattagtagataaatgaaagaacaaatgaatgaatgaataaggtatgtaaaaaatgattgctttctwacctggccaaaataagggagtccctgtttgtaggacatatccatattctcaaaactaatcttcaccactgatgagtctatgtatacgtacttggagcctg

SEQ ID NO: 39782 - DNA, 201 bp, Homo sapiens
tcacttccaaaaacagacaaacagagcttctgaaaaaaaccacaaaagctcaccattccttctaatagtttcccttccctttcctaagcagttttaatatrtaggtacttcagatgtcttttataaagaaagttaatcaagatggcacaaaatgcttgtgccaactggtgttgctgctttttataaaatatccaattcact

SEQ ID NO: 39783 - DNA, 201 bp, Homo sapiens
caaaagctcaccattccttctaatagtttcccttccctttcctaagcagttttaatatgtaggtacttcagatgtcttttataaagaaagttaatcaagayggcacaaaatgcttgtgccaactggtgttgctgctttttataaaatatccaattcacttaccatttcttcatgatggattagtaaacgttgatttctcat

SEQ ID NO: 39784 - DNA, 201 bp, Homo sapiens
gcatgatggtgtgcacctttagtctcagctactcgggaggctgaagtgggatgatcacctgagcccagggaggtcaaggctgcaatgagccatgattccaycactgcgctccagcctaggatacagagtgagaccctgtctcaaaaaaaaaaaaaaaaaaaaaaaaggccatatgcagtggctcatgtctgtaatcccagc

SEQ ID NO: 39785 - DNA, 201 bp, Homo sapiens
ccaccattaagcttcagattgagagaaacaccattgagttggcaaatgctttcgatgtgtacgtgcagaaagtcatatgtatctacaattttccagacagyggcaaagagaaatggaaactctgtgctgtattttaattggctgcaaaatgtttccttcagaaattaccattccattaagcacctactctgtgcaaacgct

SEQ ID NO: 39786 - DNA, 201 bp, Homo sapiens
acagtctctgatgtttccttctgagtaattggtcattgggagctgtggttacacatagctgagtgaagcggacacttctgtgaaggcatggcttggctctwgctgggaagttttctgtttcctggcctgttcctgtctctcttctcctctccatacttgttgggaatggacctcatacctctctggaatgatgcagtgcac

SEQ ID NO: 39787 - DNA, 201 bp, Homo sapiens
aaactgataatagagactatatcttctcaacacatgagatatattcgcaaaaactcattatatatttgggcacaaaaatatactggtggaaatattgctgrccatgaagatatagaacttgaaatttaaaagaaaactctaaaataaattcctttttatatgaaaattataaagtactccagtaagtaaattttcagtgaa

SEQ ID NO: 39788 - DNA, 201 bp, Homo sapiens
ggacgcagagagcagctctcaccagacactgaacctgccagcaccttaatcttagatcttcagcctccagaactgtgatcaataaatttgtgtgtttttawaaattctaatgcaaggtttcttctataaggttattttgtctatgttgaaaatctatgttttagtttagtttacctttatcaatgatcttagctagatctg

SEQ ID NO: 39789 - DNA, 201 bp, Homo sapiens
gtaagtggacacaggaggatgcttttagttgtttttttaattgtcaaattttatatactagtcacctaaaacatgttttttgtttgtttgtttgtgtgtgkttttttttttgagatggagtctcgctctgtcacccaggctggagtgcagtggcgcgatctcaactgcaacctccacctcccgggttcacgccaatatcct

SEQ ID NO: 39790 - DNA, 201 bp, Homo sapiens
ttaatcatcaatgtgataatattaagaagtcgggcccttaggaggtgaatgagattagcgagtttatatgagggctggagggagctagctaggccttttgrcccttttgtcctttccagcgtatgaggacaaggcattcatcctctccggaggacacagcaacaaggtgccatcttggacgcagagagcagctctcaccag

SEQ ID NO: 39791 - DNA, 201 bp, Homo sapiens
ctatggtctgaatgtgccccttttaaattcatgcactgaaacttaatcatcaatgtgataatattaagaagtcgggcccttaggaggtgaatgagattagygagtttatatgagggctggagggagctagctaggccttttgacccttttgtcctttccagcgtatgaggacaaggcattcatcctctccggaggacacag

SEQ ID NO: 39792 - DNA, 201 bp, Homo sapiens
tcagccccctgactagctgggactaaaagtgtgcaccaccatacctggctaattttggcatgttctttttttgtacaaaataatcttctggatggggctcmccatgttgcccaggctggtctcaaactcctggactcaagtgatcctcccatctcagcctcccaaggtgtggggtttacaggcatgaaccactgtgcccag

SEQ ID NO: 39793 - DNA, 201 bp, Homo sapiens
ccctgagtttttgtttttgtttttaatccagcagatacattttattttgctgtacctaagagaattattattaacatttagagctaacataaaaggagaayaggaataaattctattttttggtgtattgatacacacttttaatggttggtattaagttgaaatctcagatttgatttccttttaggctcagttttattt

SEQ ID NO: 39794 - DNA, 201 bp, Homo sapiens
aaacgaggtttcaccgtgttagccaggatgatctcgatctcttgaccttgtgatccgcccgcctcggcctcccaaagtgctgggattgcaggcatgagccmctgtgcccggcctcggctgggtggttcttaaggacttgccaggattgctcatgtggttgcagtcatctgacagccccactgggccaaatagtccaagatg

SEQ ID NO: 39795 - DNA, 201 bp, Homo sapiens
ttatgtttggctcagaataaaccttaaatattttacagaatttgcttttttttgtcaacaggattgaaggcaattgtattctttgggggtccagtttctasgtagatgaaggaactacagagaacagcctcatcttgtacttttggacagaaagataactgagagataggggagcgaaggtcagagagaccttgaggatac

SEQ ID NO: 39796 - DNA, 201 bp, Homo sapiens
actgttatatttcgggggtcttgcggggtagcttttcttacacatataagcagaagaaaacattttcccaagtcttaaaagagggttatgatgcatttcaktgtgtactctttttcttcccatatactctgcaggcatttgggcagtccttctccatccaccggaaggttgctgaagatggagagactcgggaggaaacgc

SEQ ID NO: 39797 - DNA, 201 bp, Homo sapiens
tttccttgtgattgaattcaggttagacatctttgatgggactgtcatagaactgatgctgtgttctaattgcatcttatcaggtgacttatgatttctgyttgtcccattattgatgctgttactttgatcacttgattaaggtggtgtctgcctggcttctccagtgtgaaatttcttttcttctttgtaatattttgt

SEQ ID NO: 39798 - DNA, 201 bp, Homo sapiens
taagcgaattgaattatttcaagcatcagtgagagctgctagactgttatatttcgggggtcttgcggggtagcttttcttacacatataagcagaagaamacattttcccaagtcttaaaagagggttatgatgcatttcattgtgtactctttttcttcccatatactctgcaggcatttgggcagtccttctccatcc

SEQ ID NO: 39799 - DNA, 201 bp, Homo sapiens
gatagaagccatatctccttggggtttttttcccccttaaggaaatatgaggcaaggttttcagggagggaagatggactgactgtaggaagagagagaartaaataacttgctatactgtgaacatgtagtatgaccactggacagtatttacagcctattagaatttgagagattcaggactatttgttttttttaagt

SEQ ID NO: 39800 - DNA, 201 bp, Homo sapiens
tcactcccaggaccaattataatctggatttttgtcttcatccttccaggtgtctctgatcccactgtaagcaaaccctgagtcctagggcctttcttccrcttatttcactctttctgtacacattttccagtacctccaccactcaccaccctccaaaaagaactgatccctaagcttgtgcagtgattaatgattttc

SEQ ID NO: 39801 - DNA, 201 bp, Homo sapiens
agaccttgaggatacttttttttttttttttttgagacggagtcttgttctgtcaccaggctggagtgcaatggcatgatcttggctcaccgcaacctccrcttcctgggttcaagggattctcctgcctcagcctcctgagtagctgggattacaggcgcccaccagcacacccagctaatttttatatttttagtagag

SEQ ID NO: 39802 - DNA, 201 bp, Homo sapiens
ggtggggatagaagccatatctccttggggtttttttcccccttaaggaaatatgaggcaaggttttcagggagggaagatggactgactgtaggaagagagagaagtaaataacttgctatactgtgaacatgtagtatgaccactggacagtatttacagcctattagaatttgagagattcaggactatttgtttttt

SEQ ID NO: 39803 - DNA, 201 bp, Homo sapiens
aaaagtatattcatccatcaaccataaccttaaatctgaagccaggaactaaaaagaaattctcaaggtaacacaattgtcatgaagtctcactcccaggrccaattataatctggatttttgtcttcatccttccaggtgtctctgatcccactgtaagcaaaccctgagtcctagggcctttcttccgcttatttcact

SEQ ID NO: 39804 - DNA, 201 bp, Homo sapiens
attttgggttcggtttgctcttgctcttctagttctttaagatgaatgttaggttatttatttgaagtttttcttctttttgatgtaggccctcataggtrtaaatttccttcttagtactgctttcactgtatctcatagattttggtagttgtgtttccattattattgtttcaataaatttttcaatttccttcataa

SEQ ID NO: 39805 - DNA, 201 bp, Homo sapiens
aggtggggatagaagccatatctccttggggtttttttcccccttaaggaaatatgaggcaaggttttcagggagggaagatggactgactgtaggaagagagagaagtaaataacttgctatactgtgaacatgtagtatgaccactggacagtatttacagcctattagaatttgagagattcaggactatttgttttt

SEQ ID NO: 39806 - DNA, 201 bp, Homo sapiens
  misc_feature (1)...(201): n = A,T,C or G, or insertion/deletion polymorphism (see Tables 1-2)
aaatctggtgtttttccctctctgctgtagtgaagctctgctagagatttaccgaagtccttgatattttaacctagctatcaacttcagcccagagaagntcttccaaaagtagattccaaaagtatattcatccatcaaccataaccttaaatctgaagccaggaactaaaaagaaattctcaaggtaacacaattgtc

SEQ ID NO: 39807 - DNA, 201 bp, Homo sapiens
cactatttgtagggtattttaacacatcactcagcagaagaaggttaaataaattttacaaaataagtaagaatacaaaggatcaaaataatccaacctcrtggatagaaaacaaactgataatagagactatatcttctcaacacatgagatatattcgcaaaaactcattatatatttgggcacaaaaatatactggtg

SEQ ID NO: 39808 - DNA, 201 bp, Homo sapiens
ttagagagtttagttgatttacaatcagtgttattattggtaggtaagcactactcctaccattttatttgtcttctggttgttttttggtcttctcttcyttctttccttctttcctgtcttccttttagtgaagatgattttctccaatgttacgctttaatttctttttattttttgggtgtccattgtacgttggac

SEQ ID NO: 39809 - DNA, 201 bp, Homo sapiens
tgggaggcggaggttgcagtgagccaagatcatgccattgcacgccagcctgggcaacaagagtgaaactgcatctctaaataaataaataaataaataaaaataaagtgaaaattatgcagtatgggtttcactgtagttttactactcttgtatagaggaggaaaaatttctcctctaccttcttacaatctctggcta

SEQ ID NO: 39810 - DNA, 201 bp, Homo sapiens
tatcagtatcttttaaccttactatgagaatcttaaagatggaagcattagcctctgcttatgattgctgtaggcaagaatgtgcaccaaccctcccaagmgtataaagatcatcaccgtcaccgtcaccattgtaaggtcacagctcttcacagttcacttatctttttcctagttattctccctcctaatcattgccaa

SEQ ID NO: 39811 - DNA, 201 bp, Homo sapiens
agatgcaagaagaaacagagcactatttgtagggtattttaacacatcactcagcagaagaaggttaaataaattttacaaaataagtaagaatacaaagratcaaaataatccaacctcgtggatagaaaacaaactgataatagagactatatcttctcaacacatgagatatattcgcaaaaactcattatatatttg

SEQ ID NO: 39812 - DNA, 201 bp, Homo sapiens
tccaatgttacgctttaatttctttttattttttgggtgtccattgtacgttggacatgcacacaatggacacacataaaacacaacaattagtattcggyttgcaaatactatctcgtaacccattattttaaatggatgacaacactgattgcagaaataaacaagcaaaaaagaaaatgaataaaactatatacttta

SEQ ID NO: 39813 - DNA, 201 bp, Homo sapiens
ctgggaggcggaggttgcagtgagccaagatcatgccattgcacgccagcctgggcaacaagagtgaaactgcatctctaaataaataaataaataaataaaaataaagtgaaaattatgcagtatgggtttcactgtagttttactactcttgtatagaggaggaaaaatttctcctctaccttcttacaatctctggct

SEQ ID NO: 39814 - DNA, 201 bp, Homo sapiens
ttaggatattaggatattataaaatatgtaaatataaaaataaccactaaaataaaaattcaagctagcctgaatactcaaagaagctttaagcaagatarcaacaaacaaacataaaagctaaagaaataaagtagctttaaatacaatacagaatcataagaaaaatagtatgatagagctgaggcctaacacatacat

SEQ ID NO: 39815 - DNA, 201 bp, Homo sapiens
actatatactttaactttctcctccccttttaacttttgtttctttttatgtcttattgcactgtctatatcttgaaaagttgtagttattatttctgatkggttcatggtttagtctttctacttaagagtatttcacacaccaaaaattgccatgttatattcctgtttttctgtgtgccattaccagtgagttttgta

SEQ ID NO: 39816 - DNA, 201 bp, Homo sapiens
cctgggaggcggaggttgcagtgagccaagatcatgccattgcacgccagcctgggcaacaagagtgaaactgcatctctaaataaataaataaataaataaaaataaagtgaaaattatgcagtatgggtttcactgtagttttactactcttgtatagaggaggaaaaatttctcctctaccttcttacaatctctggc

SEQ ID NO: 39817 - DNA, 201 bp, Homo sapiens
acctgggaggcggaggttgcagtgagccaagatcatgccattgcacgccagcctgggcaacaagagtgaaactgcatctctaaataaataaataaataaataaaaataaagtgaaaattatgcagtatgggtttcactgtagttttactactcttgtatagaggaggaaaaatttctcctctaccttcttacaatctctgg

SEQ ID NO: 39818 - DNA, 201 bp, Homo sapiens
agaagttttcccaattactgtgtaactgtcccttcttaggttataccttcttaggttatctcaaggtctttggttggttgattggtctaaacatttgaaaytcacaggtaggttttggcaggaaactcatttacagaaagggtgagaaatgttacctcccttacagcaacacaaactgggaattttaaaagcaacaaaagc

SEQ ID NO: 39819 - DNA, 201 bp, Homo sapiens
gcttccctaggccactttggaagaagaattgtcttgggccacacataaaatacactaacactaacaatagctaatgagctttaaaaaaaattgcaaaaaawaaatctcataatgttttaatcatgcttatgaattagtgttgggcctcattcaaagccgtcttgggctgcatgctgcccatgggccgcggattggacaagc

SEQ ID NO: 39820 - DNA, 201 bp, Homo sapiens
ctaggccactttggaagaagaattgtcttgggccacacataaaatacactaacactaacaatagctaatgagctttaaaaaaaattgcaaaaaaaaaatcycataatgttttaatcatgcttatgaattagtgttgggcctcattcaaagccgtcttgggctgcatgctgcccatgggccgcggattggacaagcttgatt

SEQ ID NO: 39821 - DNA, 201 bp, Homo sapiens
caccatgcccggctaattttttgtatttttagtagagacggggtttcaccgtgttagccaggatggtctcgatctcctgacctcgtgatccgcccgcctckgcctcccaaagtgctgggattacaggcgtgagccaccgcgcccggcctaggacttctctttaatggggtgttcagataatgtttgtttattcagcaaata

SEQ ID NO: 39822 - DNA, 201 bp, Homo sapiens
gtctcaaattcctgacctcaggtgatccacctgcctcgacctcccaaagtgttgggattataggcgtgtgccaccgcacccagcctacttctttttttttwaaaaaattatttatttatttttgtgggtatagagttggtgtatatatttatggggtatatgaggtactttgatacaggcatgcaacgggtaataatcaca

SEQ ID NO: 39823 - DNA, 201 bp, Homo sapiens
gtttctgaaactggaataaatatgaatggaggatttatcaacatttggatatttgcaatttcaattcttgattcttttttgaaaatctattctgggtctayatctgaaatgtttatctcctttggtgctagatccagagtacaatttttgaaaactttaaatcaagggtggaacaataaattcacttgctcttaagacttt

SEQ ID NO: 39824 - DNA, 201 bp, Homo sapiens
accttgaaaaacattgtttcctttctattgggcctggctttgtcaggagatactcaggaggtgatggtgaaaggaggtacctggtggagccagacgagtckggtaaatcagctttaacaagcagccagatgatagatgtcagttgggtgtcatgcccaattctagttgctgacaattaggaattagattaaaataggagtg

SEQ ID NO: 39825 - DNA, 201 bp, Homo sapiens
tatgttaaacattaggtaatatcagtatcttttaaccttactatgagaatcttaaagatggaagcattagcctctgcttatgattgctgtaggcaagaatstgcaccaaccctcccaagcgtataaagatcatcaccgtcaccgtcaccattgtaaggtcacagctcttcacagttcacttatctttttcctagttattct

SEQ ID NO: 39826 - DNA, 201 bp, Homo sapiens
atttcagaggaggcagatttaaacccagatgcatttgcattaaaccccaatggatttgattccaaagcacgtcgtctttctgctaataatagccaacagtyattgagtacttactatatttataccaaggtctgttccaagtgatacatagattttctcttttaagcctcgtggcagtatgagaaagaagctattattatc

SEQ ID NO: 39827 - DNA, 201 bp, Homo sapiens
gtgggtccagttatgttaaacattaggtaatatcagtatcttttaaccttactatgagaatcttaaagatggaagcattagcctctgcttatgattgctgyaggcaagaatgtgcaccaaccctcccaagcgtataaagatcatcaccgtcaccgtcaccattgtaaggtcacagctcttcacagttcacttatctttttc

SEQ ID NO: 39828 - DNA, 201 bp, Homo sapiens
cctatgcctcttgaaatttctctgtgtttgtctttgtacatttttaatgacttaatgagaaaaaagattcatcaggactcctttcctagcaggaggtttartgtttcacaaatgagtagggagctgctctcataatgaggtaaacggccacctgattcttggataagtccaaggaaaacctttacaccagaggaagcaaca

SEQ ID NO: 39829 - DNA, 201 bp, Homo sapiens
acttcaaagaggcaagatgtggtttgcattcatttcactgctaatattgctctcaaagatcgctaaagatctcttctccccttacacattccactcatttrtaacccagatcctcagtgtggctaatggagggtccctcagccctgtaacttctgtgcatgaagcagtaggtagtgggtccagttatgttaaacattaggt

SEQ ID NO: 39830 - DNA, 201 bp, Homo sapiens
atccaggctttaagtaaatataaatctaagtaataggctattgactattatcttagaaaaacttggggtattacaccaggttatcacagaatatttagttragaagtatggaaaatatgatatgctatttatttgaatgatactcggtaggcatgtaatgtgatgattaaatcagttaagaatatgtgatagatttttttt

SEQ ID NO: 39831 - DNA, 201 bp, Homo sapiens
aacctgggaggcggaggttgcagtgagccaagatcatgccattgcacgccagcctgggcaacaagagtgaaactgcatctctaaataaataaataaataawtaaaaataaagtgaaaattatgcagtatgggtttcactgtagttttactactcttgtatagaggaggaaaaatttctcctctaccttcttacaatctctg

SEQ ID NO: 39832 - DNA, 201 bp, Homo sapiens
atattaaatagcattttatttacagaaacatacatatatggtaaactataaagaaaatggtgatacaaaatgcaggatagtgtttacttggggagtggccraaggtacaatgagagagataggaccaaggaggacagacagaggcctttgaggctagtgggtcttggtcccgttcttaaactataggaattcattttaatg

SEQ ID NO: 39833 - DNA, 201 bp, Homo sapiens
gcttgcagtgagccgagattgcgccactgcacgccagcctgggcgacagagcgagaccctgtctcaaagaaataaaataaataaataaataaataaataawttgcagcccattgagtgaactttaaatgatcatgctactttgtgaaatagaatatcacattactagatctgttgtgtgctggacaaatgccagcacaatg

SEQ ID NO: 39834 - DNA, 201 bp, Homo sapiens
agctgcagctacattaatcagaatgaataaacggaatttaaagttgagttccaaaagcaaattgcaaaagagtgcatatggaaggatttcatcatatgaaktttacaaacagtattttactacaatattaaatagcattttatttacagaaacatacatatatggtaaactataaagaaaatggtgatacaaaatgcagga

SEQ ID NO: 39835 - DNA, 201 bp, Homo sapiens
ggatcacgaggtcaggagatcgagaccatcctggctaacacagtgaaaccctgtctctactaaaaatacaaagaaaaattagccgggcgtgttggcgggcrcctgtagtcccagctactcaggaggctgaggcaggagaatggcatgaacccggagggcggagcttgcagtgagccgagattgcgccactgcacgccagcc

SEQ ID NO: 39836 - DNA, 201 bp, Homo sapiens
agccatgttgttggatatgtcagtagtttactcctttttattgccgattagtattccattgtatggatatgccacaacttggttttttattcaccaattgwtggatatttgaaatgtttgcattttggctgctatgaacatttgtgtgtaaatctttatgtgatcacgtgctttcatttgtcttggataaataaataccta

SEQ ID NO: 39837 - DNA, 201 bp, Homo sapiens
cccagcactttcggaggccgcggccggcggatcacgaggtcaggagatcgagaccatcctggctaacacagtgaaaccctgtctctactaaaaatacaaaraaaaattagccgggcgtgttggcgggcacctgtagtcccagctactcaggaggctgaggcaggagaatggcatgaacccggagggcggagcttgcagtga

SEQ ID NO: 39838 - DNA, 201 bp, Homo sapiens
atctgcaaaacttattccaaaacaaatcagtaaatccaggttaaaatacccaggtcagacagtcacatttttactaataaaaaataactagcagcccgggygaggtggctcatgcctgtaatcccagcactttcggaggccgcggccggcggatcacgaggtcaggagatcgagaccatcctggctaacacagtgaaaccc

SEQ ID NO: 39839 - DNA, 201 bp, Homo sapiens
agtgagcatagtaagcaataggtaaaaaaatgacctcttattcaagagggtacctcattactatttacaaagtgctttcaaacattctttctcatttttttctgacaactctggacgtccccccctacttttagaagaaaactaacagtcccaaaaatgttttggtgtaagtcaatatatgaacccaggtccatgtccaga

SEQ ID NO: 39840 - DNA, 201 bp, Homo sapiens
ctgcctcagcctcccgagtagctgggactacaggcgcccgccaccacgcccagctaattttttgtatttttagtagagacggggtttcgctgtgttagccrggatggtcttgatctcctgacctcgtgatccgcccgcctctgcctcccaaagtgctgggattacaggcgtgagccaccgcgcctggccctggtgccttag

SEQ ID NO: 39841 - DNA, 201 bp, Homo sapiens
gtttgtctcttccagaattgaaactgtaaaactacaaatggttcttcaaatggagccccagatgcagtccatgactaagatccaccgcagacccctggacyggcctgctagcccatgctccaatgttaatgacatggaaggcacccttccggaggaaatctcaactacacaacacctactatgccccaattcagcaggaag

SEQ ID NO: 39842 - DNA, 201 bp, Homo sapiens
cattgttcctgcacggctaagtgcctgggttcgtcctaatcgagctgaacactagtcactgggttccacggttctcttccatgacccacagcttctaatarctcatcgcatggcccaagattccattccttggaatccgtgaggccaagaaccccaggtcagagaacacgaggcttgccaccatcttggaagccgcccacc

SEQ ID NO: 39843 - DNA, 201 bp, Homo sapiens
gtggcacgtgacccacaagacaagttgcttcccactcttccctcccctttccacgggcagaagatcctctccctgtggctgccatcaccactggcttatgkgggggttctgccaggccatcactgatacttaaagcctaagggctcttccgtcagcttgtgaccaatgctgccagctctgggactcaccttttggctcagg

SEQ ID NO: 39844 - DNA, 201 bp, Homo sapiens
ctggagctgagctttcgcttgccgtccaccactgctgtttgccactgtcgcagacccgccgctgattcccatcgccgctgactcccatccctccagatccrgcagggtgtccgctgtgctcctgatccagcgagactcccattgccactcccgattgtgctaaaagcttgccattgttcctgcacggctaagtgcctgggt

SEQ ID NO: 39845 - DNA, 201 bp, Homo sapiens
tccacgggcagaagatcctctccctgtggctgccatcaccactggcttatgggggggttctgccaggccatcactgatacttaaagcctaagggctcttcmgtcagcttgtgaccaatgctgccagctctgggactcaccttttggctcagggcaggtccagaaatgctgaccaagagcctaggcctggactcagtgacct

SEQ ID NO: 39846 - DNA, 201 bp, Homo sapiens
gaaatacatcattggataagcaacttcattcaaaagtcagtgccacagcaagcaagaaattagaagcttgtaaaaataagatggaattttgagctgggcayggtcgctcatgcctgtaatcttagcgctttgggaggccaaggcaggtggatcacttgaggtcaggaattcaagaccagcttagccaacatggcgaaaccc

SEQ ID NO: 39847 - DNA, 201 bp, Homo sapiens
gtgacagggcagcactgagttaagttaaagtgccccagtcactgcattctccctctactaaatgcacagatttctccccaccacgcagccactgctggggrtgggggaggcatggcagaagcactcccttagtcaccctggctggtgtcttagtaggctgtgtgcctcctactctagtccactggctctgggcccagctta

SEQ ID NO: 39848 - DNA, 201 bp, Homo sapiens
ctaaatgcacagatttctccccaccacgcagccactgctgggggtgggggaggcatggcagaagcactcccttagtcaccctggctggtgtcttagtaggytgtgtgcctcctactctagtccactggctctgggcccagcttagcactagggcttgcctaggaattgcagtccttgtggcctaacctgcccctcaagacc

SEQ ID NO: 39849 - DNA, 201 bp, Homo sapiens
tatataattagttactataatttttttctcaaaatatctcagatttggccattggaagccccttcagacaggctcctgtctccttttgacatatcctcatyatcttttaaatgcatgttgtaactctggcatcacaagatgtgtctggcttattttgctccagccctagaatcagtaacttctccaaagaccctagttctt

SEQ ID NO: 39850 - DNA, 201 bp, Homo sapiens
cagaaggaaggtaccaccttggaagcagagagcagccctcgccagacaccaactctgctggcaccttgatcttgtacttcccagcctctagaactgagcaraaatacatttctgctctttaattacccagtctcatgcattttcttatagacgtctgaatggactaagatcgatggacatatagaccaatggaatagattt

SEQ ID NO: 39851 - DNA, 201 bp, Homo sapiens
tgactcttgtgcagtaaaaaaaatccacatttaacttttgactccgccaaaacttgatcaacaatagcatgctgttcagtggaagccttaacagtaacatwaaacagttgataaacacatattttgtatgttacatgtattatatgctgtattcttagaataagcttgagaaaaggaaattttattaagaaaatcataagg

SEQ ID NO: 39852 - DNA, 201 bp, Homo sapiens
ggccttttttttttttttttttttttttcgcttctgctcttccaccatggaagacacagaaggaaggtaccaccttggaagcagagagcagccctcgccaracaccaactctgctggcaccttgatcttgtacttcccagcctctagaactgagcagaaatacatttctgctctttaattacccagtctcatgcattttct

SEQ ID NO: 39853 - DNA, 201 bp, Homo sapiens
ataaacacatattttgtatgttacatgtattatatgctgtattcttagaataagcttgagaaaaggaaattttattaagaaaatcataagggattgggtgyggcggatcacaaggtcaggagttcgagaccagcctggccaacatggtgaaaccctgtctctactaaaaatacaaaattagcctggcatggtggtgggacc

SEQ ID NO: 39854 - DNA, 201 bp, Homo sapiens
ttgagaaaaggaaattttattaagaaaatcataagggattgggtgcggcggatcacaaggtcaggagttcgagaccagcctggccaacatggtgaaacccygtctctactaaaaatacaaaattagcctggcatggtggtgggaccctgtaatccctgctgctcgggaggctgagacaggagaatcacttgaacccaggag

SEQ ID NO: 39855 - DNA, 201 bp, Homo sapiens
ccttgcaaaatcacaaaagaaaaaaattgaggtttcacgaggtaacctttcactccagtaataaaatgacagcatcttatgaacaagcttctcaggaaacscgacagaagaaacatgtaacacagaactcacgtccactaaaaacaaaaacagcttttttgccaaataaagatgtgtataagaagcatagttctttgggac

SEQ ID NO: 39856 - DNA, 201 bp, Homo sapiens
tgtatttggttggtggctttagtaataagagactagcttttaacacagccagaagaagctgatgtgaaccagcagaaataacactgatcatatataatacktatggaacagtggttgcccaccatttttgaacccaagatttcctgacatttatcactgtgccaacaaaaagaaaaactaggaacctggggaggacttaga

SEQ ID NO: 39857 - DNA, 201 bp, Homo sapiens
actttccgtatgctgatttttaaagtgtctgtatttggttggtggctttagtaataagagactagcttttaacacagccagaagaagctgatgtgaaccascagaaataacactgatcatatataatacttatggaacagtggttgcccaccatttttgaacccaagatttcctgacatttatcactgtgccaacaaaaag

SEQ ID NO: 39858 - DNA, 201 bp, Homo sapiens
agtggtgctacttagaagctgagaggttatgaaccttatatgcaaccatagggaatagtgttgttactataaataatgattgtactgaaccttatatgcartagtgaataatgttattataaataatgattgtactgaaccttatatgcaacatagggaataatgttattataaataatgattttcagactgaggcagttt

SEQ ID NO: 39859 - DNA, 201 bp, Homo sapiens
gcagtattcctaggaatgcaacttttaatttacttgatggctaccttgtatttaatttaggaaagagatccttacccggatgcatttgggaaggtagtttwggaccgtggccttgagtgtgaaggcctctccacgaatcacagagtaaggcattgtgagctccacaaagaagggctggaaggctcggagagaggcagtgga

SEQ ID NO: 39860 - DNA, 201 bp, Homo sapiens
tatgagtgagaatacaacttattaatagcttttgtaaacttctggcaaaaaaagatattgaagataattagagttgaaaaattatataggacatcacttasgattgggattcaatcacattttatagaaaattcaaataagagttgcttaagcatgaaagaagttcagaggtaagtagctcagggcttgtatggcaactcc

SEQ ID NO: 39861 - DNA, 201 bp, Homo sapiens
cagaaaataagttatgagtgagaatacaacttattaatagcttttgtaaacttctggcaaaaaaagatattgaagataattagagttgaaaaattatatargacatcacttaggattgggattcaatcacattttatagaaaattcaaataagagttgcttaagcatgaaagaagttcagaggtaagtagctcagggcttg

SEQ ID NO: 39862 - DNA, 201 bp, Homo sapiens
cactttgggaggccaaggcgggtggatcacttgaggtcaggagttcgagaccagcctggccaacatggtgaaaccctgtctctaccaaaaatataaaaaawtagccaggcgtggtggtgcatgcctataatcccagctactcgggaggctgaggcagaagaatcacttgaacccaggagatggaggttgcagtgagccaag

SEQ ID NO: 39863 - DNA, 201 bp, Homo sapiens
attagagattatctggtccagtgattctcaaccagggagacatttggttatttccggagatatttttggtcacaactgaggtgggtgctactggcttctakggatggaggtcaggaaagctgccaagaacccgacagtgtacaggacagcccccacaccagcatgtcactactgccgaggacgagaagccctgatctagcc

SEQ ID NO: 39864 - DNA, 201 bp, Homo sapiens
cccttgagcccaagagttcgcggttacagtgagctataattgtgccactgcattcagcctaggtgacacagcgagatcctatttaaaaaaaaaaaaaaaaagacaaaaagaaaagaaaattacagtataatttttctgtgttgaagagcttctgctggacaaattttcagtcttggtcggcagtttaactcaagaacagac

SEQ ID NO: 39865 - DNA, 201 bp, Homo sapiens
ggagatggaatgccagatgtaactctttctgacctgtaatcccagcttgcaaactaaataacatcagtggtactcagctttccttgtgtgtctacaccatycatatactcgcatcagcaatgtgtagcaattttgtgctggggtgtattagagaatagtatactttttgttctctttgagtattcatggactggactttct

SEQ ID NO: 39866 - DNA, 201 bp, Homo sapiens
acggattgtagagttcttgggctggcataattttatgtgaccaaaatttggcaaagggtcttatcagtttgaggagagattagtggagcattgaatttcasagtttgaaatgacattagagattatctggtccagtgattctcaaccagggagacatttggttatttccggagatatttttggtcacaactgaggtgggtg

SEQ ID NO: 39867 - DNA, 201 bp, Homo sapiens
tcccttgagcccaagagttcgcggttacagtgagctataattgtgccactgcattcagcctaggtgacacagcgagatcctatttaaaaaaaaaaaaaaaaagacaaaaagaaaagaaaattacagtataatttttctgtgttgaagagcttctgctggacaaattttcagtcttggtcggcagtttaactcaagaacaga

SEQ ID NO: 39868 - DNA, 201 bp, Homo sapiens
agcaggtgaagtcttttttacacaatgccactgtacggattgtagagttcttgggctggcataattttatgtgaccaaaatttggcaaagggtcttatcaktttgaggagagattagtggagcattgaatttcagagtttgaaatgacattagagattatctggtccagtgattctcaaccagggagacatttggttattt

SEQ ID NO: 39869 - DNA, 201 bp, Homo sapiens
gatcccttgaggccaagattttaagatcagcctgggaaacatagtgagaccccgtttctacagaaaaaaaaaaaaaaaagtaaaaattaggcacagtgtcrcatgcctctagtctcagctacttgggaagctgaggcaggatgatcaatcccttgagcccaagagttcgcggttacagtgagctataattgtgccactgca

SEQ ID NO: 39870 - DNA, 201 bp, Homo sapiens
aagtaaacaaagaaaagccatgccaaaataatttaacatgagtgaaatattctcaagcatgtatttgaggtatttaaaaggcaccatgagtcagaaattcwattaagaaaatacagaaatggacaaaacccaagaagaaataaaatgaggctttattgaactcaggaaaactagacaaaattatatcataaataaactcta

SEQ ID NO: 39871 - DNA, 201 bp, Homo sapiens
gccatggtggtttgctgcatccatcaacccgtcatctacattaggtatttcttctaatgctatccctcccctagcccccaaccccctaacaggccccggtrtgtgatgttcccctccctgtgtccatgtgttctcattgtacaactcccatatatgagtgagaacatgcggtgtttggttttccgttcctgtgttagtttg

SEQ ID NO: 39872 - DNA, 201 bp, Homo sapiens
ctttgggaggctgaggcgggaggatcccttgaggccaagattttaagatcagcctgggaaacatagtgagaccccgtttctacagaaaaaaaaaaaaaaaagtaaaaattaggcacagtgtcgcatgcctctagtctcagctacttgggaagctgaggcaggatgatcaatcccttgagcccaagagttcgcggttacagt

SEQ ID NO: 39873 - DNA, 201 bp, Homo sapiens
ttatttcagtgttatctttctgagaagaaaaaccaaagaagattattttatgctcctggacttttccttaacctcacagttcacaacattggccctctttstgtatacaaagccaatcacttcactgcaacagaccacagctgagcaaacaaatacagacgttgatagatgaaccactgacaacaactcctaacaaaaaca

SEQ ID NO: 39874 - DNA, 201 bp, Homo sapiens
acaaccatcttgaaaaactgtttggccttatctagtaaagctaaagatgtatagatcctaagatctagcaattccagttggaggtatgaaccctagaaagscttgcacttttgagtcagaagatgtagacaacaaaactcacagcagcactgtttgtaacagagaaaactaaaaacaacggaaattactatccacagtaaa

SEQ ID NO: 39875 - DNA, 201 bp, Homo sapiens
gtatatttcccctaaggtcattttatttcagtgttatctttctgagaagaaaaaccaaagaagattattttatgctcctggacttttccttaacctcacakttcacaacattggccctctttgtgtatacaaagccaatcacttcactgcaacagaccacagctgagcaaacaaatacagacgttgatagatgaaccactg

SEQ ID NO: 39876 - DNA, 201 bp, Homo sapiens
ccggggaggcggaggttgcagtgagcagagatggcaccactgcactccagcctggtgacagagggagactccgtctcaaaaaaaaaaaaaaaaaaaaaaaatctttttaaagcatcactaggatcagaaatgcaaatttttcagaaatttcaaaaatgtggagaaaaggttggacattttgttagggaagtaaaagcatat

SEQ ID NO: 39877 - DNA, 201 bp, Homo sapiens
accggggaggcggaggttgcagtgagcagagatggcaccactgcactccagcctggtgacagagggagactccgtctcaaaaaaaaaaaaaaaaaaaaaaaatctttttaaagcatcactaggatcagaaatgcaaatttttcagaaatttcaaaaatgtggagaaaaggttggacattttgttagggaagtaaaagcata

SEQ ID NO: 39878 - DNA, 201 bp, Homo sapiens
gggaggctgaggcagaagaattgcctgaaccggggaggcggaggttgcagtgagcagagatggcaccactgcactccagcctggtgacagagggagactcygtctcaaaaaaaaaaaaaaaaaaaaaaaatctttttaaagcatcactaggatcagaaatgcaaatttttcagaaatttcaaaaatgtggagaaaaggttg

SEQ ID NO: 39879 - DNA, 201 bp, Homo sapiens
tttgcccacagctgccctttcccccaggtgctctgtcccagggagatgggagtttaaacccctgactggggctgctgcctttctttcagagatgctttgtmcagataggagaaatctagagaggcagtctggctgctgggagtgtcttttagcatgctaattagcatacataattataattagctataattagcagtgagg

SEQ ID NO: 39880 - DNA, 201 bp, Homo sapiens
cagacacaaataagcacttaatttctttttaatgatataaaatcttttctggctgggtgtagtggctcacgcctgtaataccagcactttgagaggccaasgcgggcggatcacaagttcaagagatcaagaccatcctggctaacatggtgaaaccccgtctctgctaaaaatacaaaaattagctgggcatggtggcag

SEQ ID NO: 39881 - DNA, 201 bp, Homo sapiens
cagaggtctcttttgttgccatcttggttttggtgggttttggcctgcttcttaccatgttttatcagcaaggtctttgtgacctgcatcttgttgaaacragtcctgccaaattcctatcaggtttactgtagttaatgaggccaaaaaaaaaaaaggacattttcaaggagaaacagaaacattattagaaaagattct

SEQ ID NO: 39882 - DNA, 201 bp, Homo sapiens
agcaggataccctgcccaatgtccctggaatgtacacgttggaggcctcaggccagggctgtgtctatgtgcaggtaagtagagatccatgagaatgagcrgacattgggaaggagagtcggagagcatcttccccttaggccttctctctctctttctttctcacttgtaagaaaagtagtttgaactgtacaatcttta

SEQ ID NO: 39883 - DNA, 201 bp, Homo sapiens
aattggataaggcttattttcattcgtggcatatagataaccaattgacctagcttcatgtattgaaaagaacttttttcctaactttgtcataaaacaartgtctatatataaaagtgtgtgtatgtcttcgctattcatgcttgttttgcatttccatggaaagtttataatcaagcttgttaccccaaaaaatcaaaa

SEQ ID NO: 39884 - DNA, 201 bp, Homo sapiens
tcactccagtaataaaatgacagcatcttatgaacaagcttctcaggaaacccgacagaagaaacatgtaacacagaactcacgtccactaaaaacaaaarcagcttttttgccaaataaagatgtgtataagaagcatagttctttgggacagtcattatcaccagaaaagataaaattgaaactcaaatcagttagctt

SEQ ID NO: 39885 - DNA, 201 bp, Homo sapiens
tcaatattctgagatagcaaagcaatgatgcatttatgatagactggatgataggatttgtttttgctgaacttattcatacatatttgtgttttgcttaractttaaaattgtttctttttctatgagcacatagcaataactgggaagtggctgagaatcattcttttttttttaatttttgagacggagtcttgcact

SEQ ID NO: 39886 - DNA, 201 bp, Homo sapiens
aactttgtttcctagattttaaatttttccaccataacacgtattgcctttataataacataattcacttgttttaagtcgattcaggaagcttctgattmtatattataaattctaaatgttcccttctattttccagagtcaagtttagattatctagatcatgaaataatcagatattttcagctattacctaactca

SEQ ID NO: 39887 - DNA, 201 bp, Homo sapiens
tttgcattggttatccttgggtaatgggttttaactttgtttcctagattttaaatttttccaccataacacgtattgcctttataataacataattcacktgttttaagtcgattcaggaagcttctgattctatattataaattctaaatgttcccttctattttccagagtcaagtttagattatctagatcatgaaa

SEQ ID NO: 39888 - DNA, 201 bp, Homo sapiens
gttcttcaagggcctctaaggacaaaagtgaatccactaacactctaggaagcagtgtgactactggaagaaagacattcaagaggtaaaatggattttakaaggtcacaggagccaattgtcagtgtttgtactcttcatcaaaattatttttaatgagctccctgacaactgcgcatcctgacagcacgggtgaagtgg

SEQ ID NO: 39889 - DNA, 201 bp, Homo sapiens
aaagagaaagattgttcttcaagggcctctaaggacaaaagtgaatccactaacactctaggaagcagtgtgactactggaagaaagacattcaagaggtraaatggattttagaaggtcacaggagccaattgtcagtgtttgtactcttcatcaaaattatttttaatgagctccctgacaactgcgcatcctgacagc

SEQ ID NO: 39890 - DNA, 201 bp, Homo sapiens
actaaagaaagtttactaccacgcaatcctatctttgtctctttctcttttttattggcgtcaaactactcagtattttagactgcaaaatttccactgcrtggaggaaagtaaatggattgggattatttcctgcaggtaaatgaaactttatggtatttgttatggaggcaagtagggtacttagagaaagccaaatat

SEQ ID NO: 39891 - DNA, 201 bp, Homo sapiens
ataatcactgcccatatcccacctgccgtattcactgccgaatcccacctgccataatcactgccatattccacatgtcatattcactgccatatcccacytgccatattcactgccgtatcccacctgccataatcactgcccatattcccacctgccatattcactggcagatcccacctgccataatcactgccgtat

SEQ ID NO: 39892 - DNA, 201 bp, Homo sapiens
attcactgccaaatcccacctgccataatcactgccgtatcccacctgtcataatcactgccgtatcccacctgccataatcactgccgtatcccacctgycataatcactgccgtatcccacctgtcataatcactgctgtatcccacctgtcataatcactgccgtatcccacctgtcataatcactgccgtatcccac

SEQ ID NO: 39893 - DNA, 201 bp, Homo sapiens
ggactggaaccacacctgtcatattcatgctgtatctcacctgtcatattcactgccaaatcccacctgccataatcactgccgtatcccacctgtcatawtcactgccgtatcccacctgccataatcactgccgtatcccacctgccataatcactgccgtatcccacctgtcataatcactgctgtatcccacctgtc

SEQ ID NO: 39894 - DNA, 201 bp, Homo sapiens
cctgcttcttagcaattttgataaatctttgtatttcagcaaatacttgaaaaaaatgtaggatccactggcttatatcttctgtgtaggcatcaaaacasatggtggtggggttgttgggaagatggtagcagacagggttgcttaaaaatataagacttccttgatgtccaagaatactgagatttatatgattagaaa

SEQ ID NO: 39895 - DNA, 201 bp, Homo sapiens
acaagctcttgtggactggaaccacacctgtcatattcatgctgtatctcacctgtcatattcactgccaaatcccacctgccataatcactgccgtatcycacctgtcataatcactgccgtatcccacctgccataatcactgccgtatcccacctgccataatcactgccgtatcccacctgtcataatcactgctgt

SEQ ID NO: 39896 - DNA, 201 bp, Homo sapiens
gcagaggtcaatattaagcttccaattaatgcttattcatcacaaatagtaagtaaataatgacagaaataattccttagtcactctctagcacacttctkttttatttttaacatttttcactatgtgagatttcctagatttgttttattttctgtttccctctaactgcaatacaagctcttgtggactggaaccaca

SEQ ID NO: 39897 - DNA, 201 bp, Homo sapiens
agccatttggattcctttttctttgaattgctgcttgttaatatattggcccttttttctgttacattattaataatgccaggaattatgctagttgctaygcaagatgcagacttgaggaaaacctggtcccagctttcaaaatgcttactttccaaatctgactcatcgtttgactttaatgccccactggacttctct

SEQ ID NO: 39898 - DNA, 201 bp, Homo sapiens
tatggaaggcagaggattctcccacctcagcctcctgagtagctgggactacaggtgcacaccaccgcacccaggtaatttttgcattttttgtagagacygggttttgccatgttgcccaggctggtcttgaactcctgggctcaagcagtcggcccgccttggcctcccaaagtgttgggattacaggtgtgagtcatc

SEQ ID NO: 39899 - DNA, 201 bp, Homo sapiens
ttgcttgaacctgggaggtggaggttgcagtgagccgagatcgcaccactgcactccagcctgagtgacagagcgagactccatcaaacaaacaaacaaamaaaaaaaacaaaaacccaagaagacctctgtctcctagagcagtcacctagaatcctagagaaaaatgtctttccaaaaggaagaaatgcagaactgtgt

SEQ ID NO: 39900 - DNA, 201 bp, Homo sapiens
acacctgtaatctagaactttgggagactgaggtgggtggatcccttgagttcaggagtttgagaccagcctgggcaacacagcaaaaccttgtttctacmaaaaatacaaaaattagcccggtatggtggtgtgtgcctgtagtcccagctactagggaggctgaggtgggaggatcacttgagtcatggtaacagactc

SEQ ID NO: 39901 - DNA, 201 bp, Homo sapiens
tgcttgggaggctgaggcgggaggatcacttgtgactgggagtttgagaacagcctggggaacatagtgagaacccatcaggaaaaaaaaaaaaaaaaaaaagttgattaaaaaaagaaaaacaaaagaggccaggcacggtggctcacacttgtaatcccagcattttgggtggccaaggtgggaggatcgcttgaggcc

SEQ ID NO: 39902 - DNA, 201 bp, Homo sapiens
atcacaaggtgatgggtgcaagggctttgggtgctatctactggatacaaatgcaggggcttaggatactatcacccgagcgaattcctgggaactgcggrcataacttgccacaggaccttatcagttaattgcactctgatgtgctgggagtcagcttgcacaagttaagtccttgaggaattgggtgggcaaggagct

SEQ ID NO: 39903 - DNA, 201 bp, Homo sapiens
ttgcatacaacctgcagacttctgcattgaagccctggtgataatgccatgcctcctctgtagaattgtgaggaccaaatgggatggtaaatatgaaactrtgtataagtcataacattttataaattattattgtcctggaaactgccatcaggtttcgagatgccaagaaggtccccactatccctgtgtataaacggt

SEQ ID NO: 39904 - DNA, 201 bp, Homo sapiens
aggcatgaccttattcatcataacacttttgctgctaaaacaagcttcagacacattcagtacattttgttttgatccaatatttatttgatccagaggcytttccttttgaagggcgttttggaaacagccttatctgtaatcatgtgtactaattgaataacgtttacactttccagtgcaaatttgcttaattttcaa

SEQ ID NO: 39905 - DNA, 201 bp, Homo sapiens
caattcttctgcctcagcctcctgagtagctgggactacaagcacactaccacgcctggcttatttttgtatttttagtagagactggatttctctcactrtgttggccaggctggtctcaaactcctgaactcaggtgatccacctgcctcggcctcccaaaatgctgggattacaagcatgagccaccgtgtccacccg

SEQ ID NO: 39906 - DNA, 201 bp, Homo sapiens
gttttttccttgaccttgaaaatttagcttgggctttctttgtacaaacatgaagatcctaggagaagcccaatcaattttagagagacaagtggatgaaratagggattaaaagaattgtgcttgactgagcagagagactgatgatctgaaaggacaccaggtaaaatgtttctttttagctttacaaatgcactgctt

SEQ ID NO: 39907 - DNA, 201 bp, Homo sapiens
atatggagcacgaatttccacgtcagcatgtcatcctttcacaggaggcatgctaatcttcttcgtaacatccaattttaatatatatgctaggccgggcrcggtggctcacacctgtaatcccagcactttggaaggccaaggcaggcagatcacaaggtcaggagatcgagaccatcttggctaacacggtgaaacccc

SEQ ID NO: 39908 - DNA, 201 bp, Homo sapiens
attttatatcctaacaatttttatttactctggcaataaagagatagaacacccaccaacaaagtccctaaaatacgtaattgataaagcattggttatcygctaggttttaaacataatttctaagaatataaaaatttaatcaccaccatctttataattgttttaaaattacctctaatttcttcgcacaaggtccac

SEQ ID NO: 39909 - DNA, 201 bp, Homo sapiens
gggatccagaaatgagactgaggtggcctcagagagcggctccctcctgaaggggatgctgctgctgtcatcctgcccggcaccttggactgcagtgggcrgggcctggggtggggatgagggtgcactgaccagcaccgcagcagcttggggaggttggggtgctgttaacatgccatcgtataggtcggaagtggaaat

SEQ ID NO: 39910 - DNA, 201 bp, Homo sapiens
gttgaattgctgggtaatatatatgtgcttttaagtttttgacagataccactaaattgccattcgaaaaaatgcagtaacaatttacaccccatgaggtrtttttattattatttttaactaccaggactttacaccttgtaaaatctacaataagagagttatacattgactgtttactctgttgtttcagaacaatga

SEQ ID NO: 39911 - DNA, 201 bp, Homo sapiens
aaaaaatgcagtaacaatttacaccccatgaggtatttttattattatttttaactaccaggactttacaccttgtaaaatctacaataagagagttatayattgactgtttactctgttgtttcagaacaatgagatggtggagctacagagaatacggatgaaggatgaaatccgagaatataagttccgggaggcacg

SEQ ID NO: 39912 - DNA, 201 bp, Homo sapiens
gttagggtaaagagatgaagaggaaatgacaagaatttcttggaaagcaacttagagacccatctggggcttcagtgttactaattctgaaagaaagcaarcgaaaaagtggaagactgcagcagatctaaagaactaacaggacagaatactccacccattcaggtagaaaaagacaaaacaagaccccattattcagaa

SEQ ID NO: 39913 - DNA, 201 bp, Homo sapiens
ctcactgtttcacagtggacagggtctatgcaaacctgcggccaaggaagctgagaggtggaagaaagaggctgacacatccagtttcttaggaagaaacrtttactagggacttagaacagaagccatgtctgtatctcaggaagcagtgagacaagatggtggatccccgcaccattacccctcaaacccagggcttat

SEQ ID NO: 39914 - DNA, 201 bp, Homo sapiens
agctaaagcattcccctgttgtgccattttcttccctttctctcatgcattatttttcttactgtggttattcttgatgggaatttttagcagagctcagygccatcttatcccaggaagaaaaaaaaattgtaggagataaatgtatgatgaatggtgcaaaacacaacagttgcaatcttttaaatttattgtgaaatt

SEQ ID NO: 39915 - DNA, 201 bp, Homo sapiens
gatgggaatttttagcagagctcagtgccatcttatcccaggaagaaaaaaaaattgtaggagataaatgtatgatgaatggtgcaaaacacaacagttgmaatcttttaaatttattgtgaaattaaagaacatgcccctagaatataatcgctggcaattcaaaaagcaaggatttttagcaaaataaataagaccagt

SEQ ID NO: 39916 - DNA, 201 bp, Homo sapiens
ctaatttttaaatttattgtagagacaacacttcactatattggctggcctggtctcaaattccttgcctcaagcgatcttctgcctttacatcccaaagkgctggaattacaggcatgaaccttcacctttcttttagaaagagcgtgaatctctaattcaccagagtccccaccattccatctcatctgagttatctca

SEQ ID NO: 39917 - DNA, 201 bp, Homo sapiens
atctcagcctcctgagtacctgggactacaggtgtgcatcaccacacctggctaatttttaaatttattgtagagacaacacttcactatattggctggcstggtctcaaattccttgcctcaagcgatcttctgcctttacatcccaaagtgctggaattacaggcatgaaccttcacctttcttttagaaagagcgtga

SEQ ID NO: 39918 - DNA, 201 bp, Homo sapiens
tgtcatagttttctatttattttatagtcctactactgactgataatgttgagatctgattcaatttctgcctctaaccatctgtattgtaaaatcccgayggacaactaaaaaactgttaacaacagagcagcatttaaaacttcagaatctgaattttaaaatcctggctactcaactgatactaaaaatcaaaatatg

SEQ ID NO: 39919 - DNA, 201 bp, Homo sapiens
tcctaatcatactaccagcgttaagttgacagttatttatcaggcatatttagcagccagccttacagttttctcttgcacactgttaacaattactgtcrcatggtcactgttacatgttagccaatagtgcctcacattcactgtggcttccaaagcttgggcttggggaagcaggtggatggtgatatcatgagctca

SEQ ID NO: 39920 - DNA, 201 bp, Homo sapiens
aatctccaatgttggaggtggggcctggtgggaggcgactggatcatgagggtggtccttgatgaatggtttagagccatcccctcggtactgttcctccygatagtgagttatcgcaagatctggttgtttagaagtgtgtagcagctctccgcccctcttcctcctgcttctaatcatgtgagacgtcttgctcccact

SEQ ID NO: 39921 - DNA, 201 bp, Homo sapiens
gcacaggcagatggaagcccccaccccagctgcgtggcctgaagccagcctcccgctccccgaaggtggtctccacacagaactgggacagttccatcccygccccttcctccagggcagcagggctgaggatcccattctggctgtgtccacgtccgggccatggctggagtctgggtttaggggaggaaggcatggcgg

SEQ ID NO: 39922 - DNA, 201 bp, Homo sapiens
gtctcaaactcctaacctcaggtgatccacccacctcggcctcccaaagtgctgggattacaggcatgagccaccatgcccagccttttaaatttattttwaaaataaacgtatttcttacagttctggaggtttgaaagtccacagctgttgggctgcatctggtgagggccttcttaccgcagcataacatgacagaga

SEQ ID NO: 39923 - DNA, 201 bp, Homo sapiens
gtgccaccccgcctggctgatttttgtatttttagtagagatggggcttcaccatgttggccaggctggtctcaaactcctaacctcaggtgatccacccrcctcggcctcccaaagtgctgggattacaggcatgagccaccatgcccagccttttaaatttattttaaaaataaacgtatttcttacagttctggaggt

SEQ ID NO: 39924 - DNA, 201 bp, Homo sapiens
tcctttcagtctttctttttcccctaaataagcaaaaacgtgtcttcatttttccctttcctgttttatttacacagaaggcatcttagtcagttgtctgrccatcgctcctctagtgggctgcgtggttctctgttggacagatgtagggagcttatccaaccagtaccctctggataggcaggcgcatgattacaggga

SEQ ID NO: 39925 - DNA, 201 bp, Homo sapiens
atagggaatccgttttactagcttatcctttcagtctttctttttcccctaaataagcaaaaacgtgtcttcatttttccctttcctgttttatttacacrgaaggcatcttagtcagttgtctgaccatcgctcctctagtgggctgcgtggttctctgttggacagatgtagggagcttatccaaccagtaccctctgg

SEQ ID NO: 39926 - DNA, 201 bp, Homo sapiens
ctctcatccctttccagcccattccccacccccatagggaatccgttttactagcttatcctttcagtctttctttttcccctaaataagcaaaaacgtgycttcatttttccctttcctgttttatttacacagaaggcatcttagtcagttgtctgaccatcgctcctctagtgggctgcgtggttctctgttggacag

SEQ ID NO: 39927 - DNA, 201 bp, Homo sapiens; identical to SEQ ID NO: 11271

SEQ ID NO: 39928 - DNA, 201 bp, Homo sapiens
gcagcctcagtgagagcaccctgaagtttttgctcctgaatccagctgtgcactttgcccaagtggtgaaggaatgccgggcagtggtcattgcggggggkaccatgcagccggtaaggacacctttcccagcccctcgtgccccaggtgttgggatgagatggggacttgggagagatgcattatcagtcctgttctctc

SEQ ID NO: 39929 - DNA, 201 bp, Homo sapiens
tggttaagacaggaaggaaagagataatatctaagtagagtcatatgtcgggtcaatagatcttaaaatacagatagaagacagtaacacattttgtaacytgaggtaacaaaattatgttgaaagggagagattaaaaatgcatgtgggtgtggctgggtacagtggttcatgcctgtaatctcagcactttgggaggcc

SEQ ID NO: 39930 - DNA, 201 bp, Homo sapiens
attcaatggaaatggcaatatgaaggtcatgtttatcattcttcactggtgtggtggtgacaggtgaaatttcagcaggctgatcatacaaggtaaggaartggaaacaatgagtttagatggtttgaagtctggttaagacaggaaggaaagagataatatctaagtagagtcatatgtcgggtcaatagatcttaaaat

SEQ ID NO: 39931 - DNA, 201 bp, Homo sapiens
ataatgagaggagagtattcaatggaaatggcaatatgaaggtcatgtttatcattcttcactggtgtggtggtgacaggtgaaatttcagcaggctgatmatacaaggtaaggaaatggaaacaatgagtttagatggtttgaagtctggttaagacaggaaggaaagagataatatctaagtagagtcatatgtcgggt

SEQ ID NO: 39932 - DNA, 201 bp, Homo sapiens
tccagcgatgtataaatttgggtgcctatttctttataccctcacaaggcagagataaggtgaaccccaggctcttcatgattatgatgacttcacccctrgttccatttttgaaggataatgaggggtttttacctagaaggaggtctttcatattcttcacactggaacatctacaatacacatctttcccttgctagt

SEQ ID NO: 39933 - DNA, 201 bp, Homo sapiens
agtgccatagtgtgggaggatctttttattttctacgcgcaccgtatttgattctgtgtttacaggaactgtgtctgtagacaaaaagcaaaatgttgggktttagtttcttcaggtgaataaaatgttacttgcatctcctcattgtcacagtgttcgtattacatacttcgtgtgtgtagttttggcatttaaggaaac

SEQ ID NO: 39934 - DNA, 201 bp, Homo sapiens
aatgaaataatgaaataaccttagcttactgtaacttgtttactttataaacttttacatttacatttttaaaaacttttttactctttttttttttttttgagacacagttttgctttgtcacctagactggagtgcagtggcatgatctcagctcactgtgacctccgcctcctgggttcaagcgattctcacgcctca

SEQ ID NO: 39935 - DNA, 201 bp, Homo sapiens
accgagatactggtagtattgattgaaaactgtgcaagaccctgctcattggtggttgcattggagtaataattggcgtcattcacagagatgaagaagastttattggggatgggcacaccttttccatccaccagaagcacctaaagaagaaaagtacttgatagttgatgtgaacaacacccagagaggactgaactc

SEQ ID NO: 39936 - DNA, 201 bp, Homo sapiens
aagttagctaggcatggtggcgggctaatcccagcttgggaggctgaggtgggagaatcgcttgaacccaggaggtggaggttgcagtgagctgagatcaygccactgcactccagcctgggcaacagagtaagactctgtcgcataagtaaataaataaagctacagattatttgtatcccctcctgaaaagaggtgaag

SEQ ID NO: 39937 - DNA, 201 bp, Homo sapiens
atcattttctcctgctgtactgcaatgagatggtcataatagctcttatatagttttttgccaaaaatgcaaaatctgaatctaatcacaaggaaatatcyaacaaagccaaattgagggacatgttacaaaattcaaaacatcacataatccaaaagacaaaattttaaactgtcaacatcatgaaagacaaagaaaaac

SEQ ID NO: 39938 - DNA, 201 bp, Homo sapiens
gccctctctgcagtgtcttacagcacacctgcatctccagttttcggcccctccctgatcttaccaggtcacgtgatccctccagacaacatctgcccctygtcatctgcagcgggatctccaaccagccgctggaattcacgttccagaaaagagacctgcctcagatggtcagtcccagccagctcgctgcaccacagc

SEQ ID NO: 39939 - DNA, 201 bp, Homo sapiens
acctggactcacctgggggaccccctttgctgggacgatagaagtgtctgttgggcttgcactcacctcccaccgatctgtttttccaggcagcctcagtsagagcaccctgaagtttttgctcctgaatccagctgtgcactttgcccaagtggtgaaggaatgccgggcagtggtcattgcggggggtaccatgcagcc

SEQ ID NO: 39940 - DNA, 201 bp, Homo sapiens
taatcaggtggttcttggccaggttcagttcccaggaaggagccaagctgagcccgggagccgcagcatgaaaggattctttccttccatcctgggaactycctgggttaggaggaagcagtgcagtgggcactggcctgctgtgacctgggcaagcagtggaggtggacgggaggagatcgaggggctgggatggaggtc

SEQ ID NO: 39941 - DNA, 201 bp, Homo sapiens
cctgacaagagggaggcctcctccccattctgctctgtgcagctcttgcagcccctgcagacgagagtcaggccagcgtcccgcaaccagcttccccactratgcacatcgaaggcttcctggcagctctcactacggccaaccaggacggcagggtcatcctgagccgccaaggtaatcaggtggttcttggccaggttc

SEQ ID NO: 39942 - DNA, 201 bp, Homo sapiens
ggcagggcctgacggggtcagcttgcaccaagttgggtggagaacgagtagctccaggcctcccacagtggacagatcctcaggcctggaggggtgtcctyctgaaggagcattcccagtctctgacgaatgaggcctgggtctctggctggagttggagtgggtctgtgtctggagggggcacttgggctctggaaagag

SEQ ID NO: 39943 - DNA, 201 bp, Homo sapiens
caagatcacgccactgcactccagcctgggcgatacagcgagactcagtctcaaaaaacaaataaacaaaacaacaacaacaaaataataataaatttttwaaaaatgtcccatatatctcattgtatggatgaacatatattccagttttctgctattgtgggttatctacattctattgctagacctttaaaccagtct

SEQ ID NO: 39944 - DNA, 201 bp, Homo sapiens
tctctggggctggaaggagccagtgcagtgcccgaccctgtggcatagaacgtgagaagtgggcagcctctgcttgagaggatgccgagggtggtcagcamggataactaacggtggcagggcctgacggggtcagcttgcaccaagttgggtggagaacgagtagctccaggcctcccacagtggacagatcctcaggcc

SEQ ID NO: 39945 - DNA, 201 bp, Homo sapiens
ctcttatctagatccttggtatttttcactggttttgagacagtgccttcctgttgggtcttgtaaggtccagtctctcttcttgttggaagagcctgtgwattctttcactgcatgtttatgaatagccttcccgggccaggcactgtgatgagttccttctcccatacagctcatggcctggtacagggggagaaggtg

SEQ ID NO: 39946 - DNA, 201 bp, Homo sapiens
ctatttcatttcccactgcaccctcttatctagatccttggtatttttcactggttttgagacagtgccttcctgttgggtcttgtaaggtccagtctctyttcttgttggaagagcctgtgtattctttcactgcatgtttatgaatagccttcccgggccaggcactgtgatgagttccttctcccatacagctcatgg

SEQ ID NO: 39947 - DNA, 201 bp, Homo sapiens
ataccttggtctggctgctgtgtcccggcctcctggagaaggggtgaaaaacatgaacttacagggctttgggttccacgtgcaagcacgtgagtcagacrtgggaggctcctggacccacctgccctctaagtgggtccgttgcatgctataaacagtgaaaagcaaaacaaagccgttcaaatacagatgctcttctta

SEQ ID NO: 39948 - DNA, 201 bp, Homo sapiens
ctcattagatggcctcgtccctcaatcttctccaaactggtgctggcttccctgaggatgctctgagctggtgccattaacctgggcagcacttctctccrgtccacacgcacttcactctattatcctgcaccctgaaaaggcatggattttgttgaacggggccttgtgcatcagaagccaagtgcacctctgtctggg

SEQ ID NO: 39949 - DNA, 201 bp, Homo sapiens
gcttgagcccaggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctccttctgagctcttcacacgtaatgcaaaaacccggtcttaact

SEQ ID NO: 39950 - DNA, 201 bp, Homo sapiens
cagcttcaggccatgggatgcagggctggcttccctgccaacgcctggcgctgatggattcttcccgcattgctggaaagggcagactgaggcgctgacamaagaagagttgtagctggtcataagtgacagcatcctctgttcactcgattggtcagttgtagcttcatccaggagatggtcatggggttcctgctgcat

SEQ ID NO: 39951 - DNA, 201 bp, Homo sapiens
tctaagtccatgttgattttttcctaccattgttcggggtagaagggagcaggtatctcaggtggtgggaacagtgcgagaaagcccccaggtcaacatgmacgctgccgcgcagggagcaggctcctctcagattaagcagcgtgtgctgggactgcgggaggtgaggtccattgggtggatccactaagctttggaagc

SEQ ID NO: 39952 - DNA, 201 bp, Homo sapiens
agaggaatgagacctgaaatacaggtctagttaaaagaagtcttaggtccggaaacctacaggtccaacaacaaggcagcagattctttttttttttttttgacagagtctccctctgtcatccaggctggagcacagtggtgtgatcttggctcactccaacctccgcctcccaggttcaagcgcttctcctgcctcagc

SEQ ID NO: 39953 - DNA, 201 bp, Homo sapiens
gggcgacatggtgagaccctgtcactaaaaataaacagaaagtaaagatacatatatatctcactgtgctaggctgaatgatggcctcccaaagatgttcrcaacctaatctgtaaaaactgtgagtttcttaccttacctggcaaaagggactttgcagatgtgattcaactaaggatgttgagatggggagattctcct

SEQ ID NO: 39954 - DNA, 201 bp, Homo sapiens
gagcatagactagtagagctagctcagcttcaggccatgggatgcagggctggcttccctgccaacgcctggcgctgatggattcttcccgcattgctggraagggcagactgaggcgctgacaaaagaagagttgtagctggtcataagtgacagcatcctctgttcactcgattggtcagttgtagcttcatccaggag

SEQ ID NO: 39955 - DNA, 201 bp, Homo sapiens
tgggcgacatggtgagaccctgtcactaaaaataaacagaaagtaaagatacatatatatctcactgtgctaggctgaatgatggcctcccaaagatgttygcaacctaatctgtaaaaactgtgagtttcttaccttacctggcaaaagggactttgcagatgtgattcaactaaggatgttgagatggggagattctcc

SEQ ID NO: 39956 - DNA, 201 bp, Homo sapiens
tatgtaaagtactttatgcagtttctgcttgttgtggaattacactatgcctgttactctgaagaacttgttttttgcaaacatttttggaacttttaacytccaaaaatgatcttatcacgtgagcatttcatgatctccaaggttggaacgtgactcacagatttaggtgacagctcagcttcaggcttcattagcagc

SEQ ID NO: 39957 - DNA, 201 bp, Homo sapiens
ttgcatctgcctgtagtcttaactacttggaagcccaaagcaggatgatcacttgagcccacgtgtctgaggtcagcctgggcgacatggtgagaccctgycactaaaaataaacagaaagtaaagatacatatatatctcactgtgctaggctgaatgatggcctcccaaagatgttcgcaacctaatctgtaaaaactg

SEQ ID NO: 39958 - DNA, 201 bp, Homo sapiens
ttttttttttgccattttgtatacttctctggtgaagtgcctggtcaagccttttacccatttaaaaaatcaaactgttttcttattgatttataagatakaagctaggcatagttgcatctgcctgtagtcttaactacttggaagcccaaagcaggatgatcacttgagcccacgtgtctgaggtcagcctgggcgaca

SEQ ID NO: 39959 - DNA, 201 bp, Homo sapiens
gttgagccacagaaaccttctctacccaatcagcaagggattggcagcagagaaccagaaaaacaattagataataccactgaaaataaagactttggttytcaaaaagataaacctgtacagtgcacagatgtttcacataaaatatgtgatcagtcaaagtcagagccacccttagagtcatcttttaacaatcttgaa

SEQ ID NO: 39960 - DNA, 201 bp, Homo sapiens
gatctgtacaccaacctaataacatgagcatgattgataggttgatcagtagtttggcttattgttcaatgaatatccactcccctctcccttctactgtrggaagattatacttcttgggcctggccctgtgacttgctctggcaaatgtactactaatggaaagacaggagagagaccttgaatatgtttgacttggct

SEQ ID NO: 39961 - DNA, 201 bp, Homo sapiens
ataagagagctttaaaaaataactttatgaaatcaaaacatacctaagaaagggtacaaatggtaagtgtataatgcagtggattatgtagggaacacacwtgtgtgtaagtatcaccctggtcaaaagcagtcttcatgctacttaactaccaattgctattccatcacactttgtaaaaagtaccactacagtccctag

SEQ ID NO: 39962 - DNA, 201 bp, Homo sapiens
tggcaagaccaaaatatgaaacctatccttttcatgtattgtttgggactgactcatatttgtactctttgtattgctaatttacatagctgtttaaaagrtcacattcatactaatgatatgcaatgatacattttattgagccaagagtaaggtagaacagaacagcccagggcaatgaggatggggcaaggaggcagg

SEQ ID NO: 39963 - DNA, 201 bp, Homo sapiens
tttagcagagacagagtttcaccatgttgtccaggctgatcttgaactccaacctcagtgatccacccacctcagcctgccaaagtgctgggattacaggygtgagccactgcgcccggccacatgggcattttttaaatgcctattaggggcgagtgaagctggttctggagaagggatctctgggaaatagtgaattat

SEQ ID NO: 39964 - DNA, 201 bp, Homo sapiens
aactcaccaggctgatgtggatagaatgggaggccccagttctgtccctccatccctgaggcccctccccaacctccctggaccccctgtccacagaggcmgtgctgtgtgccagcctcactcctgcattctggagatgccgttccaagatggaggttccctcacaccttcccccacccagcaaactccattggacagatc

SEQ ID NO: 39965 - DNA, 201 bp, Homo sapiens
ccacaaaagtataaccatttgcctcaccaccctaccccctccttcccacatgccttctcccctttaaagaaatgtataaatactgtattagtccgttttcmcactgctataaagaactgcctgagactgggtaatttacaaagagattgaattgactcatagttccacatggctggggaggcctcaggaaacttacaatca

SEQ ID NO: 39966 - DNA, 201 bp, Homo sapiens
aatcttgggtcactgcaacttctgcctcccaggttcaagcgaatcttctgtctcagcctcccaagtagctgggattacagatgtgcaccaccacacctggmtaatttttgtatttttagtagacacggggtttcgccatattaactaggctggtctcgaactcctgacttcaagtgatctgctcgccttggcatctcaaag

SEQ ID NO: 39967 - DNA, 201 bp, Homo sapiens
agagttcccctgctctgcaggcttgccaacgcagatgtgtcttttgatttcacctgttctagtgtggatacaagttgcatttccctaatgaataatgatgytctgaatcttttcaggcactttttttttttttttttttttttgccattttgtatacttctctggtgaagtgcctggtcaagccttttacccatttaaaaa

SEQ ID NO: 39968 - DNA, 201 bp, Homo sapiens
gcagaagaaagaagagagggacctggtgaaccgactgaaggtgagacctggggtatccggaagtgggagtgctggaggaaacagggcttcagcgattgttstggggcgattccgagactcaggcagtgcatgctcccctgccgttgctgtgcctctcagctcttccctcagctccttgggtcgatggtgctgccgctgtgc

SEQ ID NO: 39969 - DNA, 201 bp, Homo sapiens
tatttgtcctggataaacacttaggggaaggatcgctgggtcttatgtttgactttataaggaactgctgaactgttttccacagcagctgtgccatcttrtatgtccgtcagcaccgtgtgagagttcccctgctctgcaggcttgccaacgcagatgtgtcttttgatttcacctgttctagtgtggatacaagttgca

SEQ ID NO: 39970 - DNA, 201 bp, Homo sapiens
gggacagacggccgcacccacaccacgtcagggtatatgtccgtttggaggctttcctcaaacgtctggcagccctggactgcctgtgtatgctgaagaasagggcacagaaaggctgagtctgcagggcaggctggctgtggctgccaggctgggctcctttgttgggggcctccagttgccagcacatctgtgggattt

SEQ ID NO: 39971 - DNA, 201 bp, Homo sapiens
gtcattttgccttttctagaatttcaggtaaaagaatcctacagtaggtatcttttgtgtctggctgctttcacttagtgtaaagctcttgagaggtatcygtgttagatgtgtatcggtaagttgccctgttttattactgaatatattccgctctatggatgtaccacagtttgtttatccatttatcagctgaaggcc

SEQ ID NO: 39972 - DNA, 201 bp, Homo sapiens
ccgtgtcatttgaattagttgctcctcagactgacttgacagatttcagcatgagtgttagtggggacagacggccgcacccacaccacgtcagggtataygtccgtttggaggctttcctcaaacgtctggcagccctggactgcctgtgtatgctgaagaagagggcacagaaaggctgagtctgcagggcaggctggc

SEQ ID NO: 39973 - DNA, 201 bp, Homo sapiens
ggattataggcatgtgccaccacgcccagctaattttgtatttttagtagagacagggtttctccatgctggtctcgaactcccgacctcaggtgatctgsccacctaagcctcccaaagtgctgggattacaggcgtgagtcaccgcgcctggctgttttcttttcttttctttgtttagagatagggtctcactctgtc

SEQ ID NO: 39974 - DNA, 201 bp, Homo sapiens
tagagacagggtttctccatgctggtctcgaactcccgacctcaggtgatctgcccacctaagcctcccaaagtgctgggattacaggcgtgagtcaccgmgcctggctgttttcttttcttttctttgtttagagatagggtctcactctgtcacccaggctggagtgtagtggtaaaatcatagctcactgcaacctcc

SEQ ID NO: 39975 - DNA, 201 bp, Homo sapiens
ctgtggggtttctttttctttttcttttttttttttttttgagacggaatctcactctgtagcccaggctggagtgcagtggctcaatcttggctcgctgyaagctccgcctcccgggttcgcgccattctcctgcctaagcctcccgagtagctgggactacaggcacccgccaccacgcctggctaattttttgtattt

SEQ ID NO: 39976 - DNA, 201 bp, Homo sapiens
catttttaccttggagccctcctggaatcctccatcctttccgtgtcatttgaattagttgctcctcagactgacttgacagatttcagcatgagtgttartggggacagacggccgcacccacaccacgtcagggtatatgtccgtttggaggctttcctcaaacgtctggcagccctggactgcctgtgtatgctgaag

SEQ ID NO: 39977 - DNA, 201 bp, Homo sapiens
tatgacctcctttacccttgaaggccagatctgtagtacagtcacatggcagggttaggatttcaacatatgtttgtttgttaagatgggcagtctcactrtgtggcccaggctggtctcaaactcaagcgatcctcccctctcagcctcccaagtacctggtggctggcaagatccaagattactggtgcacaccaccat

SEQ ID NO: 39978 - DNA, 201 bp, Homo sapiens
gcatattttgtcttggtaattcctcttctggaaatctttcttaagtgaacaattcctaattcaaaagctacttactatatagttatacacaaagacatatrctacaaaattattaattactaggaaaacaaaatgaaataatctatatgttatataataaaagcataactaaataaatttcgtgtagtcacataaagatat

SEQ ID NO: 39979 - DNA, 201 bp, Homo sapiens
cctaaggagtatttacaaaggcagaagcataaagaagctctgagtaataaagcatcgaagaaaatctgtgtgaaaaacgtgccatgtgattctgaacataygagaccaagtaaacttgccgtgcaggttgaaagttgtgggaaatcaaatgagaaacacagcagcggcgtgcagacctctaaagagtcattaaatggcttg

SEQ ID NO: 39980 - DNA, 201 bp, Homo sapiens
tgcaccaccacgcccagctaatgtttgtatttttagtagacatggggctttgctatgttggccaggttggtcttgaactgctgacctcaggtgatctgcckgcctcagcctcccaaagtgctgggattacaggcgtgagccacggtgcccagccaccatctgctctttacagaaaaagtttgctcacctctactctagact

SEQ ID NO: 39981 - DNA, 201 bp, Homo sapiens
aatcgcttgaacctgggaggcggaggttgtagtgagccgagatcatgccacttcactccagcctgggcaacaaagcaagactttgcctcaaaaaaaaaaaattgtttttgcaattatttaatcagactttcttaagactttgacctttatgcacttttaccttccttaataactcttcaaaagaggccttgaaaaaaatgc

SEQ ID NO: 39982 - DNA, 201 bp, Homo sapiens
tagtggtaaaatcatagctcactgcaacctccaactcctgagctcaagaaaccctctctcctcagccttccaagtagctaggaccacaggtgcacaccacyacaccaagctattttcacaaatttttatacagacagcatctcagtatgttgcccaggccggtttcaaccccctgggctcaaacaatcctcccaccttggc

SEQ ID NO: 39983 - DNA, 201 bp, Homo sapiens
aagtttgggtctgtcatttaaaaaaattaaacaatttagaaatgtagtcctctcctgcttaacatcagtaatctattactgaaaattggttgttctgcatraaaatgctaaccttcagcctatttattttattttaaacagaaaaattatactatgtcaaccccaaaccctcaatcaatttcttaaaaggttaactaaagc

SEQ ID NO: 39984 - DNA, 201 bp, Homo sapiens
aaaaaaattaaacaatttagaaatgtagtcctctcctgcttaacatcagtaatctattactgaaaattggttgttctgcatgaaaatgctaaccttcagcytatttattttattttaaacagaaaaattatactatgtcaaccccaaaccctcaatcaatttcttaaaaggttaactaaagcatggtaaggtacctaaata

SEQ ID NO: 39985 - DNA, 201 bp, Homo sapiens
aaacagaaaaattatactatgtcaaccccaaaccctcaatcaatttcttaaaaggttaactaaagcatggtaaggtacctaaatataattcttataaaacraaacatctggtcagttgtgaaatgtttaaaacattgcttcttgatcaccaaataattaatatggtgaataacagataggggcttttgtgcagtagaagat

SEQ ID NO: 39986 - DNA, 201 bp, Homo sapiens
tataggacttattttgtaacattaagaagattccaattaattcaaattaaatggatgatgccttatcttcacaatgacattccaatagcttgttttcttaytttaatgaaaatatgtaatgatggtgaagattcagtgagacaggcacttccatactagctgctggaattctacgttgacacaacatatttggtgagcaat

SEQ ID NO: 39987 - DNA, 201 bp, Homo sapiens
ccaaagaagatgttaaatactaccaaaaaaaaaaggctgaaaactggtttccaagaatctctggggcatccttaagaactccccttgcatgttcattagayggccctttacccaatgtatctctaatagtctgctgaaaatactcaaaggcaagtaattttcatgtaatcaactaaacaaaatgtttaacaaatatggcaa

SEQ ID NO: 39988 - DNA, 201 bp, Homo sapiens
ggaggaaaaaaaagatgacgtcaacatggagcagagtttttcttagaccttagcctagcaaggaaagagaaatgcctggtctcagtgctgggaagctgttycagccagagccccgtggctgtgaagagagctctcctgtctggagccaaacagaaagctcataggtcttgaggccagaaaagttagtaggtggcggctctg

SEQ ID NO: 39989 - DNA, 201 bp, Homo sapiens
cttcagcccaattcacagccgcatttttccatctctttgccattcctccatgggagagctttctgttggtacaggaatagctgagaagtgggaaagatcawgggtagtaagagctgcccccgataatctacagaaagctttgctggaatgaggttgtgcatctctgaacctgagctagatttgttgggtcagggaccatac

SEQ ID NO: 39990 - DNA, 201 bp, Homo sapiens
gcttcttgatcaccaaataattaatatggtgaataacagataggggcttttgtgcagtagaagattcaagaccaagacaagctcatgtttccctttaggcrggcttcctcctgagggaggcccctgacctccctcttcttagagcatttgctttagaaaacttgtaaattttctctctgatacttcgagatgccaattttt

SEQ ID NO: 39991 - DNA, 201 bp, Homo sapiens
tgctttcctctgatgcagctgagccctgattaaccgagcagatgagctctgattgattggtttccaagccctaaactgggagtctctgtcagactgtggcwggctggtggtgggaggggcccagcagcagtttgtcctgggagcaacagcaggcgctggtttggcttgattgtgaaaagaggggtcctgtgatgctcttat

SEQ ID NO: 39992 - DNA, 201 bp, Homo sapiens
tgctgcccaggttccccatcaggttcatttgcatatgaacccagattcatttgcatttgctttcctctgatgcagctgagccctgattaaccgagcagatragctctgattgattggtttccaagccctaaactgggagtctctgtcagactgtggctggctggtggtgggaggggcccagcagcagtttgtcctgggagc

SEQ ID NO: 39993 - DNA, 201 bp, Homo sapiens
taatctcctaaaatattttaattcagttgtgtgccatttttaagttgcgtacactagagacattttatgtgatcggagaacaatgtgaaccattgttctcraagggctatttctattatttttggtatgattaatagtttgtcacaatgtacaaatattagtgattgaaactttcttgtaattctgaatatgctcataacc

SEQ ID NO: 39994 - DNA, 201 bp, Homo sapiens
atgaggccacggcctgaagtatacaagttgatagcaccaagtgctacgtatgtaaacaaaagaccatcttagagagatgacaagtcaagtggttccagggragatcagcagaagcaccactcagctgattccagtccaaatttcaacccacagaaatatgaacaataaacagatgccattataggctactaattttagagg

SEQ ID NO: 39995 - DNA, 201 bp, Homo sapiens
attttgaaaaggtcttctggcttctgctcttgctcttagaattctgccctgagactattgtataaagaagctcagtatagcgtattaaagatgaggccacrgcctgaagtatacaagttgatagcaccaagtgctacgtatgtaaacaaaagaccatcttagagagatgacaagtcaagtggttccaggggagatcagcag

SEQ ID NO: 39996 - DNA, 201 bp, Homo sapiens
cccagcaaactccattggacagatccacaccagcaacagcttcacagctaggccctggaggtatggagctcacagacctcccactaactaagaaaaacacrgtagagagccagaagggtggcaggttccaacagagcccccaccatgtcccccacccagccccccatccgaccccttccctccacctggactcagcaccat

SEQ ID NO: 39997 - DNA, 201 bp, Homo sapiens
ttgtagagacagagtttcaccttgtttcctaggttggtcttgaactcttgagctgaagccatccaactgcctcggcctcccaaagcgctgggattacaggygtgagccaccgcaccaagcctgtttcgtgttttgttttttaagacagggtcttactatgtcacccaggcttgagggcagtggcgtgatcatggcttactg

SEQ ID NO: 39998 - DNA, 201 bp, Homo sapiens
ttctgagacagagtctcgctctgtcacccaggctggagtgcagtggcgcgatcttgcctcactgcaagctccacctcccgggttcatgtcattctcctgcsacagcctcccgagtagctgggactacaggggcccgccaccaagcccagctaatttctttgtatttttagtagagacggggtttcactgtgttagccagga

SEQ ID NO: 39999 - DNA, 201 bp, Homo sapiens
ttttttttttttttttctgagacagagtctcgctctgtcacccaggctggagtgcagtggcgcgatcttgcctcactgcaagctccacctcccgggttcaygtcattctcctgccacagcctcccgagtagctgggactacaggggcccgccaccaagcccagctaatttctttgtatttttagtagagacggggtttcac

SEQ ID NO: 40000 - DNA, 201 bp, Homo sapiens
aatttacactcccaccaacagtgtaaaggcgttcctatttctccacatcctctccagcatctgttgtttcctgacttttttttttttttttttctgagacrgagtctcgctctgtcacccaggctggagtgcagtggcgcgatcttgcctcactgcaagctccacctcccgggttcatgtcattctcctgccacagcctcc

SEQ ID NO: 40001 - DNA, 201 bp, Homo sapiens
gtgggttcattcatgcagctttcctgagacagctgggggcttagactgtgactgcaaaccaacaagctggtggagtgacggtggccttggaatgcttttcmtttttaggttgacatgttaaaatgggaaaaatctgcttacaaatctacatttcccacttcgctgaaagaactttaaaatggggtcacttagaacaacctg

SEQ ID NO: 40002 - DNA, 201 bp, Homo sapiens
catttgactcagtccagctgccgccttctctgtcctgcctgaagcagctgagcgctgttgagaccacacggcctcatggatctagacgggcatgagctccyggcctctgcttcatccttggtgctgcccgtaagtcctgtggtctctggccagctttatgtcctactcccccaatggctataacagaccttcaccagtctc

SEQ ID NO: 40003 - DNA, 201 bp, Homo sapiens
gcacattacagtctggattcagaaacccctttcaacagcacgtagatagttaaagagaaagattgttcttcaagggcctctaaggacaaaagtgaatccaytaacactctaggaagcagtgtgactactggaagaaagacattcaagaggtaaaatggattttagaaggtcacaggagccaattgtcagtgtttgtactct

SEQ ID NO: 40004 - DNA, 201 bp, Homo sapiens
tttctctgtctgaagcttggactattcatgagaggacttcctactccaagacataagggagtcttgctcagaaggaggagctcctgtctgctgaggacacrgttccatccaatgaggtcagcagggctatcagcagcttccgttaattccgttggggcaggcgcttggcaagcggcagttatttgagctgaggatgctggg

SEQ ID NO: 40005 - DNA, 201 bp, Homo sapiens
gaatattcatattccagatcaggaaagccagaggcagggcaaggcaggcaatgcccaggaacaaggaaagcctggtgcttctcctctctcacctcccaggsgtggttgaaaagctggccatcattcttaaagcagccgcttgttttctgttggcttgaaagccagattaaggtctgtttttgaacattttcatcaatgaat

SEQ ID NO: 40006 - DNA, 201 bp, Homo sapiens
aaaatgctttgttccttaatagttgaaaactcactatttttagtcctttctgaagtcctaactacattccttttttttttttttttttttttgagacggartctcgctctgtcgcccaggctggagtgcagtggggcgatctcggctcactgcaaacttcgcctcccgggttcacgccattctcctgcctcagcctcccag

SEQ ID NO: 40007 - DNA, 201 bp, Homo sapiens
cacccacaaccatctgatcttcaacaaagctaacaaacacaaggaaaggactccctattcaataaatggtgctgagataactggctagccataggcagaakattgaaactggatccccgccttacacaatgcacaaaaatcaactcaagattggttaaagacttaaatgtaaaaccaaaaagtatacaaactctggaagac

SEQ ID NO: 40008 - DNA, 201 bp, Homo sapiens
acccaacttcaaactatactacagggctacagttaccaaaacagcatagtacttgtacaaaaacagacacacaaatcaatgggacagaatgcagagaccakaaataatgctgcacacccacaaccatctgatcttcaacaaagctaacaaacacaaggaaaggactccctattcaataaatggtgctgagataactggcta

SEQ ID NO: 40009 - DNA, 201 bp, Homo sapiens
aactgtgatgtaactttgaattaaacaaacaaaacaaaacagaagaagactatatatatattttttctttttttagagacagtctcactttgctcccaggmtggaatgcagtggctattcagaggcttaatcattgggcactgcagccttgaactctgggcttttttttttttttgagatggagtctcagctctgtcgtcc

SEQ ID NO: 40010 - DNA, 201 bp, Homo sapiens
gttctcaacctctctaagactcagttacaaaaaagagggcataatagtgtctcttgccttataggttttggtgaaaattgaataagaaaacatcagtaagkatgtggcatggtgcctgacaatctttagatgcccaataagtggtagctagtatcaacatagaaataaaattgaaaagatacacacacaatgtttgcattg

SEQ ID NO: 40011 - DNA, 201 bp, Homo sapiens
gccttataggttttggtgaaaattgaataagaaaacatcagtaaggatgtggcatggtgcctgacaatctttagatgcccaataagtggtagctagtatcmacatagaaataaaattgaaaagatacacacacaatgtttgcattggttatccttgggtaatgggttttaactttgtttcctagattttaaatttttccac

SEQ ID NO: 40012 - DNA, 201 bp, Homo sapiens
gtggtgcagatcctgtgggaggggagaatgacttaacaaacccagaggtgggggtgggagggaaagaattcaggtgagactgcactcagaggtaggattcytttttcttttttgtaggtaacattttttgttttcttactgtgtgccaggcattgttctaaactaaatatacaaggccaggcgcagtggctcactcctgta

SEQ ID NO: 40013 - DNA, 201 bp, Homo sapiens
tcctgtgacctgttgaggtttgctgctccaaaggaataaggagtctttgacattaatgtccatttaactcagggatctaaaaaggcaggttagtgttagarttctataggcaccccagaattgtacctaagagtgtgtgtgtgcgtgcatatgtgtgttttcctggggatggtgtagctttccttagattgtcaaaggaat

SEQ ID NO: 40014 - DNA, 201 bp, Homo sapiens
tattttatattatatttattttattttatattttttgctctgttgctcaggccgaagtgcagtggtacaatcatggctcactacagcctccacctcctgaktctcaagcaatcctcccaccccagcctcccagagtgctgagattacaggtgtgagccaccacacctggcctccattacttaaaaatgttttaaaggctgg

SEQ ID NO: 40015 - DNA, 201 bp, Homo sapiens
agtgctgggattacaggcatgagccaccatgcccagccttttaaatttattttaaaaataaacgtatttcttacagttctggaggtttgaaagtccacagytgttgggctgcatctggtgagggccttcttaccgcagcataacatgacagagagcatgacagggcaagaggccattttcttgtctgagagtttgatttag

SEQ ID NO: 40016 - DNA, 201 bp, Homo sapiens
tgatggccatgttactttccatcactatagtagtcattttattatctatatgtgtcccataacgttatgttgtacaccttaaataaatgtaatttttttttgagacagggtcttgctctgttgcccaggctgaaatgcagtggtgcaatcatagctcactgcagcctcgaatttctgggctcaagtgattgtactgcctca

SEQ ID NO: 40017 - DNA, 201 bp, Homo sapiens
aactgactgcctaaggaaggttctggagtgtggacaaaggtggagatggctacttccactgattaataaaagccttctaggccaggcgcggtggctcatgsctgtaatcccagcactttgggaggctgaggcaggcggatcacctgaggtcaggagttcaagaccagcctgaccaacatggagaaaccccgtctctactaa

SEQ ID NO: 40018 - DNA, 201 bp, Homo sapiens
tgcactccatcctgggtgacagagcaagaaccctgtctctaaggaaaaaaatagaaactgctgtcattgaatttaacattatctatgggtctttagtttgycatgaattgtcatcagcagtcagcatgagatacccaaatacaaaagtacaaaggaaaaaatacttttcactttgtaaaactgaacgcacacagcattaca

SEQ ID NO: 40019 - DNA, 201 bp, Homo sapiens
aaacacagcaatggctcatacagtgcctttggggagcgagatggaaatggaaacacatggtaatatcacccaattcccaatgagttctgtactccagagcrtaattcctgagccctctggaactattccactacctctccccttaacccctttccttcttgcactcagtcttctacctctttaatactgtttatttcaccc

SEQ ID NO: 40020 - DNA, 201 bp, Homo sapiens
attagagaaatgcaaatcaaaaccacaatgagataccatctcacaccagtcagaatggctgctgttaaaaagtcaaaaaacaacagatgctgatgaggttrcagagaaaaaggaatgctttttttactgttgtggggagtgtaaattagttcaaccactgtggaagaaagtgtggtgattcctcaaagacccagaggcaaa

SEQ ID NO: 40021 - DNA, 201 bp, Homo sapiens
agagtctacgaggaacttaaacaaatttacaagaaataaaaacccattaaaaagtgggcaaaggacatgaacagacaattctcaaaagaaaacatacatayagccaacaaacatatgaagaaaagctcaacatcactaatcattagagaaatgcaaatcaaaaccacaatgagataccatctcacaccagtcagaatggct

SEQ ID NO: 40022 - DNA, 201 bp, Homo sapiens
atttagcaactgttttaggatagatttttattctggaagatccataatgaattatattttatatgaagacagggctaccttttgcgtcaatattttgataktgaagagtgctggtacatcaataaagtacttgtatagtaaacaaattaaagatgttttgtgaactagctaggccttgaagactcacagggcttggtgtgt

SEQ ID NO: 40023 - DNA, 201 bp, Homo sapiens
tggatagttcaatatatattttgccaaaatgttatattgagtttacacaaataaacacacacaagctgtcataataagttcatttagcaactgttttaggrtagatttttattctggaagatccataatgaattatattttatatgaagacagggctaccttttgcgtcaatattttgatagtgaagagtgctggtacatc

SEQ ID NO: 40024 - DNA, 201 bp, Homo sapiens
caccatcatcttgataccaaaacctggcagagtcacaacaaaaaaagaaagcttcaggcgaatatccctgatgaacatcgatgcaaaaatcctcaacaaartacttgcaaaccaaatccagcagcacgtcaaaaagcttatccaccacaaccaagtaggcttcatccctgggatgcaagcttggctcaacatacacaaatc

SEQ ID NO: 40025 - DNA, 201 bp, Homo sapiens
aagtttattctgataggtctattttttgatgtactaataaaactggccatctctgctatagttttgctaacttgttgcagaagtaatctcaagaagaaaayagccctattagattatgtttaggatggatagttcaatatatattttgccaaaatgttatattgagtttacacaaataaacacacacaagctgtcataata

SEQ ID NO: 40026 - DNA, 201 bp, Homo sapiens
catttaaataatgagggaggccacttctaaagacttatcatttacctgatctacacaatatctagcataggaccagttctcaattgacggcaaacagtccyagcaggtcacttcattttgaacagacattgcaattgcacttgagaaatcatgccaagttttgcagggattgtccttggacttgtcaccacgaagacataa

SEQ ID NO: 40027 - DNA, 201 bp, Homo sapiens
tgcattataattagcgtatagtgagcagtgaggacaactagaggtcactttcatcaccaccttggttttggcaggttttggctgccttctttatggcattrttttatcagcagggtctttatgacctctatcttgtcctgctgacctatcttgtcctgtgactaagaatgcttaacctcctgggaatgcagcccagtaggt

SEQ ID NO: 40028 - DNA, 201 bp, Homo sapiens
atactacattgtacccattaagtaatttctcatccctctacatcctcccacccttcttgttttttttgtttgtttgtttgttttgctttgttttgttttgytttgctttgttttgttttgttttgagacagagtctttctctgtcgcccatcctgggttcaagcgattctcatggctcagcctcctggggttttaccctga

SEQ ID NO: 40029 - DNA, 201 bp, Homo sapiens
ttctaatcaaattgaattacacgttaacaaaacttacttaaattttccttgtatatttaattctatctcttcccaggccaagtcaaaaaaaatatgaaccyttggaacaattacatctagaagtgaccagtcctagtctaaatatttaaatacataacatgaggaattcaggccaaaagtttattctgataggtctatttt

SEQ ID NO: 40030 - DNA, 201 bp, Homo sapiens
aacctagattaaatcttgttggagatagagactctttatctacctctttatatgaaatgttaagcaaccacttagagcgtaatcgatcataaccaatcagrtcttgtaactgtttgttagtcttgtgtggaaaatgtaattctgttcagcattcttgttttttcctatataaatgacccctacctttctctacactgggga

SEQ ID NO: 40031 - DNA, 201 bp, Homo sapiens
ctaaatcttactgtaaactattgtcagcctactgtgcaatagaacaccagaactcattccttcttcattcttttcagattaaataaaattttaaaacactygtagagtgtcagatgtgttccaaggactgatccaaatgctcaaggcacaaaaatgtatatgacatgttcacagcccatattagcttaaaattttaagcca

SEQ ID NO: 40032 - DNA, 201 bp, Homo sapiens
cttaaaggatacaattggcggggcacagtggctcacacctgtaatcctagcactttgggatgccaaggtgggcagatcactagagccaaggagttcaagaycagcttgggtaatattgtgaaaccccatctctactaaaaatacaaaaattagttgggtatggtggcgtgtgcctctgtaatcccagctacttgggaggct

SEQ ID NO: 40033 - DNA, 201 bp, Homo sapiens
ggcaagcctgagtcctgggattacccctttacctctatttaggtttatctattccattccagtaatagttactcaccgctattttaaaaaagaaaagaggytttttgacatcagctgttgctattctatatgttatcttctttctgtaagggaaggtacccttatcaccattctggatctgagcctgaaatctggccacct

SEQ ID NO: 40034 - DNA, 201 bp, Homo sapiens
gctgtggcttacagaggagctgtggaattaggcatcctgtggtatattacagtctcaggtgtgccgaaccacacgtatgatatgctgaagacactagaaamggccaagacatacaggattgtcagagggattgacttgggatcagttagtcaatcgatggtaggaaggggagttttcttacttccgttgaagatgtgagtc

SEQ ID NO: 40035 - DNA, 201 bp, Homo sapiens
gtaattgtacatacttaaaggatacaattggcggggcacagtggctcacacctgtaatcctagcactttgggatgccaaggtgggcagatcactagagccmaggagttcaagaccagcttgggtaatattgtgaaaccccatctctactaaaaatacaaaaattagttgggtatggtggcgtgtgcctctgtaatcccagc

SEQ ID NO: 40036 - DNA, 201 bp, Homo sapiens
gagtttcttttcacaacaatccagtaatctccaaacattggttctgaaatcagttggaacgagagttgggtaatatttcggaaagaagtcacattttgccwttgaaaaatccgattgttttgaggatcctagaaaataatgaaaaaaatataaacaatcagaatttgtatgagagtattaccctttgctgccatatttcgg

SEQ ID NO: 40037 - DNA, 201 bp, Homo sapiens
gacaacaaattggggatcaccaagccactttacaattgagtaaattcaatgcacctgctgcttgtactgctctaggaatgaaaacacacagacagctctcyttcccaaacttactagactggtgcaaaggtcattgtggttttggcaaaaaaaccccaccaaaacctaacattttcttttctcttatccatcttcataccc

SEQ ID NO: 40038 - DNA, 201 bp, Homo sapiens
gagaggagcagcaaagtgctgatgacgaagccaaccaggtcaaggaagggagacaaagaaaaccagttctagcttcacctactcctgcctaagtctaacayaaatgttgtgttggtccatcctttaaactcttcatctacacaggacagctacaaatagcaactggttaccatatcttttaacagcaaattggtgtgtcac

SEQ ID NO: 40039 - DNA, 201 bp, Homo sapiens
ttgagtaaattcaatgcacctgctgcttgtactgctctaggaatgaaaacacacagacagctctctttcccaaacttactagactggtgcaaaggtcattrtggttttggcaaaaaaaccccaccaaaacctaacattttcttttctcttatccatcttcatacccaggacagactgacttacccttgcaaaacactttac

SEQ ID NO: 40040 - DNA, 201 bp, Homo sapiens
tttttccagttgagtaccttggggtgaattattattgttactgttatctctgtcgttccttactgcttcgtggtattttgcttgataagcatgctctgcamccacctctgttcgccagaggttacttctgcaaagtaggaagaaacgagcaatacgatggtaatctttgcgcctttgctaagatcttttgtaggttcctta

SEQ ID NO: 40041 - DNA, 201 bp, Homo sapiens
tgtttattagtaatacattcagttcaggctaggtagtaatcatatctgggttggatgttgccccaataaaaaaaaaattaaatttttttcttcctgaaaakgaaagtaatttgtgatcagataacacagaaaacaacaaaacaaaaatcatacataaactcaccaggagggtgtgtatttccttcatgaatatatgttgtt

SEQ ID NO: 40042 - DNA, 201 bp, Homo sapiens
agcaggggtagtttccctttccgaccagaggcaaacaacctgggtcacttccttgcttctcagacctcagtgccctttctgggtgctttctgtgttagaaytctcacctctgagaactgagctcaaggttcttgctggggcaaaaattgaaatgagcagaatttttttttgtttgtttgtttgcatttctggcctgcctcc

SEQ ID NO: 40043 - DNA, 201 bp, Homo sapiens
gtataaatggacagatactgatagtggtgggaagcagacaaattcctaggtagatacgggcgggtccctggtgaaaaccaaccttcgagtcaaagaccgcyggaagcctgaaaactcacctgccagttctgggtagaatctaagacccaagtgagaactcccgcaatgccttttagccaatcaaatggtgctttttccagg

SEQ ID NO: 40044 - DNA, 201 bp, Homo sapiens
gggtggtaaacaaagatggttttaatcactcacagtttgtgctggcagctgaccataattccttagtagcaataccctctggtctaccgcccaaagagcayaaagagagtttgaagcagccgagacttgaagatcgacattggatcctggtaaacttttttctttagaaaaatttaagttgacctgaaaatgaaaataaaa

SEQ ID NO: 40045 - DNA, 201 bp, Homo sapiens
taaaatgaaataaaataaaatacctaggaataccaagaaggtgaaagatctgtacattgaaaactgtaaaatattaatgaaagaaattgaaggctggggcrgaaggattgcgtgattccaggagtttgaggctgcagtaagtcatgattgtgccactgcactgcagcctgtgtgacagagtgagaccaaaaaaaaaaaaaa

SEQ ID NO: 40046 - DNA, 201 bp, Homo sapiens
caataacttttagatttgcccttttgaggctagtttctagatcctgtaggtgtgcttcattttttttttctttagtctcttgtgtgtgttttcaaatagcytatcttcaggctcactaattcttctgcttaatctattttgctaataaaagaccctgatgccaattacattttttagctccagaacttctgcatgattctt

SEQ ID NO: 40047 - DNA, 201 bp, Homo sapiens
ttattcttcctatccaactgaaattttgtatcctttgaccaaacatttccccaaaactgcacccccaactcccagtgcctggtaactactattctactctsaacttctatgagtttaacttttacagattccacatatagttgagatcatgcagtatttgtcattttgtgtctggcttataacataatgctgtccagattc

SEQ ID NO: 40048 - DNA, 201 bp, Homo sapiens
aagtcttagaaagtaatgttatattaacatgtaatatgaattccctgttactctttggatggtttgcatttgaccagtgtcttttcatttttagtaaaagyaaaattttttctagacataatcctgctattgatgttgaatactatttcatcttaccctgcataccacacaataccactgatacattgtatataccactga

SEQ ID NO: 40049 - DNA, 201 bp, Homo sapiens
tatgagctatgtatcatttgccccaaattgtgtggcaccattctacatggtggtgtctcactaatgattaattcttcctctttcttttcttttccctatcytcagaatttcacattttgtttctttttgtttgtttgtttgagacggagtttcactctgttgcccaggctggagtgcagtggtgcaatcttggctcactgc

SEQ ID NO: 40050 - DNA, 201 bp, Homo sapiens
taatgtcttgtgtttttctctatatttttcaaattttctacagtgaggattcattgcttctctaataacattaatgtaagcatataaataattaaagtttyatggttaatctcacttctcattctctctgagctttgtgttttcttgtgaaggtaaatctctgaataaatactcacttagcacatacatccacttggaatt

SEQ ID NO: 40051 - DNA, 201 bp, Homo sapiens
acagcaggtgaaaggctgtagccctcctgccctctcctggcaccaggcggccaccccacgttatgggaagtggtggtggcgccaggccagcccaggagccrtgggctggtgggactgaacaagttgggacatgcacccgttcggcaaagcttgtggacagcaggaatgaatgaactgtaacacaaacgagctgagactctt

SEQ ID NO: 40052 - DNA, 201 bp, Homo sapiens
tttttgcatggctgtgctcagtagctttctaaaagaagcctaagacttagtgggggaactatcgctctccacttttgtagcaatattaagacttataaccrtgataatacaagttattttactgcctcccttacactatatttgaatggattcccatgtttataaatagataacatgaatataccttaaattagtccttct

SEQ ID NO: 40053 - DNA, 201 bp, Homo sapiens
tcctggcaccaggcggccaccccacgttatgggaagtggtggtggcgccaggccagcccaggagccgtgggctggtgggactgaacaagttgggacatgcmcccgttcggcaaagcttgtggacagcaggaatgaatgaactgtaacacaaacgagctgagactcttcggggtgcagacctcgggattccccaagccagag

SEQ ID NO: 40054 - DNA, 201 bp, Homo sapiens
gggactgaacaagttgggacatgcacccgttcggcaaagcttgtggacagcaggaatgaatgaactgtaacacaaacgagctgagactcttcggggtgcaracctcgggattccccaagccagagctgtaacatgctgtaacaccccccaccgcatttttttttctttttcttttgagacagagtctcactctatcaccca

SEQ ID NO: 40055 - DNA, 201 bp, Homo sapiens
ttaatggcagttggtcaaattaataataggtaatgtcttgtgtttttctctatatttttcaaattttctacagtgaggattcattgcttctctaataacaytaatgtaagcatataaataattaaagtttcatggttaatctcacttctcattctctctgagctttgtgttttcttgtgaaggtaaatctctgaataaata

SEQ ID NO: 40056 - DNA, 201 bp, Homo sapiens
aacagccaacatattatataataaaataattaaattgggtatagtcacataaaaatatgtgcagcagaaaattggaattcatgaaaagattggcataataygtaggcatgttttcttaattattataaatagaaaagtatgattgcagtcatggaaaatattcattaaaattagaggaaacttacaatgttagtgacatta

SEQ ID NO: 40057 - DNA, 201 bp, Homo sapiens
agtttacagttaaaaccacattcataaaacaaagttaaaattatggtaggggcttgaactttgctgaagaatagacatagttgaacaatgacccgccattrcttagcttgtttttgttatataagttgcttactgccccagagtcttgtatctggggtggcaagatttagagcttctccaacttctcctgtaggtaatatt

SEQ ID NO: 40058 - DNA, 201 bp, Homo sapiens
ctttgctgaagaatagacatagttgaacaatgacccgccattgcttagcttgtttttgttatataagttgcttactgccccagagtcttgtatctggggtsgcaagatttagagcttctccaacttctcctgtaggtaatattactattgtaaaacctgaagaactggtctttgagacatttttcagatttagcatttcag

SEQ ID NO: 40059 - DNA, 201 bp, Homo sapiens
actggtctttgagacatttttcagatttagcatttcaggagaccaagagatgccacttcgtcctgagaccgcttcccaggaaatgacttggctgtgtgaawatggttttagacacccctgcaatttcatccccagccaatccgttgtttcagttctccagccccctgcctgccaaagtagtagttaaaaaactctagcctc

SEQ ID NO: 40060 - DNA, 201 bp, Homo sapiens
gttttacagttttcagtgtagaggacttacgtgtctttcgttacatttgtcctgaagtgctttattttttgatgcttttataactgaagttattgtgaaaratttattttgtgaatgtttactggtagtatgtagaaacacaattggtttttgtatttgtaactgtattctgttagtttgccacttattttggcagttgct

SEQ ID NO: 40061 - DNA, 201 bp, Homo sapiens
ggggttacaggcacccaccaccatgctcagctaatttttgtattttttttttttagtagagacagagtttcaccatgttggccagcctggtcttgaactcytgacctcaggtgatctgtctgcctcggcctcccaaactgggattacaggtgtgagctactgcccatggcagcgatttttaaaagaacacaacaatatctg

SEQ ID NO: 40062 - DNA, 201 bp, Homo sapiens
gccaaggcaggtggatagcttgagatcaggagttcgagaccagcctggccaacatggtgaaaccctgtctctactaaaattagccaggcatggtggcgggygcctgtagtcccagctatgtgggaggctaaggcaggagaattgcttgaacctgggaggtgaagtttgcagtgagccgagattgcaccactgcaccccagt

SEQ ID NO: 40063 - DNA, 201 bp, Homo sapiens
actcccagtcatggctgactcctccctttccttcgttcttgttcctaatctgtcaccatgtcctgtcgttttctttgtctcacccaaccctctgtgcctgmaaatcccctgactgcagcctcatccctgtcacctcctgactgtagttggtgacagaagaggaggctgcaccagtgaaggagcagggactccaggtctggc

SEQ ID NO: 40064 - DNA, 201 bp, Homo sapiens
tggtcttaaatcaatttggttatgacactaggtcccagaaaaaaagctgctatctcattagcagcttggtgtgttggaaattcatgtttgaaccacacagwgaacctacactaccagtaccattacttccctgcatataaaaaacaaaaaatgggggccaggcatggtggctcatgcctgtaatcccagcaatttgggagg

SEQ ID NO: 40065 - DNA, 201 bp, Homo sapiens
ttccagtgccaagtgttagtatattctcttctgttgtttgatggaaacgctcctcagtatctgtttccattcaaagtataccatttccttctctctctctytctcgacagggtcttgctctgtagctcaggctggagtgcagtagcactatcacacatgacagcctcaagctcctaggctcaagcaattttgctgcctcag

SEQ ID NO: 40066 - DNA, 201 bp, Homo sapiens
cttgggggccaccagatgccaatcagtagaatgggagagaaggaaggatggaggaagtgaggacaaggggcaaggaggaaggtctgtccacctgtctcttytgtgcaggaggtgtccaagcaggaggagcacgtcacatccccactgaaaaagcccacagaaaatgaaaagcccacatgcttgtccattgctgcaggatgg

SEQ ID NO: 40067 - DNA, 201 bp, Homo sapiens
gacagataggcagacagctagatattcatcatatttaaatagaaaaatatttcgatctcttccctttatagttcagtcttaaagaataagactagagaacstgtttttaggattggttttgatacatagtctatgggcattactgggcaagtgtaaatctctcttaatgcatcaaccaaagagcttatcagtctgagaaat

SEQ ID NO: 40068 - DNA, 201 bp, Homo sapiens
tgctgctggcattggccacaaagcctcctggtctggctccaaagcctggcagggtcttttccccgggggagctgcaggcagggaacagtcctgatgggtcwtccccttcactcccagcccagagcccccggccaggcacccccagggaaggctctggtggagaacctgtgcatgaaggccgtcaaccagtccataggtgag

SEQ ID NO: 40069 - DNA, 201 bp, Homo sapiens
tttgcctaattcttcattttctttgactctctgtgttgttgcctctgcattagacaaaggaaggcacctctcccattcttcacagactagtcttgtataggagaaggttcctatcaatcagccttgttggaggttgtgggagattctaacaatcctttctcttctcagggagaagcaggaagctgtggttcttgtctgctt

SEQ ID NO: 40070 - DNA, 201 bp, Homo sapiens
agggtaagagagcttatcacaggcttggaatgtttctgtgtggaggagaagtttattgtggggttggaatgtctctggtcagaggggaggttatcttgggrctgcatctctctggccggagaggaggttatcttgggatgggcatgtctctggctggggaggggtttattttcgtgttggaatgtttctggtcagagatgt

SEQ ID NO: 40071 - DNA, 201 bp, Homo sapiens
ttcacttctttttattctttttgctctaaacttctcttctcgcttcacttcattcatttcgtcttccatcactgataccctttctgccagttgatcacatyggctactgaggcttctgcattcgtcacgtagctctcgtgccttggttttcagctccatcaggtcctttaaggacttctctgcattggttattctagttat

SEQ ID NO: 40072 - DNA, 201 bp, Homo sapiens
ctcagatctgcctcactccatagcctgtgcccttttctttccactcacctttttctctttctatttaaaaattcctaacacttttgagattctgagtcaawtcataccaataaaatcatgtgtcaggtttcatgattatataaaggccagacttagatctggccacacatattatacctgaacatttcttcttatttctac

SEQ ID NO: 40073 - DNA, 201 bp, Homo sapiens
gaaatcaaagaaagaataagaatgaaaaatgagtgagaactttttttggagtaaagatcatggtctgtacctgtgcaataaattgctcacatatttcattktcatttttctcacaattgcttgaagaaaaatactctctgcacacccggatttgggtttccccttgcacaggttggccaaaggtgtacctaatgggggaag

SEQ ID NO: 40074 - DNA, 201 bp, Homo sapiens
ctgaggcaggaggatcctttgagcccaggagtttgagaccagctgtggcaacatagcgagactccgtctctacaaaaaattaaaaaattagccaggcgtggtggtgcatgcttgcagtctcagctacttgaaggctgaaatgggagatttcttgagcctaggagttcaaggctcaatatatgaaacaatggttccatgtat

SEQ ID NO: 40075 - DNA, 201 bp, Homo sapiens
ggaatatgaaaaacattcaataagtgttggctgattgaattaattcatgtttcattaattttatatcatcttcctaaatctcaatgaagtatcatgcaccyatttagacagtgtaaaataatccataatagcaatatattaaaatcaaactaatacttaatatcttttgtgtgccagaagttgggcaaagggctttatatg

SEQ ID NO: 40076 - DNA, 201 bp, Homo sapiens
gtgaaaatggtgagttgtttacatgcagtggccagtacagcgtggtactcacacctctttctggaagttgccattgggtggctctgtgggctcccaggctrttgctcagtgcagtcagccgttcttgggagttctgggggaagagcccagtgtcatggatttgagggcattccagctctgaggttgcaggcttctccttgg

SEQ ID NO: 40077 - DNA, 201 bp, Homo sapiens
tattaaccaattcttttttttttagtggtaaagagctattcaaaaatttatttctttttgtgtcagtttgttaaattctgttttttttccataaataattygtctacttaatctaacttgttaaatttattgacataaagatataacattaccttattatacttttaatgtctttaaaatctttagcaatatagcctctcc

SEQ ID NO: 40078 - DNA, 201 bp, Homo sapiens
attctttaaaacaaatgagtaaatgttaagtgttttcctgagttctgtgagccatccagcaaattggacctgaggagggtgtcagggatacctagatttaragccagtcagtcagaaactcaggccacatcctgtgcttgtgactggcattggaagtgggagacagtcttgtcaggctgagccctgaccttttgggatctg

SEQ ID NO: 40079 - DNA, 201 bp, Homo sapiens
gtttgtttgcacctgcctcaccacaaatacctgagtgtttgtgcagtgtcttgagctacgacttcatggaatcacgaggcaatagaaatttttcaactccrttacagtcttatgggaacacagtgtatacatggttctttgttgacagaaacattgttatgtatatatggttcattgttatgtgtgcatgactgtatatat

SEQ ID NO: 40080 - DNA, 201 bp, Homo sapiens
atgatctcagctcactgtgacctccgcctcctgggttcaagcgattctcacgcctcagcctcccgagtagctgggcctacaggcgcacgccaccatacccrgctaattttttttttttactctttttgtgatacacttagcttaaaatacaaacacattgtgcagttgtacaaaatatttttctttatatccttattctat

SEQ ID NO: 40081 - DNA, 201 bp, Homo sapiens
aaatacagtaaaatacagtataaaagataaaaaatggtacacctgcatatgacacttaccatgaatggagcttgcagattacagtataaaagataaaaaayggtacaccggtatatgacacttaccatgaatggaacttgcagactggaagttgccctgaatgaccaatcggtaagttaatgtaaaggcctagggcattac

SEQ ID NO: 40082 - DNA, 201 bp, Homo sapiens
ataagatattatttgcaagccttatggtaacctcaaataaaaaaacatacaacagatacacaaaaaataaaaagcaagaaattaaaacataccgccagagraaatcaccttcactaagaggaaaacaggaaggaaggaaagaaggaagagaagaccgcaaaacagcaagaagacatataacaaaatggcaggagtatgttt

SEQ ID NO: 40083 - DNA, 201 bp, Homo sapiens
attataatgctataagagaggcaagcctgagtcctgggattacccctttacctctatttaggtttatctattccattccagtaatagttactcaccgctaytttaaaaaagaaaagaggctttttgacatcagctgttgctattctatatgttatcttctttctgtaagggaaggtacccttatcaccattctggatctga

SEQ ID NO: 40084 - DNA, 201 bp, Homo sapiens
agagttaaagaaagaggaaagaaacatgaaaaatggctcaacagtgaaagacaggtttattttggagaataaacctgagaggggattctgaccaattttttggtcaggaccactctctcttacagactaagagtatttaagggttttagggtaagagagcttatcacaggcttggaatgtttctgtgtggaggagaagttt

SEQ ID NO: 40085 - DNA, 201 bp, Homo sapiens
tagcatgggaaagacccacccccatgattcaattacctcccaccaggtacctcccaccaggtccctcccacaacatgtgggaattgtgggagctataattyaagatgagatttgggtggggcatagccaaaccacatcaataacatagagaaggaattcagaatcctatcagaaaaacttaacaaagagaacaaaaattta

SEQ ID NO: 40086 - DNA, 201 bp, Homo sapiens
gaaaatagtttctttctcccttcaagttggataaattttgtacacacgaaaaataagtttgaatttgtaggctaaattcatttcttagctccttagaaatrttaggccttttcaaagaggaaagccttaattacactgtattcctcaggaaggttatttccttcatgtaaattatgacttttgtgcttccagtagctctgt

SEQ ID NO: 40087 - DNA, 201 bp, Homo sapiens
gagtctcaaggtgaagacgcggtttgtgggtggctgaggggttgctccatgggggctccctccctcccttccttccttagatggacgaggtgggtcgcatyctctgtaacctgtgcggtgtggtttctggaggggtggtctgtttcttcccctcctacgagtacctgcgccaggtccatgcccactgggagaagggtggcc

SEQ ID NO: 40088 - DNA, 201 bp, Homo sapiens
tgtgcctggggtgtgcagcccctgattgtcattgtggtgcccatcaggaccctggacagaagaagggaggactcagtgccagggcaatagggaggcccccyagggacgctagtgctgtgacatgtgtcagaaaggcgcagtcagcagcagcggctgggtgtgtttggtgggaggtggcacctaccaccccgtggttcccac

SEQ ID NO: 40089 - DNA, 201 bp, Homo sapiens
ctggaatatgaaaaacattcaataagtgttggctgattgaattaattcatgtttcattaattttatatcatcttcctaaatctcaatgaagtatcatgcayccatttagacagtgtaaaataatccataatagcaatatattaaaatcaaactaatacttaatatcttttgtgtgccagaagttgggcaaagggctttata

SEQ ID NO: 40090 - DNA, 201 bp, Homo sapiens
attgttacaattgctaatacagcacctggaatatgaaaaacattcaataagtgttggctgattgaattaattcatgtttcattaattttatatcatcttcmtaaatctcaatgaagtatcatgcacccatttagacagtgtaaaataatccataatagcaatatattaaaatcaaactaatacttaatatcttttgtgtgc

SEQ ID NO: 40091 - DNA, 201 bp, Homo sapiens
ctgtaacacctcagtggccatacatgtttcgtttgtaacacttatgtaattctaatatatgttttgtccccagttatactttttctatttcttctattgtkacaattgctaatacagcacctggaatatgaaaaacattcaataagtgttggctgattgaattaattcatgtttcattaattttatatcatcttcctaaat

SEQ ID NO: 40092 - DNA, 201 bp, Homo sapiens
tttctttttctttcttttctctctctctcttctttctttctttctttttttttggagtctcactctgtcacccaggctggagtgcagtggcacattcctgsctcactgcaacctctgcctcctgggctcaaatgatcctcccacctcagcctcctgagtacctggggctacaggtatgtgccactgcaccaggctaatttt

SEQ ID NO: 40093 - DNA, 201 bp, Homo sapiens
ggtgtagacttctttatgtttaacctacttggaatcttttaggattcctgaatctggatgtctatgttcttccctcaatttggatagttttcaattattaytttgttacatatgttttctgcttctttctctattctccttgtgggacttctataatgtgtatattggcttgcacattcatgtctcccaaatcctggaggt

SEQ ID NO: 40094 - DNA, 201 bp, Homo sapiens
ttgaatgctaatatagaggctctactcctaatattcaagttgacttcctaatttttttctgggttgacattatcttctgtaatgtcagcaattttacagtrtttgattctcatcttatgatgtagctgcatttttcactaaatttttggataaaatgtttttgtgtaattaactatgatacctcccatggggaaaaaattt

SEQ ID NO: 40095 - DNA, 201 bp, Homo sapiens
caagaagactctagccggggttcagataattccagttatgatgaagcactctctccaacatctcctgggcctttatcagtaagagctgggcatggagaacrtgacctggggaatcccaatacagctccacctacaccggaattacatggcatcaaccctgtgttcctgtccagtaatcccagccgttggagtgtagaggag

SEQ ID NO: 40096 - DNA, 201 bp, Homo sapiens
ctgtgctttggggaggaagagtgctgtgattatgggactttgcagtggaactcggtgcagctctgtcaaagcagatagcgacatgggacagaaatcagccmgtgcccacagagggagcatttagaccagccctagccacaggggaatggcccatcccagtggtcggaacctgagtttctgctagtcccaccactgcggcta

SEQ ID NO: 40097 - DNA, 201 bp, Homo sapiens
agagagtctgtgctttggggaggaagagtgctgtgattatgggactttgcagtggaactcggtgcagctctgtcaaagcagatagcgacatgggacagaawtcagccagtgcccacagagggagcatttagaccagccctagccacaggggaatggcccatcccagtggtcggaacctgagtttctgctagtcccaccact

SEQ ID NO: 40098 - DNA, 201 bp, Homo sapiens
aaatcagatgagcagtcacagtacctggttttaacatcatatcaacaaaagaggcactgacgaggacaggagagacagtcttgatttgccaatgccacccyttccccatctcccagcagcacagtgtggtgtggagagagagtctgtgctttggggaggaagagtgctgtgattatgggactttgcagtggaactcggtgc

SEQ ID NO: 40099 - DNA, 201 bp, Homo sapiens
cacgtggaaccaggcttctctccgtgtgcttctgttgtcagtttcatagatagctaggctgtttttgtttcattttcttttcaattttagaatttgctttyttcttttctgacttgtagtttttaaatatgtaaatatttgtatggctcaaaagtcaaagcaatataaaaagatctattcaggaaagcctcactctcatcc

SEQ ID NO: 40100 - DNA, 201 bp, Homo sapiens
ctggatacaatgctcatagaaggaagtcgtggaaacaagctcccatcccctagtgatctcttccctttggttctggtgcaggaagtatcccttagttatgratattttggtagtgactctcaattaaggatgtaatgatagcgattccatgtgggccatggcttggctactacagggtgcacaatttcatttacttattga

SEQ ID NO: 40101 - DNA, 201 bp, Homo sapiens
ctggattataatctttttctctttatctttcatagtttttttaaaaacatggactgtatcttatctaccactatatcccaaatacctaagatagtgcttaygttcagtgactattaaataaataaatggatgaattaaaaagtaagaatgaaaactgttcattctagttatttctgttagcccataaattagaggaattga

SEQ ID NO: 40102 - DNA, 201 bp, Homo sapiens
tatcttaggtactaaggcctcaaaaataagaaaaactttattatttctcctcagtagagtttggacatacataaggagagaaggtacagtgatgaaggagrccataattctgtagtgttgatgatcctggattataatctttttctctttatctttcatagtttttttaaaaacatggactgtatcttatctaccactata

SEQ ID NO: 40103 - DNA, 201 bp, Homo sapiens
cttttccattatgtgactgtttgacctgcatattaatttcaagatagcagtcaattcgataaggcattttcatagaggaaagtttacagaaacagtttatrtggttggatcaccaaattatcttaggtactaaggcctcaaaaataagaaaaactttattatttctcctcagtagagtttggacatacataaggagagaag

SEQ ID NO: 40104 - DNA, 201 bp, Homo sapiens
aatgctaatgtgagaatataaattgtgggaaatgagtgagggcaaggtggtacttcctccttctgagctcttcacacgtaatgcaaaaacccggtcttaaytgattttgttttttttctgagtatgcatatatgtggttgaatgaaccaatgtgtgattgtatcttttccattatgtgactgtttgacctgcatattaatt

SEQ ID NO: 40105 - DNA, 201 bp, Homo sapiens
gatcaagctttattctgaagaataaacctagctggcatgctggtgtgtacctgtagtcctagctatttgggaagctgaggtgggagggtcgcttgagcccrggagtttgaggctgcagtgagctatgattgtgccactgtactccagcctgggagatagagcaagactccatctctaaaaaaaaaaaaaaatgctaatgtg

SEQ ID NO: 40106 - DNA, 201 bp, Homo sapiens
tccctttaattaaggagaaaattgcaatggaaggtagagatgtaatattatcttatttgctacattataagaatccagttattgacagaaaggtcaattcyaggatgctgctcctctctacagctaacacatctttagaattagatgttaaatgagaaattagttatttagagtgaataattgtcttagcttgggctgctc

SEQ ID NO: 40107 - DNA, 201 bp, Homo sapiens
aaggaatcttttgttctacccacctttcctgttcaccctcattttccttacccggatgcatttgggaaggtagtttaggaccgtggccttgagtgtgaagrcctctccacgaatcacagagtaaggcattgtgagctccacaaagaagggctggaaggctcggagagaggcagtggaagagataccaagtccagcatcttc

SEQ ID NO: 40108 - DNA, 201 bp, Homo sapiens
aatatgagaataaaattaaataatagatatgggaatactcagtagagcaagtgtcaaatagtagacctttagcaattgttatttatttttaaaagtgttgstcattttttccataagagaatcagtataattggagtagagtcattgtacatgatttctaacctaaaatattttttatgcctggaactctggacaattttt

SEQ ID NO: 40109 - DNA, 201 bp, Homo sapiens
atcttcaagacacggcactttaaggccatcttctaagttaagtcctctgaaataatagccatgtagttcgctggaatgtagctgactatacacctagatgktagaagagagtcaactgtattttttcatagaaaacaattcatttttccccacaagcagtatataaataacctatataatcctatgaatatcctatgtaga

SEQ ID NO: 40110 - DNA, 201 bp, Homo sapiens
gaaaacctttaaataagagaggacaaaaaaagacatctcatatcataccccactgtactttcactactttgaatttggcatttttgttgaactagggataktatctcacttataaacactttaaatatagtagaatactttaaaatagtagaaatcaaattcgagggtagacgtaggagcaaaatggggatttatattaga

SEQ ID NO: 40111 - DNA, 201 bp, Homo sapiens
gccattcacacaaaagccacttgcctcccattgggttatcgtatcaggaatgaggaacgaaagattggcagagcctgaggaactggaagaagaggttatcrgtaaaacacattctttgtctgaaccaagaacttaaaattaagtgcagagcaagcagaaaagtattgactgaagctcaaaagtgagttatattgtttggat

SEQ ID NO: 40112 - DNA, 201 bp, Homo sapiens
ctcaactaatagatggatcaatatgtcatctcatgtctgttgcttaatctgtgtttgttttccagaaaaagctgaatcagtggctaatgtgaatgctaatrctccaagcagtgaactagtagccttgacccccgccccttcagtaccgcctcctacactagccatggtgtctagacaaatgggtgactcaaaacccccaca

SEQ ID NO: 40113 - DNA, 201 bp, Homo sapiens
gacgaagtgatgtccaagtttcatactgactagatttcttttcaccgcataattccaaaactaggttataccttggaaaaatgaatttacttttaatttaraatgattattattctctgctcttttttctctctgttgtattctgggattgttcctatagccacctacacacagatccagccccattcactgattcagcaa

SEQ ID NO: 40114 - DNA, 201 bp, Homo sapiens
ttctttgatgtgtttcattatttttggaaaattctcatttcttgtctcttcaaacatgtcttctgcttgttctttctcgtttctccttctaagattctgayaatatgtatgctaagccatttgatattgttttatagcacttgaagataattcaagtgctataaaaattcaaattatttgaaaagaattcaaatgattttc

SEQ ID NO: 40115 - DNA, 201 bp, Homo sapiens
actgagttaggtcagagctgacaggtgctgactctcaagactcagatggtggtctaagctgatgatttgtaaaatccaagtcatttgtgggatgacgttgrcatctttaactctgtgggtatctcttctttcagtgaatattaagtgcttctgcagtgtcaggccctgggctgtgttttagggatgtgaaaatgaataaaa

SEQ ID NO: 40116 - DNA, 201 bp, Homo sapiens
gctgggataatataaagacagaagacttccaaatacaccagaatgaaaacattttctttagctgtactgattggcagttatcatcactaattttttggcaygaataaattggaaatttatgtcagcacccttggataataattaaaaaatatatattataggccgggcgtggtgtctcacacctgtaatcccagcactttg

SEQ ID NO: 40117 - DNA, 201 bp, Homo sapiens
tggggagagtaaaggttatgatttccttttttctctacttcttcctatccatatttgcataaaaacatggtcacacattcttacttgattacttgtagaargacacattccaaagatactaacacctttagggtaaaggacatctcttccttcacaatttattgcagaatgctaggtttacaggagaagcttgaggaatgc

SEQ ID NO: 40118 - DNA, 201 bp, Homo sapiens
atgagacctcagtggggaaaaaaacaagaatattgctataggcttaatcgtaatttatatatttaaggatgatgggaaagatgaccacttctgcagcaaaygtttagcttctttcttttgaaataatctgaatacctatcaggtgctccctttaattaaggagaaaattgcaatggaaggtagagatgtaatattatctta

SEQ ID NO: 40119 - DNA, 201 bp, Homo sapiens
ttaagaactgtttttttcttgccacatacaagattgatgaggatgcggaaaatgagacctcagtggggaaaaaaacaagaatattgctataggcttaatcrtaatttatatatttaaggatgatgggaaagatgaccacttctgcagcaaatgtttagcttctttcttttgaaataatctgaatacctatcaggtgctccc

SEQ ID NO: 40120 - DNA, 201 bp, Homo sapiens
tgggatcacaggtgtgagccactgtgcctggccctcccttaactttagaagagcaactctttatttgtgctgatgcagggtccaagtaggcaaagagacarttaagagcagagcccataaatgtttactcttcagcaaccatctttcaggagtggaataaaaacaacatcaaaatgggacatctggtggtatcataatcac

SEQ ID NO: 40121 - DNA, 201 bp, Homo sapiens
ggagtgcagtgatgccatctcggctcactgcaatctctgcctcctgggttcaagcgattctcatgcctcagtctcccaagtagctgggattacaggtgccmgccaccatgcctaattttttatttttatttttgtttttagtagagacaggctttttgtaccacattcaccaggctggtctcaaacttctgacctcaagtg

SEQ ID NO: 40122 - DNA, 201 bp, Homo sapiens
ttgtgaaaaagtgaaggcaaagtcctattttaaaaaggagacatttgaagtgaggacccagctctgatttttttttttttgcccaaattcctgtctaagaratctggggagtcatgccctacaaactataaattctcatcagatgggttttatttaaccttatatatcgtgttttactttccaatctgactcaggcataac

SEQ ID NO: 40123 - DNA, 201 bp, Homo sapiens
atgtggttcctcaaattctccttagaaccaatttttccatccagctggtccccctcattgatgagttaaataaacctttaagctacattcacgtttgacastttatctgatatttatgtaagactcatgttttgaagtatttgaatgctgtattttgtttctcaattttttatcttgaaaaaaaattcaagcctttagaat

SEQ ID NO: 40124 - DNA, 201 bp, Homo sapiens
gtaaatttttttcaaattagtaattacatcctttgctttaaatacttcacctgaaaaagtgtctgaagaaaaacatattaatgatattattttaaaatatragactgtagggttccccagtgcctggctttctttctgtgtattggctgaaaatcgcagagggccttgaccgctctgtgacccgcccagctacaggttttt

SEQ ID NO: 40125 - DNA, 201 bp, Homo sapiens
ttaaaaagtggagcaaatgatggtttacggagcagggcttactgacttttagcattgtgtacttacacaaaattatagggaaaattcttattgatattaasctctagtaatttgtaacctgtcagattttcctttgaaatttcttaacgttatttgcatgtttttagatgatggtaattaatgtgttcatattataggata

SEQ ID NO: 40126 - DNA, 201 bp, Homo sapiens
ctattatatggatatactacattttgtttgtccatttattcatcagtggatacctgggatgcttcaaccttttgactgttgagagtaaggctgctgtgaayttggatatccatctattgacagacactgtttccacaagcttttaaaaagtggagcaaatgatggtttacggagcagggcttactgacttttagcattgtg

SEQ ID NO: 40127 - DNA, 201 bp, Homo sapiens
ataactcccctccctctagcccctggtaatcactattctacttaccatatctatgtatttgcctattctgtcctttagtgtctcacttattcacttagaayactgttttcaaggttcttccgtgttgtagcatgtatcaaagttatggctgaataacattctattatatggatatactacattttgtttgtccatttattc

SEQ ID NO: 40128 - DNA, 201 bp, Homo sapiens
tttaaccattttcaagtgtacaattgagtggcattaagtacattcacattgttgtacaaccatcactaccatcatctccagaactttttcatcattcccarttgaagctctgtacctcttaaacaataactcccctccctctagcccctggtaatcactattctacttaccatatctatgtatttgcctattctgtccttt

SEQ ID NO: 40129 - DNA, 201 bp, Homo sapiens
gctctttgggaggccaaggtgggaggaatgcttgagcccagggattggagaccagtctggtcgacataggaaaacctcatctccactaagaataaataaayaaataaatactactactaattagctgagtgtggtggcatgggcctgtagttccagctagtggtggggctgaggcagtaagatcccttgagcccaggaggt

SEQ ID NO: 40130 - DNA, 201 bp, Homo sapiens
ctggttttttgttctatgtatattttcaatttccacttatttatttctccatctctaattgtcatatatttagagatacttcactgacatttcctaaattycatgtctttgagttccttagtttctctaattctaatggcttttgctctattttcctaattaagagctgttgatgaaaacctttaaataagagaggacaaa

SEQ ID NO: 40131 - DNA, 201 bp, Homo sapiens
ccctcttttcccaatcagtttaaaagcattaagagattataacctgtcacctgcccttcgcattatactgtgacttacctaagggtatgtaatcagtagaktcaagatggttagaatccttgcacaatactggtttccggaggtgagagttggtaaaaatctttaatcctgttgcctttcaagataaaatcaattttagat

SEQ ID NO: 40132 - DNA, 201 bp, Homo sapiens
gaatataaagatttacctgcattattctcactgtatttctaacatctgacatgacaggcacattaaatgaattaaaagacaaagcaaaagaaaataatcayctcccctcttttcccaatcagtttaaaagcattaagagattataacctgtcacctgcccttcgcattatactgtgacttacctaagggtatgtaatcagt

SEQ ID NO: 40133 - DNA, 201 bp, Homo sapiens
tgaagacaagctttgttgatctggaagttgaatgataaatgtgaatccaatgacgccatacccctgcggataatggcaggctggatgtagcatgttagccrtcatattctgtgtgctccctgcgatgtgggcacttcccttccatcgtggtgaggccaaagcaaaggcacagagacctgaacacaaacatgaaaaacacct

SEQ ID NO: 40134 - DNA, 201 bp, Homo sapiens
aggtaaagacataaaactatactgtgggtggtaaacaaagatggttttaatcactcacagtttgtgctggcagctgaccataattccttagtagcaatacmctctggtctaccgcccaaagagcataaagagagtttgaagcagccgagacttgaagatcgacattggatcctggtaaacttttttctttagaaaaattta

SEQ ID NO: 40135 - DNA, 201 bp, Homo sapiens
attagcaccagcaagtgttctgggagcccacagtcaactttgtattattgcctcacttaagcgagaatagagtgaaaacaaacccagttgctgtgcccgtygcacatgcacatccgttcattggaattaaactgtcagccttcatcaactgcagtgtctgtggaaaccagggagctaccacagttctgggaaccgcactga

SEQ ID NO: 40136 - DNA, 201 bp, Homo sapiens
actgtattccagcctgggcaatggaatgagactgtgtctcaaaaagaaaaaaaaaaagaaattggcatcatttgcagggcattgtcttgaatttgtcatckgttcttgaattgcagttgacagtgtaggcattagcaccagcaagtgttctgggagcccacagtcaactttgtattattgcctcacttaagcgagaataga

SEQ ID NO: 40137 - DNA, 201 bp, Homo sapiens
aaaaattagccgggtgtggtggcgggcgcctgcagtcccagctactcgggaggctgaggcaggagaatggcgtgaacctgggaggtggagcttgcagtgasccgagattgtgccactgcactccagcctgggcgacacagcgagattccgtctcaaaaaaaaaaaaattgccagtatggcccgtagtcttagctactcagg

SEQ ID NO: 40138 - DNA, 201 bp, Homo sapiens
tttcttcctaccagacggtgttgagatacaatattctccctcccacaaatatgaagacctttagtcttagtgtggaaataggaaaagctagatgtgagcarccgacttcacctcgatccttgactctcactattcacaccaggtgattaaagctggggtgctggtggccggcagagcacctggtcataggagctgagctgg

SEQ ID NO: 40139 - DNA, 201 bp, Homo sapiens
ggaaaggagctgtgaaggacaagtgtcagatctgctgctgctgcttcaagactcagcctccctgaaacatcactctttcttagcaacctgcagggagacamccagatttttccatcagaggtttcttataccgtctaaacatattttcattctacgtgacaacacacaaatcggaccagtaagatagagatcaagagttta

SEQ ID NO: 40140 - DNA, 201 bp, Homo sapiens
actattttaaccattttcaagtgtacaattgagtggcattaagtacattcacattgttgtacaaccatcactaccatcatctccagaactttttcatcatycccaattgaagctctgtacctcttaaacaataactcccctccctctagcccctggtaatcactattctacttaccatatctatgtatttgcctattctgt

SEQ ID NO: 40141 - DNA, 201 bp, Homo sapiens
gcttaaatgccttcttttaaaaagttttcccttaattcactggaatccaataagttccagactgcaatgttgagaaagttgggatataaggaagaaaacaygcgtgcacgtgcatgtgtgtgtgtgtgtggtggcctccacttccttcaggcccctcagatccttcctatccacccagcaatctcttggaaaagagcttgc

SEQ ID NO: 40142 - DNA, 201 bp, Homo sapiens
cttcagttatagtcatattcttgtgtagtggaatatatacttagtagatgatggagttggacattatgaggacattatgaggtattcaaattgacaccacrcattgttacacatttctctaacccttaatctgaaaagtggtggagcagggaagacccagggctgccatattccattttatctcccatttcatttccaaga

SEQ ID NO: 40143 - DNA, 201 bp, Homo sapiens
gcaatataacatagcagaagctttgaaaaatcaaaaaataattcaaacaaaataactctccatctgtatacagctatttcctgggtatagcctttgaccaygtgcacttgtgtaagcttgtattttcttttttctttttgttttttgagacagggtctccctcaatcagccaggctgtaggtgatagatttgtgtgctgct

SEQ ID NO: 40144 - DNA, 201 bp, Homo sapiens
ctattgtaagggtagatttcaaaaatgagtttcccatttgccaagaaggaaggaaatctttccctcctccccttcttagagcatttctgtcagaaaacctygtggctgtaaagcctttttctagccttttaaaataaaaatatttcactttagatgctaagtgcaagggcattatcctacatagccaaataaactgatctc

SEQ ID NO: 40145 - DNA, 201 bp, Homo sapiens
ttatttacttggtaaactttctatgtaagtacagtttttttttttctggtactcaccatggctggaatgctcacattttcaacatataccccagtatcctragaacttctagagtactaatttcatctctggggaagagggatagaaattttggtgaaagcaatacaaaaaagtactattgattgaattctggcactgaac

SEQ ID NO: 40146 - DNA, 201 bp, Homo sapiens
ccctgtcctggccctagaattagccatttcttcaaagagcccctgattcctatgttgccttctgatgtggtttggatctgcatccccacccaaatctgacrttgaattgtaatctccagtgttggagatggggcctggtgggaggtgattggatcacgcggatggtttttcatgaatggtttagtaccatacccctagagc

SEQ ID NO: 40147 - DNA, 201 bp, Homo sapiens
agaaggaaggaaatctttccctcctccccttcttagagcatttctgtcagaaaaccttgtggctgtaaagcctttttctagccttttaaaataaaaatatktcactttagatgctaagtgcaagggcattatcctacatagccaaataaactgatctcacacagagaatttataactgtacaaggtattctattttctaat

SEQ ID NO: 40148 - DNA, 201 bp, Homo sapiens
ttaacttgcttattttttaacattaaaagactggaagatcctccaagcttattttgtactttccctgtcctggccctagaattagccatttcttcaaagarcccctgattcctatgttgccttctgatgtggtttggatctgcatccccacccaaatctgacgttgaattgtaatctccagtgttggagatggggcctggt

SEQ ID NO: 40149 - DNA, 201 bp, Homo sapiens
atctcacataaaaggctgggcacagtggctcacacctgtaatcccagcacttgggagaccaaggtgagagaatcacttgagcccagcaattcaagactagyctgggcaacatagtgaaaccctgtctctacaaacaaaaaaaggaagaagacaaaggagaaagagtagaaggagaaggagaagaagaaggagaaggaagaa

SEQ ID NO: 40150 - DNA, 201 bp, Homo sapiens
actcatcactggtggttcacgcagtgaaccctgttcatgtggttgaggtggtatttgccaagattctttaatgaatagttactatttccttttatccatartgtactctttggaagtgagtctcttatccctgactaccctcaaagggaggagagttaaattccacatcctgaatggggagtatctacatatattatttgg

SEQ ID NO: 40151 - DNA, 201 bp, Homo sapiens
caggacatcagcattcttgctgctgaccccctccccttgtcaccccagtaaagggcaggaccctctctggggaaggttttaagacccacaatcagaaaggyaggggaaaattagagtcctgccttgaggcagatgaaaggagggcagaagaaggccagaggccttccccttggggcctgacacactcaacattataagaaa

SEQ ID NO: 40152 - DNA, 201 bp, Homo sapiens
ttatgtttatcagtttattataaagtatattacaaaagatacagatgaagagaactgtagggcagggtatggggaaaggggtgtggagcttccatgccctytctgggaaggctgctctccaggaatctccacaggttcagtcatctggaagcattctgacacagttctcttgggtttttatggaagcttcaggacatcagc

SEQ ID NO: 40153 - DNA, 201 bp, Homo sapiens
ccagcctcaagtatttctttacagcaacacaagaaatatacaaatgacaatatgcagccatttgtatattgtctgcatcccaaattcaatgtaaacttcaygaatataaagatttacctgcattattctcactgtatttctaacatctgacatgacaggcacattaaatgaattaaaagacaaagcaaaagaaaataatca

SEQ ID NO: 40154 - DNA, 201 bp, Homo sapiens
tcatctcagatgttattagtgaggtaatattcagtattttatagaatatttagatatttatctttccaggagctcatgtgctttggtaatgaggcagaatrtctttgagaaagatagaagtgagaccttagggatgggtgtctgcctaactgaagtggactccagtgaaaattatataaatatcaaggcatgaaaattcag

SEQ ID NO: 40155 - DNA, 201 bp, Homo sapiens
gagccacagtgggaattctgatcattgctagacttgtcaattatacctacacatttggaaaatgaataaataaccagaagatggatctggtctctgttagwcctacaatgaagacaatttggccccaaattctggttattcctgatagtcataatctttgcctctcatctcagatgttattagtgaggtaatattcagtat

SEQ ID NO: 40156 - DNA, 201 bp, Homo sapiens
ctctgtacccctaccttctctctctccttttggatcccaggagacattatgggcacagccctgcagaacctggatggtctggtgcagatgcccagtggctrtggcgagcagaacatggtcttgtttgctcccatcatctatgtcttgcagtacctggagaaggcagggctgctgacggaggagatcaggtctcgggcagtg

SEQ ID NO: 40157 - DNA, 201 bp, Homo sapiens
aggaaaaggcgaatggaggctgcaaaggtgtggagtggggcgggacatacggacctatccggagagtgtaactaataacaagtgatgaaggaaaaagagcstattttatataggagggaaatacagtgtaggcaacagtacagatgggattagacttgtactctagttaaaaatggaagagagtcagggtaggaagaaggt

SEQ ID NO: 40158 - DNA, 201 bp, Homo sapiens
aagaaagaaaggaagagagaaagaaagagtcctagatgagagagagagagagaaagagagaagggaagggagggagggagggaggagagtcctagaccagkggtccccaatcctactggtctgtggcttgtcaggaagtggaccccacagcaggtggtgagcagtgagcaagcaagcagagcttcatctgtatttacagct

SEQ ID NO: 40159 - DNA, 201 bp, Homo sapiens
gcggtcttgctctgttgcccaggctgttctcaaactcctgggttcaagtgattctcccgcctcacccttccaaagtactgggattacaagaatgagtcacygcacctttaacttgtttaatcctcacccccaaccctatgggatgtcagtcactcatagattaaatccttgcaactcaaagtttgattttcatatgtatga

SEQ ID NO: 40160 - DNA, 201 bp, Homo sapiens
gattcaatatgcaagatcaccccctacacccacagacaccagtcacaagtctgggcctctggaacatctgaccaataagcttcaagttgggatttccacarcttcccctttgagttcagttaatttgctggagcagctcacagaactcagggaaacccttatgtttatcagtttattataaagtatattacaaaagataca

SEQ ID NO: 40161 - DNA, 201 bp, Homo sapiens
ttctggaatagtcacttgattctttttggtagtttctacttctctgagattcttcaaatttttattcattatgactatattttcttctaagtctttgaacrtatttatgcagatattaaagtccttgtttgctagttccagcatctatgttacataagtttcttttctacttactgacttttctttgatccatggcccata

SEQ ID NO: 40162 - DNA, 201 bp, Homo sapiens
caccatgttggccaggctaatattttatgtttttagtagagacagggtttcaccatgttggccaggctggtcttgaactcctgacctcaaattatccacckgcccccgcctcccaaaatgctggattacagctgtgagccaccgtgcctggccctcattcagttatttttaaaaattatgaatgctgttctgttctggaat

SEQ ID NO: 40163 - DNA, 201 bp, Homo sapiens
aaaatatagataagcatttagatcacaagttccccaaactggtctttgtagcagcaatttaggaatcacctgggtggtttttaaaaatacatattctgccrggcacggtggctcactttgggaggccgaggcgggcggatcatgaggtcaggagatcgagaccatcctggccaacacggtgaaaccccatctctactaaaa

SEQ ID NO: 40164 - DNA, 201 bp, Homo sapiens
ttccacacacgaggagccacagtgggaattctgatcattgctagacttgtcaattatacctacacatttggaaaatgaataaataaccagaagatggatcyggtctctgttagacctacaatgaagacaatttggccccaaattctggttattcctgatagtcataatctttgcctctcatctcagatgttattagtgagg

SEQ ID NO: 40165 - DNA, 201 bp, Homo sapiens
cgtcacattgtggtgactttcctccctgaaccccttcagagtgcagcatattacaggttaggagtgcctggttaaaggcagatggaatgatctagtttcarctaaacctatctttacacaacagataagtggctttaaaagactcctacagagaaactgctggttttcaagataactctaataatgcatgtggcggcaaac

SEQ ID NO: 40166 - DNA, 201 bp, Homo sapiens
attttcagggaactgtgagtataatggcaacttctagttcatttaggataagataggcagaaccttttcacatccactccaatgtgtttattccacacacraggagccacagtgggaattctgatcattgctagacttgtcaattatacctacacatttggaaaatgaataaataaccagaagatggatctggtctctgtt

SEQ ID NO: 40167 - DNA, 201 bp, Homo sapiens
tgcaagtgaggcctctgagatgcaggaagaccagaattcctagtccattttatttttatttaaaaaagcaagaatttaaactttactgacattgattatasagtatgcactggatttgtcactctgaatctatgtcaccgttatgtgtcacctcctcggggaagaacagaagcgtcacattgtggtgactttcctccctga

SEQ ID NO: 40168 - DNA, 201 bp, Homo sapiens
tctgttctgagactgggaatcagaagggagtgaaatggggaggccatggaagagtttattttcagggaactgtgagtataatggcaacttctagttcattkaggataagataggcagaaccttttcacatccactccaatgtgtttattccacacacgaggagccacagtgggaattctgatcattgctagacttgtcaat

SEQ ID NO: 40169 - DNA, 201 bp, Homo sapiens
tcaacagtgttcagtggtcaggaggaagaaagacctatgtgtcactgagcagagactgtaacttcctgccttcagttattcccagttactcttagaagtgktttatttatctttgcaaaatggatctcacagtcatggggtgccgctgccacagtggcggggcccacttagtgactgccaaacttcagacttgaaagggta

SEQ ID NO: 40170 - DNA, 201 bp, Homo sapiens
tcaataccttcaggctgtcaaagaataacacaaacaagcacagaagaatgagtctagatcctctgtccatgaaggaaaagtgattaagcaccagctcactyaagcatggctggtgcaagtttatccctgagagaagatccaactcatcttccccttttgttcatatctggaaggcacgggacatcaccggtacccatttta

SEQ ID NO: 40171 - DNA, 201 bp, Homo sapiens
atttcccaacatatgcgtttcacttccagtaaagaagttagaagactccattcccagattaccttgaatccagggggcaggtaaatgacaggctcgaccartgagatgctctgttctgagactgggaatcagaagggagtgaaatggggaggccatggaagagtttattttcagggaactgtgagtataatggcaacttct

SEQ ID NO: 40172 - DNA, 201 bp, Homo sapiens
attgttttgctgtttagaccgagataagttcttcaatgcctgctctcaagctgatttagtctatgaaaatgattttcttatggatggaggctttcctatamctttactttgctgttgatatatttcttttttatactaaatcttttttggtgggaactgtttagacctatgaccttagaacactggcctgacttggagaaa

SEQ ID NO: 40173 - DNA, 201 bp, Homo sapiens
tataaaaattaaactactggcccataatcagtatagctcgcctcatgatagattattctcaggctaaatttataacaggcactcaacaaaagtattcatckcttatcccctaacattatctagtagctataggagccggtgacctagtaaataataaaaaaaaatctttaggggtggaatgtaactatatgcagtagcggt

SEQ ID NO: 40174 - DNA, 201 bp, Homo sapiens
atggagacctttgttcctgtgggaaaataaccctcccacctgcaacagctgcccctgctgactgcgcctgtcttctccctctgaccccagagaaaggggcygtggtcagctgggatcttctgccaccatcagggacaaaccgggggcaggaggaaagtcactgatgcccagctgtttgcatcctgcacagctacaggtcct

SEQ ID NO: 40175 - DNA, 201 bp, Homo sapiens
attctcaggctaaatttataacaggcactcaacaaaagtattcatcgcttatcccctaacattatctagtagctataggagccggtgacctagtaaataawaaaaaaaaatctttaggggtggaatgtaactatatgcagtagcggtaattctgctccatttgtaaggagggtgaaatgcgatatggtcatgtaccctctt

SEQ ID NO: 40176 - DNA, 201 bp, Homo sapiens
caattatgccaagggccattaggctctcaacatgactatagagaccccgtatcatcatggagacctttgttcctgtgggaaaataaccctcccacctgcarcagctgcccctgctgactgcgcctgtcttctccctctgaccccagagaaaggggccgtggtcagctgggatcttctgccaccatcagggacaaaccgggg

SEQ ID NO: 40177 - DNA, 201 bp, Homo sapiens
actgagagcaagagaaaaggcatcaatcccagttgttaatccacgaggcatcccccagacccttctgtaaaggttaatgaaggcagtaaggcagttatctytgtttcgtgcactgatgcaatccaagcttccacggtttagcacatagtagacgctctataaatatttattgaatgttgaacgatgagagagtaattaaaa

SEQ ID NO: 40178 - DNA, 201 bp, Homo sapiens
ctaccccgacaccagcaattatgccaagggccattaggctctcaacatgactatagagaccccgtatcatcatggagacctttgttcctgtgggaaaatawccctcccacctgcaacagctgcccctgctgactgcgcctgtcttctccctctgaccccagagaaaggggccgtggtcagctgggatcttctgccaccatc

SEQ ID NO: 40179 - DNA, 201 bp, Homo sapiens
cctggctgtccttggggcgttccagggcagctcccctcctggaatagaatctttctttccatcctgcatggctgagagccaggcttcctgcttggagtccrcaggaggctgtggcagcagtggcatccactgtggcatctccgtcctgcccaccttaagaggtgagatggagcaggtccatctgcctctgccctttctagc

SEQ ID NO: 40180 - DNA, 201 bp, Homo sapiens
tgggtcctggctgtccttggggcgttccagggcagctcccctcctggaatagaatctttctttccatcctgcatggctgagagccaggcttcctgcttggwgtccgcaggaggctgtggcagcagtggcatccactgtggcatctccgtcctgcccaccttaagaggtgagatggagcaggtccatctgcctctgcccttt

SEQ ID NO: 40181 - DNA, 201 bp, Homo sapiens
gaacagtgggtcctggctgtccttggggcgttccagggcagctcccctcctggaatagaatctttctttccatcctgcatggctgagagccaggcttcctkcttggagtccgcaggaggctgtggcagcagtggcatccactgtggcatctccgtcctgcccaccttaagaggtgagatggagcaggtccatctgcctctg

SEQ ID NO: 40182 - DNA, 201 bp, Homo sapiens
tgaatgaacagtgggtcctggctgtccttggggcgttccagggcagctcccctcctggaatagaatctttctttccatcctgcatggctgagagccaggcytcctgcttggagtccgcaggaggctgtggcagcagtggcatccactgtggcatctccgtcctgcccaccttaagaggtgagatggagcaggtccatctgc

SEQ ID NO: 40183 - DNA, 201 bp, Homo sapiens
aacaataagtaacaattaggccaggcacggtggctcatgcctgtaatcccagcattttgggaggccggggcgggcagatcacctgaagatgggagtttgasaccagcctgaccaacatgaagaaaacccgtctctactaaaaatacaaaattagctgggcgtggtggtgcatgcctgtaatcccagctactcgggaggacg

SEQ ID NO: 40184 - DNA, 201 bp, Homo sapiens
gcagggatcctgttacaaaggtgaaacccaggaggagagtgtggagtccagagcgctgccaggacccaggcacaggcgttagctcccgtaggagaaaatgsgggaatcctgaatgaacagtgggtcctggctgtccttggggcgttccagggcagctcccctcctggaatagaatctttctttccatcctgcatggctgag

SEQ ID NO: 40185 - DNA, 201 bp, Homo sapiens
gtcacctggacccctgctgctggcattggccacaaagcctcctggtctggctccaaagcctggcagggtcttttccccgggggagctgcaggcagggaacrgtcctgatgggtcatccccttcactcccagcccagagcccccggccaggcacccccagggaaggctctggtggagaacctgtgcatgaaggccgtcaacc

SEQ ID NO: 40186 - DNA, 201 bp, Homo sapiens
ctgccccctccggaagcttggatgcccctccacaccctcttgatcttccctgtgatgtcacctggacccctgctgctggcattggccacaaagcctcctgktctggctccaaagcctggcagggtcttttccccgggggagctgcaggcagggaacagtcctgatgggtcatccccttcactcccagcccagagcccccgg

SEQ ID NO: 40187 - DNA, 201 bp, Homo sapiens
tttcattctttccttccttttgttctttctttcaatctccctcccctccccttccctttcctttatttaagagggctggtagcatcctactttctactatyttagttatcaatagactaaattagaaaaaaaattagcattgtttaattatgagataaatgaactataaacctaaatatttaccagaaaagagcagagcag

SEQ ID NO: 40188 - DNA, 201 bp, Homo sapiens
gatgcgtctcactatgttgcccaggctggtcttaaatactgggactcaagtgatcctcccacctcagcctcacaaagtgttgggattacaggcatgagccwttgtgcctgacccattttttgttttgttttgttttgagacagaatcttgctctgttacctaggctggagtgtagtggcgcgatctcagctcactgcaacc

SEQ ID NO: 40189 - DNA, 201 bp, Homo sapiens
ttaactatggagatcctggtgctacaagccgttaaatagttctctcttctcaacctattcccctatcctgcttttcttttcttcatagcacttattacctyctgattatattttttgtttgccttttgtctatcacctgtcattcttttaccagaccatctagtctcatatgtctatataacctttctgaaaaacatcctg

SEQ ID NO: 40190 - DNA, 201 bp, Homo sapiens
ctcagcttccaattcagtgaaactattcttaagcatgttaatgaaaatatacttctttcctggatcctaaaaggtctaaatgaaaacaactcctattcctraggatggaaaacaagtattctgcaaaagccactaccaatccgtaccttggttcccagacatatctctagaagagacagaaacaagccctttaatataatt

SEQ ID NO: 40191 - DNA, 201 bp, Homo sapiens
cgcaaggagctaccagaggcagaatgaagagactgaagcaatgacagccacttattttgaggaattacgtgtcattgatgactatgccaaaacattttgtrttagaattagtgatgatattgattaccccaaatggacactttgctcataggtgatgctactgaattaatatacaggtacagctccacctacttattagta

SEQ ID NO: 40192 - DNA, 201 bp, Homo sapiens
ctctcagcttccaattcagtgaaactattcttaagcatgttaatgaaaatatacttctttcctggatcctaaaaggtctaaatgaaaacaactcctattcytgaggatggaaaacaagtattctgcaaaagccactaccaatccgtaccttggttcccagacatatctctagaagagacagaaacaagccctttaatataa

SEQ ID NO: 40193 - DNA, 201 bp, Homo sapiens
gattaaagaacacttgagaggcaaagatcagaggatctcagcagggtgcttttgccctagacttatatagagaggagtaaacaagctgaagtggggtgatmtgcagttggggttgttttgtatgcagaactgtctgtcacttagctgaaccagaaatattattctcagggaaacaaattgttctaatcttagctagtcaac

SEQ ID NO: 40194 - DNA, 201 bp, Homo sapiens
atcctttggggcagatacaatgttgaggattgcctcaacagactctgaagaaattgcaataatatttggaataaaaggcctttcttgcatttcattttttraaaaatattgtatcatgtttaggatgtaaaaattttgtgacttttctatagaattgttagccagaaatgttatattgagagatacatatgttctatgaag

SEQ ID NO: 40195 - DNA, 201 bp, Homo sapiens
gggctccatgagatccatttagttgcattcatcctcctgtccccaaagtatatcagtaaatgtactgtttcttgacagtttggctgtgttatcccagaggmctggatgtgggaatctccaaatggccagataatactctcagcttccaattcagtgaaactattcttaagcatgttaatgaaaatatacttctttcctgga

SEQ ID NO: 40196 - DNA, 201 bp, Homo sapiens
ttggcctagacgggatctctcagccttacaagccctctccaggtggtaggtacagagtggagagaggctgagttttgatcacagtcggagagggctgacgraaggggtagaacggagcagctggtgacatgggtgatgacccgggagttcctgacgtccacccactgggctcttgtctcctccccacgtgtgtggtgatgg

SEQ ID NO: 40197 - DNA, 201 bp, Homo sapiens
caggcctgtggccaggagagaggccaggtgacagaggccctgctcctctctgtggttggaggaaagatgagtgaagggatcaacttctctgacaacctaggccggtaagtagtggttctgctcatctcctgggtcgtgatacatggccggccctcactcccagcagctgggcccctgcctgctgtctgctgccattagagc

SEQ ID NO: 40198 - DNA, 201 bp, Homo sapiens
tgaacccgggaggagaaggttgcagtgagccaagatcgcgccactgcactccagcctgggcgacagagtgagactctgtctcatgaaacaaacaaacaaamaaaaaaacagaacaaaaagataaaaaaaaaaaagtaggggaagaactggagggaggaattacacaggagcactgaatatattcactatcttgattttggt

SEQ ID NO: 40199 - DNA, 201 bp, Homo sapiens
ctccggggttcaagcgattctcatgcctcaacctcctgagtagctgtgattacaggcatgtgccaccacacccagctaatttttgtattttagtagagatrgggttttaccatgttggccaggctggtcttgaattcagttgatccgccagccttggcatcccaaagagctgggattacaggcatgagccaccacgcctgg

SEQ ID NO: 40200 - DNA, 201 bp, Homo sapiens
gtgctagggtgtttgtcgtgctcctggggcattttggtagacagatctaggaaatgttttcagagtgaatccatactggtatttctttctttctttctttytttttttttttttgagacacagtctcgctctgtctcccaggctggagcgcagtgacccgatcacggctctctgcaacctctgcctccggggttcaagcga

SEQ ID NO: 40201 - DNA, 201 bp, Homo sapiens
attttagtagagacggggtttcaccgtgttgcccaggctggagatagttgttatatttttaggaaataatgacaagaaaaaaaagtctatacatgctgttyagtacagatacaaatttttttccccaattttttcaatctgcggttggttgaatctacggatgtgaaacctacagatacagaggtctgactgtacttattc

SEQ ID NO: 40202 - DNA, 201 bp, Homo sapiens
gcttgaacccaggaggcggaggttgcagggagccgagattgagccactgcactccagcctgggcaacagatcgagactccatctcaaaaaaaaaaaaaaaragagatggagaggacagtatggtccacctctgtgggctggttgtcctagagattaaatggtgtttaatttaaagagaaagcactagcacttgtgcctcag

SEQ ID NO: 40203 - DNA, 201 bp, Homo sapiens
gcaacctctgcctcccgggttcaagcaattctcctgcctcagcctcctgagtagctgggactacaggcacacaccaccacacagggctaatttttgtttttcgtttttgtttgtttgagacggactcttgttctgtcacccaggctggagtgcagtggtgcgatctcagctcactgtaaactctgcctcctgggttcaagc

SEQ ID NO: 40204 - DNA, 201 bp, Homo sapiens
tttgttttgtacttttagtagagatggggtgtcgccatgttgcccaggctggtctcaaactcttgagctcaagcaatacacccacctcggcctcccaaagkgctgggattacaggtgtgagccaccgtgcccggccttgttctctcatcttatagacaaattcaccgaagcacagagaggttacggcacttaatcaagctc

SEQ ID NO: 40205 - DNA, 201 bp, Homo sapiens
cctcctgtatacatatcttccttttgtcctcttctgtcgcttttaataccgtgtggaggtgcaaaaccccttctagtaatggctggggaaaaaaagtcatktaagtcccagggtgaaataagactttctaaaaaaaatacttgagtctcaacctctaaaacctttcaagtaccccgatatttcttttcatcttgtcacaaa

SEQ ID NO: 40206 - DNA, 201 bp, Homo sapiens
tttgtctgcacccagccccctctcctccctttggtggcttcctgtgtgtccagggctagcgtcttctaggtgaatctaagatgtcagtaccttagccctcrgctgcttgctcagagcctggtttgtgttctttccccagctctgccaggcccattcccagctgctgcagtacatggagcgatacgggtgagatgtgactct

SEQ ID NO: 40207 - DNA, 201 bp, Homo sapiens
taagattgggtgcccattcctctccttggggatggttatgagcatgtgagtctcacagttgaccatatccaccttacagttggactggacaatacacttgrgactgtccttatctcccaggtgtccttacacatctagattccctccccaccaattgggaaacagtgacagcccgtcatagacagaaaaagtgggcttctt

SEQ ID NO: 40208 - DNA, 201 bp, Homo sapiens
cagttatgcaggcctgcactaagtgaaacagctgactgacaaccaccccctcctcattatttcctttactcaataaatacaaagggctatagaagctcagrgcccttgttcactagaagcaaggagacccctgaccccttcttccaaatatacttgtttgtctttgtctttattcccgcattcgtcctcctttgttcagtc

SEQ ID NO: 40209 - DNA, 201 bp, Homo sapiens
tgtgatggtgaccttgaaccatcactctttgtagactctaggtcttttcccaacccggtggaaactagcagggagattccatacttgaggaattcagcctyttgctttttctctgacccacagtggacactggaggaaaccttcccttccttcccttttctcttagctcccaccagcctaagggctgtggaaaccagtacc

SEQ ID NO: 40210 - DNA, 201 bp, Homo sapiens
agacggggtttctccatgttggtccggcttgtctcaaactcccgacctcaggtgatccacctgccttggcctcccaataacatccctactttaggctacaycatatataatgagtttagttggttaatggctacccaaattcaagtagtaagcaaagtacctttatgccttgagaggcatgaaaacagcagcctccaggct

SEQ ID NO: 40211 - DNA, 201 bp, Homo sapiens
ctgtgcctgggctgaattgaggctgggatgtgatggtgaccttgaaccatcactctttgtagactctaggtcttttcccaacccggtggaaactagcaggsagattccatacttgaggaattcagcctcttgctttttctctgacccacagtggacactggaggaaaccttcccttccttcccttttctcttagctcccac

SEQ ID NO: 40212 - DNA, 201 bp, Homo sapiens
tttttttttttttttgagatggagtttcgctcttgttgcccaggctggagtacagtggcgtgatctcggctcactgcaacctctgcctccccggttcaagygattctcctgcctcagcctcctgagtagctgggattacaggcatgtgccaccacgcctgggtaattttgtatttttagtagagacggggtttctccatgt

SEQ ID NO: 40213 - DNA, 201 bp, Homo sapiens
tggggtgtgcccactggtttctgactgtgaaacccccacgacatcccaccagctctactgacctgtgcctgggctgaattgaggctgggatgtgatggtgrccttgaaccatcactctttgtagactctaggtcttttcccaacccggtggaaactagcagggagattccatacttgaggaattcagcctcttgctttttc

SEQ ID NO: 40214 - DNA, 201 bp, Homo sapiens
tttgagaccagccttaccaacatgaggaaaccccgtctctactaaaaatacaaaaattagccgggcgtgatggcacgtgcctgtaatcccagctactcggratgctgaggcaggagaatcccttgaacccgggaggtggaatttgaagtgagccgagattacgcgccactgcaccccagtctgggggacagagacagactc

SEQ ID NO: 40215 - DNA, 201 bp, Homo sapiens
ggcaggcggatcatgaggccaggcgtttgagaccagccttaccaacatgaggaaaccccgtctctactaaaaatacaaaaattagccgggcgtgatggcaygtgcctgtaatcccagctactcggaatgctgaggcaggagaatcccttgaacccgggaggtggaatttgaagtgagccgagattacgcgccactgcaccc

SEQ ID NO: 40216 - DNA, 201 bp, Homo sapiens
taatctataacaaaaggtcggcaattaagaggtcgtgcttcgtgatctggtctccaaagtcaactttcctcagggactttcagaatccccaaatagactayccactttctttcacacttatttgcctctaacttgttgatttcttttttttttttctgttttttaagggttaacaatctcttgggtgcactctgacttcca

SEQ ID NO: 40217 - DNA, 201 bp, Homo sapiens
caagtaaggtcacactcacaggtaccaggggttaggacttcaacacatcctttggggcagatacaatgttgaggattgcctcaacagactctgaagaaatwgcaataatatttggaataaaaggcctttcttgcatttcattttttaaaaaatattgtatcatgtttaggatgtaaaaattttgtgacttttctatagaat

SEQ ID NO: 40218 - DNA, 201 bp, Homo sapiens
tatacaatgcaaaatggaccaaatatagtactcaagtataacctcattctaacttaaatcttaattacatctgcaaagactatttccaagtaaggtcacaytcacaggtaccaggggttaggacttcaacacatcctttggggcagatacaatgttgaggattgcctcaacagactctgaagaaattgcaataatatttgg

SEQ ID NO: 40219 - DNA, 201 bp, Homo sapiens
gtctgggcatggcaaaggcaggaaggttgtttacagaacaggtagctaggagacaaggaagtacaaggaagttggttttaagaaacaaagaacagggaackaaagctttttgaagaggaatttatcatctctgacacttcttgtacagtctgcagaactgtgaggcaattaaacttcttttctttgtaaattacccagcct

SEQ ID NO: 40220 - DNA, 201 bp, Homo sapiens
cgcttagtatagctcatctttgtcttgttcacccttcacttgtctgcatacgggaaaatcaacacccccaaaaatcccctaagaccattacttataaaatmacatgaaaacttctgttaacacgcttgataaatgagtctcaactgatttctctagcctcactttttatcactgccatcaacactgtcctgacttttcaac

SEQ ID NO: 40221 - DNA, 201 bp, Homo sapiens
ctgctcggtatctggggcatgaatctgatatatgctatacgtgtcttatgtatcagtatatgtctttcagaatgctattagtctgtgtctaaccttatcayagtactcccccattcctcacttcaaatcaagatgcataactacgctgggaacacagtaattgttgatcctgacttgccacctagtgtcaattattgattt

SEQ ID NO: 40222 - DNA, 201 bp, Homo sapiens
tcctgctactcttcaatcatccaacatattaacttctccatagctttcttttatttttcattttgcaattctatgaaaaattgggagtttaaacccaacastctcttaagttctccttagttttcccccaaattaaaaaagaatcatttttggcacctacctgattttcgaagcatttctcaattggaattgggtgctatc

SEQ ID NO: 40223 - DNA, 201 bp, Homo sapiens
tatcagggcttcagaaggaaggtctgcatggagcacttggaaggttgggttccaggcccagctgcttgttcttggtcaaagattcctatcctctgggcccrcaatgtggccacagagtggtggatctagaatggtcatgtggactacagacagatgccggtggcggagtgggtgccatatcttgatcctgtatttggtcac

SEQ ID NO: 40224 - DNA, 201 bp, Homo sapiens
taaatctccctgagcctaagattagacattaatcaaaatgggaatactgcattagttctatagggttgattaatatgagaataaaattaaataatagataygggaatactcagtagagcaagtgtcaaatagtagacctttagcaattgttatttatttttaaaagtgttgctcattttttccataagagaatcagtataa

SEQ ID NO: 40225 - DNA, 201 bp, Homo sapiens
tagaactgtcatcatacctataccaaataaacacatattgagaaagtataggatcttagatctgtaaaaactttgaaatactatttaatcagttaaataaytgctggctaaatcacattaaaactaacaaaaagtccatgaggctcaactggattttaatacattccagataaaggcactgctcaatactctttgaggact

SEQ ID NO: 40226 - DNA, 201 bp, Homo sapiens
tgctggaattgtgaattgcaaatccattcttatcagagtgaaatcagaacttcaaccctaatcaaaattgattggatgaattattgagtgttacaaaagtkatgcaatgaagggccctcatatttttgacattcatttttattagatccttcttatctggagattaggtatgtgagaagctcggagaaataatcttagaag

SEQ ID NO: 40227 - DNA, 201 bp, Homo sapiens
tcttatgaaacaaacaagtagcttttggtagagcctgtgagggcttaagaaccctaatgtctataaatcttagaggattatacactatgctttggtcatamaaacttgtactgcctttattcttttttctttttttaaagtattgtaattgtacatacttaaaggatacaattggcggggcacagtggctcacacctgtaa

SEQ ID NO: 40228 - DNA, 201 bp, Homo sapiens
ttgtgttggtccatcctttaaactcttcatctacacaggacagctacaaatagcaactggttaccatatcttttaacagcaaattggtgtgtcactgtctyccttgagtttcttttcacaacaatccagtaatctccaaacattggttctgaaatcagttggaacgagagttgggtaatatttcggaaagaagtcacattt

SEQ ID NO: 40229 - DNA, 201 bp, Homo sapiens
gggattctagaaaaaatgtatattttctaggggaaaaagaaggcaggaatcagaataaggatactggggaaggagagaggagcagcaaagtgctgatgacraagccaaccaggtcaaggaagggagacaaagaaaaccagttctagcttcacctactcctgcctaagtctaacacaaatgttgtgttggtccatcctttaa

SEQ ID NO: 40230 - DNA, 201 bp, Homo sapiens
ttgaacctgggaggcagaggttgtagtgggccgagatggtgccattgcactccagtctgggtgacagagggagactccttctcaaaaaaaaaaaaaaaaaraagaaagaaagaaagaaaagaaaatcacttcaataggccttttgattgtgaaaaagtgaaggcaaagtcctattttaaaaaggagacatttgaagtgagg

SEQ ID NO: 40231 - DNA, 201 bp, Homo sapiens
agagatggtcaagctctgtcctgaggtcatgcagctcatgagtgtggagctggggtgtgcccactggtttctgactgtgaaacccccacgacatcccaccrgctctactgacctgtgcctgggctgaattgaggctgggatgtgatggtgaccttgaaccatcactctttgtagactctaggtcttttcccaacccggtgg

SEQ ID NO: 40232 - DNA, 201 bp, Homo sapiens
cctatcatgcgccatgcatggcaccaggtgtctctggtcttcacgctgactctgccatgggggtggtgttcctgttttacattggaaacgtggagattcaragatggtcaagctctgtcctgaggtcatgcagctcatgagtgtggagctggggtgtgcccactggtttctgactgtgaaacccccacgacatcccaccag

SEQ ID NO: 40233 - DNA, 201 bp, Homo sapiens
agggagatggcatgtgtgaggcagaagtcccctcaggattggattttgtcattactgaagttgtctggaggggactgaattgaggaatgctcaagatcagygcaggctcctcctgctgccctatcatgcgccatgcatggcaccaggtgtctctggtcttcacgctgactctgccatgggggtggtgttcctgttttacat

SEQ ID NO: 40234 - DNA, 201 bp, Homo sapiens
ctcacacctgtaatcccagcactttgggaggccgaagggggcggatcacctgaggttaggaattagagaccaacctggccaacatggtgaaaccctgtctmtactaaaaatacaaaaattagccaggtgtggtggcgggcgcctgtaatcccagctactcaggaagctgaggcaggagaatcacttgaacctgggaggcgg

SEQ ID NO: 40235 - DNA, 201 bp, Homo sapiens
gggcctgccgtgaggtaaagggacttggatggttcctccagacacctgggccaagaattcctccggaggtggggcttgctacagggtgcacgagtcaaggyggtgacctcatcggaggctgaccatggctttccagtgcatcccagaactctggggaccccgctatgacagagtgcctcatttccctgcacctcacctgcc

SEQ ID NO: 40236 - DNA, 201 bp, Homo sapiens
gctcacacctgtaatcccagcactttgggaggccgaagggggcggatcacctgaggttaggaattagagaccaacctggccaacatggtgaaaccctgtcwctactaaaaatacaaaaattagccaggtgtggtggcgggcgcctgtaatcccagctactcaggaagctgaggcaggagaatcacttgaacctgggaggcg

SEQ ID NO: 40237 - DNA, 201 bp, Homo sapiens
tcttctcttccttttttttttttcttagacagagtctcactctgtcgccccagctggagctcagtggtgcaatctcggctcactgcaacctctgcctctcrggttcaagtgattctcctgcctcagcctcctgaatagctgggactacaggcctgtgccaccatgcccagctaatttttgtatttttagtagagacagggt

SEQ ID NO: 40238 - DNA, 201 bp, Homo sapiens
cacagcgtggaggtcagcggctcccaggtgcgtgggcctcccctccccgggccagggcctgccgtgaggtaaagggacttggatggttcctccagacaccygggccaagaattcctccggaggtggggcttgctacagggtgcacgagtcaaggtggtgacctcatcggaggctgaccatggctttccagtgcatcccaga

SEQ ID NO: 40239 - DNA, 201 bp, Homo sapiens
caaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgcaacctctgcctctcaggttca

SEQ ID NO: 40240 - DNA, 201 bp, Homo sapiens
ggtggtgatcatcgacgaggcgcacaacctgatcgacaccatcacgggcatgcacagcgtggaggtcagcggctcccaggtgcgtgggcctcccctccccrggccagggcctgccgtgaggtaaagggacttggatggttcctccagacacctgggccaagaattcctccggaggtggggcttgctacagggtgcacgagt

SEQ ID NO: 40241 - DNA, 201 bp, Homo sapiens
atcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgcaacctctgcctctcaggtt

SEQ ID NO: 40242 - DNA, 201 bp, Homo sapiens
ctcaggagtcagaccagccctagtttcctgtgtttcatgtattggcttttcatgtgaaactcgaggagagcttgtccgttgctacaagctgttttttgaaygtctctacacagtccaggcaggaaatagaagcactcacatcaggagctcagtgtcaggcaggcaagcctcctgcaggggagccccgccctgctcaggtgg

SEQ ID NO: 40243 - DNA, 201 bp, Homo sapiens
ataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgcaacctctgcctctcag

SEQ ID NO: 40244 - DNA, 201 bp, Homo sapiens
ttccgtgcatggggacgctggagcccagaaaagttaagtgactcatattttctcaccaagcgtgggtgatggagccattcagttttccgatattttatttyttatatgagtattcctttaactggaaactttcctaacaacaaacacctaaagacctgcagagttgcttttatttttgttaccccagctccacgccttaac

SEQ ID NO: 40245 - DNA, 201 bp, Homo sapiens
atggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgcaacctctgcctc

SEQ ID NO: 40246 - DNA, 201 bp, Homo sapiens
accacttctgttatacatagtactagaagtcctagctagagcaattaggcaagaaaaagaaacaaaagacatccaaattagggaaagctaaatagtctctktttgcagatgtcatgatcttatatattaaccctaaagattccacagttagaactaataaatgaattcagtaaagttgcaggatacaaaattaacatacaa

SEQ ID NO: 40247 - DNA, 201 bp, Homo sapiens
tccagtgaaattccgtgcatggggacgctggagcccagaaaagttaagtgactcatattttctcaccaagcgtgggtgatggagccattcagttttccgayattttattttttatatgagtattcctttaactggaaactttcctaacaacaaacacctaaagacctgcagagttgcttttatttttgttaccccagctcc

SEQ ID NO: 40248 - DNA, 201 bp, Homo sapiens
ttaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgcaacctct

SEQ ID NO: 40249 - DNA, 201 bp, Homo sapiens
gagggccctgcagggccagaaagccgctcttggctctcactgtggtctaggccatgaggggcgtcctcatcacactgtagtttgggggatgccccccaccrtggtcaggttgatggcaccttaacccattctctcctgaggcgtgagttggaggaggcgcgtgggatcccttggggtctccaggcagcagggccagttggc

SEQ ID NO: 40250 - DNA, 201 bp, Homo sapiens
attaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgcaacctc

SEQ ID NO: 40251 - DNA, 201 bp, Homo sapiens
aattaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgcaacct

SEQ ID NO: 40252 - DNA, 201 bp, Homo sapiens
tccgttactaggtgggaaaagagtctgttactaggcgggaaggcatatctggacttgtctgggcatggcaaaggcaggaaggttgtttacagaacaggtarctaggagacaaggaagtacaaggaagttggttttaagaaacaaagaacagggaactaaagctttttgaagaggaatttatcatctctgacacttcttgta

SEQ ID NO: 40253 - DNA, 201 bp, Homo sapiens
tagcacttctgtgtcctttccccattggctggggttggacctcacaatctaagctaactcgattggctaaggtttaaaattgaatagggtctattaggtgragagtccgttactaggtgggaaaagagtctgttactaggcgggaaggcatatctggacttgtctgggcatggcaaaggcaggaaggttgtttacagaaca

SEQ ID NO: 40254 - DNA, 201 bp, Homo sapiens
tctgttagaaataaaagctcagagtcgtaaagaaaatgagcactcaaacacaagatttctcagcaaggcaaattttcttctgcagaagggtgcagcttgcrccagtcattatcgcaagagcacaccgagcagggtaggaaaggggtttttatctctaatgcagttcctagcacttctgtgtcctttccccattggctgggg

SEQ ID NO: 40255 - DNA, 201 bp, Homo sapiens
aacaagagaaaaacagaatttgagaaggaagaaagccaattaagagacagaagtttatgctgagagggactttccccaggctaaaatgattcttttagtcyggacagagaaaggtcagtgagtcccttcagagcagggacctactctagtttctggtactctctgagtaagtatcagggcttcagaaggaaggtctgcatg

SEQ ID NO: 40256 - DNA, 201 bp, Homo sapiens
acgtgtttcttagaccttttctgttaaaggcttcttagaaacttaagagcattgttacccagcacttttcttctcagtcaaaggtagagagggacctgtcytatgatttatcagtgtggcttttgtttactggaatggttatagattgatagaaaagaagtccatacagcttttaaaagaattctgctgccttgtactgaa

SEQ ID NO: 40257 - DNA, 201 bp, Homo sapiens
gggcgtgaacccaggaggcagagcttgcagtgagccaagatcacaccactgcactccagcctcggcgacagtgcgagactccatctcaaaaacaaaacaamacaaaacaaaaacaacgttctgtttaggccgggcgtggtggctcacgcctgtaatcccaccactttgggaggccgaggcaggcgatcacaaggtcaagag

SEQ ID NO: 40258 - DNA, 201 bp, Homo sapiens
aaattcagggcactgccactaaaagtatggcctcagggtcaagatttcaagattacagctgtagacctttgtgtagacctcagaaagatttaaaataatgyctcctgaaccctctcagctaggcaaaaagtctactaaaaatcccaaggacgtgtttcttagaccttttctgttaaaggcttcttagaaacttaagagcat

SEQ ID NO: 40259 - DNA, 201 bp, Homo sapiens
aacttacaatgttagtgacattacaatgttaatggcagttggtcaaattaataataggtaatgtcttgtgtttttctctatatttttcaaattttctacartgaggattcattgcttctctaataacattaatgtaagcatataaataattaaagtttcatggttaatctcacttctcattctctctgagctttgtgtttt

SEQ ID NO: 40260 - DNA, 201 bp, Homo sapiens
aggaaggaaatctttccctcctccccttcttagagcatttctgtcagaaaaccttgtggctgtaaagcctttttctagccttttaaaataaaaatatttcwctttagatgctaagtgcaagggcattatcctacatagccaaataaactgatctcacacagagaatttataactgtacaaggtattctattttctaataca

SEQ ID NO: 40261 - DNA, 201 bp, Homo sapiens
ccagcctgggcaacatagcaaggctccatctctaaaaagtaaaagaacaataaggtctgaatggcatgacaatgaggttaagtgaagctactaagattaartcttcagtggctttagttaactttgcagctgtaagtacccaaagagggtaggcaactgctacggggccaaatgagaagatgtaacaagaaacgggtcttt

SEQ ID NO: 40262 - DNA, 201 bp, Homo sapiens
cagccaacatattatataataaaataattaaattgggtatagtcacataaaaatatgtgcagcagaaaattggaattcatgaaaagattggcataatacgwaggcatgttttcttaattattataaatagaaaagtatgattgcagtcatggaaaatattcattaaaattagaggaaacttacaatgttagtgacattaca

SEQ ID NO: 40263 - DNA, 201 bp, Homo sapiens
gtttcactgtgttggccaggaaggtctcgatctcctgacctcgtgatctgcccgcctccgcctcccaaagtgctgggattacaggcgtgagccaccgcgcytggccattttttttttttttttttttgagacaaagtctcattgtgttgcccaggctggagtgcagtggtgcgatctcggctcactgcaacctcctcctcc

SEQ ID NO: 40264 - DNA, 201 bp, Homo sapiens
ccatgttgcccaggctggtctcgaactcatgaactaaaagcaatccactcacctcagactcctaatagtgctaggattgcctgcatgagccactgctcccrgccgcaccccccacctttgtacagggcaaagactttgttatgtattcttccagacttttacattttagggagaaatttgtgcttccatcgaaaactgcat

SEQ ID NO: 40265 - DNA, 201 bp, Homo sapiens
cgagcagatgggccttctccgggatgaggccctggcagaggtgaaggacatggagcagctgctggcccttgggaaggaggcccgggcctgtccctattacrggagccgccttgccatccctgcagcccaggtgagggccctgcagggccagaaagccgctcttggctctcactgtggtctaggccatgaggggcgtcctca

SEQ ID NO: 40266 - DNA, 201 bp, Homo sapiens
aacgttacagtgttccgatgagacacagtaggcagtacttgggagggtcttatagaccccaccctgtggaagtgggtctcaacattacacaaccccctctygggcccgtggacagttgctgtcctctctgttttctctctttgtgcctgtgccaccctcagagaagaagaaaggagctgaggaggagaagccaaagaggag

SEQ ID NO: 40267 - DNA, 201 bp, Homo sapiens
gattttacgggctctttctggagaacaaaagtaaaacgttacagtgttccgatgagacacagtaggcagtacttgggagggtcttatagaccccaccctgyggaagtgggtctcaacattacacaaccccctctcgggcccgtggacagttgctgtcctctctgttttctctctttgtgcctgtgccaccctcagagaaga

SEQ ID NO: 40268 - DNA, 201 bp, Homo sapiens
agaattaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgcaac

SEQ ID NO: 40269 - DNA, 201 bp, Homo sapiens
gagaattaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgcaa

SEQ ID NO: 40270 - DNA, 201 bp, Homo sapiens
tgattttacgggctctttctggagaacaaaagtaaaacgttacagtgttccgatgagacacagtaggcagtacttgggagggtcttatagaccccaccctrtggaagtgggtctcaacattacacaaccccctctcgggcccgtggacagttgctgtcctctctgttttctctctttgtgcctgtgccaccctcagagaag

SEQ ID NO: 40271 - DNA, 201 bp, Homo sapiens
cagagaattaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgc

SEQ ID NO: 40272 - DNA, 201 bp, Homo sapiens
tggagatgattttacgggctctttctggagaacaaaagtaaaacgttacagtgttccgatgagacacagtaggcagtacttgggagggtcttatagacccyaccctgtggaagtgggtctcaacattacacaaccccctctcgggcccgtggacagttgctgtcctctctgttttctctctttgtgcctgtgccaccctca

SEQ ID NO: 40273 - DNA, 201 bp, Homo sapiens
ttccagagaattaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcac

SEQ ID NO: 40274 - DNA, 201 bp, Homo sapiens
tagccgcaggtggtctggagagagtgaggcaggggtggcagtgactgaagaccattcagtgtctttcatagaaagaatggcagaggagaccccagttcctycctgagtcccctctccttgggaaaaagtgttcctactctctgggtgagcgtctggtccgaatcgttggcttggagatgattttacgggctctttctggag

SEQ ID NO: 40275 - DNA, 201 bp, Homo sapiens
tttccagagaattaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctca

SEQ ID NO: 40276 - DNA, 201 bp, Homo sapiens
ctttgtgtaaatgaagacgtgagaagcctaggttctgtgcagcttatcaacgaccgctgcgtggacatgcagagaagcaggcacggtagccaccaggaccrtggtgtagccgcaggtggtctggagagagtgaggcaggggtggcagtgactgaagaccattcagtgtctttcatagaaagaatggcagaggagaccccag

SEQ ID NO: 40277 - DNA, 201 bp, Homo sapiens
tggggatttccatttccagagaattaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgc

SEQ ID NO: 40278 - DNA, 201 bp, Homo sapiens
cagaacctttgtgtaaatgaagacgtgagaagcctaggttctgtgcagcttatcaacgaccgctgcgtggacatgcagagaagcaggcacggtagccaccrggaccatggtgtagccgcaggtggtctggagagagtgaggcaggggtggcagtgactgaagaccattcagtgtctttcatagaaagaatggcagaggaga

SEQ ID NO: 40279 - DNA, 201 bp, Homo sapiens
atggggatttccatttccagagaattaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtg

SEQ ID NO: 40280 - DNA, 201 bp, Homo sapiens
ctggcctggccggcccatcactggaaggcaaaggagaggtggcgggggcaggtccacgtgtgttggtaggatgtcatttagctggcaccatctctttgccyctttctttctcctttgttgcagaacctttgtgtaaatgaagacgtgagaagcctaggttctgtgcagcttatcaacgaccgctgcgtggacatgcagaga

SEQ ID NO: 40281 - DNA, 201 bp, Homo sapiens
aaaaacaaacaaacaaagcttagctgggcgtgatggcgcatgcctttagccccagctactcaagaggctgaggaggaaggatcacttgagcctgggaggcwgaggcttcagtgagctatgatcgtgccactgtaccccagcctgggtgagagagtccctacctcaaaaaaataaaaccaaaaaactactggggccacgtca

SEQ ID NO: 40282 - DNA, 201 bp, Homo sapiens
aacaaacaaacaaacaaacaaacaaaaaacaaacaaacaaagcttagctgggcgtgatggcgcatgcctttagccccagctactcaagaggctgaggaggraggatcacttgagcctgggaggctgaggcttcagtgagctatgatcgtgccactgtaccccagcctgggtgagagagtccctacctcaaaaaaataaaac

SEQ ID NO: 40283 - DNA, 201 bp, Homo sapiens
gtttcctttggacactctttgggcattcacagcatcgccaatgatggcttccataattttggcttgccatttttcttttcttttcttttttttttttttttgagacagagtttcacttttcttgcccaggctggagtgcaatggcacaatcttggctcaccgcaacctccgcctcctgggttcaagtgattctcctgcctc

SEQ ID NO: 40284 - DNA, 201 bp, Homo sapiens
tatctcaaaaaaaaaaaaaaaaaaaaaaaaaacgaccaggtggctcacgcctgtaatcccagcacttcgggaggccaaggtggaccgattgcttgagctcrgaagttcaagatcagcctgggctacatagtgaaaccctgtctctaaaacaaacaaacaaacaaacaaacaaacaaacaaaaaacaaacaaacaaagctta

SEQ ID NO: 40285 - DNA, 201 bp, Homo sapiens
agtgctgagattacagccataagccactgcgcccagccctggcttggtattattttcaattgggaaaatagctggggtctttaagctgtgttttgactggmacttttgttttagccttccccggtttcccagtataccatgctagcaggttagcctgtttattaatgtggtctgggacattgtatttttgactattagcaa

SEQ ID NO: 40286 - DNA, 201 bp, Homo sapiens
agttttttgtttttagtacagatggggtttcaccatgttggccaggatggtctcgatctcttgacctcttgatccacccacctccgcctcccaaagtgctkagattacagccataagccactgcgcccagccctggcttggtattattttcaattgggaaaatagctggggtctttaagctgtgttttgactggcactttt

SEQ ID NO: 40287 - DNA, 201 bp, Homo sapiens
tcactgcaacctccgcctcctcggctcaagtgattctcctgcctcagcctcttgagtagctgggactacaggtgtgcaccaccacacccagctaagttttktgtttttagtacagatggggtttcaccatgttggccaggatggtctcgatctcttgacctcttgatccacccacctccgcctcccaaagtgctgagatta

SEQ ID NO: 40288 - DNA, 201 bp, Homo sapiens
gctggtctcaaactcctgacctcaggtgatccacttacctcggcctcccaaagtgctgggattacaggcatgagactccatgcctggctgggtatttttttgtagttgttgttgttgttttgagacagagtctcactctgtcaccaggctggaatgcagtggcgtaatctcggctcactgcaacctccgcctcctcggctc

SEQ ID NO: 40289 - DNA, 201 bp, Homo sapiens
aagcaattcttgtgcctcagcctcctgagtagccgggattacaggcatgtgccaccatgcccagctaatttttgtatttttagtacagatggggttttacyatgttggccaggctggtctcaaactcctgacctcaggtgatccacttacctcggcctcccaaagtgctgggattacaggcatgagactccatgcctggct

SEQ ID NO: 40290 - DNA, 201 bp, Homo sapiens
ggagaattgaagggttttcagagcccatgggtaagtaatatctcagctctggatagctcaactattttaactatgaagccttttcttgcttccagcttaaytggtttcttatttttgtttttgtttttgagacagagtctcactctgttgcccaagctggagtgcagtggcacaatctcggcttactgcaaccttcacctc

SEQ ID NO: 40291 - DNA, 201 bp, Homo sapiens
gcagtgagctgagattgtgccactgcacaccggcccctgcaacagtgtgagactccgtctcagaaaaagaaaaagaaaaagaaaaagaaaagaaaagaagyaggtggttggtctgggttctgatcctaatttctgggctagtactcccatagctatggccctcttctctgctacatacaaggagaagggcttagttagctc

SEQ ID NO: 40292 - DNA, 201 bp, Homo sapiens
gagttcaagaccagcctggccaacatagtgaaattctgtctctactaaaaatacaaaaaaaatagccaggcgaggtggtgggcgcctgtaatcctagctaytcaggaggctgaggcaggagaattgcttgaatctgggaggtggaggttgcagtgagctgagattgtgccactgcacaccggcccctgcaacagtgtgaga

SEQ ID NO: 40293 - DNA, 201 bp, Homo sapiens
actactgccatctatgaaccagtcaccctcagaatctggaagaggctgatttttttttttttaagacggagtctcgctctgttgccaggcttgagtgcagkggcatgatcttggctcactgcaacctccaactccctggttcaagcgattctcctgcctcagcctcccgagtagctgggattacaggcacccaccaccatg

SEQ ID NO: 40294 - DNA, 201 bp, Homo sapiens
ccagcatgcctctggtggacttcctgatgtagctggaggattatacacctatgatcctggatgctgtgactgattattttttatttttgagatggaatctygctctgttgcccaggctggagtgcagtggcatgaacttggctcactgcaacctccgcctcctgagttcaagtggttctcctgcctcagcctccccagcag

SEQ ID NO: 40295 - DNA, 201 bp, Homo sapiens
gctgatgattttacaaaaatctaaaatatgtggcattggtttggggaccaggtgatgagaagaatctggaagggactctaagaaattctttgtaaaggctrgaaggacaaggaacacattttttattgggagctagaaaaaaggtcgcttgtgtaatgtagtggcaaaaagtttagcaatgcttcagcttgtgataaggtg

SEQ ID NO: 40296 - DNA, 201 bp, Homo sapiens
agttgttcaatgggaatgtcaatgggaagacaactaagtttatgcatgaagagggaaaggcaagtgaatcacgaccactgcccacctgacagcagctgtgyaaaatgctgtgacagactgtttccaaagatgcacatcactgcgtatcttccaacagacatgccctttaaaaacaactttattgccaggcgtggtggatca

SEQ ID NO: 40297 - DNA, 201 bp, Homo sapiens
ctgcaaaccattcttgaaagaaactaaaaaacatccaaataaatggaaaaacattctatgttcatggattgggagataatattgttaagatagcaatactyggccaggcacagtggtgcatgtctgtaatcccagcactttgagaggctgagctaggatgatcacttgagcccaggagttcaagaccagccgaggcaacat

SEQ ID NO: 40298 - DNA, 201 bp, Homo sapiens
gttcaacccaaatatttattgtcctgtcatgaaatagcaatgatatatttggaatgtcagctagcttttctgtccagtgcctccctcccatcttcatctcrgatattaaattttactaaaacttacttttatttagaatgtaattcttctgaatcactttcagactttctgtttttatatgtggttgtgtggtctgtgaca

SEQ ID NO: 40299 - DNA, 201 bp, Homo sapiens
ttgcttgaactcgggaggcagaggttgcagtgagctgagatcgcgccactgcactccagcctgtgcgacagagcaagactctgcctcaaaaaaaaaaaaaagaaatgtaagtccttggctgtacccctcccctaaccttgatttccaactagagtttaagccttaagaggggagattagaactaataaataattttagcaa

SEQ ID NO: 40300 - DNA, 201 bp, Homo sapiens
gtgtttagatagatataattagatatctatatataatagattctatgctatgggcattgtaagttctaaattgcttcagtggcattattgtacattcttayataagattgaagaattttgtgattttgattaatttatatccttcaaagtgaccaggaaggtagagtttgcatgcagaaaatttgcatgtatattaattcc

SEQ ID NO: 40301 - DNA, 201 bp, Homo sapiens
tgcagataaataaatgagatgttaatgccactgaaagctctggctttgcgtttggcttttctagtgaaacctgtttagtattctggatttcttccaacttraatttatcacctcatcatttttaacatcagtgatctacacagtctctcatctattacgtatattaaattctggtattttcaactactcttcattaaaact

SEQ ID NO: 40302 - DNA, 201 bp, Homo sapiens
atcgtgcagataaataaatgagatgttaatgccactgaaagctctggctttgcgtttggcttttctagtgaaacctgtttagtattctggatttcttccarcttgaatttatcacctcatcatttttaacatcagtgatctacacagtctctcatctattacgtatattaaattctggtattttcaactactcttcattaa

SEQ ID NO: 40303 - DNA, 201 bp, Homo sapiens
ttttgtttttagcatactatcgtgcagataaataaatgagatgttaatgccactgaaagctctggctttgcgtttggcttttctagtgaaacctgtttagkattctggatttcttccaacttgaatttatcacctcatcatttttaacatcagtgatctacacagtctctcatctattacgtatattaaattctggtattt

SEQ ID NO: 40304 - DNA, 201 bp, Homo sapiens
atatgtcaaaaagtgactgggcatggtggcatgtgcctgtaatcccagctactcgggaggctgaggtgggaggattgcttgagcccaggaggttgagaacrgcctcagcaacatagcaagaccctcatttcaaaaaaaaaaaaaaaaaaaagaaataaaataaaataaatgtaaaaatgaaaaaacaaaaagtgaagtgtg

SEQ ID NO: 40305 - DNA, 201 bp, Homo sapiens
gggtgacagagtgagactccgtctcaaaaaaaaaaaaaaaaaaaaaaaaaaagatttatgcctgtatatcccaaggactccggtttgaagaaaaaaaaaaactacttgaatcaataaaagtagtgatatggtagttgtattcaagataaaaatacaggccagatgcagtagctcatgcctataatcccaacacttttagag

SEQ ID NO: 40306 - DNA, 201 bp, Homo sapiens
cttggtggaacccattgctgggaatggccagggctcagcaccagcgctcagcagatgctcagtgcgttttgctgagtttgctgagggaagactgttttctrttctctctcacacacacagagtggatgaggatgaggatgacctggaggaagaacacataactaaggtaacacgagtgtcctcagctggtgctgtgctggg

SEQ ID NO: 40307 - DNA, 201 bp, Homo sapiens
tgctttcctttttttttctttttccttttcctttcctttcttttcctttctttttttggagacagggtgggtctcactctgttgcccaggctggagtgcartggtgcaatcttagctcactgcaacctctgccttcctggctcaaatgatcctcttgtgcctcccgagtagctgggactacaggtgcccactaccatgttc

SEQ ID NO: 40308 - DNA, 201 bp, Homo sapiens
gctgaagtgggagggaggtggagaccatagggagcagagatcacgccactacactccagcttgggtgacagagtgagaccatgtctcaaaaaaaaaaaaaatgcaatgaccaccaaaaactactctctgcagtaacatggcaatgaaaatagatgccattgttatgtactttaacttctactatgattatttgacatgaga

SEQ ID NO: 40309 - DNA, 201 bp, Homo sapiens
atgatgaagagcaaatatcccccctggggcctcagaggggtccagcttgctggagggagggcagagaggagagcagcctgccatgagtcccgaggcttccractcaagacttgggtttggggtgctgagctcatgtctcctttttacatttccctacccacagacctgagcggccacgggaggttggggttggcatttgcc

SEQ ID NO: 40310 - DNA, 201 bp, Homo sapiens
gtggctcacgcctgtaatcccagcactttgggaggccaaggcaggtggatcacctgaggtcaggagttcgagaacagcctggccaacatggtgaaactccrtctctattaaaaatacaaaaaaattagtcaggcatggtggcaggcacctgtaatcccagctacttgggaggctgaggcatgagaattgcttgaacctggg

SEQ ID NO: 40311 - DNA, 201 bp, Homo sapiens
tttctgctgctatctcagagttgactgggagctggtgaggggagacaacattccaggcacagaacatccgaaggcccgagatgatgaagagcaaatatccsccctggggcctcagaggggtccagcttgctggagggagggcagagaggagagcagcctgccatgagtcccgaggcttccaactcaagacttgggtttggg

SEQ ID NO: 40312 - DNA, 201 bp, Homo sapiens
atagcttgagtccaggaagtcgaggctgccatgagctatgattgcaccactgccctccagcctgggagacaaagcaagactctttctctaaaaaaagaggwaaaaaaaaaaaaaggaacgagattgtgtcctttgcagggacatggatggagttggaagctgttatcctcagcaaactaacacaggaacagaaaaccaaac

SEQ ID NO: 40313 - DNA, 201 bp, Homo sapiens
gaaggcttcctggaggaggtgatgtttctgctgctatctcagagttgactgggagctggtgaggggagacaacattccaggcacagaacatccgaaggccygagatgatgaagagcaaatatcccccctggggcctcagaggggtccagcttgctggagggagggcagagaggagagcagcctgccatgagtcccgaggct

SEQ ID NO: 40314 - DNA, 201 bp, Homo sapiens
aggaactacagaagcatctccaccaaagctcttcttgccaaagtttacttctgtattgtttaggccttggaggtaaaggataaaattgtccagacagctaattattttcttcaggtggctgaggtaggaggatagcttgagtccaggaagtcgaggctgccatgagctatgattgcaccactgccctccagcctgggagac

SEQ ID NO: 40315 - DNA, 201 bp, Homo sapiens
ctcccttgtggacatgacagtctggggagatagaccgagaggaagcaattttgaatgagatgggtgtgaaggggccatgaatctgtgtcagagcagccagrcctaccagggaaggtcaaagaaggcttcctggaggaggtgatgtttctgctgctatctcagagttgactgggagctggtgaggggagacaacattccagg

SEQ ID NO: 40316 - DNA, 201 bp, Homo sapiens
aaaaggaactacagaagcatctccaccaaagctcttcttgccaaagtttacttctgtattgtttaggccttggaggtaaaggataaaattgtccagacagytaattattttcttcaggtggctgaggtaggaggatagcttgagtccaggaagtcgaggctgccatgagctatgattgcaccactgccctccagcctggga

SEQ ID NO: 40317 - DNA, 201 bp, Homo sapiens
ccaagctctaggtgaggccacggggactcagcagaaacaaggccgacctgggtcctcccttgtggacatgacagtctggggagatagaccgagaggaagcrattttgaatgagatgggtgtgaaggggccatgaatctgtgtcagagcagccagacctaccagggaaggtcaaagaaggcttcctggaggaggtgatgttt

SEQ ID NO: 40318 - DNA, 201 bp, Homo sapiens
atacatcccgtaatggagggtgctctgacttcagctggttcgggaaaggccactcctgggattgcttcctcttttctgcccagcatttcttcttcttcttyttttttttttttttgagacggagcctcactctgtcgcccacgctggagtgcagtggcgccatctcagctcactgcaacctctgcctcccgggttcaagat

SEQ ID NO: 40319 - DNA, 201 bp, Homo sapiens
taagtgacagcatcctctgttcactcgattggtcagttgtagcttcatccaggagatggtcatggggttcctgctgcataccaagctctaggtgaggccayggggactcagcagaaacaaggccgacctgggtcctcccttgtggacatgacagtctggggagatagaccgagaggaagcaattttgaatgagatgggtgt

SEQ ID NO: 40320 - DNA, 201 bp, Homo sapiens
ggttcctgccactttctaaataaaaatcattaagatactcaatcaccaaattgcccacactatctgactgcacccagtccagagcaggcctcgctcggctsagcccttccccaagtcatctaacataaactcaaatcctactataagcccctcctaatggcctcttacctagaccacacttccctagggtgtgtaaaccca

SEQ ID NO: 40321 - DNA, 201 bp, Homo sapiens
cacggatgggattagcgctttataaaagggacatggggaactagcctaggccttttttttttttttttttttttttcgcttctgctcttccaccatggaaracacagaaggaaggtaccaccttggaagcagagagcagccctcgccagacaccaactctgctggcaccttgatcttgtacttcccagcctctagaactga

SEQ ID NO: 40322 - DNA, 201 bp, Homo sapiens
atgggatgcagggctggcttccctgccaacgcctggcgctgatggattcttcccgcattgctggaaagggcagactgaggcgctgacaaaagaagagttgyagctggtcataagtgacagcatcctctgttcactcgattggtcagttgtagcttcatccaggagatggtcatggggttcctgctgcataccaagctctag

SEQ ID NO: 40323 - DNA, 201 bp, Homo sapiens
ctctttcatcttgtcactatgtaggatttatggctctttgttaaactatgatttaagcaaagcccctaagccactgccttgagagagaaatacttttgaactgaggcctctcccgtgtgatgggtactgcatgcattaataaatttctgctttttttttttttttgttaatctaacttttgttttcaggagagtatctcaa

SEQ ID NO: 40324 - DNA, 201 bp, Homo sapiens
aagaggtgagacctttagggggtgattcaggcatgcgggttctgccctcacggatgggattagcgctttataaaagggacatggggaactagcctaggccytttttttttttttttttttttttcgcttctgctcttccaccatggaagacacagaaggaaggtaccaccttggaagcagagagcagccctcgccagacac

SEQ ID NO: 40325 - DNA, 201 bp, Homo sapiens
ggaaggagtcaagcagggtttttacaattctccattgggctgtttgagggagatatgcttttgatcccatataccaccaggatccttgtttttgtcccccsctccgttattaactctacagtgtgtattcaggttctattgggaaatcatagaaaggaagtagtgctaggatctgttgggattgcaccctgagggcttcag

SEQ ID NO: 40326 - DNA, 201 bp, Homo sapiens
tttcctcctaccatagagaaaccctttgcaacctttgagatgtttacagaccttccagtcccagcattcccctccctccattgcaggagtacccccgcaaygccctggcaataattccttcgaatgaaggtctctcttttaccacatccagaattttttttatttgacaaaccagaaatggaagacaacccatcagctcgt

SEQ ID NO: 40327 - DNA, 201 bp, Homo sapiens
aacccaggaggcggagcttgccatgagccaatatgtcgccactgcactccagcctgggtgacagagagagagtcttgtctcaaaaaaaaaaaaaaaaaaaataggcaaagaggggttcagagcctcaaaaatggagagcagcagaaactcaccaagagaaacaataagaagcacattttataaaaggaattgacaacggtt

SEQ ID NO: 40328 - DNA, 201 bp, Homo sapiens
gaacccaggaggcggagcttgccatgagccaatatgtcgccactgcactccagcctgggtgacagagagagagtcttgtctcaaaaaaaaaaaaaaaaaaaataggcaaagaggggttcagagcctcaaaaatggagagcagcagaaactcaccaagagaaacaataagaagcacattttataaaaggaattgacaacggt

SEQ ID NO: 40329 - DNA, 201 bp, Homo sapiens
tgaacccaggaggcggagcttgccatgagccaatatgtcgccactgcactccagcctgggtgacagagagagagtcttgtctcaaaaaaaaaaaaaaaaaaaataggcaaagaggggttcagagcctcaaaaatggagagcagcagaaactcaccaagagaaacaataagaagcacattttataaaaggaattgacaacgg

SEQ ID NO: 40330 - DNA, 201 bp, Homo sapiens
gctgtggaatactgtgctaaccaggaaatagccaattcttccttcagggcatgttatgagatacatgaattgttttctaagtcacaatagccttttttttycttttctttttttttgcttgctttcttttctttttctttttttctttttcttttttttttttttgagatgaagtcttgctctgtcacccaggctggagtg

SEQ ID NO: 40331 - DNA, 201 bp, Homo sapiens
tctgaggtaacctaaacttagggattatttctttttaagagaaactttaggctgggcgaggtggctcacgcctataatcctagcactttgggaggctgagkggggcagatcacctgaggtaaggagttgagagcagcctgaccaacatggagaaaccctgtctctactaaaaaatataaaattagccaggcatggtggctt

SEQ ID NO: 40332 - DNA, 201 bp, Homo sapiens
ttacagtctaaggacatccagaacagagtttccacaccaaaggcacatctagtttctcatccacaagctttttatctttgtctttgtgtttgttttttatwccggaacttcttgacaaatattattccatcatcagaaggaaggtcctgggaaaaagaaagacatgagcacttgtgctaggtattttacaggcatatcttc

SEQ ID NO: 40333 - DNA, 201 bp, Homo sapiens
taggggtattacaggtccttaagaaggctatgggcagtaggctgaccaaagtttctaatgtttcctgacatagcttagataacactcattttagagtttgrttagccctttctactttcctggaggattgaggccttcatgctgaatgtaaatagtatttgattctatgatggctaatattgagtgtcaacttgattgaag

SEQ ID NO: 40334 - DNA, 201 bp, Homo sapiens
ttttagtagagatggggtttcaccatgttgcccaaggctggtgtccaactcctgacctcaagtgatctaccctcctcggcctcccaaagtgctgggattayaggcgtgagccaccacgcccaaccttgagttaaatttctaaaaatctcaacataatgtgtttggctcctcttcttattatgcttagagttaggcactagc

SEQ ID NO: 40335 - DNA, 201 bp, Homo sapiens
ccactttgggaggccgaggcaggcgatcacaaggtcaagagatcaagaccatcctggccaacatggtgaaaccctgtctctactaaaaatacaaaaattakctggacgtggtggtgcgtgcctgtagtcccaggtactcagaggctgaggcagaagaatcacttgaacccgggaggcggaggttgcaatgagtggagatca

SEQ ID NO: 40336 - DNA, 201 bp, Homo sapiens
ttacaaaactaactcttgtcacaaagctaggatacgtttatttctcctttttgttgatttttgaacaattagaatttatttctcacagttctgaaggctgygtgtctgagagcagggtcccagcacagccaagttctggtgaggaccctcttccagtggcagatgcccacttctggtgctatctcccatggaggacagcag

SEQ ID NO: 40337 - DNA, 201 bp, Homo sapiens
gggtggatcatgaggtcaggagatctagaccatcctggctaacccggtgaaaccctgtctctactaaaaatacaaaaaattagccagggttggtggtgggygcctgtagtcccagctactcaggaggctgggcgtgaacccaggaggcagagcttgcagtgagccaagatcacaccactgcactccagcctcggcgacagt

SEQ ID NO: 40338 - DNA, 201 bp, Homo sapiens
ggaattacaggcacccgccaccacactaatttttgtagtttttagtagagatggggtttcaccatgttgcccaaggctggtgtccaactcctgacctcaartgatctaccctcctcggcctcccaaagtgctgggattacaggcgtgagccaccacgcccaaccttgagttaaatttctaaaaatctcaacataatgtgtt

SEQ ID NO: 40339 - DNA, 201 bp, Homo sapiens
agagcttccacaccctccctaggtgcaccatcctccaggaatgtccgcgtgtttgctatacagaagctccctgaatccagtcctcttggattttttgttcrtttgttttgttttgttttgttgagatggagtctcactctgtcgcccaggctggagtgcagtggcatgatctcggcttgctgcagccttcgtctccggggt

SEQ ID NO: 40340 - DNA, 201 bp, Homo sapiens
agaattgcttgaacctgggaggcagagattgcagtgagccgagatcgtgccactgcacttcagcctgggcaacaaagtgagactccatctcaaaaaaaaaataaaaaataaaaaacaaaactctgatcaccaaatactcgaatgcttggggagactgatttgagtaataataaaactctgatttcccacacagccaggtct

SEQ ID NO: 40341 - DNA, 201 bp, Homo sapiens
ctatgagactttgggcaaattaatctctaaacctcaatttctcaatctgtaaaatgttcaaggtcaagcaactcacttttccacattgtaattgatgaaaytaaaattcagactcagatctgcctcactccacagtctgtgctttttccttcccactcatctttttctctttctattaaaaatttcataacacatttgaga

SEQ ID NO: 40342 - DNA, 201 bp, Homo sapiens
gtttctgtgggttgtatactcatgaaatgtatgtatgtgtttttcttccatttttctcacgggttgtttggtatttctttatttttttcttttttttttttgagacagaatctcgatgcattgcccaggctggagtgcaggggtgatctcggctcactgcaacctccacctcctgggctccagtgattctcgtgccttaga

SEQ ID NO: 40343 - DNA, 201 bp, Homo sapiens
aaagtctcttctattcaatcactagaggaaaaaccattttctcactaccttgattctagaaaaatttgtgcattcttttgataatactcagacacaaatarttctttagtggccattcaattattccctttgttactgtacatttccaagatagattatttgattagcaaaaatgcctgcgcaatgcattcaggttattgc

SEQ ID NO: 40344 - DNA, 201 bp, Homo sapiens
ttctgggttcaagcgattctcctgcctcagcctcccgaatagctgggactacaggcacacgccaccacgcctggctaattttttgtatttttagtagagcyggggtttcaccatattggccaggctggtcttcaactcctgacctcatgatccagtcacctcagcttcccaaagtgctgggattataggcgtgagccacca

SEQ ID NO: 40345 - DNA, 201 bp, Homo sapiens
gagaaaaccagcttagattgcgtatgtgaaatactagaaagtgagattgtattttccttctctgatgactttacaaatagaatgattaaaaagtatttttytctaataatttgtgtacacagaaacttaggattgacaaaacgatcttatttgttcttgacatatgtataattttatgcttttttaaaaaacttttttttc

SEQ ID NO: 40346 - DNA, 201 bp, Homo sapiens
ggtaatccacccacctcggcctcccaaagttctgggattataggtgtgagccactgtgcctggcctgcattccagctttcttgtagctatttgtgtgataytttttcatcattttactttcagtctgtgtttttggatctaaggtatatctcttggaaacaataacatatagttggatagtttttaaaatccagactgaca

SEQ ID NO: 40347 - DNA, 201 bp, Homo sapiens
tatcattcctcagggtgtgtataacttaataaataactttttttttttttgagacagagtctcactctgttgcccaggatggagtgcaatggcccgatctyggctcactgcaagctccacctcccgagttcaagcaattctcctgcctcagcctcctgagtagctgggattacaagttcatgccaccatgcccagctaatt

SEQ ID NO: 40348 - DNA, 201 bp, Homo sapiens
cgggtgtggtagcaggcatctgtaattccagctacttgggagactgaggcaggagaattgcttgaacctgggaggggcaggttgcagtgagctgagattgygccactgtgctccagccttggtgataaagtgagactctgtctcaaaaaagaaaaaaaaaaggaaagaagagattctggaggtagaaacaagaaatagttt

SEQ ID NO: 40349 - DNA, 201 bp, Homo sapiens
gcccagggcagagaccaccgtgttgctttatgcctcgctggtgagagggggtcataaacagtttgtgctccatgaaccgttcctgcccacctccaaggtcrtgtttctgctccctctcttctcccttagagcccatggggacaaggcagagaacttgagtggagatgaaggtggtgaatattagaggaacaaagtgctcct

SEQ ID NO: 40350 - DNA, 201 bp, Homo sapiens
cagttacctactaaattttgaagttatatgaataatctttattttcaagaatcttatgaattttatatgttctgcaaaaacaggtaaaacttcattcctcytttactctatttaaaaaaactgtaatggatggatatatataattgcgtgtgtgtaaaagtaatattaatatatcaatatcatgatcttactggtatatgt

SEQ ID NO: 40351 - DNA, 201 bp, Homo sapiens
gtggacttcgacttctgcccctgcccagggcagagaccaccgtgttgctttatgcctcgctggtgagagggggtcataaacagtttgtgctccatgaaccsttcctgcccacctccaaggtcgtgtttctgctccctctcttctcccttagagcccatggggacaaggcagagaacttgagtggagatgaaggtggtgaat

SEQ ID NO: 40352 - DNA, 201 bp, Homo sapiens
tgggaggtggaggttgcagtgagcccagatcatgccactgcactccagcctgggtgacaagagggagactgtctcaaaaaaaaaaaaaaaaaaaaaaaaaaagatggtcatggtcatcccagggtgggggcaggcttgaggactctgcggtggtctctcaggatctactccagatccaggctggcttccagaaatactgca

SEQ ID NO: 40353 - DNA, 201 bp, Homo sapiens
ttcgtttggaaaagggttttttattctcactccttgttttgagtctcaaagctagttgcttacactcagttcgtgcaaatgctgtagtggcatatttagamgataggctttgtgtggacttttggaaaagtttaatagtttatgtctgcatgtttttctttatctaatctcccctcaacctgtccccaacaaatacattaa

SEQ ID NO: 40354 - DNA, 201 bp, Homo sapiens
ggtgtgctcaataaaatcgagttgacatgaatgagcagatgctgcctcgttgcagtctggtagtgtaattccaggctgcccatgtggacttcgacttctgsccctgcccagggcagagaccaccgtgttgctttatgcctcgctggtgagagggggtcataaacagtttgtgctccatgaaccgttcctgcccacctccaa

SEQ ID NO: 40355 - DNA, 201 bp, Homo sapiens
aggctgaggcaagagaattgcatgaacctgggaggtggaggttgcagtgagcccagatcatgccactgcactccagcctgggtgacaagagggagactgtytcaaaaaaaaaaaaaaaaaaaaaaaaaaagatggtcatggtcatcccagggtgggggcaggcttgaggactctgcggtggtctctcaggatctactccag

SEQ ID NO: 40356 - DNA, 201 bp, Homo sapiens
cctggcctaaaagtgcatttttttaatgtagctttcaaaagtacatgttttatgtaacgaagcatcctctaattctagctattgaagttagccatatcacygttaattgttgctttgagacaaagttacatctttaaaattttgtatcatgggatgcaatgaaacatccttctgtaaagcaaagggattgactacctgata

SEQ ID NO: 40357 - DNA, 201 bp, Homo sapiens
tgacccagtgtttggcataggggtgtgctcaataaaatcgagttgacatgaatgagcagatgctgcctcgttgcagtctggtagtgtaattccaggctgcscatgtggacttcgacttctgcccctgcccagggcagagaccaccgtgttgctttatgcctcgctggtgagagggggtcataaacagtttgtgctccatga

SEQ ID NO: 40358 - DNA, 201 bp, Homo sapiens
ctcatgcctgtaatcccagcactttgggaggccgaggcgggcggatcacttgaggtcaggagtttcagaccagcctgaccaacatggtgaaaccccatctytactaaaactacaaaaattagccgggcatggtggcgggcacgtgtaatcccagctactcaggaggctgaggcaagagaattgcatgaacctgggaggtgg

SEQ ID NO: 40359 - DNA, 201 bp, Homo sapiens
tccctggctgggctcgagctgcttcagggcaggaaccacgtctttacagtttgatgttcccagagctgacccagtgtttggcataggggtgtgctcaatamaatcgagttgacatgaatgagcagatgctgcctcgttgcagtctggtagtgtaattccaggctgcccatgtggacttcgacttctgcccctgcccagggc

SEQ ID NO: 40360 - DNA, 201 bp, Homo sapiens
tcggccgggtgcagtggctcacgcctgtaatcccagcactttgggaggccgaggcaggtggatcacctgaggtcaggagttcaagaccagcctgaccaatrtggtgaaaccctgtctctactaaaaatacaaaaattagccgggcaatgtggcatggacttgtaatcccagctactctggaggctgaggcaagagaattgc

SEQ ID NO: 40361 - DNA, 201 bp, Homo sapiens
tgtctgcaccttatacacaaggaggctgcagccccacaaggagagactccttggctgaggccacaagcctcggcagtggagagctgggctagaactcagcyggcctggctctagatctcaggctctgaggcagctgactgcactgggtaacctttgaggtgccaaccgtcaaggcgtccttagcctgagctttccttctcc

SEQ ID NO: 40362 - DNA, 201 bp, Homo sapiens
cctgggaggcggaggttgcagtgagccaaggtcgcaccactgcactccagcctgggtaacagagcgagactccatctcaaaataaataaataaaataatasctactggtgggaatggttattcatgcctgtaatccagctttttgggaggcagaggcagggggatcgcttgggcccaagagttcgagtgagctatgattgc

SEQ ID NO: 40363 - DNA, 201 bp, Homo sapiens
gccagtgttcaatctgagactttccaaggtcagaagagaggaggattggtattgatatttaataagcatttactgtgtccaaggcattttggtacgaattktatatctcttatctgatatccttgccttttaggactaggctgtttttacctttaaggtagatgttattattctcattttacacatgaggtaactgaaaca

SEQ ID NO: 40364 - DNA, 201 bp, Homo sapiens
tgggctgtgagtggttgaggcgtggatcctaggagtcgacctctctccagccaggcagccaggcctatgtgaatgggcgtggtgtgctttgtctctggcaygtggggaggtgggtactggtgctgagacttcttcctccctccccacctccactgcccctgtccagaggcaggaagaagaagaaacagagaatctcctccg

SEQ ID NO: 40365 - DNA, 201 bp, Homo sapiens
gctgggcaggatggcatgggtctttagtcccggctacttgggaggccgaggtgggaggatcactcaaacctgggaagttgaggttgcagtgagctgagatyacacccttatactccaactggagtgacagagcaagaacctgtctcaaaataaataaataaatgattaaaaataaaatattatataaaaccaccttcggtc

SEQ ID NO: 40366 - DNA, 201 bp, Homo sapiens
gaggtatagcatctaacaatactgcacttccatagagcggacttgggataacagttaactcctaagacatcagctgaagatgacaaaggtaaaaatatctrccgttaagataaagttgaaaactctgtacttactgtactttattcaaaatgttagccttctcttagcagattcttcaataagcttgcttttaggtttcaa

SEQ ID NO: 40367 - DNA, 201 bp, Homo sapiens
agcgaggctgggacctgcagggatgaggtcccgggaggggatgcggcagcccttgagtgctggttggggaaggagagctgcccccagtgaggaggcgccgrgctgagtggcccagactccttaggagaggcctggttttgggcttcctggtgattttccttcatgtctgcctcctgtaggcggagcaggccaggaggaagc

SEQ ID NO: 40368 - DNA, 201 bp, Homo sapiens
tttagaaaccctggattggataaattcattatgataaagattaaaatatcaccttatgtttatgtgtcgtgggagctttttttttttttttttttttttgrgacggagtctcgttctgtcgcccaggcgggagtgctgtggcgcgatctccgctcactgcaagctccgccttccgggttcacgccgttctcctgcctcagc

SEQ ID NO: 40369 - DNA, 201 bp, Homo sapiens
cgccttccacagtgagcagcgaggctgggacctgcagggatgaggtcccgggaggggatgcggcagcccttgagtgctggttggggaaggagagctgcccscagtgaggaggcgccgagctgagtggcccagactccttaggagaggcctggttttgggcttcctggtgattttccttcatgtctgcctcctgtaggcgga

SEQ ID NO: 40370 - DNA, 201 bp, Homo sapiens
ccagctactcaggagtctgaggcaggagaatcgcttgaacctgggaggcggaggttgtagtgagccgagatcatgccacttcactccagcctgggcaacaragcaagactttgcctcaaaaaaaaaaaattgtttttgcaattatttaatcagactttcttaagactttgacctttatgcacttttaccttccttaataac

SEQ ID NO: 40371 - DNA, 201 bp, Homo sapiens
tttgggaggagcgtgccgccttccacagtgagcagcgaggctgggacctgcagggatgaggtcccgggaggggatgcggcagcccttgagtgctggttggrgaaggagagctgcccccagtgaggaggcgccgagctgagtggcccagactccttaggagaggcctggttttgggcttcctggtgattttccttcatgtct

SEQ ID NO: 40372 - DNA, 201 bp, Homo sapiens
atctaaacacttccctcattcaggttttccccagttattaactatgttaacataattagtggctatgccaactcatgatatgttctttttttaaaaaaacrtttctgtagccaggcatggtggcagatgcctgtaatcccagctactcaggagtctgaggcaggagaatcgcttgaacctgggaggcggaggttgtagtga

SEQ ID NO: 40373 - DNA, 201 bp, Homo sapiens
gtgacttttacaaaaggttgtagtttttgttccctccacacttaagaattttatctcacatcatgaatatctgacttctggctttttttttttttttttttaaggtaagcaagctaacatttaaaactgtgattaaataagagtatctttcaaggtttggctaaggagagctaacatttccgtgctgtgctgttaatcaaa

SEQ ID NO: 40374 - DNA, 201 bp, Homo sapiens
tagtggtgagatctcagctcactgcaacctccaactcctgggttcaagggattcttccacctcagcctgccaagtagctagaactacaggtgcacaccacyatgcccggctaatttttgtatttttagtagagacaggatttcaccatgttggccaggctggtattgaactcctaacctcaagtgatttacccgcctcagc

SEQ ID NO: 40375 - DNA, 201 bp, Homo sapiens
tgtgacttttacaaaaggttgtagtttttgttccctccacacttaagaattttatctcacatcatgaatatctgacttctggctttttttttttttttttttaaggtaagcaagctaacatttaaaactgtgattaaataagagtatctttcaaggtttggctaaggagagctaacatttccgtgctgtgctgttaatcaa

SEQ ID NO: 40376 - DNA, 201 bp, Homo sapiens
ttgtgacttttacaaaaggttgtagtttttgttccctccacacttaagaattttatctcacatcatgaatatctgacttctggctttttttttttttttttttaaggtaagcaagctaacatttaaaactgtgattaaataagagtatctttcaaggtttggctaaggagagctaacatttccgtgctgtgctgttaatca

SEQ ID NO: 40377 - DNA, 201 bp, Homo sapiens
gaagcttccatttttgtttcaggaagctagatgctatgctttgaagaagctcagccaagacaactggaagagaagagactacatggagagagaaaggccaygtggaggaccactggggctccacgcattgagtgaagcctttttggacttttgagccagccaactaataagaagtaaaaccaacactgtggagtggcaaac

SEQ ID NO: 40378 - DNA, 201 bp, Homo sapiens
tttgtgacttttacaaaaggttgtagtttttgttccctccacacttaagaattttatctcacatcatgaatatctgacttctggctttttttttttttttttttaaggtaagcaagctaacatttaaaactgtgattaaataagagtatctttcaaggtttggctaaggagagctaacatttccgtgctgtgctgttaatc

SEQ ID NO: 40379 - DNA, 201 bp, Homo sapiens
ctgacctccctcttcttagagcatttgctttagaaaacttgtaaattttctctctgatacttcgagatgccaattttttttttttttttggtcattttacytttagtcgatgcataatctttaaaaaagctttgtcagttttacaacccaggaaagtctttctccaagacctgggaactatttctttgaaatgcaatcagc

SEQ ID NO: 40380 - DNA, 201 bp, Homo sapiens
ttttgtgacttttacaaaaggttgtagtttttgttccctccacacttaagaattttatctcacatcatgaatatctgacttctggctttttttttttttttttttaaggtaagcaagctaacatttaaaactgtgattaaataagagtatctttcaaggtttggctaaggagagctaacatttccgtgctgtgctgttaat

SEQ ID NO: 40381 - DNA, 201 bp, Homo sapiens
gggaggcccctgacctccctcttcttagagcatttgctttagaaaacttgtaaattttctctctgatacttcgagatgccaattttttttttttttttggkcattttacttttagtcgatgcataatctttaaaaaagctttgtcagttttacaacccaggaaagtctttctccaagacctgggaactatttctttgaaat

SEQ ID NO: 40382 - DNA, 201 bp, Homo sapiens
gacagggtcttgctctgtcacccaggctggagtgcagttttgcagtggcatgatcccggctcactgcagccttaactgctcaggctcaagtgaccctcccrccacaacctcccaagtagctgtgtcccacaggcacacaccacagtgcctaatttttttattttctgtagacatggagtctccccatgtactcaggctggt

SEQ ID NO: 40383 - DNA, 201 bp, Homo sapiens
gtttttttgagacagggtcttgctctgtcacccaggctggagtgcagttttgcagtggcatgatcccggctcactgcagccttaactgctcaggctcaagygaccctcccgccacaacctcccaagtagctgtgtcccacaggcacacaccacagtgcctaatttttttattttctgtagacatggagtctccccatgtac

SEQ ID NO: 40384 - DNA, 201 bp, Homo sapiens
aaattacatagtatttgcatatgacctactcacatcctcctacacactttaaatcatctctagattacttataatacataatacaatgtaaatgctatgtwaatagttgtaattctgtattgtttagggactagtgacaagaaaaaatagtctgtacatgttcagtacagaagcaatcttttttttttttttaagagacag

SEQ ID NO: 40385 - DNA, 201 bp, Homo sapiens
ctcgttagctggtttctagttgaattggttatgtatctagttaccaatatgctgcaaccgtgcagtcacctacacattatttaagtatatttaactgttamatgcactacccaccaatcatgaaataaactttatgaaaaaaattttttaaaatgaatttactatagcttgagtatacagtgtgtataaagtctacagtaa

SEQ ID NO: 40386 - DNA, 201 bp, Homo sapiens
agggtttcatggtgttagccaggatgatctcgatctcctgacctcgagatccacctgcctcggcctcccaaagtgctgggattacaggcgtgagccaccgygcccagccaattgcttgatttttgataccatgccagatcattttccaagtccacttgcccgaatgtcacactcgtaagaaatgataagtatccatgtggg

SEQ ID NO: 40387 - DNA, 201 bp, Homo sapiens
ggtgcctgccactgcgcccagctaattttttgtatttttagtagagacagggtttcatggtgttagccaggatgatctcgatctcctgacctcgagatccrcctgcctcggcctcccaaagtgctgggattacaggcgtgagccaccgtgcccagccaattgcttgatttttgataccatgccagatcattttccaagtcc

SEQ ID NO: 40388 - DNA, 201 bp, Homo sapiens
acaataatattgcacacatagagatgcatttattcctcagttatcatttctctagaccaagggtgggtgcaaattatttttagagcctaaggattacacartttgggagggtaggggattcgctttaagaaaaagaaagcaaaataggctgggcacaatggctcatgcctgtaatctcagcactttgggaggctgaggcgg

SEQ ID NO: 40389 - DNA, 201 bp, Homo sapiens
tgtgagccgaaatcgcaccactgcactccagcatgggcaacagagcgagacatcacctcaacaacaaaaaaaagagtgccctttggaaaggtgaatgtctrcatagtgtgagtttaatggagtcacatttgtctaaatagaaattcctctcaacctgtcattgcactctcttgccactgtgaacgtccaccaatagtgtcc

SEQ ID NO: 40390 - DNA, 201 bp, Homo sapiens
ctcagttaaggacttgtttatttaaatgggactgtaaatatgttttggtttctaagctatattagcaaaatttatttttcaaaaatgcccactgtgatgtsaatgtcaaaatatattcttaagtgttttataactaattgtaaactttttttcagaagtcttattttatacttgtgaaactgaacacaattttgggacaac

SEQ ID NO: 40391 - DNA, 201 bp, Homo sapiens
tcaattggagttttttgttttgttaatagacaaccaaatgtaaaactagcatataataaaagtgaatattattttcacagattatattacttttttctaaytgttggacactgatatatatcatttatttttcccagtgaccctgatttgtaaaatgaggtcaagtaacttctccacattgtaattgatgaaactaaaatt

SEQ ID NO: 40392 - DNA, 201 bp, Homo sapiens
atttcaaacacctgggttcaagtgatcctctggcctcagcctcccaaaatgctgggattataggcgtgagccactgtgcccagccccttttgttgatcgckccacaattttccaaaacgttcatagggactctatattagttttctagagctgccataacaaagcaccacaaactgggtgggttaaaaaaacagaaaatgt

SEQ ID NO: 40393 - DNA, 201 bp, Homo sapiens
aaaaaaatccaggtggcatggagagtaatatcacagactcatttaaaggatgattaacgattctccaaagaaaaatcaggaaggccacctaggcgatatayaaaacaacaaagcccacgatacctttcatattctaaaaatcccatgaatctataggtggagaacaatttacatggtctatggaataaaaaactgctttaa

SEQ ID NO: 40394 - DNA, 201 bp, Homo sapiens
gtcctatgcagaaggatggttctctgagcaagtcttctccaagaacacaaaagaatgggggattttgaaaaacaaaaggtggtggaggatgggggttgcayggggttcaggttgggggtgggggtactgggggtgcagggtgctttatcatccctgctttcttttctttttaaataaatacattttctttctgtcttcttt

SEQ ID NO: 40395 - DNA, 201 bp, Homo sapiens
agctgtttccactaaaaaaaaatccaggtggcatggagagtaatatcacagactcatttaaaggatgattaacgattctccaaagaaaaatcaggaaggcyacctaggcgatatacaaaacaacaaagcccacgatacctttcatattctaaaaatcccatgaatctataggtggagaacaatttacatggtctatggaat

SEQ ID NO: 40396 - DNA, 201 bp, Homo sapiens
ctgcttgggaggctgaggcgggaggatcacttgtgactgggagtttgagaacagcctggggaacatagtgagaacccatcaggaaaaaaaaaaaaaaaaaaaagttgattaaaaaaagaaaaacaaaagaggccaggcacggtggctcacacttgtaatcccagcattttgggtggccaaggtgggaggatcgcttgaggc

SEQ ID NO: 40397 - DNA, 201 bp, Homo sapiens
tcaagaaatatgaattatagccaggtccagtggtgtgtgcctgaagtcccagctgcttgggaggctgaggcgggaggatcacttgtgactgggagtttgaraacagcctggggaacatagtgagaacccatcaggaaaaaaaaaaaaaaaaaaaagttgattaaaaaaagaaaaacaaaagaggccaggcacggtggctca

SEQ ID NO: 40398 - DNA, 201 bp, Homo sapiens
aaacaagttttaacatctggaaagaaaaagcatccatcaacttttcttatcaagaaatatgaattatagccaggtccagtggtgtgtgcctgaagtcccasctgcttgggaggctgaggcgggaggatcacttgtgactgggagtttgagaacagcctggggaacatagtgagaacccatcaggaaaaaaaaaaaaaaaaa

SEQ ID NO: 40399 - DNA, 201 bp, Homo sapiens
tgggaggctgaggtgggcggattgtctgaggtcaggagttcgagaccagtctggccaacatagtgaaaccccttctctactaaaaatacaaaaattagccrggtgtggtggcgcacacctgtagtcccagctacttgggaggctgagatgggagaatcgcttgaacccaggaggcagaggttgcagtgagccgagatcgtg

SEQ ID NO: 40400 - DNA, 201 bp, Homo sapiens
tatcagatagaattatcaattccttctctatgttattttgaatttctttgagtttcctcaacacggctattgtgaattcactgtctgaaaggtcacatatytctgtttttccaggattggtccctggagctttatttagttcatttggtgaggtcatgtttccctggatgccgctgatgctcgtagatgttcttcagtatc

SEQ ID NO: 40401 - DNA, 201 bp, Homo sapiens
tttacttgtttgctgggaatcaaagagcttagttttgttttttgttttttttttttttgagacggagtctcgctctgtcccccaggctggagtgcagtggygcgatctcagctcactgcaagctccccctcccaggttcacgccattctcaaagagcttagtttaagctcaattcaagtgactatttgaggcctggtcagg

SEQ ID NO: 40402 - DNA, 201 bp, Homo sapiens
caaggctggggcgcagtggtgcgatctcactgcaacctctgcctcccgggttcaagcaattctcctgtctcagcctcccgagtagctgggattacaggcayaccaccacacccagctaattttttgtattttttgtagggacagagtttcaccatgttgcccatgctggtctcgaactcctgagcccaggtgatccacctg

SEQ ID NO: 40403 - DNA, 201 bp, Homo sapiens
ggtgcagctgtcatgggttggagtcttgtgtctgtggctctcccaggctagtgttgcatgctaatggctctacagttctgatgtcttaggagtggccctgwcccacgactttactaagcaatgccctatttgggtatctttgcagtgacccccaatcccacagttccactgggcaaggggatttagaaaacagagttccga

SEQ ID NO: 40404 - DNA, 201 bp, Homo sapiens
aaaatcagataactagaattatataactctatgtgctttattttttacttgtttgctgggaatcaaagagcttagttttgttttttgttttttttttttttgagacggagtctcgctctgtcccccaggctggagtgcagtggcgcgatctcagctcactgcaagctccccctcccaggttcacgccattctcaaagagct

SEQ ID NO: 40405 - DNA, 201 bp, Homo sapiens
ccattccataggttgtctctttgctcttattgtttccttggctgtgcagaagctttttagtttgatataagtccatagtagggtgcttttagacataggcmcagtaacaggagttatgtctgacaatctgacatcaagaatagaaaaattggctaggcctgtagttccagctacttgagaagattacttcagcccaggagt

SEQ ID NO: 40406 - DNA, 201 bp, Homo sapiens
acattctgagatgctgggggttaggatttcaacacaggaatttggaggaatacaattcaatcaggcttatggacaattctggtcttaagtcaagagtagtsttctccagtctgtatgtggaggcgcacacctatggtcccagccacttgggaggctgaggccagagaattgtgtgagcccaggaggagttccataccagcc

SEQ ID NO: 40407 - DNA, 201 bp, Homo sapiens
gctcagctcatgattctgttttgtggaacaaagtgttacctgtttctagaattgcaaataaagccaattgagatttttttttttttttttttttggcagaktcacactctgttgcccaggctatagtgtagtggtgagatctcagctcactgcaacctccaactcctgggttcaagggattcttccacctcagcctgccaa

SEQ ID NO: 40408 - DNA, 201 bp, Homo sapiens
agtattagcttgctcctagttccacaacatcaacaatggagcatgaaaatgtaaacacctaaccaaatatttgcaccttttggatgatttcccacttctaraaaatgaaaaatatttggttgtttacagtccccatccatttatctgttcccttccttccagttttttgctaagacagtgggacaccctggctggagagca

SEQ ID NO: 40409 - DNA, 201 bp, Homo sapiens
agttactactgtaaggcagagagtttagattgcaattcagcagcatctccaaaaaactcgtagtgctagaatggctttgaggtggaattttggaaatgagraccatgatgaatgaatgatggaaatggtgactccttgccatagttaagctgttgtccttaacatttcttttaggtagcacagtatacaagcttacattaa

SEQ ID NO: 40410 - DNA, 201 bp, Homo sapiens
ataggatttagaatatcccataaacttagctgataaagcaggggcaggctttgagaggatcgactgcaattttgaaagaagttgtaccgtgagtaaaatgygatcaaacagcattgcatgcttcagagaaatctttcttcacaaaaggaacaattggtgcagcaaaattaattttcttattttaagaaattgtcagccggg

SEQ ID NO: 40411 - DNA, 201 bp, Homo sapiens
cataaatcatgtaactgttgatgataccccaggaaggtgagcctttggttataaatccttttaacattttccagtctaaaagttttgtggtcttattacasgatgtagaaaacagtgggcctcagttattcttttgctgttgtgccggagtataccacggttgtttttgaaagataactttgaccatacccttaggaactt

SEQ ID NO: 40412 - DNA, 201 bp, Homo sapiens
gtagctgggattacaggcatgggccaccacacccggctaatttttgtattttttagtagagatggagtttcagcatgttgcccaggctgatcttgaactcrtgacctcaagtgatccacccttctgggcctcctaaagtgctgggattacaggtgtgagccactgcacccagcctgcttctttcttcattccttcttgctc

SEQ ID NO: 40413 - DNA, 201 bp, Homo sapiens
caccttttggatgatttcccacttctagaaaatgaaaaatatttggttgtttacagtccccatccatttatctgttcccttccttccagttttttgctaaracagtgggacaccctggctggagagcaatattcagtttatagcttgattttgtttacccctgagaccaaggacaattttatctatgtttttaaaggcaga

SEQ ID NO: 40414 - DNA, 201 bp, Homo sapiens
ttttggaaatgagaaccatgatgaatgaatgatggaaatggtgactccttgccatagttaagctgttgtccttaacatttcttttaggtagcacagtatayaagcttacattaaaatattcacggccaggtgcggtggctcacacctgtaatcccagcactttgggaggccgaggcaggcggatcacaaggtcaggagttc

SEQ ID NO: 40415 - DNA, 201 bp, Homo sapiens
cgaaatgacaccataggatttagaatatcccataaacttagctgataaagcaggggcaggctttgagaggatcgactgcaattttgaaagaagttgtaccrtgagtaaaatgcgatcaaacagcattgcatgcttcagagaaatctttcttcacaaaaggaacaattggtgcagcaaaattaattttcttattttaagaaa

SEQ ID NO: 40416 - DNA, 201 bp, Homo sapiens
ctgtgccttgtgtaacactgcagttccgggagtcctccaacctggaatgcatgctttgcggggatctatgatgccctcgaattgtatgttacatgtgaacytgtgagcattttctaggggctctgcacctttgtgttctcagctctgagccccatgcttgctgcaaccagcaggtgttcagagtgaatgaatttgcttatc

SEQ ID NO: 40417 - DNA, 201 bp, Homo sapiens
cagcttcccgggtagctgggattacaggcatgggccaccacacccggctaatttttgtattttttagtagagatggagtttcagcatgttgcccaggctgrtcttgaactcgtgacctcaagtgatccacccttctgggcctcctaaagtgctgggattacaggtgtgagccactgcacccagcctgcttctttcttcatt

SEQ ID NO: 40418 - DNA, 201 bp, Homo sapiens
ctagctcatccagaccgatgactcctttgagaaaatttttctgtgtagtggagctgccactattttataggtagtcacccattttatctggggagtcattrggctgaaaataaaacccttgcttgtaccccttaccttaaaaaggatattggcttaggattggacaaatttaaatctttggtcccttaaattttgttattc

SEQ ID NO: 40419 - DNA, 201 bp, Homo sapiens
agttgattccaaacctcatggtgactttgagggctttaagacttcagtagagcaggctgggcatggtggcctataattccagccctttggaaggctgaagmgggtggatcacaagcatagagttcaagaccagcctgggcaacacagtgagacccccatctcctaaaaaggatttttttttaagacttcagtagaggaagt

SEQ ID NO: 40420 - DNA, 201 bp, Homo sapiens
gagacgtgggagaagaaagctgcaaaagtcattatgagcaacacccttgatcttaggggtgctggtctttgagaagagagctctaagccttttgtagaggyattagaaaggtatcggcgccacggtgaaatgcaggggagattgggtttaggggctttcctggtctgcattctgctacagccgttaaatgccgctagatgg

SEQ ID NO: 40421 - DNA, 201 bp, Homo sapiens
agtggtgccatctcagttcactgcaacctccacctcatgggctggtccaccatgatcctcccacctcagcttcccgggtagctgggattacaggcatgggycaccacacccggctaatttttgtattttttagtagagatggagtttcagcatgttgcccaggctgatcttgaactcgtgacctcaagtgatccacccttc

SEQ ID NO: 40422 - DNA, 201 bp, Homo sapiens
attttatctggggagtcattgggctgaaaataaaacccttgcttgtaccccttaccttaaaaaggatattggcttaggattggacaaatttaaatctttgrtcccttaaattttgttattccttcactggactttcatgttttagaaccatttttacatttctcagtgagtagtttatggggtgtggttggttgactcaaa

SEQ ID NO: 40423 - DNA, 201 bp, Homo sapiens
atataagaaatacattttataaagatatagctgctgtagatagtgattcctctgatggatctgggcaaagtctattgaaaaccttctggaaaggattcacmattctagatactgttgggaggaggtcaaattatcaacatgaacaggagtttcgaagaagttgattccaaacctcatggtgactttgagggctttaagact

SEQ ID NO: 40424 - DNA, 201 bp, Homo sapiens
gaccatcctggctaacacggtgaaaccccgtctctaccaaaaaaaaaaaaaaaaaaaaattagccggccgtggtggcgggcgcctgtagtcccagctactygggaggctgaggcaggagaatggtgtgaacccgggaggcgagcttgcagtgagccgagatcgcgccactgcactccagcctgggtgacagagtgagactc

SEQ ID NO: 40425 - DNA, 201 bp, Homo sapiens
gttgttctatctccttgtctcatcttacaagaaaagtcactttgaaacaatggacataatctttgcttcttcttttttttttttttttcctgagacagagkctcgctctgtcgtccaggcaggagtacagtggtgccatctcagttcactgcaacctccacctcatgggctggtccaccatgatcctcccacctcagcttc

SEQ ID NO: 40426 - DNA, 201 bp, Homo sapiens
gcaaatggagcagagtcatatggactcatagaaaaaggggtgcttggctgggcgcgggtagctcacccctgtaatcctagcactttgggaggctgaggcgrgtggatcacctgaggtcaggagttcgagagcagcctgaccaacatggtgaaaccctgtgtctactaaaaatacaaaattagccaggtgcggtggcacatg

SEQ ID NO: 40427 - DNA, 201 bp, Homo sapiens
gggtaaaataatgctagttctgtgagttctcttcttgtgcaaatccataaactgccaccaatctgtagtcattttaattgctcctaaaccgaagagcatcrtggcaactacctttcccctcgtagagtgacactatcactagtcttattgaggccaaagttataaagatgggctctcgatctactaatattagtaaaatgg

SEQ ID NO: 40428 - DNA, 201 bp, Homo sapiens
gtttcattttgctaggcatgtgaaactgctgcctggaattttctgttctcttgcaaccaccctgtattattcctgtctcaagagaaagcaggagagagagatagccaaattcccaaacaggtcacttaatcttcaagagtcacgataatgagtttccctctgctttaatcctttcacacacagaaaaagtagccccaagaa

SEQ ID NO: 40429 - DNA, 201 bp, Homo sapiens
tcaaagtcaggtaattacacgagatgtggttcctatatattattttttaatttcaaaaactatctcaaatatacagaaatttttttttcctaattgatttratagtaagttacccactgccccatcatttctgtatatttagtgcctttgtttttttgtcttaacaaacaaggacatgcacctacatagctgtaatatagc

SEQ ID NO: 40430 - DNA, 201 bp, Homo sapiens
atacctctgtaaagacagagggtaaaataatgctagttctgtgagttctcttcttgtgcaaatccataaactgccaccaatctgtagtcattttaattgcycctaaaccgaagagcatcatggcaactacctttcccctcgtagagtgacactatcactagtcttattgaggccaaagttataaagatgggctctcgatct

SEQ ID NO: 40431 - DNA, 201 bp, Homo sapiens
agtttcattttgctaggcatgtgaaactgctgcctggaattttctgttctcttgcaaccaccctgtattattcctgtctcaagagaaagcaggagagagagatagccaaattcccaaacaggtcacttaatcttcaagagtcacgataatgagtttccctctgctttaatcctttcacacacagaaaaagtagccccaaga

SEQ ID NO: 40432 - DNA, 201 bp, Homo sapiens
ccttcttgtaataattcctctacctctgtagtcatgtttttcttttttcattttgtcttgtccccagaatgtctaacaaaacagccaaatatacctctgtraagacagagggtaaaataatgctagttctgtgagttctcttcttgtgcaaatccataaactgccaccaatctgtagtcattttaattgctcctaaaccga

SEQ ID NO: 40433 - DNA, 201 bp, Homo sapiens
cagtttcattttgctaggcatgtgaaactgctgcctggaattttctgttctcttgcaaccaccctgtattattcctgtctcaagagaaagcaggagagagagatagccaaattcccaaacaggtcacttaatcttcaagagtcacgataatgagtttccctctgctttaatcctttcacacacagaaaaagtagccccaag

SEQ ID NO: 40434 - DNA, 201 bp, Homo sapiens
aaactacttaacttcattagtaatcagggaaatgcaaatgagaagcaccaggtgatactgtttcacactctccggggcggccaaaatttttaagtcttaamaaacaaccctaacaatgtagagtcacaaacaggaatccttagacactgctggtggcagttgaattagtacagccactttggagaactctgcagccttgtc

SEQ ID NO: 40435 - DNA, 201 bp, Homo sapiens
gagctgccttgcagctctagtctgcttctgtttttggctttcccagatagtttcaattcttactctcagtttgtgaacctcccttcagtgaacctcccttyacttatgctggatatctcttgcgactggatgagcttcactaaagcacagtcatttggacctggattcgaatccctggttttccactttttagctgtgagt

SEQ ID NO: 40436 - DNA, 201 bp, Homo sapiens
acagtttcattttgctaggcatgtgaaactgctgcctggaattttctgttctcttgcaaccaccctgtattattcctgtctcaagagaaagcaggagagagagatagccaaattcccaaacaggtcacttaatcttcaagagtcacgataatgagtttccctctgctttaatcctttcacacacagaaaaagtagccccaa

SEQ ID NO: 40437 - DNA, 201 bp, Homo sapiens
aggtgcctgccactgcgcccagctaattttttgtatttttagtagagacagggtttcatggtgttagccaggatgatctcgatctcctgacctcgagatcyacctgcctcggcctcccaaagtgctgggattacaggcgtgagccaccgtgcccagccaattgcttgatttttgataccatgccagatcattttccaagtc

SEQ ID NO: 40438 - DNA, 201 bp, Homo sapiens
aagaaacaacccataaatacttgaggaagatacttgccatacatgtaactgacaaattaataaaggaaaaaggtactctggagaaaaatgaacaaaagccytgaatagaaactacacagaagtggaaatgtgaggttgggcgtggtggctcacacctgtaatcccaacattttgggaggcctagacaggtggattgcttga

SEQ ID NO: 40439 - DNA, 201 bp, Homo sapiens
aaaaggtgaagatttctcagaactgtgatgctgcccattttaacaccaaatacagtgttcttgtcacagtgtaggtgggtgtgcgatttgtttattaatgrgtgaataatgaggtcctaggagaaacctaggtcaaatcctgctctctgttgggtccagttggttttagccagcttggcccacatcctgtttttcatggtc

SEQ ID NO: 40440 - DNA, 201 bp, Homo sapiens
gtacctaaatataattcttataaaacaaaacatctggtcagttgtgaaatgtttaaaacattgcttcttgatcaccaaataattaatatggtgaataacasataggggcttttgtgcagtagaagattcaagaccaagacaagctcatgtttccctttaggcgggcttcctcctgagggaggcccctgacctccctcttct

SEQ ID NO: 40441 - DNA, 201 bp, Homo sapiens
agtggcgcgatctcagctcactgcaaactccgcctcccgggttcatgccattctcctgcctcagcttcccgagtagctgggactacaggtgcctgccactrcgcccagctaattttttgtatttttagtagagacagggtttcatggtgttagccaggatgatctcgatctcctgacctcgagatccacctgcctcggcct

SEQ ID NO: 40442 - DNA, 201 bp, Homo sapiens
ggggtagagggagtatggctaacagctgttttttccttaaatctgcgctgtggatcttagaaccagatgcctgttattcactcccaagcctcctaggcaayccgccagtgagatcgtcccgccagtgagatcgtcccgctgttagtctttgagttgatggccagtcagccctgggtcttagtgggtgggaatagaagtggg

SEQ ID NO: 40443 - DNA, 201 bp, Homo sapiens
cagtggcgcgatctcagctcactgcaaactccgcctcccgggttcatgccattctcctgcctcagcttcccgagtagctgggactacaggtgcctgccacygcgcccagctaattttttgtatttttagtagagacagggtttcatggtgttagccaggatgatctcgatctcctgacctcgagatccacctgcctcggcc

SEQ ID NO: 40444 - DNA, 201 bp, Homo sapiens
gctaagtttttttttttttttttttgagacagagttttgctcttgttgcctgggctggagtacaatggcatgatctcagctcactgcaacctctgcaaaayacaaaaattagctgggtatggtggcatgcacctgtagtcccagctactcgggaggctgaggcaggagaatcgcttgaacctgggaggcagaagttgcaat

SEQ ID NO: 40445 - DNA, 201 bp, Homo sapiens
gagaagacagctgtgccaaattaggtcgttcatcaccaagagacatctaagctgtcaatcagccattgtcaatcatagactgtgctaaaattttccacttrtataaacttgccaggaacctttataagcccctgcccagcttgtctgtatggaatatgatttagctgcttgctcgatttgtgtctctcaaattgcaattta

SEQ ID NO: 40446 - DNA, 201 bp, Homo sapiens
ctgtttacactgggcctgatcacaaatctcctgagaagacagctgtgccaaattaggtcgttcatcaccaagagacatctaagctgtcaatcagccattgycaatcatagactgtgctaaaattttccacttgtataaacttgccaggaacctttataagcccctgcccagcttgtctgtatggaatatgatttagctgct

SEQ ID NO: 40447 - DNA, 201 bp, Homo sapiens
accacatatgtgcaccacaattggggcccacatcctcaactcctccttgttgctcaaatttggactattccatttgacacagatcatccactatcattacyatgactccctcctccatgggacatgacttcctgggacaaatctattccagaaccaaagggcttactgaaataattgatctcagtggtttctaaggaaata

SEQ ID NO: 40448 - DNA, 201 bp, Homo sapiens
tactgcatgtctacagcacagttgatgggcataacccttcttagcaacagcaagcagctgagcagaaagtaattgcaggaggcagagccaagaggaaaacygctgagagtgctgacggtaggtggagagaacagaagcacacaccgtagggtgcaatcttagtgagctttgttttccttcaatagaggtgagttcagaccc

SEQ ID NO: 40449 - DNA, 201 bp, Homo sapiens
gaggacacgggggaagttgctttcctggtgctgaggcccccggccaccgtggtagtgtacagcaagtacagggtaacagaagggccagcaggaggacacgstgcaatggtgtaccgagggacaggagagtgaatcagagccacaggacagagctccacctgtttccagggaagtgcatggggggctcccggaagccaaagg

SEQ ID NO: 40450 - DNA, 201 bp, Homo sapiens
atagattaaaggaaacacaaagaccgcaatggaaaaattgcaaaagatggaaagagaagaaatagaaataataaataaataaatgtagtggtttgagtcasaaggttcgatctcattagttaccaataaaatgtacattggaaggacaataagatgatactccttttttacctgtcaaattggcaaagagtcttttttttt

SEQ ID NO: 40451 - DNA, 201 bp, Homo sapiens
cctagctggttctttcttttctcctctctcagcttgatgccacactgttgctgtcaacgaaactaaaattatggtggctcaacacattgaactgacagatyaggcctacaatcatgaatcctaccctaaccacatatgtgcaccacaattggggcccacatcctcaactcctccttgttgctcaaatttggactattccat

SEQ ID NO: 40452 - DNA, 201 bp, Homo sapiens
tgtggccagtgtggatttcttcatcatatgttaaccttggcaaagctgccagagatatttttaacaaaggatttggtttggggttggtaaaactggatgtragaacaaagtcacgcagtgctgtgggattttcaacatctggttcatttaatgcagacactggaaaagcttttgaagtcttggagaccaaatataaacggt

SEQ ID NO: 40453 - DNA, 201 bp, Homo sapiens
tttcaggttgttcctttgtttgaaagaattctactgagcacctgccctaaccgccttcctagctggttctttcttttctcctctctcagcttgatgccacrctgttgctgtcaacgaaactaaaattatggtggctcaacacattgaactgacagattaggcctacaatcatgaatcctaccctaaccacatatgtgcacc

SEQ ID NO: 40454 - DNA, 201 bp, Homo sapiens
gggtatttcccctcccaccctgattccaagtgagaggggaaacaagagggcactttggggaaattgggcactgcttgctgaaggcagacagagtcttactycttggctctatgcttgctcagctatgggagcttgtaaatttgagacagcatggagaataaaaaagtgtttggaagaacctgacctatgtcccttactgaa

SEQ ID NO: 40455 - DNA, 201 bp, Homo sapiens
cagctatgggtatatcctaggcaagctgcctgtgctagttcccttatctgtatctgtagcctgagttttcaggttgttcctttgtttgaaagaattctacwgagcacctgccctaaccgccttcctagctggttctttcttttctcctctctcagcttgatgccacactgttgctgtcaacgaaactaaaattatggtggc

SEQ ID NO: 40456 - DNA, 201 bp, Homo sapiens
gcctgggtgatagaggctacaatgggctacaatcataccactgcactccagctagggtgacagaatgagactctttaaaaaaaaaaaaggggattactggrgtatttcccctcccaccctgattccaagtgagaggggaaacaagagggcactttggggaaattgggcactgcttgctgaaggcagacagagtcttactcc

SEQ ID NO: 40457 - DNA, 201 bp, Homo sapiens
aggacacgggggaagttgctttcctggtgctgaggcccccggccaccgtggtagtgtacagcaagtacagggtaacagaagggccagcaggaggacacggygcaatggtgtaccgagggacaggagagtgaatcagagccacaggacagagctccacctgtttccagggaagtgcatggggggctcccggaagccaaaggc

SEQ ID NO: 40458 - DNA, 201 bp, Homo sapiens
atctgaaggctcaacacagggggaccggagtccaagctccctcacatggtcaccagcaggattcagttcctcgaaggctgtcatttagaggcctccctccrtccctccttacaggtccttctcacagggcacttcgtgacatggcagctgactttctggggaccatccaagtgagaaagagcccttagaaagaagtgacag

SEQ ID NO: 40459 - DNA, 201 bp, Homo sapiens
acaacaacaacaacaacaacaacagttatttacatcaagggtccccaaaccctgttaggaatggggccacacagcaggaggtgagtggtgggcgagggagyattactgcctgagctccgcctcctgtcagatcagcagtggcattagattctcataggggcgtgcaccctattgtgaactgtgcatgtgagggatcttggt

SEQ ID NO: 40460 - DNA, 201 bp, Homo sapiens
aaagagaaacagcagtctcatctcagccgctggtcccaccatacctgctccctttacacaaaacagaaaagactgtgatcattattcggttctaataatayaccccatggaaacacagtagttgggagcaaaagtacttgtttttggaaaatgtaaaatccaaggaaaacctaccttgtgagtagagaaggatttgcatct

SEQ ID NO: 40461 - DNA, 201 bp, Homo sapiens
tttggtggtctcttcacacggatgcgcgtgacaccacagagtcacatttatattcctggcagaaagaggaatataaagtaaaggaagaagaaggcaaatargctttgtctttttattctgaaaaggacactaccctcagaaaccaccaccttcatcttattgctaaaagcagcgtcacatgaccagcacaagtgcaaatga

SEQ ID NO: 40462 - DNA, 201 bp, Homo sapiens
attagattctcataggggcgtgcaccctattgtgaactgtgcatgtgagggatcttggttgcacactccttatgagaatctaatgcctgatgatctgaggyggaacagtttcatcctgaaaccatccccaccccaccaccagtccatggaaaagctgtcttccacgaaattggtccctggtgccaaataggttggggacca

SEQ ID NO: 40463 - DNA, 201 bp, Homo sapiens
ctgttgcccagccttgagtacagtggtgcgaacacaattcactgcagccttgacctcctgggctccagtgattctcttgcctcagcctccctgtagctggraccacagatgtgcaccactgtgcctggctaatttttgtagagaaggggctcactatgttgcccaggctggtttcgatctcctggagtcaaatgatcctcc

SEQ ID NO: 40464 - DNA, 201 bp, Homo sapiens
ctgggtgacagagcgagactccgtctcaaaaaaaaaaaaaaaaaaaaacccaagctgtgccccgaccaccttgggcgcatattctcagaatctcctgaggsctgtgtcatgggccatggtcactcatatttggctcagaataaatctcttcaaatatttaacagagtttgactcttttcatcaacatatccactgtggcag

SEQ ID NO: 40465 - DNA, 201 bp, Homo sapiens
caccagtccatggaaaagctgtcttccacgaaattggtccctggtgccaaataggttggggaccactgcttcacatcactatttcatagtgttgaaccagrctttcaaaattagtgaaatgcagaacgtacaaccactggtccccttcccatgatagtgggaaagacctgggtctagagtctatatttttgtacttatgag

SEQ ID NO: 40466 - DNA, 201 bp, Homo sapiens
tatataaagatagttccaccggacagattttttttttttttctttttctgaggcaggtcttgctctgttgcccagccttgagtacagtggtgcgaacacamttcactgcagccttgacctcctgggctccagtgattctcttgcctcagcctccctgtagctggaaccacagatgtgcaccactgtgcctggctaattttt

SEQ ID NO: 40467 - DNA, 201 bp, Homo sapiens
tgtactctacttgtactctattaatgaaacaacaaagtctgaatgacagcacgtctgtttatagagtggtttatcaaacgtttaaagcctgctgttgagayctaccactcagaaaaaaaggttcctttcaaaatattactgctcattgacagtgtacctggtcacccaagagctctgaaagtataaggagatgactgttgt

SEQ ID NO: 40468 - DNA, 201 bp, Homo sapiens
gtccctaaaatacgtaattgataaagcattggttatctgctaggttttaaacataatttctaagaatataaaaatttaatcaccaccatctttataattgytttaaaattacctctaatttcttcgcacaaggtccactaacaagtgcaatcacaccactgtcagatacctaagcaaagggaaaaagaaacacagtccatg

SEQ ID NO: 40469 - DNA, 201 bp, Homo sapiens
agtggttctagatagaagatcaaaccagccataacattcctttaagccaaagtctaattcttttttttttttttttttttttttcagagtcttgctctgtygcccaggctggagtgcattggcacaatctcggctcactgcaagctctgcctcctgggttcacgccattctcctgcctcagcctcccatgtagctgggact

SEQ ID NO: 40470 - DNA, 201 bp, Homo sapiens
cttcctaaatgtgtcataaaatgccactataacttgtaactgtaaaactttcctgctttacagctaggtaaggcctgggacacgtaaatgctaaaaaaaaatcagaccttatctgcacttctgtctgctgtcctcggctccatacctaattaaaaccctgaacttaccaaggttttcaccaaaagttaaagtcactaagag

SEQ ID NO: 40471 - DNA, 201 bp, Homo sapiens
aggtcaagaattcgagaccagcctggccaatatggtgaaaccccatcgctactaaaaatacaaaagttatgttggcatggtggcgggcacatgtaaccccrgctactctggaggctgagacaagagaatcgcttgaacccaggaggaggaggttgcagtaagctgagattgtgccattgcactccagcctggatgacagag

SEQ ID NO: 40472 - DNA, 201 bp, Homo sapiens
ggctgcaggggaacagagactaggcatgtatttgtaaggggacagtggatgaacagttaccctttagtcaatctatttttctttacttctttctgttttcwtagcacctgagtaatttctatttagtggctcacatgagactactgtagtaaaaggatactaccccttggttgttggaattgccagctttgggagaattta

SEQ ID NO: 40473 - DNA, 201 bp, Homo sapiens
gggttgtttgtttttttcttgtaaatttgtttgagttcattgcagattctggatatcagccctttgtcagatgagtaggttgcgaaaattttctcccattytgtaggttgcctgttcactctgatggtagtttcttttgctgtgcagaagctctttagtttaattagatcccatttgtcaattttgtcttttgttgccatt

SEQ ID NO: 40474 - DNA, 201 bp, Homo sapiens
ctgtctcaaaaaaaaaaaaaaacttaaaatcttttttttaattctctcaatttcaatctcacttacttcttctttcaaagccaccactgtctgaacctggkgcccttccttctgattatagttttcgttgttgttactgtgttttgtttacttttacaattttggaatatgaaaatatctttcttttgtaacgacaaatat

SEQ ID NO: 40475 - DNA, 201 bp, Homo sapiens
ccttggtttattaaattagtatggaataacatgtactgttaacagtgtttattgagcttctgagatgtcttcagtggactcagaatacaaggattgctttytgtgggtgtgtgtaaatgtgtaaataaatgtttactggactcttactaaaatgatcagtttatcaggtactattaaaaatattacatggttatttgtgcc

SEQ ID NO: 40476 - DNA, 201 bp, Homo sapiens
tcacctactttttgatggggttgtttgtttttttcttgtaaatttgtttgagttcattgcagattctggatatcagccctttgtcagatgagtaggttgcraaaattttctcccattttgtaggttgcctgttcactctgatggtagtttcttttgctgtgcagaagctctttagtttaattagatcccatttgtcaattt

SEQ ID NO: 40477 - DNA, 201 bp, Homo sapiens
accatatattttttattttaataaagttcaattaatctacttttactatattttatttttaacaaccttgtcaatatattatttattatttttgtttatcttatttttatagttagtggttttttatgtgtgtcttgtataaaaaatatttgcctatccctttgttataaagataaacttatttaaaaaaaaaaaatctag

SEQ ID NO: 40478 - DNA, 201 bp, Homo sapiens
aatctcacttacttcttctttcaaagccaccactgtctgaacctggtgcccttccttctgattatagttttcgttgttgttactgtgttttgtttactttyacaattttggaatatgaaaatatctttcttttgtaacgacaaatatggaatacaaacattacaacttctttttttgcccatcctggattaaaaaggaaat

SEQ ID NO: 40479 - DNA, 201 bp, Homo sapiens
tgcataaatgtcttcttctgagaagtgtctgttcatgtccttcacctactttttgatggggttgtttgtttttttcttgtaaatttgtttgagttcattgyagattctggatatcagccctttgtcagatgagtaggttgcgaaaattttctcccattttgtaggttgcctgttcactctgatggtagtttcttttgctgt

SEQ ID NO: 40480 - DNA, 201 bp, Homo sapiens
aaccatatattttttattttaataaagttcaattaatctacttttactatattttatttttaacaaccttgtcaatatattatttattatttttgtttatcttatttttatagttagtggttttttatgtgtgtcttgtataaaaaatatttgcctatccctttgttataaagataaacttatttaaaaaaaaaaaatcta

SEQ ID NO: 40481 - DNA, 201 bp, Homo sapiens
ttcaccatgttggccaggatggtcttgatctcttgacctcatgatccgcccaccttggcctctcaaagttctgggtttacagacgtgagccaccgtgcccrgcctttttactttactttattttattttatacagagcctcactctgtcatccaggctggagtgcaatggcacaatcttggctcactgcaacctctgcctc

SEQ ID NO: 40482 - DNA, 201 bp, Homo sapiens
cacaagggttgaactagtttacagtcccaccaacagtgtaaaagtgttcctatttctccacatcctctccagcacctgttgtttcctgactttttaatgaytgccattctaactggtgtgagatggtatctcactgtggttttgatttgcatttctctgatggccagtgatggtgagcattttttcatgtgttttttggct

SEQ ID NO: 40483 - DNA, 201 bp, Homo sapiens
cactgcactccagcctgggcgacagtgagacccggtctcaaaaaaaaaaaaagaagaagaaaaagctatttttgagtattttataatataatagtagagtrgtacatgtatagaatttataagtggacatatcctggagtggagagtcaaaaagtcaatggattgcatgatgaaaacttgaaacaacttagagaaagatgc

SEQ ID NO: 40484 - DNA, 201 bp, Homo sapiens
gctgaaaggtccaggggctgatgaggccacgtgtaagcgaaagtttgggataagcagaaaccgagtgcgctgagggagtgagattgtggctgtatccggcrcctggctgagcaggagagtgaaccccgtgggtgtgtgtttgctggtgacgttcctggagctgtcttgaagtccgagctgccttgcagctctagtctgctt

SEQ ID NO: 40485 - DNA, 201 bp, Homo sapiens
tcccataccttgccctatgcatcctttcaagtatcctttacaatatatatatatttttgagacggagtcttgctctatcaccaagctggagcgcagtggcrcgatcttggctcactgcaacctccagctccctggttcaaacggttctcctgcctcagcctcctgagtaactgggactacaggcacgtgccaccatgccca

SEQ ID NO: 40486 - DNA, 201 bp, Homo sapiens
tgttttgtgccagccgtatgaaacttctcactttccttcaaatcagcttgccagtccctagaatgtgcaagctgctcatgttgctcatgttgtatgtgtcstgtatctagaaaacccttttactgcttctccagctgacggaaaaaatcctactcgctttactccaaaggccagctcaagtatcacctcatctgtgaagca

SEQ ID NO: 40487 - DNA, 201 bp, Homo sapiens
ccaaatgttgaacatcatttggacacagcttcaaaatggtaccaattcttttaatttgtgactgctttatttatttatttatttatttatttatttatttwtttattattatactttaagttttagggtacatgtgcacattgtgcagattagttacatacgtatacatgtgccatgctggtgcgctgcacccactaactc

SEQ ID NO: 40488 - DNA, 201 bp, Homo sapiens
ctcctgggttcaagcaattctcctgcctcagcctcccgagtagctgggattacgggtgcccgccaccacgccaggctaatttttatgtttttagtagagaygggctttcaccatcttggccatgctggtcttgaacttctgacctcgtgatccacccgcctcagcctcccaaagtgccaggattacaggcatgagccaccg

SEQ ID NO: 40489 - DNA, 201 bp, Homo sapiens
gaaccatatattttttattttaataaagttcaattaatctacttttactatattttatttttaacaaccttgtcaatatattatttattatttttgtttawcttatttttatagttagtggttttttatgtgtgtcttgtataaaaaatatttgcctatccctttgttataaagataaacttatttaaaaaaaaaaaatct

SEQ ID NO: 40490 - DNA, 201 bp, Homo sapiens
atggaatattcaaactgatcactagatccacttcacagattttgtccagggcttcggcttgtcctaatgtcctaggaaaaccatcaaggagccagtgctgkccacgcctattctccaactcggacatcattaggcgtgtgatcacatggtctggaaccaaaagacttttctctatatactgctttgccatctcaccaactt

SEQ ID NO: 40491 - DNA, 201 bp, Homo sapiens
gtgccagccgtatgaaacttctcactttccttcaaatcagcttgccagtccctagaatgtgcaagctgctcatgttgctcatgttgtatgtgtcctgtatmtagaaaacccttttactgcttctccagctgacggaaaaaatcctactcgctttactccaaaggccagctcaagtatcacctcatctgtgaagcatttcct

SEQ ID NO: 40492 - DNA, 201 bp, Homo sapiens
gcagtgagctgtgatcataccactgcactccagcctgggtgacagaacaagaccctgccccctaccccctcctccaaaaaaagcatatttaaatattcccrgaatccaaatgttgaacatcatttggacacagcttcaaaatggtaccaattcttttaatttgtgactgctttatttatttatttatttatttatttattt

SEQ ID NO: 40493 - DNA, 201 bp, Homo sapiens
agagaaaaagataagaagacattttctttttaggtttatttttctgtcttaactgaagaccttccaggctggcaatatccaagggccagattcaaagtgaraaggttatatacctcttgaaatatgtaaggttggatgattagaccttgatgcttaaaatagtgctttcagggcagtgaaattttcatcagctcaccccac

SEQ ID NO: 40494 - DNA, 201 bp, Homo sapiens
tcctctatttatggaatgtatattccagtgaggaagaataaataggttcagatggtgctaagagctatgaataaattaaatacagagtaatgtgatttttwaaaagtgacttagagcaagctagggggtgaggagtgggggtggtgtttgaccactgtccagcggccagacagccggagaggcttctctgaggaggtgagc

SEQ ID NO: 40495 - DNA, 201 bp, Homo sapiens
attcaatgactggctttgccgcgtctttgtactgtcttagcctggcagcaactgcttcgggtttatcatcctcctgctggactaatggttcaccagtgacrtcatcaataccatgtacatgaggtggattgaagtccaggttatatacccttccgctaggagggtgaatccaacggcggctgagacgatctttaagtgttt

SEQ ID NO: 40496 - DNA, 201 bp, Homo sapiens
tccttaactcctgcaacacttttgcttagtggttttatcattatatattgtataaatatatatatatagtatacatctataaccatttatttattatactyacattaatttttttcctatagactcttccagcaagaataaggtttttttttgtttttgttttgagagggagtcttgctctgtcacccaggctggagtgca

SEQ ID NO: 40497 - DNA, 201 bp, Homo sapiens
gaaataattttttccatgatttggaaagtgatattatatttgtcaatgagaaataatgtaatagctttttaatagttcacaaaatgatgtcacttgctctytattcaaaaatatctttagcctttttgaggttattttggggagatgataaggacaggcatctccataatcccaaatatttgggagaaaacttcaaaaatt

SEQ ID NO: 40498 - DNA, 201 bp, Homo sapiens
ggctttctgaccactgcccacttctttgaagaagcattagtccatgtgggcagaaaatgaaatgttgtggttaaagacaagagataaaaaatggcagaagragatttatttgctatttatttgctacttggatttagaatgtagccttgtgaagactttgtcagtgttgtataaagtgatcccatgaagaaagaattcagt

SEQ ID NO: 40499 - DNA, 201 bp, Homo sapiens
cccagcgatactaactttagcaaggatacagctgggatcctaaacttggcgatcagagcccagagccgataaagttagctgcgtgagtctagcttcccccrgggcgggaatcgaggcggagcagggtacagtacggaggccagggatgagtgcagttgaccagattgttgacggaagtgtcataaaagtggacttaaatgt

SEQ ID NO: 40500 - DNA, 201 bp, Homo sapiens
ctcggctcttgtataattcaatgactggctttgccgcgtctttgtactgtcttagcctggcagcaactgcttcgggtttatcatcctcctgctggactaayggttcaccagtgacgtcatcaataccatgtacatgaggtggattgaagtccaggttatatacccttccgctaggagggtgaatccaacggcggctgagac

SEQ ID NO: 40501 - DNA, 201 bp, Homo sapiens
cacttttgcttagtggttttatcattatatattgtataaatatatatatatagtatacatctataaccatttatttattatacttacattaatttttttcmtatagactcttccagcaagaataaggtttttttttgtttttgttttgagagggagtcttgctctgtcacccaggctggagtgcagcagcatgatctcagc

SEQ ID NO: 40502 - DNA, 201 bp, Homo sapiens
gtctctactaaagatacaaaaatcagccaggcgtggtggcgcatgcttgtaatcccagatactcgggaggctgaaacaggaaaatcacttgaagatgggartgggaggttgcagtgagccaagatggcgtcactgcactccagcctgggcaacacagcgagagtctgtctcaaaaaaaaaaaaaaaaaaaaaaaaattagc

SEQ ID NO: 40503 - DNA, 201 bp, Homo sapiens
catatagattacatatggcagtgaattgacagaggattcactgggacatcttcagaaagtaagtaatgtgtttcaacaccactaaagtgttaaaataggcytcttttcttctcgccagtatgaaaagttagacaggagtcactcccaagaatagtaaaggacactcactggggacagtcatgatgggtgaagaagggatac

SEQ ID NO: 40504 - DNA, 201 bp, Homo sapiens
tatgtttgagaggatggatggggagaagactgatctatatttccactaaggtagccaagaaatattcacatgaagggacaatgggagaggagctggcaagrgtttgggcagtacttggaagatgcattccttatcatatagattacatatggcagtgaattgacagaggattcactgggacatcttcagaaagtaagtaat

SEQ ID NO: 40505 - DNA, 201 bp, Homo sapiens
caaaacaatgatgatttttttctggaattggtcatgttttaaaagaacaagaggagacagattatgggtatgttcttctataaactgtgtttagattttakaactgtgcatccattctcagctaatcagatgacagctcactctgcaggactcacatgctggtctgatcgtttacgtgttcttggtcaccctttttctgtt

SEQ ID NO: 40506 - DNA, 201 bp, Homo sapiens
aactgctcaactgctggacaatctcagcaaacacacccactgttgagacttattgagtgactcaatgttggctagaattgtccatttagctggaggggaaragggagggaaggatggatggaggagtgaagtatggaagcaggcatcaggccacttcccgtacctctcccaaactccaaaggcaatgatcacattggaggg

SEQ ID NO: 40507 - DNA, 201 bp, Homo sapiens
  misc_feature (1)...(201): n = A,T,C or G, or insertion/deletion polymorphism (see Tables 1-2)
gatagagctgttgatggcactaaatgagacaatgtgtatatagttcttagcacagagcctggaacaccagagttgttcagtaagtgatctgtgattatctnagaacacacatccccacttcacaacttggttccaatatcacctgttctgtgaaacctcactgacaacactcactagcagaggtaatgaaaaatcatagga

SEQ ID NO: 40508 - DNA, 201 bp, Homo sapiens
taactattaaatatttgaataatacccctctgataaataaatatatgagcatactacactgacttgcacatatgagaattttctagattgccagttagcasctaaaatttggagtaaatgccctaaccttctatctgggactcatgtttagaattatgatttattttcttattccatggaattataatacatatggagtaa

SEQ ID NO: 40509 - DNA, 201 bp, Homo sapiens
gtttaatttagattgtgaggtccagctccagccaatggagacaggacacattagcagggacaagctgtgtaaggaataaaattgcttccctcctttgttcrggtgtggtctcaccattgttccatctgtgaggagcaccctttctgcagaaggtaaaattgccttgctgagaaaactttttgtctaaatgctgatttttcc

SEQ ID NO: 40510 - DNA, 201 bp, Homo sapiens
taagaggggccaggatttcttcagttttgtcttgggggtgagtaatagaatctctggtcctgaggtgaaaaagtgatttttaaaaattagttggttatgtygtgatatgagttatcccccagcccaccctgtccacattgctcaaccagatttcttcccttggggccctgcatgttcagcttcacgatatcctcccatagt

SEQ ID NO: 40511 - DNA, 201 bp, Homo sapiens
ggctgctgcttacacaaagaacaaaggtgcttctatgttgggccttgcttccttatctgtgcagctatgggtatatcctaggcaagctgcctgtgctagtkcccttatctgtatctgtagcctgagttttcaggttgttcctttgtttgaaagaattctactgagcacctgccctaaccgccttcctagctggttctttct

SEQ ID NO: 40512 - DNA, 201 bp, Homo sapiens
atttttgcctccagatcaaacagaacaactcacctctacacatgtattcaggtagctgaaggcattgacaatcaaatcaaattgttcattttgaacaaccraaaagggtgaggcaatttcaataaagaaaggttgggagacttctagagtggttgtagaggaaatgccaaatccaacgtcgccattcacacaaaagccact

SEQ ID NO: 40513 - DNA, 201 bp, Homo sapiens
gagcagcctggcaacatagcaaactccatttctaaaaattatttaattaattcaataagaaaaatttttaaatgactactaaaaaatcacaaaaataatarcatattttagcctttaaaaattagtagagattgggtgcaggggctcatgcctataatcccagcactttgggaggctgatgtgagaggatcacttgaggct

SEQ ID NO: 40514 - DNA, 201 bp, Homo sapiens
tgttggagtgatgattcatagaggtttggctcacagtccaaagtatgcccaaaaaaggaaaggaatgtactcaccacagcccaccatctacatgcccacaraaggaaaagaaactatttcctggaaggctgctgcttacacaaagaacaaaggtgcttctatgttgggccttgcttccttatctgtgcagctatgggtata

SEQ ID NO: 40515 - DNA, 201 bp, Homo sapiens
aacccagaggaaccagatgggtctgggcatttcatttgcataactgaaattgcataagttgtgaatttctggtagctccaccctgtacccctagtgtgctsgctgactggtggttgtctttagaaaaggcaccacttagaaaatggcatgatggtgtaaaggaccaactggagccttggctcacaaccagcctagtgttgg

SEQ ID NO: 40516 - DNA, 201 bp, Homo sapiens
ctcagcctcccaagtaactaggaccacaggcgcatgccaccatggctggctaatttatttttatttttttgtagaaatgaggtctcactatgttgttcagsctgctctggaactcctgggctcaagtgatctgcccgctttgaccttgcaaagtactaggattacaggcataaaacacgacatgcagccccaaatttgctg

SEQ ID NO: 40517 - DNA, 201 bp, Homo sapiens
gattcagttcctcgaaggctgtcatttagaggcctccctccgtccctccttacaggtccttctcacagggcacttcgtgacatggcagctgactttctggrgaccatccaagtgagaaagagcccttagaaagaagtgacagtctttatataacctaatctcagaagtgacaactcatcccttctacaaggttctattatt

SEQ ID NO: 40518 - DNA, 201 bp, Homo sapiens
caacagtgcaaaaaataacgctttaaatctgcttccttttttgagaaagaaattcacttaaaatacaatttccttttatattcctccaaagcctgagctgkatgattttttgtgtgtgcttcctaaaaaactttatctctagaggtaaatgctgagttttgaaaaagtttagagcttttgctaaatagactgaagacttgc

SEQ ID NO: 40519 - DNA, 201 bp, Homo sapiens
taaaatttgctttttttttttttctttggagacagggtctcactctgtcaccactcaggctggaatgcagtggtgtgatcatagctcactgcagccttgamctcctgggctcaggtgatcctcccacctcagcctcccaagtaactaggaccacaggcgcatgccaccatggctggctaatttatttttatttttttgtag

SEQ ID NO: 40520 - DNA, 201 bp, Homo sapiens
acaccatgatacttcttatagaacgataatgtaaacaatattatttggttattgagaaacatttacattataaatgtaaaaactcataattcataatattyacccatatggaaggagagaaaatggtttaaaatttttccacattgcaatttcttatatacctatgtttaatgagacagtattttatatggacacctgagt

SEQ ID NO: 40521 - DNA, 201 bp, Homo sapiens
gattctcttcaaaaggtggtttataatcagctacagtctaaaatttgctttttttttttttctttggagacagggtctcactctgtcaccactcaggctgraatgcagtggtgtgatcatagctcactgcagccttgaactcctgggctcaggtgatcctcccacctcagcctcccaagtaactaggaccacaggcgcatg

SEQ ID NO: 40522 - DNA, 201 bp, Homo sapiens
ctacaggcgtgagccactgcacctggcctaccttgatcttgattctcttcaaaaggtggtttataatcagctacagtctaaaatttgctttttttttttttctttggagacagggtctcactctgtcaccactcaggctggaatgcagtggtgtgatcatagctcactgcagccttgaactcctgggctcaggtgatcctc

SEQ ID NO: 40523 - DNA, 201 bp, Homo sapiens
ttaaaaaacaaagtgcctgattcggccgtacatgtactaaaattggaacactggaacggtaacagagaagattagcatggctcctgcacaaagatgacacrcaaattcatcaagcattccttttttttttttttttggagacagtgtttcactcctatcaccaaggctggactacagtggcgtgatctcagctcactgcaa

SEQ ID NO: 40524 - DNA, 201 bp, Homo sapiens
ctgggctcagtggctcatgcctataatcccagcactttgggaggctgaggtgagagtattgcttgaggccaggagttcaagaccagcctaggcaacacagygagaccctctttctacaaacaattaacaaaaattcaataatattaaacaaaaataataaaacatagttgttagttgccctcatgtggtagcaaaggtggc

SEQ ID NO: 40525 - DNA, 201 bp, Homo sapiens
attccagcctgggcaacaagagcgaaattctgtctcaaaaaaaaaaaaaaaaaatcctgtaggtttgttatcaagaaaatgctgatgactataattaggaytataaatttagttgagagtgagagctagattagtaaataaaattgtctataaacatttgtaaatcagtcatcctcctgggtacggtttgtaaaagaaccc

SEQ ID NO: 40526 - DNA, 201 bp, Homo sapiens
actccagcattttccaggcctttctcagtcctttggagatgtaaaccttaccatgtttttgaaatgttagcatttagggaattagctaagcagcattccakcgagattggatttgaaacagagctaaagttctccggaccaaccaaaaaattcctttcctcaggggatgtctttagctcaggggagaaacatttataagaa

SEQ ID NO: 40527 - DNA, 201 bp, Homo sapiens
catatttcctgaacaccaaaacgggaaagggctgtctagagtgaaagtataagacagacaggccctgttccaggaagctccctgcactctgctcttctccycaagccgaccccaaactcacagccagctttagcaagcaggcccgtcatccttccaggtgctatgtaatattaagaagcagcagctaacaattattagtgc

SEQ ID NO: 40528 - DNA, 201 bp, Homo sapiens
gcccctgcccagtcttgtctgaatggaacagatttgtgtctcctaaattgcaagtcatgaaagaccccaattaaaataccttttttttttttttttttttytgagacagggtctcttgctctgtcacctagcctggagcacagtgacacaatcttggctcattgcaacctccacctcccaggctcaagtgatcctcccacc

SEQ ID NO: 40529 - DNA, 201 bp, Homo sapiens
tacccgttccaccgggggagaagcttgaactcagtgggacttcaacgggccgctgctggtaccttagctctggtttcgggcaactctttcagggtcctgartcttctctgaggcctcatgtatttgggcaccaaaatattgtcaacaaaaagagtcaaactctataaaatatttgaagatttattctgagctaaatatgag

SEQ ID NO: 40530 - DNA, 201 bp, Homo sapiens
aataaatcaaggactgtcaaacaaagggaggtctggggctcaggaggacttacccgttccaccgggggagaagcttgaactcagtgggacttcaacgggcygctgctggtaccttagctctggtttcgggcaactctttcagggtcctgagtcttctctgaggcctcatgtatttgggcaccaaaatattgtcaacaaaaa

SEQ ID NO: 40531 - DNA, 201 bp, Homo sapiens
aatatgtaattatgtattcacgtgtttattgtccatctccaacacccacctctatcccaaatgtcaactccatagaggcagggaccttattagtcttgttyaccagtgtattccttttagctagaataatgcctagcacacagcaagaaaagtaagaaaaatgatgtggggaatcttttaacaaatgattattcattcaga

SEQ ID NO: 40532 - DNA, 201 bp, Homo sapiens
gtccctgagtaacgaatcttattgtgagttcctcaaattgtcaagtactgattaatgcacaacctcctgacactgaagaggactctgactcacttttgaawcaaatgtcgatattttagcctttatattgcagtctgtagccaatgattgtaacctctgtgttgtacctccagtgaaaaggatggttgtgctgtcaggagt

SEQ ID NO: 40533 - DNA, 201 bp, Homo sapiens
actgaaagtttccatttcacatgaacagaaaaacatgggtaattaagagttctcaaatccaaattgataacaaaaatatgaaaagttgctcaaactaaatmgaaattagatagcacaagttaaaacaagctaaatttgtgtctatcaaaatgacaaaaacttttaaaacttctaaatatattgctgaaagtaatttggaaa

SEQ ID NO: 40534 - DNA, 201 bp, Homo sapiens
agagaattccctttagaatgcatctctgaattagaattaggatccttaaacaacaatttcctaggagaaaaccagctcagaataaatcaaggactgtcaamcaaagggaggtctggggctcaggaggacttacccgttccaccgggggagaagcttgaactcagtgggacttcaacgggccgctgctggtaccttagctct

SEQ ID NO: 40535 - DNA, 201 bp, Homo sapiens
tcaccagtgtattccttttagctagaataatgcctagcacacagcaagaaaagtaagaaaaatgatgtggggaatcttttaacaaatgattattcattcakagattccccacatcatttttctttcttttttgccctctagttacattggctttgaattcttttttctttttttttgagacttagtctggctctgtcgccc

SEQ ID NO: 40536 - DNA, 201 bp, Homo sapiens
aggctggaaacccaggaacataaggaaggtgggtatgtcaaaaatatgacaaagtaaatgagttgcctatttaaataacaggcttgaaaaaaaatgcttgkaggatggaaggcagtacttacactgaaagtttccatttcacatgaacagaaaaacatgggtaattaagagttctcaaatccaaattgataacaaaaatat

SEQ ID NO: 40537 - DNA, 201 bp, Homo sapiens
cagcctatacaatctgcacaactctacctggtggccctatgggagcctatggccatttagtgtgaactctagtctgtaaaacgaatatcatgcccactatrtcgactaatcaagcccatcctgtaccatagtctggaaaaggctgacattcctaaaagctttgcactctaagataagccacgaaaaccagaaatatttcaa

SEQ ID NO: 40538 - DNA, 201 bp, Homo sapiens
gccagtgagattttttttctaaggctggaaacccaggaacataaggaaggtgggtatgtcaaaaatatgacaaagtaaatgagttgcctatttaaataacrggcttgaaaaaaaatgcttgtaggatggaaggcagtacttacactgaaagtttccatttcacatgaacagaaaaacatgggtaattaagagttctcaaat

SEQ ID NO: 40539 - DNA, 201 bp, Homo sapiens
gaggcagagtctcaatctgtcacccaggctggaatgcagtgagtggtgcaatcttgggtcactgcaacttctgcctcccaggttcaagcgaatcttctgtstcagcctcccaagtagctgggattacagatgtgcaccaccacacctggctaatttttgtatttttagtagacacggggtttcgccatattaactaggctg

SEQ ID NO: 40540 - DNA, 201 bp, Homo sapiens
acgaggtcaggagatggagaccatcctggctaacacggtgaaacgccgtctctactaaaaatacaaaaaaaaataggtgggcatggtagcaggcgcctgtrgtcccagctactcgggaggctgaggcaggagaatgacgtgaacccgggaggcggagcttgcagtgagcggagatcgcgccactgcacttcagcctgggcg

SEQ ID NO: 40541 - DNA, 201 bp, Homo sapiens
tctgtgtgggtattgagaatgccaggaattaagaccagaaattctagagatgatggcaatggcaatgagaaatgaaggggaatgagttggtgtttgctacrtaacagtaacagtgctggatagcggatgatagaatctgatgacatgaggtttaaagcacagaatttttagagaggagagaaggagaatgctctgaaagca

SEQ ID NO: 40542 - DNA, 201 bp, Homo sapiens
tgctaaccttcagcctatttattttattttaaacagaaaaattatactatgtcaaccccaaaccctcaatcaatttcttaaaaggttaactaaagcatggkaaggtacctaaatataattcttataaaacaaaacatctggtcagttgtgaaatgtttaaaacattgcttcttgatcaccaaataattaatatggtgaata

SEQ ID NO: 40543 - DNA, 201 bp, Homo sapiens
gtcatgggagtgagtgcctgccataggagagaagatccctcaaaaagaggaattcagggctggatgcagtggctcctgcctgtaatcctagcaccttaggrggctgagatggaaggattgcttgagcccaggaggtcaggactgcagtgagccaaggtcacaccactgcactccagtctaggcaacagaatgagaccctgt

SEQ ID NO: 40544 - DNA, 201 bp, Homo sapiens
cttgaatctgggaggcagaggttgcagtgagccgagattgcgccactggactccagcctgggtgacagagtgagactccatctcaaaaaaaaaaaaaatcmcaaacattaaaaacataagatggtgatctatttcaagtactttgttaatttttttttttttttttttacctattctaagtttccttctggaggaatatgg

SEQ ID NO: 40545 - DNA, 201 bp, Homo sapiens
gacagatttacttattttgaaaaacaattctatggagatgtagttcacatattatacaattcacccatgtaaagtggacaggctgactttgttttcttttytttttttttttttttgagacagggtctcactctgttgcccaagctggagtacagtggtgccatcatggctcactgcagtctcgacctcccaggctcacgc

SEQ ID NO: 40546 - DNA, 201 bp, Homo sapiens
acagcgagagtctgtctcaaaaaaaaaaaaaaaaaaaaaaaaattagcaattacacctcctacggaatgtggtacaggcaaggcctttttagagggcatcrgccttcaccaccctactcccagagcttctctccaagcccagcatttttagctacatttttattgcacatatattttattaggtagaaatatattttatta

SEQ ID NO: 40547 - DNA, 201 bp, Homo sapiens
ctcttggtttgacatagctctcctagtcctgccattgttcataagaacaacatgtcccaccagcactgcttcttcagcctgggtcccagaataagactcasgaaacagatatgagcacaacctgaaccccagagcctaggcatctgagtgtcagtctgaggcacaattatcagctgacctgcagatctgccagtaagataa

SEQ ID NO: 40548 - DNA, 201 bp, Homo sapiens
atgctaatggccatgaccccataaagtgggaaattttaatgatgtaagaaggaaagagaagaaagcctagagcaattgatttccttgagtaaaggagaaarggatggaatctagtacaaaaatggagggattgcccttagaaggagctagaaaatttaatatatggtaacacttggaaaagcagaatatgtggatgtggat

SEQ ID NO: 40549 - DNA, 201 bp, Homo sapiens
agtagaagattcaagaccaagacaagctcatgtttccctttaggcgggcttcctcctgagggaggcccctgacctccctcttcttagagcatttgctttaraaaacttgtaaattttctctctgatacttcgagatgccaattttttttttttttttggtcattttacttttagtcgatgcataatctttaaaaaagcttt

SEQ ID NO: 40550 - DNA, 201 bp, Homo sapiens
tgatccacccttatcagcctcccaaaatgctggggttataggcatgagccattgcgcccggcctattctggtggtttctatcggatttttaaaatacataygcaaacagtatatacttattgtttaaatggaattatactatttattcaacttgtttttttatttatatatactagaaattttccacagaaatcttttaaa

SEQ ID NO: 40551 - DNA, 201 bp, Homo sapiens
ctcccaggctcaggtgatcctctggagtatctgggactacaggaatgcagcgccacacctagtggtggcgaaacatggagaagccctaatttttttgtatrttttatagagatgggatatcactatgttgcccaggttgtctttctctttaaaaaaaaaaagccagaatgaaagtgaatggtgcagccttcaagttcagtg

SEQ ID NO: 40552 - DNA, 201 bp, Homo sapiens
taactcttgtcacaaagctaggatacgtttatttctcctttttgttgatttttgaacaattagaatttatttctcacagttctgaaggctgtgtgtctgaragcagggtcccagcacagccaagttctggtgaggaccctcttccagtggcagatgcccacttctggtgctatctcccatggaggacagcagaggctataa

SEQ ID NO: 40553 - DNA, 201 bp, Homo sapiens
ggcatgagccattgcgcccggcctattctggtggtttctatcggatttttaaaatacatacgcaaacagtatatacttattgtttaaatggaattatactrtttattcaacttgtttttttatttatatatactagaaattttccacagaaatcttttaaaattccctaatttgttatcttttatttatttattgagacag

SEQ ID NO: 40554 - DNA, 201 bp, Homo sapiens
caccatgcctggctaatttttgtatttttagtagagacagggtttcaccatgttggtcagctggtctcaaactcctgacctcaggtgatccacctgtctcrgcctcccaaagtgcttggattacaggcgttagccatcacacctgacctatttttaaattttatattaatatattaactggatttttgtcaaatagagaat

SEQ ID NO: 40555 - DNA, 201 bp, Homo sapiens
ttgaggataaagagaatatggaaatattaagaaatattttagctttgttagatttttgcctccagatcaaacagaacaactcacctctacacatgtattcmggtagctgaaggcattgacaatcaaatcaaattgttcattttgaacaaccgaaaagggtgaggcaatttcaataaagaaaggttgggagacttctagagt

SEQ ID NO: 40556 - DNA, 201 bp, Homo sapiens
tacggtcctttgtgattaaattattatcatacgtgtgatatgaaatagacttctgagttgggcatggtggctcatgcatgtaatcccagcaactcaggagkctgaggccagagcatcacttggggccaggagtttcagagcagcctggcaacatagcaaactccatttctaaaaattatttaattaattcaataagaaaaa

SEQ ID NO: 40557 - DNA, 201 bp, Homo sapiens
gaccctcttccagtggcagatgcccacttctggtgctatctcccatggaggacagcagaggctataattcctttggagaaagcctactagcaaatacacamtggaattttatttagcctttcaaaaaaaggaatttctgccatttgcgacaacatagatgaacctggagaactatgctaaatgaaaaaaagccaggcaggg

SEQ ID NO: 40558 - DNA, 201 bp, Homo sapiens
ctgggttcaaggaattctcctgcctcagcctcccaagtagctgggactacaggtgtgtgccaccatgcctggataatttttttgtatttttagtagaaacrggatttcaccatgttagccaggctggtctcaaactcctgacctcaggcagtctacccgcctcagcctcccaaagtgctgggattacaggcgtgagccacc

SEQ ID NO: 40559 - DNA, 201 bp, Homo sapiens
tttttttttttttttttttagacggagttttgctcttgtccaggctggagttcaatggcatgatctcagctcactgcaacctccaccttccgggttcaagkgattttcctgccttagcctcccgagtagctgggattacaggcacctacaaccacacccggctaattttttgtatttttagtagagacgaggtttcgccat

SEQ ID NO: 40560 - DNA, 201 bp, Homo sapiens
ttttttaaaatcaggttttgaagtaagaaatgccacaaacaatcctgtaaaataatgaagctgtacacaattaaggatgcatccttaaatttaagacacayctttttattttgcacatttgcattaacgtgattcccctctggggaagttttgagcatttaccatgaatactatttgatactaagcacacaactagctcac

SEQ ID NO: 40561 - DNA, 201 bp, Homo sapiens
gttcttcctcctcctcctcagcctactcaatatgaagatgatgaggatggagacttttatgaagagctacttccacttaataaacagtaaacatactttcwcttccttatgattttcttcacattttcttttacttagcttactttaagaatacaatacataacacatataacatacaaaatatgtgttaatcaactgttt

SEQ ID NO: 40562 - DNA, 201 bp, Homo sapiens
tttcccactagcaatgtgtaaaagttcctgttgcccctattctttccagcccttggtatttgacagttctttttttctgttttttttttttttttttttaracggagttttgctcttgtccaggctggagttcaatggcatgatctcagctcactgcaacctccaccttccgggttcaagggattttcctgccttagcctc

SEQ ID NO: 40563 - DNA, 201 bp, Homo sapiens
ccacttcccgagctcaagtgattctcctgcctcaacctcccatgtagctaggattatgggtgcctgccaccatgccccctgctacatacaatttctcttgktcttttttttttttttttttttttgagattaggtctcactccgtcatctaggctagagtacaggcacaatcatggctcactgaagcctccacctcccagg

SEQ ID NO: 40564 - DNA, 201 bp, Homo sapiens
gctttcccactagcaatgtgtaaaagttcctgttgcccctattctttccagcccttggtatttgacagttctttttttctgtttttttttttttttttttwagacggagttttgctcttgtccaggctggagttcaatggcatgatctcagctcactgcaacctccaccttccgggttcaagggattttcctgccttagcc

SEQ ID NO: 40565 - DNA, 201 bp, Homo sapiens
tctctctcgctctctttttcttttttcttttctttttttttttttttttgagatggagtctcactctgtcacccaggctggagtgtagtggtgcgatctcrgctcactgcaacctccacttcccgagctcaagtgattctcctgcctcaacctcccatgtagctaggattatgggtgcctgccaccatgccccctgctaca

SEQ ID NO: 40566 - DNA, 201 bp, Homo sapiens
tgagttgcagtcttgctctgttgcctaggctggagtgcagtggcatgatcttggctcattgctcctgggttcaagcgattcttctgcttcagcctccctastagctgggagcacaggtgcacaccactacacctgggtaatttttgtatttttggtagagagagggtttttccatgttggccatgctggtctcgaactcct

SEQ ID NO: 40567 - DNA, 201 bp, Homo sapiens
gaggcggagaatcgcttgaacgtgagaggcaggtgttgcagtgagccaagatcgcgccactgcactggagcctgagtaacagaaagagactttgtctcaawaaaaaaaaaaaaaaaaagaatcaaagagagcccttgctctggattaggctttggctggtttgatcttctatccagacctttcttcatgtcagaaatgaga

SEQ ID NO: 40568 - DNA, 201 bp, Homo sapiens
ttcacatgtgatttctctctctcgctctctttttcttttttcttttctttttttttttttttttgagatggagtctcactctgtcacccaggctggagtgyagtggtgcgatctcagctcactgcaacctccacttcccgagctcaagtgattctcctgcctcaacctcccatgtagctaggattatgggtgcctgccacc

SEQ ID NO: 40569 - DNA, 201 bp, Homo sapiens
catccctgggcctccagcttgcagatggccagttatgggacttctgggcctccataatcacatgagccaatttccctagtgaattccctctcatccatccrtatctctctctatctgatctatatcctatttgttatgtgtctctggagaaccctgactaatatgtactgtagaaaagcctcctgagacttagacgctatg

SEQ ID NO: 40570 - DNA, 201 bp, Homo sapiens
cttcttaaggatgtgacagtgatctgcactagagcttcaggcagctaaggtaggctttcctggaaatcagcccataagatgagaaagaaatcttttttttktttttttgagaaggagagtctcgctgtgtcacccaggctggagtgcagtggcgcaatctcggctcactgcaacctctgcctcccgggttcaagcgattct

SEQ ID NO: 40571 - DNA, 201 bp, Homo sapiens
gacttagacgctatgtttcctttgtttaaatgttgttgaattgatcataggtataatgcattagatttttcagaagaaagaaaaggtttattccacattayatctcttcagaagcctacccaaaggggatatctgttttggctatttattgcagtgtaataaactactctaaagcttagtagcttcaattagtgatttatt

SEQ ID NO: 40572 - DNA, 201 bp, Homo sapiens
aagccaacaacttctctcaccacaaatacctttttttttttttttttttttttttttttgagacagagtctccctctgttgcccaggctggagtgcagtgrcacgatctcagctcactgcaacctccacctcctgggttcaagcgattctcctgcctcagcctccagagtaactgggatattacaggcatgtgccaccacg

SEQ ID NO: 40573 - DNA, 201 bp, Homo sapiens
ctaccatattcatagaattcatacatattcatataaatcatcagcaaatctcgttgggcctaccttcaacatctatctagaatctgagtccttcctgctgsttcaccaagccaacaacttctctcaccacaaatacctttttttttttttttttttttttttttttgagacagagtctccctctgttgcccaggctggagt

SEQ ID NO: 40574 - DNA, 201 bp, Homo sapiens
aaaaggatagacgtgcttttatacaaaacttgcatttaaatgaaaccactagacttcttcatacaatgtaatgaagtcttggtattccagcgatttggcayctaaatgcataggcactcagtaaatattggagggaaggaggatggtggaaagaaagaaagggggagcagggaaaattaggggggaaattattttttcttc

SEQ ID NO: 40575 - DNA, 201 bp, Homo sapiens
agaggttgcagtgagccgagatcacgctactgcactccagcccgggcaacagagcaagactgtgtctgggaaaaaacaaaaacaaaaacaaaaacaaacaacaacaacaacaagaatttagcacagtgtctggcatgtggaaagcactctataaatgttagctattttactatttcatcatagattcttataggacagtgg

SEQ ID NO: 40576 - DNA, 201 bp, Homo sapiens
caggaggcagaggttgcagtaagccaagattatgccactgcactccagactgggtgacagagcaagaccctgtctcaaaaaaaaaaaaaaaaaaaaggatrtaaaagaacacctggataaatggagagacagtctctggatcagaggactcaacataaaattaaaaattaaaaacaggaaaatctcttccaattaatctat

SEQ ID NO: 40577 - DNA, 201 bp, Homo sapiens
ggcagaggttgcagtgagccgagatcacgctactgcactccagcccgggcaacagagcaagactgtgtctgggaaaaaacaaaaacaaaaacaaaaacaaacaacaacaacaacaagaatttagcacagtgtctggcatgtggaaagcactctataaatgttagctattttactatttcatcatagattcttataggacag

SEQ ID NO: 40578 - DNA, 201 bp, Homo sapiens
gagcccaggaggcagaggttgcagtaagccaagattatgccactgcactccagactgggtgacagagcaagaccctgtctcaaaaaaaaaaaaaaaaaaaaggatataaaagaacacctggataaatggagagacagtctctggatcagaggactcaacataaaattaaaaattaaaaacaggaaaatctcttccaattaa

SEQ ID NO: 40579 - DNA, 201 bp, Homo sapiens
cctgtaatcccagctactcaggaggctgaggcaggagaatcgcttgaatccaggaggcagaggttacagtgagctgaaattgcaccactgcaccccagccyggcaacagagcgagagtctgtctcaaaaaaaaaaaaaaaaaaaaattagctgggcatggtggtacacgcctgtaatctcagctactcaggaggctgaggc

SEQ ID NO: 40580 - DNA, 201 bp, Homo sapiens
acgatcttagctcactgcaacctctgcctcctgggttcaagcaattctcctgcctcaacctcctgagtagctgggattacaggcacacgccaccatgcccrgctaatttttgtatttttttagtagagacgggtttcaccatattggtcaggctgatcttgaactcctgaccttgtgatccacctgcctcagcctcccaaa

SEQ ID NO: 40581 - DNA, 201 bp, Homo sapiens
caaagtagctgggactgcagctgtgcacgaccatgcccagctaattttttgaaaaaattttttgtagagacaggagtctcactatgttgcctgtctttggkttggattaatttgctaaagcagctcacagaactcaggaaaacacatttaccaatttattatgaaggatattacaaaggataccgaggaagcaatgcatag

SEQ ID NO: 40582 - DNA, 201 bp, Homo sapiens
agtcagtcctcccacctcagcctcccaaagtagctgggactgcagctgtgcacgaccatgcccagctaattttttgaaaaaattttttgtagagacaggartctcactatgttgcctgtctttgggttggattaatttgctaaagcagctcacagaactcaggaaaacacatttaccaatttattatgaaggatattacaa

SEQ ID NO: 40583 - DNA, 201 bp, Homo sapiens
tggcctcagtcagtcctcccacctcagcctcccaaagtagctgggactgcagctgtgcacgaccatgcccagctaattttttgaaaaaattttttgtagakacaggagtctcactatgttgcctgtctttgggttggattaatttgctaaagcagctcacagaactcaggaaaacacatttaccaatttattatgaaggat

SEQ ID NO: 40584 - DNA, 201 bp, Homo sapiens
ttgcagtgagccgagatagcaccactgcactcccacccgggtgacagagcgagactccttctcaaaaaaaaaaaaaaaaaaaaaaaaaaaaaaagagattmctactctgttgcccaggctggagtgcagtggtgtgatcacagctcactgcagtctcgaactcctggcctcagtcagtcctcccacctcagcctcccaaag

SEQ ID NO: 40585 - DNA, 201 bp, Homo sapiens
tctactaaaaacacaaaaaattagccgggcgtggtggcgggcgcctgtagtcccagctactggggaagctgaggcaggagaatggcatgaacccaggaggyggagcttgcagtgagccgagatagcaccactgcactcccacccgggtgacagagcgagactccttctcaaaaaaaaaaaaaaaaaaaaaaaaaaaaaaag

SEQ ID NO: 40586 - DNA, 201 bp, Homo sapiens
ggggcacaaggcggggaagagactcaaacaataagagctactactgtttgctgaacacttatgtactgagtacattccatcctcagaatcaaccttaaacwgttaacatcctcattttacagatgaggaaaatgaggctcagaagagttaactaacctaagagaccctgaagtcctagcattttccacatggaacattttc

SEQ ID NO: 40587 - DNA, 201 bp, Homo sapiens
aaccccgtctctactaaaaaaatacaaaaaaaaattagccgggcgtggtggcaggtgcctgtagtcccagctactcaggaggctgaggcaggagaatggcrtgaacccaggaggcagagcttgcagtgagccgagatggcaccactgcactccagcctgggcaacagagcgagactccacctcaaaaaaaaaaaagaagag

SEQ ID NO: 40588 - DNA, 201 bp, Homo sapiens
ggggagtgaaaaggtgctattaataattacaccaggacaataggcaggcataaactgaggctgtcctggacacatcaggacatatgttcactctaggtgtmggtcacatcagaatggctttgagcaattcaccctaacctccttgagcctcaatttcttcttcttcttcttcttttcttttttttttttttgagacagggt

SEQ ID NO: 40589 - DNA, 201 bp, Homo sapiens
atgctgaggctagtcttgaactcctggcctcaagtgatcctcctgcctcagcttcccaaagtgttgggattacaggcgtgagccaatgcacctggctgagrctggtattttcaaatttcaattctagctgtcagggagagagaaattgattggcccaccagggaccaggtgtttgcttctggtccattcttctataaccag

SEQ ID NO: 40590 - DNA, 201 bp, Homo sapiens
tttgtcttcagagctgaaaaactcagtctctcatttagctttgaaaacaacagttcagttcctcagaatcaagataaattttaggagaaaaagcaatagaraattccctttagaatgcatctctgaattagaattaggatccttaaacaacaatttcctaggagaaaaccagctcagaataaatcaaggactgtcaaacaa

SEQ ID NO: 40591 - DNA, 201 bp, Homo sapiens
cctgggctcaagtgatcctcccgtcttagcctcccaagtacctagggctacaggtgcatgccaccatgctcagctaattttcttgccatgatgctgaggcyagtcttgaactcctggcctcaagtgatcctcctgcctcagcttcccaaagtgttgggattacaggcgtgagccaatgcacctggctgaggctggtatttt

SEQ ID NO: 40592 - DNA, 201 bp, Homo sapiens
cctaaaggaactatttttacatgataaaaaacaatggtatggagtcagcaaggaaaaccacaataacacaaatgctgactttcctctcttccactacttcyactctccttgcaacttagtagcctcattttgagaggacataattttaagaaacagttggcttgtagttaaggcaaagaggagtggggatgttctatgtaa

SEQ ID NO: 40593 - DNA, 201 bp, Homo sapiens
tttgctcaccattatccagcctcctttctttggcaaaaccatcttaatctgcaccatgctgtattccagtcttggaggcagctccccaactaagaatatgmctctagctaagccagacagtgtctccccaccatcccctctctctggaattggactctggggtggagtgatccaaagatattaagcaatatacaggcagct

SEQ ID NO: 40594 - DNA, 201 bp, Homo sapiens
aaattgacaaatgggatctaattaaactaaagagcttctgcacagcaaaagaaactaccatcagagtgaacaggcaatctacaaaatgggagaaaattttygcaacctactcatctgacaaagggctgatatccagaatctgcaatgaactcaaacaaatttacaagaaaaaaaccaacaaccccgtcaaaaagtgggcga

SEQ ID NO: 40595 - DNA, 201 bp, Homo sapiens
taaaaaccctagaagaaaacctagccattaccattcaggacataggcatgggcaaggacttcatgtataaaacaccaaaagcaatggcaacaaaagacaamattgacaaatgggatctaattaaactaaagagcttctgcacagcaaaagaaactaccatcagagtgaacaggcaatctacaaaatgggagaaaattttcg

SEQ ID NO: 40596 - DNA, 201 bp, Homo sapiens
gtaacccacctttgatatgttttcatatacattatggggaaaccatatttttttgaagtcaagaaatgtatattgcttcatgttgcaaaatttgtatgctwtgtcaaagaagcattgccagaaaatgatctgaaatgtagaacaataaagttacattatagatgtcttaggtgaaccaagagaaaaattagtgtcagagtt

SEQ ID NO: 40597 - DNA, 201 bp, Homo sapiens
cttactgcagctttgacctcccaggctccagtgatcctcccacctcagccttctgagtagctggactacacacgtgctccaccacacccagctaatttttkttcttttttttttgagacagagtctcgccctgtcacccaggctggagtgcagtggtgcaatctcagctcactgcaacctctgcctcctgggctcaagcga

SEQ ID NO: 40598 - DNA, 201 bp, Homo sapiens
tctctactaaaaatacaaaaaaaaaattagccgggcgtgttggtgggcacctgtagtcccagctactcgggaggctgaggcaggagaatggcgtgaacccrggaggcggagcttgcagtgatccgagattgcaccactgccctccagcctgggcgacagagcgagactccgtctcaaaaaaaaaaaaaaaaaaaaaaaaag

SEQ ID NO: 40599 - DNA, 201 bp, Homo sapiens
aaatgaaggtgacatgaattttgatgggcttattaacactgaactatttcttgataagagttgtctaaaaaaatgagaacatatgccaggcgcggtggctyatgcctgtaatcccagaactttgggaggctgagacgggcggatcacaaggtcaggggatcgaaaccatcctggctaacaaggtgaaaccccgtctctact

SEQ ID NO: 40600 - DNA, 201 bp, Homo sapiens
agtaggagaattgcttgaacccaggaggcagaggttgcagtgagccgagatcataccactgcattctatcctgggtggcaagctagactccatctcaaaargaaaaaagaaccatgtgaaaaggcatttcagaaaagtgtcattccacctcatcccttctgtcacgtttcagtctcccattcttcccatctaccccgtaag

SEQ ID NO: 40601 - DNA, 201 bp, Homo sapiens
atatttctgtctcactgatgcttagggaccatcttttgattttgatccgtgtcaagattctaaggcagtttaactaagacatgggttttcagtgtttttttgtttttgtttttgttttaatttctgtttctgtgagtgtaatttagggaggagtaccagcttgttttttataagttgtttcttacaatgattaacacataa

SEQ ID NO: 40602 - DNA, 201 bp, Homo sapiens
tccatgtagataataattgggagtccattaattgacattaagatttcaaaatgcttcttaaaaattgtagctttcggccaggcacagtggcctgtaatccyagcactttgggaggccgaggcgggcagatcacctgaggtcgggagcccgagaccagcctgaccaacatggtgaaactccgtctctactaaaaatacaaaa

SEQ ID NO: 40603 - DNA, 201 bp, Homo sapiens
attgcttttactcaggcagagtgaagaaaatggccctgtgacagacatttccagtttcctgtacatagaaatggggaaacagttgtgaaaaaaaaaaaaaagccagctggggttcttgacacacagttcatgctaattttaaattgtactaatacttgactatatagtgagggatcctttgcaggatgatgatctgttgaa

SEQ ID NO: 40604 - DNA, 201 bp, Homo sapiens
tgacatcctgggttcaagcgattctcgtgcctcagcctcccgagtagctgggattacaggcaaacaccaccacgcccagctaatttttgtatttctagtasagacagagttccgccatgttggtgagcatgctcacaaactcctgacttcaagtgatccacccgtctcggccacccaaagtgctgggattatagggctaag

SEQ ID NO: 40605 - DNA, 201 bp, Homo sapiens
catgctgctgctctcagggtgggggaagggtggtgctggcaattcaggagtgttgttgtgttttttttttttttggttttttttttggagacggagtctcrctgtgtcacccaggctggagtgcagtggtgcaatctcggctcactgcaacctccgcctcctgggttcaagtgattctcctgcctcagcctcccaagtagc

SEQ ID NO: 40606 - DNA, 201 bp, Homo sapiens
ccagaaagtggagactgaagtgagccaagatcatgccactgcactccagcctgggggacaaagtgggacgctgtctcaaaaaaaaaaaaaaaaaaaaaaaactacaaccctaacattattaactccatcacatttttgtttgttcgtctttagctcagatcaccttttggatcattttttattgtaatttataaatactct

SEQ ID NO: 40607 - DNA, 201 bp, Homo sapiens
cttgccttaactttttcaacactatgccatgccatgcacctattgatttgtttatgttccactagaatacatgctctggatcacagagttttttttttttkttttcccagaacatagctgaatcctcagtgcctaaagcagtgcctgacatagtacagtgctttgtaaatacttgccgagtgaatgaacaacaaatgaatg

SEQ ID NO: 40608 - DNA, 201 bp, Homo sapiens
aggattcagcacttcagtcttcacagcagaactgaatgaaaaaattctacagggtccagtgcagtggctcacgcctgtaaacctaagcactttaggaggcygaggcagactgatagcttgagctctggagttcgagaccagcttcggcaacatagtgaaaccccatctctacaaaaaatacaaaaattagccaggcgtggt

SEQ ID NO: 40609 - DNA, 201 bp, Homo sapiens
gaggctaaggtgggctgatcacctgatgtcaggagttcaaggccagcctggccaacaaggtgaaacctcatatccactaaaaatacaaaaattagctgggygtggtggtgcatgcctgtaatcccagctactcaggaggctgaggtaggagaatcacttgaacctgggagatggaggttgcagtgagccgagatcacgcca

SEQ ID NO: 40610 - DNA, 201 bp, Homo sapiens
ttcagttgactgggaaaaaaccttttccaggaaaacaagatttatgaagagaaaaacataaaggcctttgaatatactcatagcttggacatcgattttarttaagctgagtgctctttttcatcaggggtgagggttgaggttagaattatataaataatataccaagttaaattaaaggattgggttatgtgcaggaat

SEQ ID NO: 40611 - DNA, 201 bp, Homo sapiens
gctactcaggaggctgagacaggagaacggcgtgaacctgggaggcagagcttgcagtgagctgagattgcgccactgtactccagcctgggcgacagaamgagactctgtctcaaaaaaaaaaaaaaaaaaaaaaaaaatctttaaactgggtttcacagtttaaaatctagaggtccacaaactatatttaaggattca

SEQ ID NO: 40612 - DNA, 201 bp, Homo sapiens
ggagaatcgccggaacccaggcaggtgaaggttgcagtgagccgagattgcaccactgtgctccagcctgggagacagagtgagactttgtctccaaaaartaaaataatataatataaaattccaggcaagcagcttcaggaagtctatcatggaatcacaggttctctccagttgtaataagaagtcaagaggatatag

SEQ ID NO: 40613 - DNA, 201 bp, Homo sapiens
cttatataaatatcaatataatttatatacatatatagtttatatacatatatatacacatttctaaatttctaagatataactcttgagttgaatctcayaaaaaatgagaagatattttccaagcagactgtggcagacactgctcattggctaaactacccacaacatccctctctctaggcatcttcaaaccagagt

SEQ ID NO: 40614 - DNA, 201 bp, Homo sapiens
ggcgtggtggcgcacacctataatcccagctacttggaaggctgaggtaggagaatcgccggaacccaggcaggtgaaggttgcagtgagccgagattgcrccactgtgctccagcctgggagacagagtgagactttgtctccaaaaagtaaaataatataatataaaattccaggcaagcagcttcaggaagtctatca

SEQ ID NO: 40615 - DNA, 201 bp, Homo sapiens
gtaaaattcctggatcatatggtagttctatttgaattttttgaggaaacttgacggtgttttccatagcagttaaaccattttacaatcccaccaactgygcacaagggtttcaatttgtccccatccttgccaacacttgttactttctgttttttttttatagcagccatcctcacagatgtgaagtagtatgtcatt

SEQ ID NO: 40616 - DNA, 201 bp, Homo sapiens
tgttgcagtgagccgtgatcatgccactgcactccagcctgggagacagagcaacacaccatctcaaaaaaaagtaataataatgaaagataagaaagagmcagagaaaagagagaaagaaaagaaaaaagaaaaaaagaaatttcccagtttctgctagaaatgaaggtaaatggaagattcagacagacatttccaaga

SEQ ID NO: 40617 - DNA, 201 bp, Homo sapiens
cttctctgctatctttccaacaaacttttgagaatgtctgtccagtcctcctaggaattgattcatctctccacagcagtacatttttgccgtctgggttkttctgtctagaataatgccagggaacggcctttggtaggacacccagtggtgggcttggttagctttctgaggaatatggactgtgctttaaattctgtg

SEQ ID NO: 40618 - DNA, 201 bp, Homo sapiens
tgagcctgggaggttgaggttacagtgagctatgactgtgccactgcactccagcccgtgtgacagagcaaggctctgtctccaaaaaaaaaaaaaaaaaraagaagaatgaggccgcgcgcacaggggctcacacctgtaatcccagcattttaagaggccaaggtgagtggatcatttgaggtcaggagttccagacca

SEQ ID NO: 40619 - DNA, 201 bp, Homo sapiens
cctagttcaaccccatcgagaccatcctggctaacacggtgaaaccccgtctctactaaaaaaatacaaaaaaaaattagccgggcgtggtggcaggtgcytgtagtcccagctactcaggaggctgaggcaggagaatggcatgaacccaggaggcagagcttgcagtgagccgagatggcaccactgcactccagcctg

SEQ ID NO: 40620 - DNA, 201 bp, Homo sapiens
tgctgagagcagtagatgttgggaagacctgcctacggagaggagctacccactgtgggtctcctctgagctgttctaaaatttagtaaagctcatcttcrtcttgtccttcacttgtctgggtacctcattcttattgtgcacccttcacttgttcgtgtacctcattcttcctgtcattcttcctggatgcaggacaag

SEQ ID NO: 40621 - DNA, 201 bp, Homo sapiens
atatctgggcctctgccccataatgattcaacaaggtatgtctacttcatggccttatgttcacattcagaaaaagctaaatttttactcttgcttagagrtttcattccagggaaaagtgaatgtaatttcgttcaatattcattaagtaggctcaacacttgtgcaagagactcttataatgactccatgattcttcaa

SEQ ID NO: 40622 - DNA, 201 bp, Homo sapiens
aggccacctagttcaaccccatcgagaccatcctggctaacacggtgaaaccccgtctctactaaaaaaatacaaaaaaaaattagccgggcgtggtggcrggtgcctgtagtcccagctactcaggaggctgaggcaggagaatggcatgaacccaggaggcagagcttgcagtgagccgagatggcaccactgcactcc

SEQ ID NO: 40623 - DNA, 201 bp, Homo sapiens
actgagccagagagagcccgggacaagcgggagacctgcccattcccagttggctgcgcgggagattccctggtgcagctgcggcaccctcacaggtgcasgtccaggcatctctgcagcctgcaccctcgagagccgggaagaccctccccttctctcgaccctgcaggctcaggggtgtctgctcccattgcctggcct

SEQ ID NO: 40624 - DNA, 201 bp, Homo sapiens
gacggggttttgccatgttggccaggctggtctcgaactcctgacctcaggtgatccaccgccttggcttcccaaagtgctgggattataggtgtgagccrctgcgcccggccattgccgttacttttaatgtcaaaaaccacagttacttttgcaccaaacccattaaaaggcagcattgttttcacccagacttctcat

SEQ ID NO: 40625 - DNA, 201 bp, Homo sapiens
aaatgattctcctgcctcagcctcctgagtagctgggattacaggcgcccaccatcacacccggctaatttttgtattttttagtagagacggggttttgycatgttggccaggctggtctcgaactcctgacctcaggtgatccaccgccttggcttcccaaagtgctgggattataggtgtgagccactgcgcccggcc

SEQ ID NO: 40626 - DNA, 201 bp, Homo sapiens
tggagtaatcctccaaaatagagggggactagatcttataatggctgaaaaaggagatcttaaatggcctctgcctctcgttggatgaggaatgttgcctmtacctcaaccaatcaagcctagtaagagatgctgctgaaaaacttacagaaagggctaaaagactaagggaataccaaaacaaccaaatagattgttggt

SEQ ID NO: 40627 - DNA, 201 bp, Homo sapiens
tcacctgatgcaaatggggcatttccacaactggctcgttttacagcctctccctcaaccgatgcctctgacctaatttgtgctgtccctagtgcccgctktattcatggctcaatatcaatggtgcaacatctgattgtattaaatgtataaagaataactcttcctatatctctactatagtggatgtctctctggcct

SEQ ID NO: 40628 - DNA, 201 bp, Homo sapiens
tctactaaaaatataaaaattagctggggatggtggtacacgcctgtaatcccagctactcaggagactgaggcaaaaggatcacttgagcccggaaggcrgaggttgcagtgagccgagatcacaccattgccctccagcctaggtgacagagcgagactctctctcaaaagaaaaagaataggaagtgaaagatagtat

SEQ ID NO: 40629 - DNA, 201 bp, Homo sapiens
agtagctgggattacaggcatccgtcaccatgcccggctaattttgtatttttagtagagatggggtttctccatgttggtcaggctggtctcaaactccygatctcaggtgatctgcccacctcggcctcccaaattgttgggattacaggcatgagccaccatacccagcttgtttcttcttgtgatgtttttgcttta

SEQ ID NO: 40630 - DNA, 201 bp, Homo sapiens
cgggttcacgccattctcctgcctcagcctcccgagtagctgggactacaggcgcccgcccccacgcctagctaattttttgtatttttagtagagacggrgtttctccttgttagccagtatggtctcgatctcctgacctcgtgatccgcccgcctcggcctcgcaaagtgctgggattacaggcgtgagccaccgtgc

SEQ ID NO: 40631 - DNA, 201 bp, Homo sapiens
tgcaagctccgcctcccgggttcacgccattctcctgcctcagcctcccgagtagctgggactacaggcgcccgcccccacgcctagctaattttttgtayttttagtagagacggggtttctccttgttagccagtatggtctcgatctcctgacctcgtgatccgcccgcctcggcctcgcaaagtgctgggattacag

SEQ ID NO: 40632 - DNA, 201 bp, Homo sapiens
gtgctgagattacaggtgtgagccactgtgcccggccctctcttaagctggctttaattattatttggtttcacattttgatctttaattaatttttgcarttgtgataactaacttggaagagagaagacagactgagttctgggcaaagtcttggatcattgagagggaaggaaaaggtttgaagatgaaagtgatgag

SEQ ID NO: 40633 - DNA, 201 bp, Homo sapiens
taagtttaataaagtcaaaactgtcattttttcccccttattgtggattttggtattccacctagaattgcctgcttgggattttacttgtattttcccamaatttttttctaataagtctgtatttttaattaattaatttatttatttgagacagtctcactctgttgcccaggctggagcgcaatggcatgatctcgg

SEQ ID NO: 40634 - DNA, 201 bp, Homo sapiens
ttgaggcagttttcctaagatattgccacctccaactgtagaaagaatgagcagaagctatttactctgaatccatgaaactctcaagggaaaaaaaaggwgtgtgtgtgtgtgtacatatataaacatatatatgtacacacacacacacacacacacatatatatatacatattccttttttttctttgagacagggtc

SEQ ID NO: 40635 - DNA, 201 bp, Homo sapiens
ttggttgtttcaaagctcaaccatccaatgaagagcttcctccgctggtcaggctctttaggagactcagacttagacatgacggcagaaagaagagagaytttaatgatgcttcctcggtggtgtccaagggcagaaaggcaaaatctattttcttagcaattttcaagaatacaatacattgtgtgtgttttttaaaat

SEQ ID NO: 40636 - DNA, 201 bp, Homo sapiens
cttctctgtgatgctggtgccctcctcaccaggccatgacttagcacgccggtaaacggagtatgctctgggccctcctagggaacactgtggggggtggrttttctggcctctatagtctaaccagtttggcatgcccactgctctggacatcctgattccttccttcaccatttgctgtggcagttcttccaattctac

SEQ ID NO: 40637 - DNA, 201 bp, Homo sapiens
tctaaagctgcttagaatgaagctcttccaggagccatccgcacaatttcccacttaaccaggaaacatttctcctctaaaatacatgaaatcatcttgaygtattattttggagattacactaattaatacatatccgagactcgaaaaaaactaaaaaagaaggtttcataaacagaagacaattcaagggagttcctg

SEQ ID NO: 40638 - DNA, 201 bp, Homo sapiens
cggccaggccaagaagcttccaagcttgatcctcctcttaatatttattggagctggaggtcctggagcagcactgtatgtcttgcatctggcactgttcratcagatgttagtaggggcagaaagaataacccaaaaaccctgagacaaactgggtgccaatgatcagtacaagttcaactcggtgaatgtggattacag

SEQ ID NO: 40639 - DNA, 201 bp, Homo sapiens
aactcgtttaatcctaaatgggtcctgttaagaattcctttgttattttgttatgctttaaggcccaggaaaagcctaggcaaaactcttggtgggctttygttacattccagcctttgtataagggcactggcttttttaacttttaatatttaacttaaccactcagtcagtactgaaacagttgttatggaggcctgc

SEQ ID NO: 40640 - DNA, 201 bp, Homo sapiens
agcttatataccttctaagctatatgtctacgtgtaagtgtgcattcatctaaagacataagtgattaacttcttctaatctatagctaaggtctgagtcytgaagaccttcctctggagcctcagtaaatttacttaatctaaatgggtccagctgctggggtgattacccttattatgtctcctgcttaaatcacggag

SEQ ID NO: 40641 - DNA, 201 bp, Homo sapiens
cttgatttatactattaatatagctatcaataataaacaagggcaacctcttttggctctgatatattctgagacccctgaataatgcctctagaattttytttttgaggtcccttgatggtcttttcttgaggcagttttcctaagatattgccacctccaactgtagaaagaatgagcagaagctatttactctgaatc

SEQ ID NO: 40642 - DNA, 201 bp, Homo sapiens
agccattgtacagtttgacaggcctgtgtgaatatcctgctttgtagctgagtgttcttgcttgttaatctgcttcccctatccccactcttttttttttwttttaatctggtggttgagaggtgcttccaagcctacctattttatttaccacttcctcgttagttttttgggcttcttaaaatggtcctccactcttat

SEQ ID NO: 40643 - DNA, 201 bp, Homo sapiens
aactagctaggagatttttatgatgatatgatacagatcagcaatacgtaagacagaaagggggcttcacccagcaagagttaggatttatagtcccagtrtgcccgagttttacatattgtgaactttgctaaccttcacctttatcaacaagctgtgagtgactctccagcacaaagctttgagtatcaagcatgcata

SEQ ID NO: 40644 - DNA, 201 bp, Homo sapiens
ccacttctgggatgaaataaaatctgtgtcttgaagagacatctgcaccccatgttcatagcagcactattcacaatagccaagatatggaaacaacctamgtatctgtcagccaatgaatgaataaagaaaatgtggtgtgtatacacaatggaatattatttagccatgaagaaggaaatcctgccatttgcaaaaaca

SEQ ID NO: 40645 - DNA, 201 bp, Homo sapiens
ttgctttctgaacactagttaccatctacccaagctaaggtttcctgggaatacaggtccggaaacggtactgtaatccctttagatcccatcaggaaacmtagaggatgatctgaacaataattccctccaattgatagcttaggaagatctctccattctgttattttaaggatttttaaagaccacctcaaccaagat

SEQ ID NO: 40646 - DNA, 201 bp, Homo sapiens
gacaggtagtccaggggaggggtgtggaaatactgctttacacaagggtagtctgggacagctccgctgtcaaggtggtatctgaatagaaatgagagagyaagccatatggatatgtgatgaaagtgtccctggccgggcgcggtggctcacgcctgtaatcccagcattttaagaggccgaggcgggcggatcacgaga

SEQ ID NO: 40647 - DNA, 201 bp, Homo sapiens
attgcgtgattccaggagtttgaggctgcagtaagtcatgattgtgccactgcactgcagcctgtgtgacagagtgagaccaaaaaaaaaaaaaaaaaaaattgaagacagaaataaatggaaaggtatcctctgttcaaagagtggaatagttaatattgttaaaatgtccatactactgaaagcaacatacagattcaa

SEQ ID NO: 40648 - DNA, 201 bp, Homo sapiens
atttatgtgcccgggatccaggaatcctggttttggtggcagtttcccttgattttattgagacttttaagttggtccctttacatttttatttctagttsacaatccaaaaaaaattattaatcagaattcagttttgggaagacgaggggtcatacggtttgtattttcacatgtgaatgtaggaattatgttctctat

SEQ ID NO: 40649 - DNA, 201 bp, Homo sapiens
tgggcagttgttcagtttggtgttactgtgggggatgaggagggtggtcaatggaggcttctattctgcctcttgctctgcctcctgagctccaggcctgygtttggactttaccttactctcagagcaggttttgtaaaaaagtaaaacctgttggggttttgctgactcagcgcatgtgtgaggaaggaggagggatag

SEQ ID NO: 40650 - DNA, 201 bp, Homo sapiens
caatcacacccagctagttttttgtatttttggtagagacagggtttcaccctgttgcccaggcgggtctcaaacccctgggctcaaacgatccacctgcytcagtctcccaaagtgctgggattacaggtttgagccaccttagaaccctcttttaccccttgttgttgttaaccactttttactagctaacaattataa

SEQ ID NO: 40651 - DNA, 201 bp, Homo sapiens
gagcaagtctgttggcaacgtttttcccgcatgtgctcactctgtgtctctgtgtcccattttggtaattcacacaatatatcaaagtttttcattattgkattatatatataatattatgtatatataatatgtaatatatataatacgtatataatatataatatatgttatatattatatgttatatgcaatatatgt

SEQ ID NO: 40652 - DNA, 201 bp, Homo sapiens
catggaaaagaaagtagaagagcaaaatacaggaaaacacataacagtaagaacaaacaaggaatatttgggaaatgagagaaattaggattaggaggtasgtgggccttaacaaaaataaatagaatcaaattttctccttgtattgctatagtgcttcccaggaactgaatataacttatttaattgtaccaattgtac

SEQ ID NO: 40653 - DNA, 201 bp, Homo sapiens; identical to SEQ ID NO: 11305

SEQ ID NO: 40654 - DNA, 201 bp, Homo sapiens
gccaaggcgagaggctcacttgaggtcaggagtttgagacaagcctggccaacatggtgaaactccgtctctactaaaaaaaaaaaaaaaaaaaaaaaaaatcaataaaataataattagtaaaatataagaagaattggccgggtgcagtggctcatgtctgtaatcccagcactttgggaggccaaggcgggcggatca

SEQ ID NO: 40655 - DNA, 201 bp, Homo sapiens
cttgtgtgtgttttcaaatagcctatcttcaggctcactaattcttctgcttaatctattttgctaataaaagaccctgatgccaattacattttttagcyccagaacttctgcatgattctttttaattatttcaatctccgttaaatttatcagatagaattatcaattccttctctatgttattttgaatttctttga

SEQ ID NO: 40656 - DNA, 201 bp, Homo sapiens
ggccaaggcgagaggctcacttgaggtcaggagtttgagacaagcctggccaacatggtgaaactccgtctctactaaaaaaaaaaaaaaaaaaaaaaaaaatcaataaaataataattagtaaaatataagaagaattggccgggtgcagtggctcatgtctgtaatcccagcactttgggaggccaaggcgggcggatc

SEQ ID NO: 40657 - DNA, 201 bp, Homo sapiens
tataaaatactttatttcttgaggtccaaaagacttcaaaataggggctgagtgatataatggaaagaacactggattaggagccagaatatctgggttaygttgcctgctctctcactaactggctcagtgaatttgggcaggttatttgaactctctggatctcggtttcttctatggtgagtttatgggcttagatta

SEQ ID NO: 40658 - DNA, 201 bp, Homo sapiens
atataactgatcaaaacaaaataaatacaaagtatgattcatacatattagatataaaattaaaatacttttgaagcacatctttaatgagaatgatgagytgttttttcccccagtgaatttatgcatccatggattgcaagaattaaacaacattaattctgttactatttttgttttgtgtagctataagtgctaaga

SEQ ID NO: 40659 - DNA, 201 bp, Homo sapiens
cctcctgctgccctatcatgcgccatgcatggcaccaggtgtctctggtcttcacgctgactctgccatgggggtggtgttcctgttttacattggaaacktggagattcagagatggtcaagctctgtcctgaggtcatgcagctcatgagtgtggagctggggtgtgcccactggtttctgactgtgaaacccccacga

SEQ ID NO: 40660 - DNA, 201 bp, Homo sapiens
gcatttgagtccaggaattcaagaccaacctgggcaaaatagtgagagaccctgtctctataaaaataaaatgaggccgggtgcagtggctcaagcctgtmatcccagtcctttcggaggccaaggcgagaggctcacttgaggtcaggagtttgagacaagcctggccaacatggtgaaactccgtctctactaaaaaaa

SEQ ID NO: 40661 - DNA, 201 bp, Homo sapiens
tcctgcctcagcctcccgagtagctgggattacagacgcatgccaccacgcccagctaatttttgtatctttattagagatggagtttcaccatgttggcyaggctgctcttgaactcctgacctcgtgatccacccacctcggcctcccaaagtgctgggattacaggtgtgagccaccgcgcccggccaaaataattgt

SEQ ID NO: 40662 - DNA, 201 bp, Homo sapiens
aagagaggcattgctatcaacagcacttttttccatcatcataattatcatcatcagttctacaccaagagaagatgtactgatgagcatgaaatttggcygttgaaggccatgcataagaattatttcccttttccctcacatgccatggcagtgaacattttacttgaggtaggtcttaaacagattaaaacttgtagg

SEQ ID NO: 40663 - DNA, 201 bp, Homo sapiens
catttccctgcacctcacctgcccccatgctcctgagtccctccagccctggatgccagcagccagttctgcaagccagggagatggcatgtgtgaggcaraagtcccctcaggattggattttgtcattactgaagttgtctggaggggactgaattgaggaatgctcaagatcagtgcaggctcctcctgctgccctat

SEQ ID NO: 40664 - DNA, 201 bp, Homo sapiens
aaaataacatttatttatttaaaaaataattttttaagagacagggtctcactgtattgaccaggctgctctcaaactcctgggttcaagtgatcctcccrccttggcccccaaatgtgctaggattacaggcataataagccactgtgcccggccatgtaagtaaaaataaaacttaaaagatagaaaactgaatgcaat

SEQ ID NO: 40665 - DNA, 201 bp, Homo sapiens
tacatttctgaggtctgcacatctgaagatattataaactagctaggagatttttatgatgatatgatacagatcagcaatacgtaagacagaaagggggyttcacccagcaagagttaggatttatagtcccagtatgcccgagttttacatattgtgaactttgctaaccttcacctttatcaacaagctgtgagtgac

SEQ ID NO: 40666 - DNA, 201 bp, Homo sapiens
catcggaggctgaccatggctttccagtgcatcccagaactctggggaccccgctatgacagagtgcctcatttccctgcacctcacctgcccccatgctmctgagtccctccagccctggatgccagcagccagttctgcaagccagggagatggcatgtgtgaggcagaagtcccctcaggattggattttgtcattac

SEQ ID NO: 40667 - DNA, 201 bp, Homo sapiens
tagtagagatagggtttcacattgttggtcaggctggtcttgaactcccgacctcagctgattcacttgcctcggcctcccaaagtgctgggattacaggygtgagccaccatgcccagctaaaaggccattcttaattttcaaaagagaactttatgacatctgggaatttcagaggctttgcagaacaatattaagaaa

SEQ ID NO: 40668 - DNA, 201 bp, Homo sapiens
ttgctgcatagaggcaatgtttccaggagaacctcacctggccagaaacatctgccttgaacatggttagaacaaatgaaacttttttgtattaaaacacwtgagattctgtggctcttcgttactgtgttaccctatcctgaccttgctttgtggtttatttaatgatgcacatttactagagtggtgtacattcaatag

SEQ ID NO: 40669 - DNA, 201 bp, Homo sapiens
acaccagttatgaggaaccaggaacttggccatcactgtgagacagaactggagcaggggcctagctgaatagtaggtgtattacatgtgtgatctttggrcaggactatacctgctcttcctgctactgctactgtgtgccaccatggatgggaacataagatccaggaaacaagacttttcaaggttggaacagactgt

SEQ ID NO: 40670 - DNA, 201 bp, Homo sapiens
acaatgggagctgtagaccggagctgttcctatttggccatcttggctcctccccccttttttttctttttttaagatgcagtctcactctgtcacccagrctggagtggagcagcatgacctcggctcactgcaacctccgcctcctgggttcaaacagttctgtctcagcctcccaagtagctgggactccaggcacct

SEQ ID NO: 40671 - DNA, 201 bp, Homo sapiens
gacttctagagtggttgtagaggaaatgccaaatccaacgtcgccattcacacaaaagccacttgcctcccattgggttatcgtatcaggaatgaggaacraaagattggcagagcctgaggaactggaagaagaggttatcggtaaaacacattctttgtctgaaccaagaacttaaaattaagtgcagagcaagcagaa

SEQ ID NO: 40672 - DNA, 201 bp, Homo sapiens
acctactgtctggcactccccagtgagatgaacccggtacctcagttggaaatacagaaatcacccgtcttctgcgttgctcacaatgggagctgtagacyggagctgttcctatttggccatcttggctcctccccccttttttttctttttttaagatgcagtctcactctgtcacccaggctggagtggagcagcatg

SEQ ID NO: 40673 - DNA, 201 bp, Homo sapiens
cacagggtagttcatgagacatgggctcaaggtggacaaagctcttgcttggggagaacacaagataagcagtgtgatgtgcctcttcgtgttcttctgayacccactggtagccgtaacagggactacgatccttgtaattgacctaatgaattagaaaaattatattatttttagattatacgtcataaagattaatgt

SEQ ID NO: 40674 - DNA, 201 bp, Homo sapiens
caggtgccctctgtcactgctttctttgactaggaaagggaattccctgaccccttgcgcttcccgggtgaggtgatgcctcgccctgcttcggcttgcgygtggtgcgctgcacccactgtcctgcacctactgtctggcactccccagtgagatgaacccggtacctcagttggaaatacagaaatcacccgtcttctg

SEQ ID NO: 40675 - DNA, 201 bp, Homo sapiens
gccatctcggctcactgcaagctccgcctcccgggttcacgccattctcctgcctcagcctcccgagtagctgggactacaggcgcccgcccccacgcctrgctaattttttgtatttttagtagagacggggtttctccttgttagccagtatggtctcgatctcctgacctcgtgatccgcccgcctcggcctcgcaaa

SEQ ID NO: 40676 - DNA, 201 bp, Homo sapiens
ttgccattatctgcaaaaaaggaaataaaaagaaattaaatgtgccagagagaacacgcttcagtctcacttcaatatacttgttttattgagtccctgcyggcaataattcacctcaagagaaatcaaactttcaaaaggaacatggataagaagttgaagtaatgacatctaaagagcttcatgattacttgctccaca

SEQ ID NO: 40677 - DNA, 201 bp, Homo sapiens
cccacttgaggaggcagtctgcccgttctcagatctcaagctgcatgctgggagaaccactactctcttcaaagctgtcagagagggacatttaagtctgyagaggttactgctgtctttttgtctgtgccctgcccccagaggtggcgcctacagatgcaggcaggcctccttgagctgtggtgggctccacccagttcg

SEQ ID NO: 40678 - DNA, 201 bp, Homo sapiens
tgccatctcggctcactgcaagctccgcctcccgggttcacgccattctcctgcctcagcctcccgagtagctgggactacaggcgcccgcccccacgccyagctaattttttgtatttttagtagagacggggtttctccttgttagccagtatggtctcgatctcctgacctcgtgatccgcccgcctcggcctcgcaa

SEQ ID NO: 40679 - DNA, 201 bp, Homo sapiens
aaaaagacaacacatatttgataaagggtgagaaaaaaaccattattgttttccctccctcaactttcttttaattaatattagatggaaatggtctctcrttacttgaaagtattcctgatattcccagctcaggaatggaaaaccaaacatcatatcttctcactcagaagtaggagctaagctattaggaagtggcag

SEQ ID NO: 40680 - DNA, 201 bp, Homo sapiens
agtagagacagggtttcgccatgttgcctaggctggtctgaaactcctgacctcaggtgatccgccctcctcagcctcccagaatgttgggattacgggcrtgagccactgcgcccggccaagtttatacatttctttctacacactacgtagctgcatcccacagttgtcatctgtaatactttttttttttttttgaga

SEQ ID NO: 40681 - DNA, 201 bp, Homo sapiens
cacgcctgtaatcccaacactttgggaggccgaggtgggcggatcacgaggtcaggagattgagaccatcctggctaacacagtgaaaccgccgtctctaytaaaaatacaaaaaattagctgggtgtggtagcaggtgcctgtagtcccagctactcgggaagctgaggcaggagaatggcgtgaacctgggaggaggag

SEQ ID NO: 40682 - DNA, 201 bp, Homo sapiens
atggtagtgcacccctgtagtcccaactactcgggaggctgaggcaggaaaaacacttgaacccgggagtcagaggttgcagtgagcctggatggtaccaytgcattccagcctgggtgacagcaagactccgtctcaaaaaaaaaaaaaaaaaaaagaagtaagaagtaaggaaagaacaaaggaaggaaggaagcaaga

SEQ ID NO: 40683 - DNA, 201 bp, Homo sapiens
gctacttgggaggctgaggcagaagaatcgcttgaacccaggaggcggaggttgcagtgagctgagactgggccgctgcactccagcctgggcaacagggygagactccatctccaaaaaaaaaaaaaaaagaaatagttgaagaaacacactcagaatagaagaaccaaattgaaagtgtccatcataatagatgaaaat

SEQ ID NO: 40684 - DNA, 201 bp, Homo sapiens
ctatgaagttcagcagccaaataatagaatttccaggaagagtaaaacagaggggaagaaatcaacaatgaaatagttcaggctgggcgtggtggctcacrcctgaaatcctagcactttgggaggctgaggcgggcggattgcctgagctcaggagttcaagaccagcctgggcaacacagtgaaaccatgtctctacta

SEQ ID NO: 40685 - DNA, 201 bp, Homo sapiens
gggtgcaggttacagtgagccgagagcgccactgcattccagcctgggtgacagagcgagactccatctcaaaaaaataaataaataaaagaccaggcccrgtggcttacacctgtaatcctagcactttaggaggctgaggcgggcggatcacttgaggtcaggagtttgagatcagcctggccaacatggtgaaacccc

SEQ ID NO: 40686 - DNA, 201 bp, Homo sapiens
cggtggctccctcactcactttgggaggccgagggaggtgtatcacaaggtcaagagatcgagaccatcctggctaacatggtaaaaccccatctctactraaaatacaaaaattagctgggcatggtggcggtcgcctgtagtcccagctactcaggaggctgaggcaggagaatcacttgaactcagggggtgcaggtt

SEQ ID NO: 40687 - DNA, 201 bp, Homo sapiens
agagacggggtttcaccatgttggccaggatggtctcgaactcctgacctcaggtgatctgcctgcctcagcctcccgaatgctgggattacaggcatgarccacactgcacctggccgatgataaacctttgaaagctaaaaagcaaagagatgattgcagactaactcagaagaactgagaaagctgaattatgtggca

SEQ ID NO: 40688 - DNA, 201 bp, Homo sapiens
ctcatttatagaacttcacttgatttatactattaatatagctatcaataataaacaagggcaacctcttttggctctgatatattctgagacccctgaawaatgcctctagaattttctttttgaggtcccttgatggtcttttcttgaggcagttttcctaagatattgccacctccaactgtagaaagaatgagcaga

SEQ ID NO: 40689 - DNA, 201 bp, Homo sapiens
aataacataaacttatagaatataaattggaattcactcatttatagaacttcacttgatttatactattaatatagctatcaataataaacaagggcaayctcttttggctctgatatattctgagacccctgaataatgcctctagaattttctttttgaggtcccttgatggtcttttcttgaggcagttttcctaag

SEQ ID NO: 40690 - DNA, 201 bp, Homo sapiens
cttatccacggagtcatggttgtcaaaggttacaaaggcaaagtcccttttcttgccactgccttggtcagtcatgatttcaatcacttcaatttttccamactgttcaaaattatctgttcttcagtgtcgtcgtcttcttctttttttttttttttttctgagacagagtctggctcttgtcacctaggctggaatgca

SEQ ID NO: 40691 - DNA, 201 bp, Homo sapiens
gagccaccacacctggtcttaggtttcttaattttatttctctgtgtttctacaggcttttaggccattttactaataattacttttttttttttttttttagtttttttgagacagagtcttgctctgtcaccaggctggagtgcagtggtgcgatcttggctcattgcaaccgctggttcaagcgattctcctgcctca

SEQ ID NO: 40692 - DNA, 201 bp, Homo sapiens
atcgcttggacctgggaggcagaggttgcggtgagcagagatcaccccacggcactccagcctgggcaacagagcgagactctgtctcaaaaaaaaaaaaatttactttttattataaatttgtcatatttaatgccatggtgcattatagttctggctacaaaatgaaacaatttatttttaaacttgattttttttctc

SEQ ID NO: 40693 - DNA, 201 bp, Homo sapiens
aggtctgcaacatcagtcactcctcgcccatctgtatcccagcttttaacagtttgttactgctctttcctatcatattctcttgtgggcaccaaattttyttttttaattttattgtatctttagaggagttttaggggagagtaaaaataaatatatttttcaatccatctttacccagaaattgaaatattacttttt

SEQ ID NO: 40694 - DNA, 201 bp, Homo sapiens
gcagtaataaggatttttaaaaattatgtgacaattgtgtattagactgaagtaattaatacctttgtcacagggaccgggtgcaatggctcatgcctgtwatcttagcactttgggaggccgagacaggcagatcacttgaggtcaggagtttgagaccaacctggccagcatggtgaagcctcatcttactaaaagtac

SEQ ID NO: 40695 - DNA, 201 bp, Homo sapiens
cggggtttcaccatgttagccaggatggtctcgatctcctgacctcgtgatccgcctgccttggcctcccaaagtgctgggattacaggcgtgagccactrcgcccggccctacaacatgttttaaaatatgaatacgttgtggaatgattcgatcgatttgaccagtgtcttcattttttgatcgagctaattaacatat

SEQ ID NO: 40696 - DNA, 201 bp, Homo sapiens
taaatatatttatatatttataaaaatatataaatatatttatatatttatataaaatatatataaatattttaatatatatttaatatataaatatttataaaaatataaatatttatataaaatataaaatatttattgcaaaaactttttaatgataaaaatattggaaccagcataaagatgagcttaccaaagtta

SEQ ID NO: 40697 - DNA, 201 bp, Homo sapiens
ataaatatatttatatatttataaaaatatataaatatatttatatatttatataaaatatatataaatattttaatatatatttaatatataaatatttataaaaatataaatatttatataaaatataaaatatttattgcaaaaactttttaatgataaaaatattggaaccagcataaagatgagcttaccaaagtt

SEQ ID NO: 40698 - DNA, 201 bp, Homo sapiens
tataaatatatttatatatttataaaaatatataaatatatttatatatttatataaaatatatataaatattttaatatatatttaatatataaatatttataaaaatataaatatttatataaaatataaaatatttattgcaaaaactttttaatgataaaaatattggaaccagcataaagatgagcttaccaaagt

SEQ ID NO: 40699 - DNA, 201 bp, Homo sapiens
atataaatatatttatatatttataaaaatatataaatatatttatatatttatataaaatatatataaatattttaatatatatttaatatataaatatttataaaaatataaatatttatataaaatataaaatatttattgcaaaaactttttaatgataaaaatattggaaccagcataaagatgagcttaccaaag

SEQ ID NO: 40700 - DNA, 201 bp, Homo sapiens
acctctaggaagctgtacatatccttttcatttgtacttgatactggagtatatgtgattccattaatatagacattatgacgattgatgcagtcttcatygtcctggtcattcaaaggcccagggaagccagtgaggtccttttctggtagcaggttgtaaacctgtacaaatacgaaagacaaaaaggcaaacttattt

SEQ ID NO: 40701 - DNA, 201 bp, Homo sapiens
tgaggccaagagttcaagaccagcctggccaacatggtgaaaccccatctctactagaaatacaaaaattagccaggcgtggtggtgcgcacctgtaatcygagctacttgggaggctgaggcataagaatctcttgaacccgggaggtggagattgcagtgagctgagatcacaccatggcactccagtctgggcaacac

SEQ ID NO: 40702 - DNA, 201 bp, Homo sapiens
aaaaaaaaacaaaaaacaaatcgtctgatgaaatagagaggaaggaggagagggcgcttgggtcatcaaggaaagcttctttgaggaggaaatatgttggwtgacttaacaagccaggagaggccgggcgcggtggctcatgcctgtaatcccagcactttgagaggccgaggccgagacggcgccactgcactccagcct

SEQ ID NO: 40703 - DNA, 201 bp, Homo sapiens
agaatttccttagaataacagcaaaggaacttaaagtgttcagaaaaacaaagtgaggatggtaggaatcctttcgcctgaaactttggaaaaaggtggaygaattacaactaagtcatcttttagctttgctttcttgatcttccttcaaagtttatgatacctaaattctctcttcaactcataaaatgtgttttatgg

SEQ ID NO: 40704 - DNA, 201 bp, Homo sapiens
ctccaggagtagatggagctctgcaatcaggagtctccctagaccacagtgaacacagaggtggttttaaataggcctttgagcaatgccagtggctaccygcccccaccaccccttggctcaatacagagagaacaggcaaaatctcccatttctggctgtctcctaagggttgggcttctaaacagcctgcatctggga

SEQ ID NO: 40705 - DNA, 201 bp, Homo sapiens
gtcgtgagttcaagatcagcctggccaagatggtgaaatcccgtctctactaaaaatacaaaaaatttagctgggtgtggtggtgggtgcctgtccctagmtgcttgggagtttgaggcagagaattgcttgaacccgggaggcagaggttgcagtgagccaagattgcgccactgtactccagcctggcgacagagcgag

SEQ ID NO: 40706 - DNA, 201 bp, Homo sapiens
ctgagattacaggcacgcgcgccatcacgcccagctaatttttgtatttttagtagagacagggtttcaccatgttggccaggctggtcttgaactcctgwccttgtgatctgcccacctcggcctcccaaagtgctggcattataggcgtgagccactgttcccagcctgctaatagcttttaaaaaggaatattgattt

SEQ ID NO: 40707 - DNA, 201 bp, Homo sapiens
gatgtatttatgttaaacatctcctgaaattagcaatgcgtttgaaagaagtacttcagtactgaaaaattagctaacagctcccagtttctccctggaasggcttcgtctacccactttatcagttgctgactgagtgttgggcttctaactagcctgcactgggaagcagaaggagcagggaaacgacagacttacagg

SEQ ID NO: 40708 - DNA, 201 bp, Homo sapiens
tgcaggggagccccgccctgctcaggtggcctcatctcccctcccagctggtggtgctgccctatcagatgctgctgcatgcggccactcggcaggctgcvggcatccggctgcaggaccaggtggtgatcatcgacgaggcgcacaacctgatcgacaccatcacgggcatgcacagcgtggaggtcagcggctcccagg

SEQ ID NO: 40709 - DNA, 201 bp, Homo sapiens
gattgcgccactgtactccagcctggcgacagagcgagactctgtctcaaaaaataataatgataataataataattttataaaatacagggagtataaasaaaaactgatcacccaaattggagaaccaaattaatagttaatcttaacctaattaggagttaatcctacagggccaataataggcagagtgaagaaatc

SEQ ID NO: 40710 - DNA, 201 bp, Homo sapiens
agtgattctatcagaaaatatcatttttcactcactggcttttgaaacataattagattttctgagcaactgttgcttataattggaatttgcttattatmattttaacagagaaaaacactgacctatgtaattttagtgcaattaaatttttctccttatgcctgtgtgtacctcatcaattcagcaaaagcaaaacct

SEQ ID NO: 40711 - DNA, 201 bp, Homo sapiens
ttgagatgggaatataagtccttttcttccaactgtttttaattgtagtatatcagaattgtagcataatcttttacagacaatatagttataaatttaayatgcagtttgagattgttcttaagttctcttctctaaaatgctatttcactgagggctgctttataattttaaattctactactattgtgtatagtgggc

SEQ ID NO: 40712 - DNA, 201 bp, Homo sapiens
tcctgcaggggagccccgccctgctcaggtggcctcatctcccctcccagctggtggtgctgccctatcagatgctgctgcatgcggccactcggcaggcygcgggcatccggctgcaggaccaggtggtgatcatcgacgaggcgcacaacctgatcgacaccatcacgggcatgcacagcgtggaggtcagcggctccc

SEQ ID NO: 40713 - DNA, 201 bp, Homo sapiens
gactacaggcgcatgccaccacacatggctaattattgtatttttagtagagacggggtttcaccatgttggccaggatggtctcgaactcctgacctcargtgatctgcctgcctcagcctcccgaatgctgggattacaggcatgagccacactgcacctggccgatgataaacctttgaaagctaaaaagcaaagaga

SEQ ID NO: 40714 - DNA, 201 bp, Homo sapiens
aatttaacataggtaaatctccaagacaggatgctgagtgaaaaacaaacagtgatttatagaatgaaacttatacagtttattatatgtaaatcacacawccacaaacatatacatctacacacattatttctaaagataaatggatggcaaagtactgaaaaatgttcaggggggtgacattaacctttaatgtgatgt

SEQ ID NO: 40715 - DNA, 201 bp, Homo sapiens
aaagaaaaattacccagtttcaggtatttctttatagtagtgcaagaatggactaatacaatgaaaacaccaaacatcaggctgggtgtggtggctcatgmttgcaatctcagcactttgggagcctgaggtgggaggatcacttgaggccaggagttcaagaccagcctgggcaatatagtgagacccaattgctacaaa

SEQ ID NO: 40716 - DNA, 201 bp, Homo sapiens
gctgaacaaatcttatttcagcaaatgacaaaataagatttgttcagcacatctcatgtgagtgctcacatagcgtgggctctgtggtcagacaaacactrggcacttctcttggtgttatcaccttaagctgtgtgccttggggaaagttactcaatttctcattccctccatttcctcgtgcacaaaatggcagaaaat

SEQ ID NO: 40717 - DNA, 201 bp, Homo sapiens
tttaataatttaccagccttgtatttcttcacattcttgtttcagagatagtttgaaaatagtccaaaaggaagataattccaaattcctgaggattttcmccaagtgttgagtgtactatataaagtgataacagaggattatgtggatgcataacccagtggcaacgaattccattttggccgtgaactactgaacaga

SEQ ID NO: 40718 - DNA, 201 bp, Homo sapiens
aatggcttgaacccgggaggcggaggttgctgtgagccgagatcgcgccattgcactccagcctgggcaacaagagtgaaactccatctcaaaaaaaaaaagagagagaaataccattacatgtcccttgcttctaggagctaccttgatcaagtttgccgaagaaggaatcatatgcctcccctttgtttagtttactat

SEQ ID NO: 40719 - DNA, 201 bp, Homo sapiens
ggtggcagtttcccttgattttattgagacttttaagttggtccctttacatttttatttctagttcacaatccaaaaaaaattattaatcagaattcagktttgggaagacgaggggtcatacggtttgtattttcacatgtgaatgtaggaattatgttctctatacctagcaaaggggtctcgtgtctctgagtccag

SEQ ID NO: 40720 - DNA, 201 bp, Homo sapiens
cactgtgctttttctagctattccttagcttaagcagctgaaaccagcatgtagacaagccgataaatgtcagaatgacctgggtcatagattttaattgkgagttcaaattctttggtaaagcaaatccgatcttcataagggtcaggaaattccttaactatggcccataatttggccttcgactagggttgatagaga

SEQ ID NO: 40721 - DNA, 201 bp, Homo sapiens
ttttttgtttgtttgtttgtgtgtgtttttttttttgagatggagtctcgctctgtcacccaggctggagtgcagtggcgcgatctcaactgcaacctccrcctcccgggttcacgccaatatcctgcctcagcctcctgaggagctgggactataggagcccgccaccacgcccagctaattttctgtgttttttttagt

SEQ ID NO: 40722 - DNA, 201 bp, Homo sapiens
tggagtgcagtggtataatcacagctcacagcagcctcgaccttctgggctcacaggatcctcccacctcaacctcccaagtagctggggctacaggcacrcaccatgtctggctaattttttttttaataggaatgaagtctcactatgctgcctaggctggtctcaaactcctgggctcaagcaatgctccagcctcag

SEQ ID NO: 40723 - DNA, 201 bp, Homo sapiens
cagcagcagcggctgggtgtgtttggtgggaggtggcacctaccaccccgtggttcccacccaggggagccaagtcctcttccttggctgtagtcctgccragggtctctcctcagttttgagtctcaaggtgaagacgcggtttgtgggtggctgaggggttgctccatgggggctccctccctcccttccttccttaga

SEQ ID NO: 40724 - DNA, 201 bp, Homo sapiens
tttacacaatgccactgtacggattgtagagttcttgggctggcataattttatgtgaccaaaatttggcaaagggtcttatcagtttgaggagagattaktggagcattgaatttcagagtttgaaatgacattagagattatctggtccagtgattctcaaccagggagacatttggttatttccggagatatttttgg

SEQ ID NO: 40725 - DNA, 201 bp, Homo sapiens
taaaaacatagtatatatgaatatcattttcatatatcttgctacttccttagccttcttaattataaacttgagtcagctattatttactgagtacttayattttagatgctgttctaagtgctccacatgtataaacttgcttagtcatcacgagtgggaactattaccctcatcgtacagaagaggaagcagaagccc

SEQ ID NO: 40726 - DNA, 201 bp, Homo sapiens
tctcttgccctttggttatatctgcccctgctgggggcagggatgtggggcttgggggcatctcctgtggtgtgcctggggtgtgcagcccctgattgtcrttgtggtgcccatcaggaccctggacagaagaagggaggactcagtgccagggcaatagggaggccccccagggacgctagtgctgtgacatgtgtcaga

SEQ ID NO: 40727 - DNA, 201 bp, Homo sapiens
tttgagctggaggtcagcagggccttctccacacaaggaactgttggtgcccatttattactcacctgggaaaggacctgatcgttgccattggcagcatrgttcaatggctgcaaatggatctgatggagagcgtgtggctttgggaggagcgtgccgccttccacagtgagcagcgaggctgggacctgcagggatgag

SEQ ID NO: 40728 - DNA, 201 bp, Homo sapiens
tccttacctgtttccccctatttttcttacttcctttccattttattttgtatgcctctttgtaagctgccttaaatgctttttggaatgaggcaggatayacattcaataaataaaatatgtctgagccacttatgaacaaaaccttcttgggccagagcctaaacattacttatataaaaagacctgattcctcacctt

SEQ ID NO: 40729 - DNA, 201 bp, Homo sapiens
tctcagttcagagctgttttactccttctccctgggacatttggcaatgtctggagacatttatttatttatttatttatttatttatttatttattttttatttattttttggagccagcgtttcgttctgtcacccaggctggagtgcagtggcgcaatctcggctcactgcagcctctgtttcctgggttcaagcgat

SEQ ID NO: 40730 - DNA, 201 bp, Homo sapiens
aaaatgtagttgcacagtatttactgcctctagataatagtttattaaatactctcccagactatataactgagaaaatacactaacaaattcccctcccmcttttctaaattaaaaacatagtatatatgaatatcattttcatatatcttgctacttccttagccttcttaattataaacttgagtcagctattattta

SEQ ID NO: 40731 - DNA, 201 bp, Homo sapiens
tcgggaggctgaggcaagataattgcttgaaccagggagtcggagattgcagtgagctgagatgcgccactgtactacagtctggtgacagagccagactstgtctcaaaaaaaaaaaaaaaaaagtatttgagttgatgctctgtcaaaactcatttatcaagaggatttggttttaggcaacgaaaccttgcctcaaac

SEQ ID NO: 40732 - DNA, 201 bp, Homo sapiens
tacaaaaaaattagacgggcgtggtggcgggcgcttgtagtcccagctactcgggatgttgaggcaggagaatggcgcgaacccgggaggcggagcttgcrgtgagccgagatcgagccactgcactccagcctgggcgacagagcgagactccgtcacaaaacaaaacaaaacaaaaattagctgggcgtggtggtgcgt

SEQ ID NO: 40733 - DNA, 201 bp, Homo sapiens
ggcctctaaggacaaaagtgaatccactaacactctaggaagcagtgtgactactggaagaaagacattcaagaggtaaaatggattttagaaggtcacasgagccaattgtcagtgtttgtactcttcatcaaaattatttttaatgagctccctgacaactgcgcatcctgacagcacgggtgaagtggctcatctggg

SEQ ID NO: 40734 - DNA, 201 bp, Homo sapiens
aatccctaacaaattactgatgtctgtctagttatggaatcataagtgtcatcaacagatgaacagataaagaaaatttggtatatacacatagaattccrttccattttaaaaaacaagaacattctgctatttatggcagcatgattaaatctggaggagattatgttatgtgaaataagccaggtataggaaaacaaa

SEQ ID NO: 40735 - DNA, 201 bp, Homo sapiens
tgcttgaacctgggaggtgaagtttgcagtgagccgagattgcaccactgcaccccagtctgggtgacagagtgggactccatgtcaaaaaaaaaaaaaaagggaaaaagaaaacaaatcacacagaacatgaaggggctgctgaacaatgcagcaggaatgtaaatacattctctttcgggtcagacgtttggccagacg

SEQ ID NO: 40736 - DNA, 201 bp, Homo sapiens
ggcagaggttgcagtgagccaagattgtgcctctgcactccagcctgggtgatagagccagactttgtatatatatgtgtgtgtacatatatatatatatrtgtgtgtgtgtgtatatatgtaatacatatatattacatacctaatatatataatatatatgtaataaacatcatgtatatatgatgtttattagccctc

SEQ ID NO: 40737 - DNA, 201 bp, Homo sapiens
ttgagggacatgttacaaaattcaaaacatcacataatccaaaagacaaaattttaaactgtcaacatcatgaaagacaaagaaaaactaaggaattgttrcagattgagaccaaagagacatgacaactaaatgtactgtgtgaacctagattggatcccagaccagagaatcttctttttctataaagaacattattgg

SEQ ID NO: 40738 - DNA, 201 bp, Homo sapiens
tccttccctgtggccatagtggaagatggaggcttcacagttcctgagactagatgtcttcagttcaagcagtcagcagagacttgtttttttgttgttgktgttttttgtttttgttttttgagacagagtctcgctgtgtctcccaggctggagtgtagtggcgcgttctcagctcactgcaacctctgcctcccgggt

SEQ ID NO: 40739 - DNA, 201 bp, Homo sapiens
agttctttaaagaccattgatatgtaaatcaatgtgtaagaagatatcgtttaagaggggttatggcacatggtggaaggaatgctgctttgcatttatcygtgtgaagtaatctgcctgtgcatctgaagaaacagcaggccccgccgcaagtgatgaagcagttctgtggagaaacccatttacaccagtttccagatg

SEQ ID NO: 40740 - DNA, 201 bp, Homo sapiens
cttagcaatattaaaacctcaggcaggtggcttgttggtctgagcagcctctaaatttgtacaaaagcctggtggctggctgggttggtaaaaatggcagytgtcctgcatgctgacattgggagttactctgcactgctgcaggctgtcctggcacactgcaggccgggcatcatttcatggtggaggacgtcactcagt

SEQ ID NO: 40741 - DNA, 201 bp, Homo sapiens
ctccagggaagaatctgttccatgccttacttttagcttctggtgttgccagtaaatgcttgttgatacagcactttaatcactgtctccattgcctcatrgcattcttcctgggtctgtctccgtgtctcttctctgcttctcataaggacagcagtcatattggattgagtccatactacttaatatagtttgaatatt

SEQ ID NO: 40742 - DNA, 201 bp, Homo sapiens
gaggcaatggagaagtgtgtgtttgggatttaaagaacctcaagaaactgtgatattatgaaatatatatctggtcttcatcttgattcctggcataaaastcctataattcttggaatccaaaattttaaatctaaattgcgactgtaagaaaataacgtggtgctgccttgtgctgcctttcattctaaatggattttg

SEQ ID NO: 40743 - DNA, 201 bp, Homo sapiens
aagttaccaaccacatcctgcggctagaattaagctccactgtggtattacttgaacctaaacttcacactgtgaaatagtactgtataaagaccacatayctaaattggaaactcaaagtttaaagaaaaaaaagactctcacactccttaattgaggggaagttaaagaatattgaccattacattcagttggttataa

SEQ ID NO: 40744 - DNA, 201 bp, Homo sapiens
ctgccttaagaacccattgtttgagtcacttcttatggtccttatcacttttgatctcgtgttagagcaaaatgcacactgccatcctctccactagtttrtaagctcttgaagcagggctgagtcagactcatccatagatcccccgaagtgcctggcactctccaagtgaatagaggcacttaataaacttcagtagaa

SEQ ID NO: 40745 - DNA, 201 bp, Homo sapiens
atggctcacactgggctgacactgctgaccttacagccttgcaaatgatgtcatcaccatacgttcttcactcatgacgtggcatggatttgaccaaaggygtgatcatgtttaaaataaaaaccctttatgagagttcccttgtgcaatgcttccagtgtttaggcactgctgggtcaattttctcattattcacataag

SEQ ID NO: 40746 - DNA, 201 bp, Homo sapiens
ttgacctatatttggcattttttgactcttagatttattgtggaaggaaggctcatatggattcatttctgagtcagatcttaccaccttttggcatcaakaatttagcatcagagtttccagaaattatgtatgccacttgatatgtcagatgtcttagctagtctgggctactaaagcagcataccaaagactgggtgg

SEQ ID NO: 40747 - DNA, 201 bp, Homo sapiens
cacacatgttttacaatcaatttgtacagttaatacaattgtcatagtggtcctgaggtgacgtacatccttcagcttatgaagataacacgattaagagwttaaagtaagacaggcataagaaattataagagtattatttgggaactgataaatgtccatgaaatcttcacaatttatgttcctctgccacagctccag

SEQ ID NO: 40748 - DNA, 201 bp, Homo sapiens
gttgcaggcagctgggccaaaccgcctgccctggaccctagagctcatcagattggcacctgctcttcccacacaggcaaacacggatggtgccactggcygaaccccgccatcagccttcacacagttgagctcaccaggaaagcagaatctctaaaactccagctgcagtgcaagcccagcccccagggacaccgctgt

SEQ ID NO: 40749 - DNA, 201 bp, Homo sapiens
gcatgcaatatgatcactggattatggtacagctttggctaaatcacttacatttttcattcttattaatttggagacatgcacgtgccaacccaagtacrataaatggcacactgtttattgcaagcactaaatagatacatcgaaggttatgttctcaggcatccctagcttataagtgtacattatgttgatttgata

SEQ ID NO: 40750 - DNA, 201 bp, Homo sapiens
gacattgttagagaatgttctcggttaatttactaaatctccctgagcctaagattagacattaatcaaaatgggaatactgcattagttctatagggttkattaatatgagaataaaattaaataatagatatgggaatactcagtagagcaagtgtcaaatagtagacctttagcaattgttatttatttttaaaagtg

SEQ ID NO: 40751 - DNA, 201 bp, Homo sapiens
ttgtgccctgacagcccttctgatggctctggagcctctggctgcctgccttcctactcaccaggtgcaacttgttaattacttgcatgcaatatgatcaytggattatggtacagctttggctaaatcacttacatttttcattcttattaatttggagacatgcacgtgccaacccaagtacaataaatggcacactgt

SEQ ID NO: 40752 - DNA, 201 bp, Homo sapiens
aaaatgtaggatccactggcttatatcttctgtgtaggcatcaaaacagatggtggtggggttgttgggaagatggtagcagacagggttgcttaaaaatrtaagacttccttgatgtccaagaatactgagatttatatgattagaaatttctatacaaagctggaaacagtggagcatgttcccacatagaagcacagg

SEQ ID NO: 40753 - DNA, 201 bp, Homo sapiens
taaaatgtttctttttagctttacaaatgcactgcttgttaacatctatgaattcatgtacttgcttttccatgctatagacgggtaacttccagggctgytgtgtggcacaagtttggggagtagggatggaaatggtacccttaaagttatgcagtgcagacctgcacaacctgacacaggggccttgggtcagtccat

SEQ ID NO: 40754 - DNA, 201 bp, Homo sapiens
actgagcagagagactgatgatctgaaaggacaccaggtaaaatgtttctttttagctttacaaatgcactgcttgttaacatctatgaattcatgtactygcttttccatgctatagacgggtaacttccagggctgctgtgtggcacaagtttggggagtagggatggaaatggtacccttaaagttatgcagtgcaga

SEQ ID NO: 40755 - DNA, 201 bp, Homo sapiens
aggcagggaaaagcgtatgttttttccttgaccttgaaaatttagcttgggctttctttgtacaaacatgaagatcctaggagaagcccaatcaattttakagagacaagtggatgaagatagggattaaaagaattgtgcttgactgagcagagagactgatgatctgaaaggacaccaggtaaaatgtttctttttagc

SEQ ID NO: 40756 - DNA, 201 bp, Homo sapiens
tagatggtagaagagagtcaactgtattttttcatagaaaacaattcatttttccccacaagcagtatataaataacctatataatcctatgaatatcctrtgtagaactgtcatcatacctataccaaataaacacatattgagaaagtataggatcttagatctgtaaaaactttgaaatactatttaatcagttaaat

SEQ ID NO: 40757 - DNA, 201 bp, Homo sapiens
caggagaactcccctttataaaaccatcagatctcatgagacttactcactatcatgagaatggcatgggaaagacctgtccccatgattcaattaccttycaccgggtccctcctacaacacatgggaattatgggagctacaattcaagatgagatttgggtggggacacagccaaactgtatcaactatcatacctct

SEQ ID NO: 40758 - DNA, 201 bp, Homo sapiens
cacggcactttaaggccatcttctaagttaagtcctctgaaataatagccatgtagttcgctggaatgtagctgactatacacctagatggtagaagagartcaactgtattttttcatagaaaacaattcatttttccccacaagcagtatataaataacctatataatcctatgaatatcctatgtagaactgtcatca

SEQ ID NO: 40759 - DNA, 201 bp, Homo sapiens
aggccagcaatttgtgggaaaaaagcgataatggattttaatttaatttaaaaggcatggcaaatgtacctgcttcttttaaagtgctgcatttctgatayatagatgtccgcaaggtgggtgcccttacattatacagccttatcttatcaatccgagtgtcaaagacccgaagcaaaggatctttctcttcccactgag

SEQ ID NO: 40760 - DNA, 201 bp, Homo sapiens
tacattgttcctgtactgcactgggtctccttgtgctgaactgcatgggataggccatttccatacaatctcatcctctgaataaggaaccatgatgctcmtaaagacatactaaatatagatcttgggtaatattggagtcagtgctggtcatcaatgattttctctgtgatgatagagggggtccactatgaatgatag

SEQ ID NO: 40761 - DNA, 201 bp, Homo sapiens
tggcatttttgttgaactagggatattatctcacttataaacactttaaatatagtagaatactttaaaatagtagaaatcaaattcgagggtagacgtargagcaaaatggggatttatattagacaccagtatataatgtacataatattatgtcaggaaagctgataattccctcacatattagttcttttcctaata

SEQ ID NO: 40762 - DNA, 201 bp, Homo sapiens
tccaaaaaaaaaaaaaagagttctgtaattgtaaaaatgtgacataggcattctctaatgtgcaatgaatagtcatttttaagcatttcatacattgttcstgtactgcactgggtctccttgtgctgaactgcatgggataggccatttccatacaatctcatcctctgaataaggaaccatgatgctcctaaagacata

SEQ ID NO: 40763 - DNA, 201 bp, Homo sapiens
tatgaccatgcagctttccactgggaacttttacaggttgctgctatttttataaaaatgatagactgtaatgttgccggggacagtggctcatgcctgtwatcccagcagtttaggaggctgaggtgggagaaacacttgaggtcaggagtttcagaccagcctaggcaacatggtgaaaccctgtctctactaaaaata

SEQ ID NO: 40764 - DNA, 201 bp, Homo sapiens
aaacacttctctaagaaatttgtatatttttggaattcagtcaacattttttggataaatgaatgtgaacactttaggaattgcttattccacaaatgatytcttaccaagatttccagaaactattttcatattgaaacaaaaacaaaacaacacaccactctgcttcttcccacagagttctgagacagcttttacata

SEQ ID NO: 40765 - DNA, 201 bp, Homo sapiens
gtaaccatctgtgaatggtaatgccataaggtagagagactaaatctaattgatatgcaaaaaggagaatttcagctgtccagctatggagattcaaattsaacctttaataggctgaggatttcagctaaatttttaaaatcatgatatctagttcaggcactcatcttttaggtttctcacagattaaagtacagccgt

SEQ ID NO: 40766 - DNA, 201 bp, Homo sapiens
agcctgggtgatagagccagactttgtatatatatgtgtgtgtacatatatatatatatgtgtgtgtgtgtgtatatatgtaatacatatatattacatayctaatatatataatatatatgtaataaacatcatgtatatatgatgtttattagccctccaatgcttgaaatcaggggttggaatcaaggctaaccaact

SEQ ID NO: 40767 - DNA, 201 bp, Homo sapiens
agcttgggaggatgaggctgcagtgagccatgattgagccactgcactctgcactccagcctgggcaatagagcaagactgtcttaaaaaaaaaaaaaaagaggtatttctcttttaggggagaaggtttacctgggaggcattatgcagggtgagcagtaatctatctggaggacacacttgggtttggtgaaggtgaca

SEQ ID NO: 40768 - DNA, 201 bp, Homo sapiens
aaaggcttcccaggggacaggcttgaccccgtgtgtctgggaactgcccctttttctcatacttggtgcaggctttgccttgttcatggcaggcttcctgrcaggaggtgaaggagcaggcagggtgggactccagcagctcctcctgctcccagaggccacctctttcttcagggactgaggtctgatttcagctgagca

SEQ ID NO: 40769 - DNA, 201 bp, Homo sapiens
tgaagagaagcagcaattggtgaggcccctgtccccaagccccatgctcctccagatcctgaacataggagttgtcacggagatggagagcagagcatgcraccccagctcctgggcctctctgaaaggcttcccaggggacaggcttgaccccgtgtgtctgggaactgcccctttttctcatacttggtgcaggctttg

SEQ ID NO: 40770 - DNA, 201 bp, Homo sapiens
aactctggatctcatacacctcataattcctccaagatggctgaggtctggggcttctgcaagaggaaagaagtcaaggtgagctgaagatggggcctcaygtccttgtcaaaggagaggggagttggagtcagagccggcccccaaaagacccatgcccagcacagtcacttcccagctctgcttgtcctcctccttccc

SEQ ID NO: 40771 - DNA, 201 bp, Homo sapiens
ctctttctcccacccaatgagtctcctggcattgggccctttgccgggtctgcaattgcggtagctgtttctcaagactgcctttatgttaaacaaagaarcagttattggctttaagtccaaagggttcttctagttttttgctgtgtcactgtctctaaaacagaggaggaaacaaggcctccccaggtccttttcctc

SEQ ID NO: 40772 - DNA, 201 bp, Homo sapiens
gctccactgtcctgccagactgcctccaaaccttacaagctgtcagtcttactggggaggttcttttttacaaagggtgggggtgtcacacaaaaagagcsttcagctgctctatgcatctgtctgcaatatgtcacctcagagacctcacccccatagcaccatcggagaggagctgtgtcctcatatgtcttcataact

SEQ ID NO: 40773 - DNA, 201 bp, Homo sapiens
aggtgtctcctgtagcagacagctccactgtcctgccagactgcctccaaaccttacaagctgtcagtcttactggggaggttcttttttacaaagggtgrgggtgtcacacaaaaagagcgttcagctgctctatgcatctgtctgcaatatgtcacctcagagacctcacccccatagcaccatcggagaggagctgtg

SEQ ID NO: 40774 - DNA, 201 bp, Homo sapiens
tttcgcctacaacaaataatacatagttaatatctagaacttttccaaaagcatgtcatagttttctatttattttatagtcctactactgactgataatrttgagatctgattcaatttctgcctctaaccatctgtattgtaaaatcccgatggacaactaaaaaactgttaacaacagagcagcatttaaaacttcag

SEQ ID NO: 40775 - DNA, 201 bp, Homo sapiens
cacctactagggggtgctgaggttggaggatcacttgagcctgggacgttgaggctgcggtgaactgagatcccaccactgcactccagcctggtgacgaygtgatagcctgtctcaaaaaataataataataaaaaaattcaggtagtactggaaacctcgaagattccaagattagtcagatccttaaaaggtatacct

SEQ ID NO: 40776 - DNA, 201 bp, Homo sapiens
tcctggtgaaccctccctgtatgaccatgcagctttccactgggaacttttacaggttgctgctatttttataaaaatgatagactgtaatgttgccgggsacagtggctcatgcctgtaatcccagcagtttaggaggctgaggtgggagaaacacttgaggtcaggagtttcagaccagcctaggcaacatggtgaaac

SEQ ID NO: 40777 - DNA, 201 bp, Homo sapiens
aaatgtctcctccctcatggaccagccatgtgaccttggcaaagtaacttaaccgctcttaccttgggtgtcatctgctgtggagctataaaatgaaacartcatcacttccttccagggccccatgagaatcaggtgaggatgacacaggggaggcaggtacacacggccacacacccgaggggactcagcagggggcag

SEQ ID NO: 40778 - DNA, 201 bp, Homo sapiens
aattctaatggcttttgctctattttcctaattaagagctgttgatgaaaacctttaaataagagaggacaaaaaaagacatctcatatcataccccactrtactttcactactttgaatttggcatttttgttgaactagggatattatctcacttataaacactttaaatatagtagaatactttaaaatagtagaaat

SEQ ID NO: 40779 - DNA, 201 bp, Homo sapiens
cggtggtggatttttttcccttagccgtcattttggatatttgattaattatcgaccattatatttccttcttcttgttagttacgatttactaagaagaatttttatgctattttaaagttaaatgatctgtgattgtaaaatcattcattatttacctcaactgctcacttaattttttaaaaacatcttcaaggctcc

SEQ ID NO: 40780 - DNA, 201 bp, Homo sapiens
agtttgagaccagcctggctaacatggtgaaaccccatctctactaaaaatacaaaaattagctgggcattgtcgtgggcacctgtaatcccagctactcrgcagtagaattgcttgaacccgggaggcagaggttgcagtgagctgagatcatgccactgcactccagcctgggtgacacagcgagactccgtctcaaaa

SEQ ID NO: 40781 - DNA, 201 bp, Homo sapiens
gcggtggtggatttttttcccttagccgtcattttggatatttgattaattatcgaccattatatttccttcttcttgttagttacgatttactaagaagaatttttatgctattttaaagttaaatgatctgtgattgtaaaatcattcattatttacctcaactgctcacttaattttttaaaaacatcttcaaggctc

SEQ ID NO: 40782 - DNA, 201 bp, Homo sapiens
tagcagtctggactggttttttgttctatgtatattttcaatttccacttatttatttctccatctctaattgtcatatatttagagatacttcactgacrtttcctaaattccatgtctttgagttccttagtttctctaattctaatggcttttgctctattttcctaattaagagctgttgatgaaaacctttaaata

SEQ ID NO: 40783 - DNA, 201 bp, Homo sapiens
ggcggtggtggatttttttcccttagccgtcattttggatatttgattaattatcgaccattatatttccttcttcttgttagttacgatttactaagaagaatttttatgctattttaaagttaaatgatctgtgattgtaaaatcattcattatttacctcaactgctcacttaattttttaaaaacatcttcaaggct

SEQ ID NO: 40784 - DNA, 201 bp, Homo sapiens
aatgacaatatgcagccatttgtatattgtctgcatcccaaattcaatgtaaacttcacgaatataaagatttacctgcattattctcactgtatttctarcatctgacatgacaggcacattaaatgaattaaaagacaaagcaaaagaaaataatcacctcccctcttttcccaatcagtttaaaagcattaagagatt

SEQ ID NO: 40785 - DNA, 201 bp, Homo sapiens
gtcaccacacttccagcctgggcaaaagagtgagactctgtctaaaaaaaaaaaaaaaaaaaaaaaaaaaacaaaaccacccctatctatcctatctatcctatctatctatctatctatctatctatctatctattggtctatctatctagataaaaatagcagtcaactaatttttcaaattaaaaatgctttattgtt

SEQ ID NO: 40786 - DNA, 201 bp, Homo sapiens
taggaggccaaggtgggcgggtcactagaggtcaggagttcgagaccagcctggccaacatggtgaaaccccgtctctattaaaaatacaaaaattagccrggtgtggtggcaggcgcctgtactctgagctactggggaggctgagacaggagaatcgcttgaacctgggaggcagaggttgcagtgagctgagatcgtg

SEQ ID NO: 40787 - DNA, 201 bp, Homo sapiens
ccaccacgcctggctaattttgtatttttaatagagatggagtttctccatgtttgtcaggctggtctcgaactcccgacttcaggtgatccgcccacctyggcctcccaaagtgctgggattgattacaggtgtgagccaccgtgcctggccacttcatttctttaaagtgaaatgaaactagttgagagatctagctca

SEQ ID NO: 40788 - DNA, 201 bp, Homo sapiens
cggagtacaggcgcccgccactacgcccagctaatttttctatttttagtagaggtggggtttcaccatgttggccaggctggtctcaaacccctaacctyaaatgatccatccgcctcagcctcccaaagtgctgggattacaggcgtgagccaccgcgcctggcctggacacccattttgaatagcacttaccacagat

SEQ ID NO: 40789 - DNA, 201 bp, Homo sapiens
gtctgtagacaaaaagcaaaatgttggggtttagtttcttcaggtgaataaaatgttacttgcatctcctcattgtcacagtgttcgtattacatacttcgtgtgtgtagttttggcatttaaggaaacagagctaaaaaaaaaacaaaggacaataactgcatcaacaacatgttatacaccagaggaaatgcggcgact

SEQ ID NO: 40790 - DNA, 201 bp, Homo sapiens
tgtctgtagacaaaaagcaaaatgttggggtttagtttcttcaggtgaataaaatgttacttgcatctcctcattgtcacagtgttcgtattacatacttcgtgtgtgtagttttggcatttaaggaaacagagctaaaaaaaaaacaaaggacaataactgcatcaacaacatgttatacaccagaggaaatgcggcgac

SEQ ID NO: 40791 - DNA, 201 bp, Homo sapiens
aagatagccctttaggcatgcacaactgtgaaagaaagaaaaaaaaaaatcagaatgcagtacacaaataacttcaagccagaaataaatgttgtttttttaacataacaggattcaaaaagacaggttttatccagatttaatattcgcaatagccttaaattagaaatatattataaattcctcatacacatgtatata

SEQ ID NO: 40792 - DNA, 201 bp, Homo sapiens
gaagacagcttgagcacgggatgtcaaggttgcagtgacccatgattgcactactgcactccagcctgggtgacggagtgagaacttgtctaaaaaaaaaagtgaatccaaatatttgtgtaaccttttttgaagaatctatcagtgtacaggtactattttataatttccttcaattcactatccattaagacatagcat

SEQ ID NO: 40793 - DNA, 201 bp, Homo sapiens
ccttgggaaaaagtgttcctactctctgggtgagcgtctggtccgaatcgttggcttggagatgattttacgggctctttctggagaacaaaagtaaaacsttacagtgttccgatgagacacagtaggcagtacttgggagggtcttatagaccccaccctgtggaagtgggtctcaacattacacaaccccctctcggg

SEQ ID NO: 40794 - DNA, 201 bp, Homo sapiens
tggcctgggcactcccttggcctctgccatgtaagcctgtacatagagcacctcataacagcagaactcgcttccccagtttaaggaatgcaatggagacygagagagacagagagagagagagagagagagagagagaaacaagagactgagagattgggggaggaaaaacagaagagagtgaacagcagaaaaatggca

SEQ ID NO: 40795 - DNA, 201 bp, Homo sapiens
tggctattctgacgtcatagcatactggattactggtgtgtttgtggtgatgctggtgtaaacaaacctgctgtgctgccagtcatataaaagtatagcakgcacacttatgtacagtccataatactttataatgataataaaagactatgttactggtttatgtacttactctattctttgttgttattttagagtata

SEQ ID NO: 40796 - DNA, 201 bp, Homo sapiens
agtcactgtgtggggagaatccaaatgcctcactgaggtgacatttatgccatggccagaatgacaatgggggaccaacgctgcccaagtcagggacagcrgtgtcagaaagaagccaccctggggcacagcctcacaggtggacctgagtttggcagaggaggttagaaaggggacagtgtggctgcagggaggctgggg

SEQ ID NO: 40797 - DNA, 201 bp, Homo sapiens
ggaggccgaggcaggtggatcacgaggtcaggagatcgagaccacggtgaaaccccatctctactaaaaatacaaaaaattagccgggcacagtggtgggygcctgtagtcccagctactcgggaggctgaggcaggagaatggcgtgaacccaggaggcggagcttgcagtgagccaagatcgcgccactgcactccagc

SEQ ID NO: 40798 - DNA, 201 bp, Homo sapiens
atgacgggagggagggccggggagtcactgtgtggggagaatccaaatgcctcactgaggtgacatttatgccatggccagaatgacaatgggggaccaaygctgcccaagtcagggacagcggtgtcagaaagaagccaccctggggcacagcctcacaggtggacctgagtttggcagaggaggttagaaaggggacag

SEQ ID NO: 40799 - DNA, 201 bp, Homo sapiens
ggtgcccacggagctttgctggagcaggtggagctccgggatagcctcctgagaaaggcacctcctgttagtatcaatgatccccacattatgaggacaayggaagcaggaaggggtttaatcactttctccccgtgctgacttattcactcagcgactctgccctgagcactcaccttgtgccaggtggcctggtgggct

SEQ ID NO: 40800 - DNA, 201 bp, Homo sapiens
ggctggcatagcgtgagaagcagaggttccaagccagacagccctgggtttaaatgtctcctccctcatggaccagccatgtgaccttggcaaagtaactkaaccgctcttaccttgggtgtcatctgctgtggagctataaaatgaaacagtcatcacttccttccagggccccatgagaatcaggtgaggatgacacag

SEQ ID NO: 40801 - DNA, 201 bp, Homo sapiens
gatttctttgattactagtgatgttctgcattccttctcatgtttattgattgctaatatttcatgtacaaacctagttacagcaacaaccagcaagccayaactctcaaacatccttgccatcttagtgccattgctgtaatatataaaacacacattaaaccacagcagttaatattgtgctcgtggttaataccacag

SEQ ID NO: 40802 - DNA, 201 bp, Homo sapiens
aggcagctatagttcactttcagttctgtatagcttttattatatgcgtctatatatgcaatatcatattttaggacttttgtatatatatatttcatgtmttctttttattattgatgtacatgcgagttgtttccagtttggaaaagtgctaaataatgatgtattgtagaaaagagaaaaatagtctaaggagaaact

SEQ ID NO: 40803 - DNA, 201 bp, Homo sapiens
aattttaatattttaattttaatattagtttaaaattttattaaatgaaatggtacagaataaactctgtcaggataatttattatatttgaaagtctcaygtgtatttctaaaggcagctatagttcactttcagttctgtatagcttttattatatgcgtctatatatgcaatatcatattttaggacttttgtatata

SEQ ID NO: 40804 - DNA, 201 bp, Homo sapiens
tgttgccataatttggatttctttgattactagtgatgttctgcattccttctcatgtttattgattgctaatatttcatgtacaaacctagttacagcamcaaccagcaagccataactctcaaacatccttgccatcttagtgccattgctgtaatatataaaacacacattaaaccacagcagttaatattgtgctcg

SEQ ID NO: 40805 - DNA, 201 bp, Homo sapiens
cttcatttcttttctttccttcttttcttttttttttcttttcttttctttcttttttttgcccaggctggagtgcagtggcacagtcttggctcaccgcwacctctgcctcccgggttcaagtgattctcctgtctcagcctcccgagtagctgggattacaggcatgcgccaccacgcctggctaattttgtattttta

SEQ ID NO: 40806 - DNA, 201 bp, Homo sapiens
tgagcactctaacacataagatatttgatagcttttcttattattttcttaatatggagttttagaagtgcagttactggtccaaagatatgcctttagtrcccttagccttagttcttaaggcttgtagtaccctttgcaaagaggcttttctcaaaggttttgacacgctatactccaccagtgctggagtagagggct

SEQ ID NO: 40807 - DNA, 201 bp, Homo sapiens
aggtctttgcagtgggtctcatatcattccacgtacactgaggcgcacttgttgccagagaccaaaaactttactgagcaccctttcacccccagcgcccmcttggctgggtctatttccaattcttttagtctctggggctgatgaaatgaagatgggagggtagggcaagagaaacaagaagagctagccaagaagata

SEQ ID NO: 40808 - DNA, 201 bp, Homo sapiens
cttcctgggttcgagcgattcctcgtgccttagcctcccaagtagctgggactacagacaagcgccaccacgcccagctgatttttgtatttttagtaaaracggggtttcaccatgttggccaggatgctcaaacccctgacctcgcgatccgcccgcctcggcctcccaaagcgctgagattaccggcgtgagccaccg

SEQ ID NO: 40809 - DNA, 201 bp, Homo sapiens
ggtctatttccaattcttttagtctctggggctgatgaaatgaagatgggagggtagggcaagagaaacaagaagagctagccaagaagatagaaaataaygattttcagctcactgccacctccacttcccgggttcccgcgatcctcccaccacagtgaagtggtgtcatttgcctgggaaaatacccaaggttcattg

SEQ ID NO: 40810 - DNA, 201 bp, Homo sapiens
cttacacgtcgctcagtaaatacttgctgattgactttcaaattcagattacttttacgctagcatacggtgggcacaaagggtttttttgtttatttgtktgtttgagacggagtctcgctctgtcgccaggctggagcgcagtggtgcaatctcggctcactgcaacctcctcttcctgggttcgagcgattcctcgtg

SEQ ID NO: 40811 - DNA, 201 bp, Homo sapiens
acacggacacacaagagatgagtaagagcagaggcttaataggcaaaagaaagagaaaagagaatagctccctctcctgcagagagaggggtgcccgagtrggtcttccagttccatggtgaggtgcacgggttttatagactggcttgaggaggcagtgtctgatttacatagggcccaaagattggttagaccaggtgt

SEQ ID NO: 40812 - DNA, 201 bp, Homo sapiens
agatgaaaaaaatcaaatatagtggtgaatgatacaaatttcttttctgagaggagcagcttcgcttcatttcttttctttccttcttttcttttttttttcttttcttttctttcttttttttgcccaggctggagtgcagtggcacagtcttggctcaccgctacctctgcctcccgggttcaagtgattctcctgtct

SEQ ID NO: 40813 - DNA, 201 bp, Homo sapiens
tcttttattatgcaaatgggttttctacctggccagagccatgttgcctgttccttactggacatgtggttgacaaagaaaagggaagatggagctgccaygttgaacatgcctagcccccaggtaaccttttcctattgtcacagctgccggcattcacccatgcaaggttccagcttgcttatctatgtctgcagctca

SEQ ID NO: 40814 - DNA, 201 bp, Homo sapiens
gaggagaggctgggggatcggtattgtagcaatgcaggagtcctgtcctgagtggctgctcagggtattgacatgccattttgataaatacatgaattaatgagtgagtttcgagagtagggggagagagaataactgggcatccccttctgtagatcctcagtcttctagtctcatctctctagaaggatattcacccat

SEQ ID NO: 40815 - DNA, 201 bp, Homo sapiens
gagtccccaccattccatctcatctgagttatctcactatctctgttcttccctcatttacatcatctgtcacttacctgttgacatgtgagttttgactyttgattgagatgctgacaccctccttcccttctaggaaaggaaaataaagggggaaggaaggtggagagggacaaaggagaggcgtgtggaggatgatag

SEQ ID NO: 40816 - DNA, 201 bp, Homo sapiens
ctggagtgcagtgagacaaacacagctcactgcagcctagacctgctgggtttaagtgatccttacatctcagcctcctgagtacctgggactacaggtgkgcatcaccacacctggctaatttttaaatttattgtagagacaacacttcactatattggctggcctggtctcaaattccttgcctcaagcgatcttctg

SEQ ID NO: 40817 - DNA, 201 bp, Homo sapiens
ggtctcttgcgctgtcacctaggctggagtgcagtgagacaaacacagctcactgcagcctagacctgctgggtttaagtgatccttacatctcagcctcstgagtacctgggactacaggtgtgcatcaccacacctggctaatttttaaatttattgtagagacaacacttcactatattggctggcctggtctcaaat

SEQ ID NO: 40818 - DNA, 201 bp, Homo sapiens
ttttttttttttttgagacagggtctcttgcgctgtcacctaggctggagtgcagtgagacaaacacagctcactgcagcctagacctgctgggtttaagkgatccttacatctcagcctcctgagtacctgggactacaggtgtgcatcaccacacctggctaatttttaaatttattgtagagacaacacttcactata

SEQ ID NO: 40819 - DNA, 201 bp, Homo sapiens
tttttttttttttttttttttttttgagacagggtctcttgcgctgtcacctaggctggagtgcagtgagacaaacacagctcactgcagcctagacctgstgggtttaagtgatccttacatctcagcctcctgagtacctgggactacaggtgtgcatcaccacacctggctaatttttaaatttattgtagagacaac

SEQ ID NO: 40820 - DNA, 201 bp, Homo sapiens
cacctgaacctggaggcaaaggttgcagtgagccaagatcacgccactgcactccagcctgggtgacagagacagactccatctcaaaaaaaaaaaaaaaagaagaagaagaagaagaagaaatatagaggagcttctggactggcaaatacattaaggtgctgggtaagtccaaggaaagcatagcagttctgcacccac

SEQ ID NO: 40821 - DNA, 201 bp, Homo sapiens
  misc_feature (1)...(201): n = A,T,C or G, or insertion/deletion polymorphism (see Tables 1-2)
atattatcctcagagttctaagagaaaaaaacttttaacatataatttaacatccaatgaactatttaagatgatagaatattatcctcagagtactaagnaaaaaaaaaaaacttttaacatagaatttaacatccaatgaactatttttcaaaaacaaggacaaaataagatctaatagagaaagctatctcaggaaag

SEQ ID NO: 40822 - DNA, 201 bp, Homo sapiens
tttaggttgattctgtgaatttgtgtgttgaagcatagcatagcatagcatttcgtatgcctaaaaatatggaaataataagtgcgtggctcaatgaattrtccaaagcaagtgcacccagtaaccagtacccataagaaacagaacatcgtcagccctctaggagttccctcatgttgtcatctcaggccactgcgctgg

SEQ ID NO: 40823 - DNA, 201 bp, Homo sapiens
tgtatttgcaccacattttctttatccagtcttccatttatgggcatttaggttgattctgtgaatttgtgtgttgaagcatagcatagcatagcatttcrtatgcctaaaaatatggaaataataagtgcgtggctcaatgaattatccaaagcaagtgcacccagtaaccagtacccataagaaacagaacatcgtcag

SEQ ID NO: 40824 - DNA, 201 bp, Homo sapiens
tatttcttgtgaggatttaatcctctgaataactatgaaatgggaagcataattaactccttttacagataatgaacctggagcttggagagttagtaccrtggccaagatctctgagataggaagtggtgatacccaggacaggaatctagatgctacgatgccagagtcttgaaccaacccctatgcctgctggccttg

SEQ ID NO: 40825 - DNA, 201 bp, Homo sapiens
aacatgaagtcccacaagagctagtatttcttgtgaggatttaatcctctgaataactatgaaatgggaagcataattaactccttttacagataatgaamctggagcttggagagttagtaccatggccaagatctctgagataggaagtggtgatacccaggacaggaatctagatgctacgatgccagagtcttgaac

SEQ ID NO: 40826 - DNA, 201 bp, Homo sapiens
acaacatctttgggttgagcctcatgcttctccttcctttaccacaggtcatcatctgtcttctccatagttcatagaacaaaaaacaacatgaagtcccrcaagagctagtatttcttgtgaggatttaatcctctgaataactatgaaatgggaagcataattaactccttttacagataatgaacctggagcttggag

SEQ ID NO: 40827 - DNA, 201 bp, Homo sapiens
agagcgcgtgtcatctgcgggtggcactgcccacggtgggcgggcgggcctctctactcgaaggtgaccacgtttagattctgagacgggaagtggagggygaataggtcacggcggccttttttttttagtttaacttttccttttttgctgtctggtcatcctcgtcggtcttctgcttctgggtatcgacatcgttat

SEQ ID NO: 40828 - DNA, 201 bp, Homo sapiens
attaatggatggcctcaaaatttacaactatagattgtatttatcggttcaagccaagaggccctgtctacatttcaccttgacaacatctttgggttgarcctcatgcttctccttcctttaccacaggtcatcatctgtcttctccatagttcatagaacaaaaaacaacatgaagtcccacaagagctagtatttctt

SEQ ID NO: 40829 - DNA, 201 bp, Homo sapiens
atgggagccatcgcagagtattgagcagaagagtggcatgacctggctggattctttcatagagtccttctggctgtgatattactctctattagacaggmaagctccttgagggcaggcattgtgtcctattgacctttattataaggacatagcacatctagcctgtagaagacttcaatatgttttttcaaatgaatg

SEQ ID NO: 40830 - DNA, 201 bp, Homo sapiens
aggcttgcaaggaagggagggtaggtgtttgggggaagagcatctagacaaaaaaagacaagtacagtgcaaggttctggaggcaggcgcgcacttggctrctgtgtttgaaaatgagggcggtgcggctgcaggggagaggacggggggtggacaagaactatggggtggccaggtcctatggggctgtgggaaggacct

SEQ ID NO: 40831 - DNA, 201 bp, Homo sapiens
aatgccactgtgaggctcaactgatgaatctcagtagggtggtgaatgtaaaggctagactatgggaggttatggggctgggaggttgagagaaggaaaaycatattttatactgttcctgagacatttaatgaaggaaaaaaaggaaacaaaaaagcaacttaaaggttaagtcccacaaatgaattcttcaagtgaact

SEQ ID NO: 40832 - DNA, 201 bp, Homo sapiens
ttatttgttctttatctggaattcagaattaactaggcattttatatttttatttgctaactctggctaccttattctcttcttaatattcttcaactctmctagctttgccctccttccctgccccctcttctaggggagtcggatcgagttgtaaggagaacatgccctcccctcccctccccttcccttcccctccct

SEQ ID NO: 40833 - DNA, 201 bp, Homo sapiens
cgggattctgagcatttccttttggccctctttgactttgatttgcttttatttccattatccttggatactgaaaacttttcctcatttcaagttactgwcatctgtatttttttcttcttggatgtgtttgtttctttttcattcaaatcttttgctacctgaaggtgaaataaaaggttttggcaaatcaccaacctg

SEQ ID NO: 40834 - DNA, 201 bp, Homo sapiens
cctgttcagttgcctcactgcttaatccccttgtgagacagagagcatgcagacaggcaggtgcagaggctggggtgagcgctctggggtctggcccggcygtagtgtctaggagtggatgcctgcagccccagcgttacaaagctttcagcttggccgcccgaagacagcttgaatgttaaccagcttaatggacctttt

SEQ ID NO: 40835 - DNA, 201 bp, Homo sapiens
ccggccgtagtgtctaggagtggatgcctgcagccccagcgttacaaagctttcagcttggccgcccgaagacagcttgaatgttaaccagcttaatggamcttttgccttttcacaagggcagagggccaacatgatagcttgctgtatcccgagctcttgttcagcgtcctggaaaaatcaggtcacacacggactcaa

SEQ ID NO: 40836 - DNA, 201 bp, Homo sapiens
actcctttcctaccgcccccagctgaactcctcttggcatccagacgtctctcctcttctctctttccctgctgtgctgttccaccgtccatctgctggtmtcctcctctactcacctgctgctctgctgtggagcttggggtttgcggtttacgtgggggcaggatagagggtgtggagggacaaaaggcaacctctttg

SEQ ID NO: 40837 - DNA, 201 bp, Homo sapiens
ctcttctctctttccctgctgtgctgttccaccgtccatctgctggtatcctcctctactcacctgctgctctgctgtggagcttggggtttgcggtttaygtgggggcaggatagagggtgtggagggacaaaaggcaacctctttgtcttgaaaacaggaatgcctgtcctcatttagggccgcaggtcttcaggcttg

SEQ ID NO: 40838 - DNA, 201 bp, Homo sapiens
tcttctctctttccctgctgtgctgttccaccgtccatctgctggtatcctcctctactcacctgctgctctgctgtggagcttggggtttgcggtttacrtgggggcaggatagagggtgtggagggacaaaaggcaacctctttgtcttgaaaacaggaatgcctgtcctcatttagggccgcaggtcttcaggcttga

SEQ ID NO: 40839 - DNA, 201 bp, Homo sapiens
tgataacttttaattttctctttttcattttattcccctgaaaccttcatctttctgaagcttactgccccaaggcaggggagaatggctattggttctcytttgtagtctctcacatttatcacatcaagggttaattctggagggatgaagttaagttttctccttataaagggagaaaacaccccttctgcttgtgac

SEQ ID NO: 40840 - DNA, 201 bp, Homo sapiens
tttctgtttctgatatgcataatgggacagttgtggcctcacacacttcagtagaaagaataacatatgcaaatgttaatggacccaaacaactaactcamaatttgcagatgtcttcaggagttacccaaaatgtatggttgaactcaccaatgaggaatcctgtgcattctcatataggggcaactgtatctcatcaaa

SEQ ID NO: 40841 - DNA, 201 bp, Homo sapiens
tgtaccattttttatcttttataccatatttttaccgtacctacttatgtttagatacacaattacttaccattgtgctacaattgcctacagtatttagyatactaacacactgtacaggtttgtaacctaggagcaatttgctattccatatatagtaggctgtatcatctaggtttgtgtaagcacactctataaggt

SEQ ID NO: 40842 - DNA, 201 bp, Homo sapiens
tggcctcacacacttcagtagaaagaataacatatgcaaatgttaatggacccaaacaactaactcacaatttgcagatgtcttcaggagttacccaaaaygtatggttgaactcaccaatgaggaatcctgtgcattctcatataggggcaactgtatctcatcaaactgattttggagctaacgtacccaatatgccgg

SEQ ID NO: 40843 - DNA, 201 bp, Homo sapiens
agcagtacgggggtagtccttctattttagggttgccagataaaatacagtatgcaaaatcaatgtgcattggagaaaataatttattattagagaatacrtaatttctttagcataaatatgtcttgtgccattcttagtttgggacatacttatgctaaaaaattatttgttctttatctggaattcagaattaactag

SEQ ID NO: 40844 - DNA, 201 bp, Homo sapiens
atgacctaggggggctgtagtatcagaagaacagaaataacataaccagaaggagtggcaaaacagctataaccaacacttcctgccgcataaggtttgtmttcttaagctttgagacttagggagaggacacgtggcaggtctgaggcccgtgggacctatgtgacttccctctcccctttgacttataacctaaatatc

SEQ ID NO: 40845 - DNA, 201 bp, Homo sapiens
gagggacttgtgcctcctcagcgggaggagtggggctacctcctcctgccgtggccgcgatcaggaggcaataggtggagagcccacaggggaggtagtgsaggagacaagagaacattctgagggagcaggagggttataaggcggtggaactgggtgaaggaaactttcctcttcctcacaaggaggcaatacaggagg

SEQ ID NO: 40846 - DNA, 201 bp, Homo sapiens
ttccagttgtacaggtcagaagtagagaagccgacataaactaagaatgggcctgagtgcttatcgcccggagggacttgtgcctcctcagcgggaggagkggggctacctcctcctgccgtggccgcgatcaggaggcaataggtggagagcccacaggggaggtagtggaggagacaagagaacattctgagggagcag

SEQ ID NO: 40847 - DNA, 201 bp, Homo sapiens
gtccggagcatggactccatcagtgaggtcaagacctggggcttttcagaaaagggggggttatgagtcttccagttgtacaggtcagaagtagagaagcsgacataaactaagaatgggcctgagtgcttatcgcccggagggacttgtgcctcctcagcgggaggagtggggctacctcctcctgccgtggccgcgatc

SEQ ID NO: 40848 - DNA, 201 bp, Homo sapiens
gcccttggttcccagcgagagagcctgtgagcacagtggagcctcaggacagcacgatcagagctggcttctcaaaggcggtgcccttgagctcagtcacytctcgcccctttgccgcccattgctggcacctggcttgggctctccgtctgcccaacagctcacttcagaggaaacaggaaaccaacggggccttcgctg

SEQ ID NO: 40849 - DNA, 201 bp, Homo sapiens
gttatgagcttcctcctctggtctaccgtctgatgtaaggaaatattttctggcctctcttcgggtacgttccttctcttcagaggtggaaagggttaaarggagctgttgacagtcctcccaggtgggccggtgagtccggagcatggactccatcagtgaggtcaagacctggggcttttcagaaaagggggggttatg

SEQ ID NO: 40850 - DNA, 201 bp, Homo sapiens
aggggtgtaactctggtaggcctcctggaggcgttccaaaaacgccccgggtggctcatcaggcccctggacaacttcaaatgtcttagacaaatttatgkgttttcgagcagctcctttgatacccgcaaggagatactggtgaaaatcatctaaagctctcttcctgcctgaggagtttggatcctaattaggccgggt

SEQ ID NO: 40851 - DNA, 201 bp, Homo sapiens
ccacaaatgccaaattaatagcacagctattctcaggagccgccgggtcaaaaggggtgtaactctggtaggcctcctggaggcgttccaaaaacgccccsggtggctcatcaggcccctggacaacttcaaatgtcttagacaaatttatgtgttttcgagcagctcctttgatacccgcaaggagatactggtgaaaat

SEQ ID NO: 40852 - DNA, 201 bp, Homo sapiens
ttgtaattttcttttaatatcagggcctgcctgagccacaaatgccaaattaatagcacagctattctcaggagccgccgggtcaaaaggggtgtaactcyggtaggcctcctggaggcgttccaaaaacgccccgggtggctcatcaggcccctggacaacttcaaatgtcttagacaaatttatgtgttttcgagcagc

SEQ ID NO: 40853 - DNA, 201 bp, Homo sapiens
taatgttcattccagcaaatccttccagtttttgtaattttcttttaatatcagggcctgcctgagccacaaatgccaaattaatagcacagctattctcrggagccgccgggtcaaaaggggtgtaactctggtaggcctcctggaggcgttccaaaaacgccccgggtggctcatcaggcccctggacaacttcaaatg

SEQ ID NO: 40854 - DNA, 201 bp, Homo sapiens
tgctatgcaggcctgtctgtttgactgtcatgcaggtctgtctgtgtgatcatcagggagaatcggccggccacattttcaatctttctcctcttctggaraaaataaccactcagtctttagcgtcagctcacccttcagggtttgacacctggagcagcagtcaaagaagctgaaaacacgaccttcctttctaggtgt

SEQ ID NO: 40855 - DNA, 201 bp, Homo sapiens
atctttctcctcttctggaaaaaataaccactcagtctttagcgtcagctcacccttcagggtttgacacctggagcagcagtcaaagaagctgaaaacasgaccttcctttctaggtgttaactttagccactgtggtagatggtccagaaagatgaccactgctaattcctttcctccctgaatgtgcatactgttgca

SEQ ID NO: 40856 - DNA, 201 bp, Homo sapiens
tgaattaaatagctagtgatataatgtaattaatcatcttatgttttgtaaaaggctgtggcacactcttatccatatttcatttcaaagaccttacatgktaatcctcagtaccattaacaataagtaacaattaggccaggcacggtggctcatgcctgtaatcccagcattttgggaggccggggcgggcagatcacc

SEQ ID NO: 40857 - DNA, 201 bp, Homo sapiens
tgtttttgataagcattgttttacatatatatgtatatatatatgtgtgtatatatatgtgtgtatatatatgtatatatatatgtgtgtatatatatatrtgtgtgtgtgtatatatatatatatatatatatatatatgtatagttttgggggtttgtttttttttcttttttttttgagacggagttttcctctgtca

SEQ ID NO: 40858 - DNA, 201 bp, Homo sapiens
tcgctgttgctgctactgctcacagacaacttggctacttggtggaggccacagggtctagcctcttaagacaagtaggctaccggacgtcaccatggccstccactgtggcggtcaccgtgggctactgggggccaagagagaaggagccccggtctcgtcagtcatcagactcctccgctgcggggagggtgaggactt

SEQ ID NO: 40859 - DNA, 201 bp, Homo sapiens
aagcatcttgtgggagagaaagttaaatgaggctgatctaacagtaaactgtgatactgcaggatgcgggcatttgacatccatttgccagaggcacttcrtagtaaagtgtctacagcatgaggacctgtaagggttaaattttggcccagagtcagtttatcagcttcctggaccaggctcgctgttgctgctactgct

SEQ ID NO: 40860 - DNA, 201 bp, Homo sapiens
gcctttcctgctgagatgagtagcccatgctcttggtagatggctccatgtacatgcacagtagcaaaagcatacctgctgtcagtgtgaattttaatacrttcgtcgttaccctatcggagggcctgagagagggcaatcaactcagccctctgtgccgaggtacctgctggcagtgcttgggcccacagtatattcgtc

SEQ ID NO: 40861 - DNA, 201 bp, Homo sapiens
atgggtatcccttagcttaggcaagataggcggagccctcctatacatgatttcaaaaggtgaaaacctagcccggtaaggagtgcatctcactctaagargggctaaaggaaggagtctcacctaattttcaccggtctctaagatcaattttgtaagagtattttttagggtgtggttcatgcgttctacctgcccaga

SEQ ID NO: 40862 - DNA, 201 bp, Homo sapiens
ataaagccactaataaccacaaaaggaaaactatggttctttttactttgtcaaagttctgcatctgttcccggttggtcagccaggattccatgtcctgsgcagtctgaatgacaaatgcttcgtaatctgcaaacatctgtgtaaaacggttagcaaagacctctcggagctgtacattgagctggtagtcccttagtt

SEQ ID NO: 40863 - DNA, 201 bp, Homo sapiens
caggaaggagcctgactgttagcacctgggtgagaaattgcataaacaaacattatcataaactgtaatacctgccattggtttccctaaaagcccatttktacttcccacagaagctctagctttcccgctccttctgcctattaaattgttgttgtaatatacccttacccctagctgttcagcaagctactgctttct

SEQ ID NO: 40864 - DNA, 201 bp, Homo sapiens
catctggaaggttttagcatagttcataatggatgatggctggttaacaatttagtacgtctttgatgatcaatctagttcagcatagctgtctcttgtcrgtaaaaaaaaaaaaaaaaaaaagccaatctctgcaaaatatttaaagagctttattctgagcccatatgagtgaccatggcccagggaacagtctaaaag

SEQ ID NO: 40865 - DNA, 201 bp, Homo sapiens
tacagcttggttttatacattgtagggagacagaagttataggcaaagacaaatcaatacatctaaggtatacattggtttggccaggaaaggcgggacakcttaaggaaggagcaatacaggtcataggtggattcaaagattttctgatttggaattggtcaaaagagttaagctgaagacttaaagtcaggctgggcg

SEQ ID NO: 40866 - DNA, 201 bp, Homo sapiens
aaaaaaaaaaaaaaagacaaagtcagtagaaagaaatgcttgggttgagataagggggggtgggctgtgattcttgttatatagatgaagcctcagatagmaggcttcagagagaatagatggtaaacgtctcttttggaatttcacaggtgtcagactcttagttaatctctgctagatctgggaaaagcctagctgcat

SEQ ID NO: 40867 - DNA, 201 bp, Homo sapiens
gagatagttgaagattttccttatatttaacagtgttgttttgttataaagaaatgaaacctacttgggaaaatgcttccaaagattaacaaaatcttaarttatgaaggattaattaaaacttcattgtagagtctagaggtaaaaatagaccaaatatagaaagaagacgtaacttgcatctgtgtttaattaatacat

SEQ ID NO: 40868 - DNA, 201 bp, Homo sapiens
agggagagagtataatgaggtacgtccaacccttccttcccatcatggcctggaatttagtttttcagcttgctctggggtcccctcggcctagacagctstctgttcagttggttgggggcttaggatataatttttggtttacactcttcaggttgatgatcaggcaaagcataaacagttcaaatcaaatgcagctgg

SEQ ID NO: 40869 - DNA, 201 bp, Homo sapiens
tattttgggaagctaggaaggctggagaggctttcagctgcacactgacctatcaccccatgtgaggcagagacagaaatgatcagaatatggaacgacaygaacacatagaattggggccaagtgtgagatgctgcagtaaattgggatttgtaagaaaaatgtatgtcacatagattcatccatgctttaagaagcatg

SEQ ID NO: 40870 - DNA, 201 bp, Homo sapiens
attttctttttttttttttcctttctggctaatagggtttctatgtgattattaagctgacttttagtttgcctgtaaatatttgtctcccatggctggakagtcatgcattgctccttaatttctatacttagtttgctacatttggattccttcctgcagttcttaccaacctcccaaagcctcatctgacagaatact

SEQ ID NO: 40871 - DNA, 201 bp, Homo sapiens
tgtatcagaatgtttttgataagcattgttttacatatatatgtatatatatatgtgtgtatatatatgtgtgtatatatatgtatatatatatgtgtgtrtatatatatgtgtgtgtgtgtatatatatatatatatatatatatatatgtatagttttgggggtttgtttttttttcttttttttttgagacggagttt

SEQ ID NO: 40872 - DNA, 201 bp, Homo sapiens
ttaatttttgtcacattgtatcttttaaaaaatttaaaatttggtgaatatattaggcaatatatatttattaattttttgtttaccataaaaacctacaygtagaccttcaggtccatgcatttcatactgttgaagctgtggacacattttgggtttacgaatctttgagttggtgaatgcctttaagcccatgtcctg

SEQ ID NO: 40873 - DNA, 201 bp, Homo sapiens
gaaaattctctattaatgtatcagaatgtttttgataagcattgttttacatatatatgtatatatatatgtgtgtatatatatgtgtgtatatatatgtrtatatatatgtgtgtatatatatatgtgtgtgtgtgtatatatatatatatatatatatatatatgtatagttttgggggtttgtttttttttctttttt

SEQ ID NO: 40874 - DNA, 201 bp, Homo sapiens
taaaacctgaagaactggtctttgagacatttttcagatttagcatttcaggagaccaagagatgccacttcgtcctgagaccgcttcccaggaaatgacytggctgtgtgaatatggttttagacacccctgcaatttcatccccagccaatccgttgtttcagttctccagccccctgcctgccaaagtagtagttaaa

SEQ ID NO: 40875 - DNA, 201 bp, Homo sapiens
actggggcaatttagacgattcgtggcataaagataactgctggaaaacttataaacataggggtgcaacaatcaggaagagaatgaaatggaagggcccrgtagcccccttttaatatgctacaattagattctcaaggtacaagagtttgtctatatactttggaaataaggagcaggattttatgatcttgaaaaatc

SEQ ID NO: 40876 - DNA, 201 bp, Homo sapiens
gccatctaagttaccccaatcctccaacaagtgtcgacagctgccagaaaaagttatttattacttaatcaaaattaacttttcaaatttctggacataamagcttaaagaattatcaaaaacttattcttagagtatcctgaacttatagaaatcttgttttataatagtatcttatgacatttgaacagcatgatttta

SEQ ID NO: 40877 - DNA, 201 bp, Homo sapiens
ctttataagggtgttaactcacatttaaggatatggagagggttcttattacgatgaatttaacatatgttaagttcaccttagttggcatgcatgctttraaggacatcattatttactctaacttccccaattccactttctagattccttcttctggcttttttatatattcagaagtaaagcgttttttaatattca

SEQ ID NO: 40878 - DNA, 201 bp, Homo sapiens
accctatctcattaaaaaaaaaaaaaaagagagagagaagaaaagggaaaagaagatatgcagttgttcctgcaccatttgttgaaaagactggaatgttgattttaataatgcatgtaaattctccaccaccttgggaaatggtgttggctgaaaattacatgtgccctgataacatatgctttaacagagtacctggtg

SEQ ID NO: 40879 - DNA, 201 bp, Homo sapiens
ccaggcccctataattaggcctaatcgtagcctgttgtttgaaaagggtatgaaggacattcatcaggcttggcacggtgccctagacctgctctcctggktagtggggccctccattgcaacagaggtgtgggtgggcctgggagagtgtggcaagaaatgcttaggaggctctacttggccttaaagggctgtgtgacc

SEQ ID NO: 40880 - DNA, 201 bp, Homo sapiens
atttcttcaatccttataaggtgctgggtacctgccaggaaccctgtccatacacgatctcagttcagctcctcaccttgggtacacaagaaaggatcccyggctgaagagggaaatagaggctggaaacaggggtacatgggcagggtggtggtggtgagagaattgcccgaatcagctgccaaatggtgcccaggttgg

SEQ ID NO: 40881 - DNA, 201 bp, Homo sapiens
atgcctgctgagtgaatgagggagggagggggcaggacaagggactggggatttggtagggacaatggaggagctcggagaagaggcaacatttcttcaayccttataaggtgctgggtacctgccaggaaccctgtccatacacgatctcagttcagctcctcaccttgggtacacaagaaaggatccctggctgaagag

SEQ ID NO: 40882 - DNA, 201 bp, Homo sapiens
ccctgacctacccactcaccctcaggttttaccacaaatgctatttcctcacatccaccttccctgacccagccaggccccccatgatgagcctcgcagawcctcatctcccctccacagaggtgatcataacccacagaacccagggccacgatccctggctttgaaccctggctctgccactcagctaagtctctgtct

SEQ ID NO: 40883 - DNA, 201 bp, Homo sapiens
tatcagatgctgctgcatgcggccactcggcaggctgcgggcatccggctgcaggaccaggtggtgatcatcgacgaggcgcacaacctgatcgacaccaycacgggcatgcacagcgtggaggtcagcggctcccaggtgcgtgggcctcccctccccgggccagggcctgccgtgaggtaaagggacttggatggttcc

SEQ ID NO: 40884 - DNA, 201 bp, Homo sapiens
ggaggcccgggcctgtccctattacaggagccgccttgccatccctgcagcccaggtgagggccctgcagggccagaaagccgctcttggctctcactgtrgtctaggccatgaggggcgtcctcatcacactgtagtttgggggatgccccccaccgtggtcaggttgatggcaccttaacccattctctcctgaggcgt

SEQ ID NO: 40885 - DNA, 201 bp, Homo sapiens
cctgagcccaggaggcggacattgcagtgagccaagataacaccactgcactccagtctgggctacagagtgaaactctgtctcaaaaaaaaaaaaaaaaagattaaataaatgcaaacaaagtggtttaaagtactttaaagtacttacactatgcactaggcactgttctaaagtgtttactactacactactaccaat

SEQ ID NO: 40886 - DNA, 201 bp, Homo sapiens
tgtatccacacatctataacagtatctggcacatagctggtgctcaaaaaatagttcttgaataaatgaatgaacaaatggaaagtgcaaatggctgttatattccctgacaacgagaagaaactgaatatgctttgtgatggttagttttatatgtcagattggcgaagtcatagtacccagtttattcaattaaacaca

SEQ ID NO: 40887 - DNA, 201 bp, Homo sapiens
attccagttttctgctattgtgggttatctacattctattgctagacctttaaaccagtcttctaaatttctaaatttcggtcaaatttattacttttcarcttaactcccaaattcagtttcaccaagattttcctctgaccacttctctgttttggttccagatgtgatgaatatgtcacccagttggatgagatgcag

SEQ ID NO: 40888 - DNA, 201 bp, Homo sapiens
tcattgtatggatgaacatatattccagttttctgctattgtgggttatctacattctattgctagacctttaaaccagtcttctaaatttctaaatttcrgtcaaatttattacttttcagcttaactcccaaattcagtttcaccaagattttcctctgaccacttctctgttttggttccagatgtgatgaatatgtc

SEQ ID NO: 40889 - DNA, 201 bp, Homo sapiens
agtctcaaaaaacaaataaacaaaacaacaacaacaaaataataataaattttttaaaaatgtcccatatatctcattgtatggatgaacatatattccarttttctgctattgtgggttatctacattctattgctagacctttaaaccagtcttctaaatttctaaatttcggtcaaatttattacttttcagcttaac

SEQ ID NO: 40890 - DNA, 201 bp, Homo sapiens
gaggatcacttcaacccaggaggcagaggttgcagtgagccgagatggcaccactgcactccagcctgagtgacagcgagattctgtttcaaaaaaaaaaagggtgctgggctcacacctgtaatcccagcactttaggaaactgaagcaggtggatcacttaagcccaggagttcaagaccaaccaaggtaagataataa

SEQ ID NO: 40891 - DNA, 201 bp, Homo sapiens
ttagaataatacggatattattagaatattattagaataatatggatattattagaatagaataaggtgctctttaaaaatacactttctgaggctccccmccccagactcatggaaatgaaatctctaacatttaggctatgtaatctatatttttattttgtatttttaagcaggttctctaataaactttaatacaat

SEQ ID NO: 40892 - DNA, 201 bp, Homo sapiens
tctactagaaatagaatgtgatcgccctgtgtaattttaaattttaaattttctagtaaccacataaagagaaacattaaattaattttaatagtgtattktatttaatccaatatatccaaaatatgatcatttcaacatttagccaatataaaattgttaatgatatcttaaagacttttttttcataatttgttttca

SEQ ID NO: 40893 - DNA, 201 bp, Homo sapiens
taaaatacagtagccaaacatattattgcagaagttcaggatgctctgggagcacataagagagcacataacccagacctggaaccttttaaaaaaattttgagggaaagcaaaatgtaaattaagctctgaagtatgagtagtggttgtctcgaagaacaaagagatgaaaagagctttctaagcataacgaatgacaga

SEQ ID NO: 40894 - DNA, 201 bp, Homo sapiens
tttgtaggggcttggcctggtggctcacacctataatcccagcactttgggaggccaaggagttcaggttgcttgagcccagaagttcaacaccagcttgrgcaataaggcaaaatcctgtctctataaaaaaatacaaaaattagctaggtgtggtggcatgtgcctttagttccagctacttgggaggctgaggcagga

SEQ ID NO: 40895 - DNA, 201 bp, Homo sapiens
taactaataggcaccaaacatattcatttatcacattttttagtgcctcctctatgttgaacatggttccaggcactgaggacacagcagtgaaaaaaaaacgaagtttcttccatcacagagcttactgtctagtgaaagagatagatgctaaataaatatatacataacatacactaatttagtagtaatcaatcctaa

SEQ ID NO: 40896 - DNA, 201 bp, Homo sapiens
aaattcagcttttgctttggactaaaataatgttatttgaatatcagaggcctagttagtaggcaaccctttaaaaatctcaggtctatttgcctttagcygtttgctgaaaaggagtttttgtttgtttgtttgttttgttttggctgtttgttcatcaatttggtttattttgttaaagatttctttccatactataca

SEQ ID NO: 40897 - DNA, 201 bp, Homo sapiens
tgagagattcttctgcctcagcctccccaagtagctgggattacaggtgcccaccaccacacccggctaatttttgtatttttagtagagatagggtttcmccatgttggccaggctggtctcgaactcctgacctcaaatgatctgcccacctcagccttccagtgctgggattacaggcgtgagccactgcgcctggcc

SEQ ID NO: 40898 - DNA, 201 bp, Homo sapiens
agcatttaaaactgcaaagtctaaccccaatcttatgatactcttgatctcccttgctgtgcctttttaaaaataacatttgtcattttatgacatgttayaaaatgaacttacttatatttcttgtttattgcctgtctctcctctctggaatataaggcagagatgtcttgtttttcactgtttcttattattcagaag

SEQ ID NO: 40899 - DNA, 201 bp, Homo sapiens
ccttcaatgcctctcccgtgtgaccgctccttttctttcaaaagtaaatcctatgtctgggaggtaacccgatcaccgcggaaagaacgccgacatggaartcttaggattggtttctcgttccaggaagttgcgctactttgggcaaatcacgtcacctctgggactgtttctaatcagaataaagaaagggctggacca

SEQ ID NO: 40900 - DNA, 201 bp, Homo sapiens
aacttccttactgccttaaacctttgctcatctatcagcttctcaatgaggtctaccctgatcacagcatttaaaactgcaaagtctaaccccaatcttaygatactcttgatctcccttgctgtgcctttttaaaaataacatttgtcattttatgacatgttataaaatgaacttacttatatttcttgtttattgcct

SEQ ID NO: 40901 - DNA, 201 bp, Homo sapiens
attcataatgccaagttttagtgaggatgtggagcaaccgaatctctcatccaattgtgaaaatgaatcatcattatctactagaattcatcatccacagrgcctctgtcccagcaatttttaccgctacataaatacccaggagagtgacagcaaatgtgcaaaaagtcacgtataagaacatttgcggttgcattattt

SEQ ID NO: 40902 - DNA, 201 bp, Homo sapiens
taaagttaagattcataatgccaagttttagtgaggatgtggagcaaccgaatctctcatccaattgtgaaaatgaatcatcattatctactagaattcaycatccacagagcctctgtcccagcaatttttaccgctacataaatacccaggagagtgacagcaaatgtgcaaaaagtcacgtataagaacatttgcggt

SEQ ID NO: 40903 - DNA, 201 bp, Homo sapiens
tattcagagatcaggccagtgggcttgtcaactgagctgtaattccaccagcctgctttagtcaatactgcaatggcgcttccttctatacatattattaraaactgccctagtggaaaataatcttctaccagcccagtcttgctttttatattagaattaaaatttttattcattaaaaacattattaggagagtgaaa

SEQ ID NO: 40904 - DNA, 201 bp, Homo sapiens
agtatacattgggggaggcagagctggaatcattggcatatgtggaatgaaattaatgcatgtattagcacataagggatgtgaatagcaatacttttcayaaacaaaaaaagcaggattattggttgtaaaatttatctaccatgttaatatgctgaataatcctgtacgttttctatccttgtgaatacttgggctggc

SEQ ID NO: 40905 - DNA, 201 bp, Homo sapiens
gagaaatgtgtttacgaagcattgagcaactttgggtgggttgagaccgaaagtatccttgccacttgagtatacattgggggaggcagagctggaatcaytggcatatgtggaatgaaattaatgcatgtattagcacataagggatgtgaatagcaatacttttcataaacaaaaaaagcaggattattggttgtaaaa

SEQ ID NO: 40906 - DNA, 201 bp, Homo sapiens
attaaaatcaactcataagttatgccttgattatattacagcaagatgacagtggttttataacattgcttacaacaatcgtaagattattgatcattcayaatttcaaggatcccagaaatgacactgacataaactgagggcaaagctgactgtaactaaaagattttagccaaatgtcaaagtcaaagataaatgtca

SEQ ID NO: 40907 - DNA, 201 bp, Homo sapiens
gtttttcactccaagatacatctaaaatacatattataactgaaagagaaaatgtatattaaaatcaactcataagttatgccttgattatattacagcawgatgacagtggttttataacattgcttacaacaatcgtaagattattgatcattcacaatttcaaggatcccagaaatgacactgacataaactgagggc

SEQ ID NO: 40908 - DNA, 201 bp, Homo sapiens
tgtattcttggatgaatattgcttattgctggattaaaacaagtttcatctattctctatttgttctaccctgctctatttcaattctagaatattgctaytctgttttctattgtatagatgtaagcactaaggaaacctgttcacataaagagagaaatagaaataggggacgttctattataacaatgttatctaatt

SEQ ID NO: 40909 - DNA, 201 bp, Homo sapiens
gtagccagtatttccaccaggggccatcctgctcctttccccacaactttgtcctgctcgtccaggcctgggagacgctgggtctgtgacaggctgaaccrtgtgaggagcagccccctccctggcctggccggcccatcactggaaggcaaaggagaggtggcgggggcaggtccacgtgtgttggtaggatgtcattta

SEQ ID NO: 40910 - DNA, 201 bp, Homo sapiens
ccttagagtgtaacccactaaggatgcctggtcactaggctctaaagtcacgtggaaccaggcttctctccgtgtgcttctgttgtcagtttcatagatarctaggctgtttttgtttcattttcttttcaattttagaatttgctttcttcttttctgacttgtagtttttaaatatgtaaatatttgtatggctcaaaa

SEQ ID NO: 40911 - DNA, 201 bp, Homo sapiens
tagttcaaaggagattcataaatgaatcatgtaattttaagcaattctcactagatggagctagttacaaataaatacttttttaatatttttcttctttwtttttaattttttatttttatttattttttattttttgaggaattaacagtctttattgggctcagatcaggaggccgtgggtcttgaggacctctgtgt

SEQ ID NO: 40912 - DNA, 201 bp, Homo sapiens
ttatctgctctatcctataatatacttaaaagttttgaaatcatagtaccaatattacttctaacaatagatctgattgaaattgcctttcctctttgccyttagagtgtaacccactaaggatgcctggtcactaggctctaaagtcacgtggaaccaggcttctctccgtgtgcttctgttgtcagtttcatagatagc

SEQ ID NO: 40913 - DNA, 201 bp, Homo sapiens
ttgtgaactgttaacaaggttattcttctcatcctaaagtctggagcaatctcatcaccatctttctattatgccccacacccacttctcgtctcaagaartcagtattttacttttctaccaggatttagctttactgtccactttactgcttctccaaaaagttgcagtgatgatgttgagaagtgactaattcattag

SEQ ID NO: 40914 - DNA, 201 bp, Homo sapiens
acgcgcagccccgaccgcggccccggagggagccccaggaactttgtttctcggccccctacctctggcaccctccgctctcactgggactcgccggccgsccctacagggggaaggcggtcttgatttcttaatctcatgcttcagtctcctcacctgcaaaatgagaatggtgataataggacctacattagggatgtg

SEQ ID NO: 40915 - DNA, 201 bp, Homo sapiens
tggtcttgctgtctcgaggtagtagaggtggaagaggtggaggaggtggaaggggaggcaggcgaggcaggcacactcggggtaacatttgttggaaaaartccgcacagcctaggcaacaatgcaaaacctctctataaacgatagaaaaattagctgggtgtggtggtgtgcacctgtagtcccagctactggagaggt

SEQ ID NO: 40916 - DNA, 201 bp, Homo sapiens
gcccgaggatgaccgcgcgcaggagtttggaagccattgccttcgcgaggaggggggcggtcaaacgcgcagccccgaccgcggccccggagggagccccrggaactttgtttctcggccccctacctctggcaccctccgctctcactgggactcgccggccgcccctacagggggaaggcggtcttgatttcttaatct

SEQ ID NO: 40917 - DNA, 201 bp, Homo sapiens
gagttgagatcacggcactgcactccagcctgggcaacagagactctgtctcaaaaaaaaaaaaaaaagaaaaaagaaaaaaatagaaaatatatatttaytattcattacatggaagtagatcatcataaaggtcttcatcttcatcatcttcacattgagtaggctgaggaggaggaagaggaagacgaggagttggtc

SEQ ID NO: 40918 - DNA, 201 bp, Homo sapiens
agccagtgctggccacgcctattctccaactcggacatcattaggcgtgtgatcacatggtctggaaccaaaagacttttctctatatactgctttgccayctcaccaacttcggtgctggccttgatgttctcccgcaagaagtggccgctggagagatgctggagaccaaagttctgggcgatcctctggcacacggtg

SEQ ID NO: 40919 - DNA, 201 bp, Homo sapiens
attttgtccttttaaaaattcttttatttgattcaatatattgtattttgtttatttttttaactgcagaagtgagtagttatatatatatatatataaaattccttaccaatgaaagcccacaagagagctcaaagcaattaattcctagataaatataattttaattgatcttatcctacttatccagtcatttttcct

SEQ ID NO: 40920 - DNA, 201 bp, Homo sapiens
ctgttgtgcctaccatgcccttccccgccttggatgcacaggtgccccaccttagctgcccgagatgctgtttatccttgatagtcaccttttaagccttmtacaggtctatcaagttgagtcaccattaccacttggtgtgtgctgtgccttgtgtaacactgcagttccgggagtcctccaacctggaatgcatgcttt

SEQ ID NO: 40921 - DNA, 201 bp, Homo sapiens
gttcttccattgggcagggtcaatatgcttctttggactgaataggtgtgatcttgtttgagaaaagtgtgtaaacgtagggccagattttgttcgtctcygttccggaaaattggtggagcactcctcggctcttgtataattcaatgactggctttgccgcgtctttgtactgtcttagcctggcagcaactgcttcgg

SEQ ID NO: 40922 - DNA, 201 bp, Homo sapiens
acacatagaggggaacaacacacactggttcctgttggaggctgaaggatgagaggaaggagatgatcaggaaaaataacaaatggatactaggcttacakacctggtgaagaaataattggtacaacaaacccccatgacacacatttacctatgtaacaaacctgcacatcctgcagctgtacccctgaacttaaaagt

SEQ ID NO: 40923 - DNA, 201 bp, Homo sapiens
actaaaataagtgtagtataatactgatgtttaaaaaataaaatgtaataccactttttaaatgtatccgatgaaatgtagacactgcagtgattttttttggccaccaccgttcctgtaaaacacacatgaacacttttttcaccagcaggaaattttatatcactcttgtttctttttggtcttatattttcattctac

SEQ ID NO: 40924 - DNA, 201 bp, Homo sapiens
atctacacacattatttctaaagataaatggatggcaaagtactgaaaaatgttcaggggggtgacattaacctttaatgtgatgttctgtttttttttttaaagaagaatatatttttgtaaaattaggtaggcacatttgattatgttggtaattaaaatgaaatttagtaaaactatttgatgattagcccttacact

SEQ ID NO: 40925 - DNA, 201 bp, Homo sapiens
tctatatcactttttccaggcatgatcatactttttagatacgtaccaaacctgtatttgaccaaatgctgaatgactaaacataaaatccttttttgtaygtatgaagcaaaaattgtcatcacagtttgaacttctggaatagaagaataaatctcaagaattatcagaattttatcattttaatttttaattaaaata

SEQ ID NO: 40926 - DNA, 201 bp, Homo sapiens
catgcaatctaaaaatggggaagagaagcattttttaaaatcaggttttgaagtaagaaatgccacaaacaatcctgtaaaataatgaagctgtacacaaytaaggatgcatccttaaatttaagacacacctttttattttgcacatttgcattaacgtgattcccctctggggaagttttgagcatttaccatgaatac

SEQ ID NO: 40927 - DNA, 201 bp, Homo sapiens
ggaggatcacctgagcctgggaggtcaaggctgcagtgagccgtgatggcaccactgcactccagcctgggtgccagaaagagaccctgtctcaaaaaaawttttatgttattatttgtggtaactacatatgattaaacaattaataccttaagtagtaaaagattaaaaggacaatacatccactatcaaccattggtg

SEQ ID NO: 40928 - DNA, 201 bp, Homo sapiens
actctgtttaaaaaaaaagaaaaagaccctgcagaaattaaaattgtaaaaatataaatatacaaggaacaggcaccaggcacctttggctccacatcctygtcatcacttcataccttgtggctctagtttgcatttttgtggctgcttatgaggtcgtgcctcttcagtatttacaggcatttatgactatcctgcact

SEQ ID NO: 40929 - DNA, 201 bp, Homo sapiens
tgggatgcttgcattttcacagcaaaatggtgatattaaaataattattaaattttatttttcaaaggtcaacaacattatatattatctggccaggcacrgtggctcatgcctatagtcccagcacttcgggaggccaaggtgggcagattgcttgagcccaggagttcaagaccagcctgggaaccatagtgagacccc

SEQ ID NO: 40930 - DNA, 201 bp, Homo sapiens
atttgggctccagaggaccctacaactattgtggggggaactggatgtggtgggaaaaattgtatacctcttctcagacttcataccccaccaatgggctstcaccacggtttgcagactgttcacaccgagtgtgtgtagaaaggatgaaatcttaagattagaatgagagtgaacgcaggttggtcatgcctgcagctc

SEQ ID NO: 40931 - DNA, 201 bp, Homo sapiens
aaatgggatgcttgcattttcacagcaaaatggtgatattaaaataattattaaattttatttttcaaaggtcaacaacattatatattatctggccaggsacggtggctcatgcctatagtcccagcacttcgggaggccaaggtgggcagattgcttgagcccaggagttcaagaccagcctgggaaccatagtgagac

SEQ ID NO: 40932 - DNA, 201 bp, Homo sapiens
gatctgctgctcccatgccctcctttgtgtgttttaaatctgtttgagccttctgggctcctgtgaattagggagtggcagctcctcagtctaactcctaytgtgaccaggttgcctaattggccctttggtttgggcacccactgtccttctgcgtggttggatagatgctgctcccaatgtccctgatctcttacagac

SEQ ID NO: 40933 - DNA, 201 bp, Homo sapiens
ctgtgactaacaaggggtctgggaggatctgctgctcccatgccctcctttgtgtgttttaaatctgtttgagccttctgggctcctgtgaattagggagwggcagctcctcagtctaactcctattgtgaccaggttgcctaattggccctttggtttgggcacccactgtccttctgcgtggttggatagatgctgctc

SEQ ID NO: 40934 - DNA, 201 bp, Homo sapiens
tggggcacccccttgctggaaggtgtctgtggaagtggaagctgcagaaagcctgtgggagctcctggcgggagctggtctcgtgttgctgctctgagccrccagctctgctttgcctcaggctcaccagtggcctgggtagctcctctgtgctccggtgccctgcataccttggtctggctgctgtgtcccggcctcctg

SEQ ID NO: 40935 - DNA, 201 bp, Homo sapiens
gaatccttgttgatagacgcataaactagagctcggagcaagggctgctcccagcacgggagcctgggatcttctgactccagctcccacgcctctttgcrtgaccctgtcacgtccccttcttttatgatggggcacccccttgctggaaggtgtctgtggaagtggaagctgcagaaagcctgtgggagctcctggcgg

SEQ ID NO: 40936 - DNA, 201 bp, Homo sapiens
gagccaccgcacccggcccaaattggcaaagagttttaaaagtaatagcattcagcattgataaaggcatgggaaaggtggagctcttttccactccaackgatacataaactagttcacagccttcaaaacattcacactcttggacctagtactaactctacttggagtgagttagttatacaaggttaaactccaata

SEQ ID NO: 40937 - DNA, 201 bp, Homo sapiens
gtgaggaagcaggatgatgactgtcattctcagagatgttttgatattgtctatacctatcaacactgctttgccaagatagggaagtgcaaaccagaaastggtaagccatcaccttcttgataaaggagatggacttaatttaatgaaatgtacctcttactgactttgctgcttgatttaaacaatccttctagggat

SEQ ID NO: 40938 - DNA, 201 bp, Homo sapiens
ctttgcatcccaagtctttaacacaaaagctagcacacagtgggcatgaaatattttatgaaagaatcagtttgtactagaagaaggcacacttttatcargggttcactagtcaatattgattagtgttagataaatactaagaaaattaggatgtataggaagtgacagatgttaataaaactacctgtattagtttca

SEQ ID NO: 40939 - DNA, 201 bp, Homo sapiens
gtatttttagtagagatagcgtttcttcatgttggtgaggttggtcttgaactcccgacctcaggtgatccgcctgcctcagcctcccaaagtgctgggaytacaggcgtgagcccccacgcccagccccttctttttatttgaaatcaagatttcgtctctggcgaagttatttctcagatataacttagcaagaattta

SEQ ID NO: 40940 - DNA, 201 bp, Homo sapiens
acaaagttgggaaggccttgcttttgagagccagaccaggagtacctgtgactaacaaggggtctgggaggatctgctgctcccatgccctcctttgtgtrttttaaatctgtttgagccttctgggctcctgtgaattagggagtggcagctcctcagtctaactcctattgtgaccaggttgcctaattggccctttgg

SEQ ID NO: 40941 - DNA, 201 bp, Homo sapiens
taacaaagttgggaaggccttgcttttgagagccagaccaggagtacctgtgactaacaaggggtctgggaggatctgctgctcccatgccctcctttgtrtgttttaaatctgtttgagccttctgggctcctgtgaattagggagtggcagctcctcagtctaactcctattgtgaccaggttgcctaattggcccttt

SEQ ID NO: 40942 - DNA, 201 bp, Homo sapiens
cagtgtctgtgttgttgcagtagggaggtagatggaatggggtgagaggggaggtgagcctggagagatggtttggggccagatggggaaagctgtgttayggggcttgtcagtttctgccagccaaggcttcagcatagctgactgtaacaaagttgggaaggccttgcttttgagagccagaccaggagtacctgtgac

SEQ ID NO: 40943 - DNA, 201 bp, Homo sapiens
ttgagcctatgtgtgtcctgcacttgagatgggtctcctgaatatagcacactaatgggtcttgactccttatccaatttgccagtctgtgtcttttattwggggcatttagcccatttacgtttaacattaatatacttgtgtgtgaatttgatcccgtcattacaatgttagctggttattttgcccattaattgatgc

SEQ ID NO: 40944 - DNA, 201 bp, Homo sapiens
acttgagctttttttagacccatgggttctttgcccatgttctgaggactttttatttcaggcgctgctctggggggatattaaggatacagcatcacatrgacacacggtgtttccgtgatgggcatagttctgtgggttgttcgaagcacttgcatatgcggttttgtgtgccctgtgagaacgcagtgctggtatttg

SEQ ID NO: 40945 - DNA, 201 bp, Homo sapiens
tacgggtgagatgtgactctctgaggtagtgggacagtcccttggtggccccctgcatgggcctctgagaggcagcactttggttcccacctctggcccgkgctgtggcggggtggagctgcatgccattcatgtcctaggcacatcatggtgtgtgctgcacacagacctggaaggctggggactgaccgctggctctga

SEQ ID NO: 40946 - DNA, 201 bp, Homo sapiens
tgaggaatgctcaagatcagtgcaggctcctcctgctgccctatcatgcgccatgcatggcaccaggtgtctctggtcttcacgctgactctgccatgggkgtggtgttcctgttttacattggaaacgtggagattcagagatggtcaagctctgtcctgaggtcatgcagctcatgagtgtggagctggggtgtgccca

SEQ ID NO: 40947 - DNA, 201 bp, Homo sapiens
acattttatcagagctaggttatgaacattgcaggtgggcctttcaacttcctgcagaagtgcagaggtgcaactgagcattcactaagaactggcacttstccaaactgtgcaaaagagggagtgcaagtctgtctcacacacgtaattgaggaaggaaaagaaggccagtgttgctgaagcttagggaaggagataaag

SEQ ID NO: 40948 - DNA, 201 bp, Homo sapiens
ctgatcaggcaacatttgagggggctttgaagaataagtagggattttccggggagagaagaggggcaaagtcattcaggaggatgaaacagcctgtagargagggaaggctggagagagtgctgcttgtcagtgtctgtgttgttgcagtagggaggtagatggaatggggtgagaggggaggtgagcctggagagatgg

SEQ ID NO: 40949 - DNA, 201 bp, Homo sapiens
cttgaatcagagtaatctcctgatcaggcaacatttgagggggctttgaagaataagtagggattttccggggagagaagaggggcaaagtcattcaggargatgaaacagcctgtagaagagggaaggctggagagagtgctgcttgtcagtgtctgtgttgttgcagtagggaggtagatggaatggggtgagagggga

SEQ ID NO: 40950 - DNA, 201 bp, Homo sapiens
tgcatgtgaaggatttaatacagtacctgacacatgacaagcacttgataaatgatggatgtgatggtgacaataatagtaataataataaaataataatrtgttggctgtgctcgataggagtggagggtagcaaactcagcttgaatcagagtaatctcctgatcaggcaacatttgagggggctttgaagaataagta

SEQ ID NO: 40951 - DNA, 201 bp, Homo sapiens
ctgcctacctccggcgctgagctctgcggtccttcggctctgcctgtccgagtcttctggctattcattctgctgcgcttcatgctgtctgtccgtcaccytagctgcctctgactgctcattttcttattcatttttccttctctgactttggtccttccagccgagcatgctgtctagttatctccctgctttcgtggt

SEQ ID NO: 40952 - DNA, 201 bp, Homo sapiens
cctgaacaaaattgtgagaatatagcacaggcatgtgtgttacagatgccatgataattctcacaccaaattgtaaaaaaaaaaaaaaaaaaaaaaaaaaagcaaaccctaaagtgtttaatgtgcctcatatctttgctacatcaaatttttggatcagaatttataagatctaccagaaaagtatcaaaagattattct

SEQ ID NO: 40953 - DNA, 201 bp, Homo sapiens
tcattttacttttctggacttagttttctctggggtaaaatagatggcacctacagtatcatttatttgtgttcttttaattttatgttaaatcgctcacyttgttggctagacagttttcaatctcaaatttttcagagtctccaacaacttctccatctggtaaaatggcaaagatgaacattcgtgcaatgggggcaa

SEQ ID NO: 40954 - DNA, 201 bp, Homo sapiens
tttctctggggtaaaatagatggcacctacagtatcatttatttgtgttcttttaattttatgttaaatcgctcaccttgttggctagacagttttcaatytcaaatttttcagagtctccaacaacttctccatctggtaaaatggcaaagatgaacattcgtgcaatgggggcaacgtctgactccacagggaaggata

SEQ ID NO: 40955 - DNA, 201 bp, Homo sapiens
aatattctttataatgaactgataaatgtagatatgtatttccctgagctctgtgagcagctctagcaaataaatcccccaagaagggggtcatggaaccstgatttatagttggtaggtcagaagcacagacaaaacaacctggggcttgcaattgcattggaagtgggactgagtcctcaacctatggcatctgacact

SEQ ID NO: 40956 - DNA, 201 bp, Homo sapiens
gctctagcaaataaatcccccaagaagggggtcatggaaccgtgatttatagttggtaggtcagaagcacagacaaaacaacctggggcttgcaattgcaytggaagtgggactgagtcctcaacctatggcatctgacactacccaagtagatagtatgagaatcggattgaattagaggacctgccccccccaccccct

SEQ ID NO: 40957 - DNA, 201 bp, Homo sapiens
taaccctcactttgaaataggatgtgtcaaccctattttgcagatgaggaaagcaagggtcagagaggttagacaactcttccagagtcacacagctgggragtagcagctccaggagcagaagctggggccgcttcctggtgcaccgatggtcttcaggtgttttgtggaaactcgggggcctccggggcgaccttgagg

SEQ ID NO: 40958 - DNA, 201 bp, Homo sapiens
gaagggggtcatggaaccgtgatttatagttggtaggtcagaagcacagacaaaacaacctggggcttgcaattgcattggaagtgggactgagtcctcarcctatggcatctgacactacccaagtagatagtatgagaatcggattgaattagaggacctgccccccccaccccctgctgccaccaccaccacccagct

SEQ ID NO: 40959 - DNA, 201 bp, Homo sapiens
ggtgggcggatcacctgaggtcgggagtttgagaccagcctgaccaacatggagaaaccccgtctctactaaaaatacaaaattagccgggcgtggtggcrcatgccataatcccagctactaggggggctgagacaggagaatcgcttgaacctgggaggcagaggttgcgatgagccgagatcatgccattgcactcca

SEQ ID NO: 40960 - DNA, 201 bp, Homo sapiens
ttttccagtttttcctttttgtaatatcagtactcttaactggaaagctttccctaacttacacctacctgcagcacgtgagaatactgtcttctctgccwcaacttctcttgatttttaaacagaaggaagaactgctaatgtagcagatgaaaagtagtatctcactgttacttggtgggtgcagtttcactatttcct

SEQ ID NO: 40961 - DNA, 201 bp, Homo sapiens
accgagtaactactaggtaagcatttattaaatgaaacaccaatttcaggttaaaaaagaaacctgaaatgttgattctgttgaataaaaagtataggagrttgtttttttggattaagtttctgtactatgctccaacagacaaaaccaaaaatcaaaatggagtcacccatgctaaagttctgtcaccaaacttcaata

SEQ ID NO: 40962 - DNA, 201 bp, Homo sapiens
aacaaagtgctccttcaggtctgggcaagagccgtggatcctgtaggtcagcttccggggcttcccatgccctcacgtttcaggagataacgtgagcctcrgaggacctgagttctgaatagaaaatttttgctcttcatttcttcacacacccagcctctcagtgagctcctgctggctttgtccagcatgcgacataag

SEQ ID NO: 40963 - DNA, 201 bp, Homo sapiens
taagcatttattaaatgaaacaccaatttcaggttaaaaaagaaacctgaaatgttgattctgttgaataaaaagtataggaggttgtttttttggattargtttctgtactatgctccaacagacaaaaccaaaaatcaaaatggagtcacccatgctaaagttctgtcaccaaacttcaataagttgttatctgatctt

SEQ ID NO: 40964 - DNA, 201 bp, Homo sapiens
aatgaaacaccaatttcaggttaaaaaagaaacctgaaatgttgattctgttgaataaaaagtataggaggttgtttttttggattaagtttctgtactakgctccaacagacaaaaccaaaaatcaaaatggagtcacccatgctaaagttctgtcaccaaacttcaataagttgttatctgatcttcagagtgagacca

SEQ ID NO: 40965 - DNA, 201 bp, Homo sapiens
gggtcttcatcaacatagtgttgaacttagaaaataaaaagcagacaaacaaaaaactaagctgctgaaatattcaaaaatgtttctcttgtttcttgaayaagagagaaataaaaatcttgtttctctcaagatgaaacacatgtgaagattctaaatattagttagggatacatatgcagcaaaaatataaggaaatcc

SEQ ID NO: 40966 - DNA, 201 bp, Homo sapiens
ttattaagcacggtgtcgttctataaccattttctgaacatttccccaaatctttaccaaaacaaagctctcttaaattctttctccattatatttctttycaactcctccctgagtaatacatatttagtgggaataaagtttttattttggccaggtgcggtggctcacacctgtaatcccagcactctggaaggctaa

SEQ ID NO: 40967 - DNA, 201 bp, Homo sapiens
aaacttcagaatctgaattttaaaatcctggctactcaactgatactaaaaatcaaaatatggtaatataatcattgctgtaacctaattatggtccacawttcagtgtgtggtaataataaactatatgaaaacatttacttcagaaaagaaaagtcttacattaagctaatcatatgtcttatgatcctaaaattttat

SEQ ID NO: 40968 - DNA, 201 bp, Homo sapiens
tttgaaatgatgtgaacgttggtttcctcctcagtaaaatggagaatgataataactataagtggtaaggaaaaatgcatgtgaaggatttaatacagtayctgacacatgacaagcacttgataaatgatggatgtgatggtgacaataatagtaataataataaaataataatgtgttggctgtgctcgataggagtgg

SEQ ID NO: 40969 - DNA, 201 bp, Homo sapiens
cgtctcaaaaaaaaaaaaaaaaaggttttatggctgggcttggtggctcacacctgtaatcccagcacttttggaggctgaggtgggaagattgcttgagyccagaagtttaagaccaaacaaaacaacaaaaccaaaaaagccagacccagtggtgcccaagtgcctgtagtctcagtgactcaggaggctgaggtggga

SEQ ID NO: 40970 - DNA, 201 bp, Homo sapiens
ttctttggactgaataggtgtgatcttgtttgagaaaagtgtgtaaacgtagggccagattttgttcgtctccgttccggaaaattggtggagcactcctyggctcttgtataattcaatgactggctttgccgcgtctttgtactgtcttagcctggcagcaactgcttcgggtttatcatcctcctgctggactaatgg

SEQ ID NO: 40971 - DNA, 201 bp, Homo sapiens
tggagaaccggcctgggttactcagtttgtgcagaagaaagaagagagggacctggtgaaccgactgaaggtgagacctggggtatccggaagtgggagtrctggaggaaacagggcttcagcgattgttgtggggcgattccgagactcaggcagtgcatgctcccctgccgttgctgtgcctctcagctcttccctcag

SEQ ID NO: 40972 - DNA, 201 bp, Homo sapiens
cctgcgaaggggctgcaggcaccccgaggcctgctggagaaccggcctgggttactcagtttgtgcagaagaaagaagagagggacctggtgaaccgactraaggtgagacctggggtatccggaagtgggagtgctggaggaaacagggcttcagcgattgttgtggggcgattccgagactcaggcagtgcatgctccc

SEQ ID NO: 40973 - DNA, 201 bp, Homo sapiens
ctaggcagggaaaagcgtatgttttttccttgaccttgaaaatttagcttgggctttctttgtacaaacatgaagatcctaggagaagcccaatcaatttkagagagacaagtggatgaagatagggattaaaagaattgtgcttgactgagcagagagactgatgatctgaaaggacaccaggtaaaatgtttcttttta

SEQ ID NO: 40974 - DNA, 201 bp, Homo sapiens
agctcaccaggaaagcagaatctctaaaactccagctgcagtgcaagcccagcccccagggacaccgctgtccacatctgaaatagctggcgatcatcacrgggtgggagacaggatgcagtgggcaccttccacattgaaacccactcaattaaaaccccacgtgtgggggacagacacacacgtacccatcacacccag

SEQ ID NO: 40975 - DNA, 201 bp, Homo sapiens
cctttgatctcaaaaatgccccagcctctaagtaacccatggcagtatgaagccaacaatgaggaatttcttccgagctctcccctggagatggggtggcrggagggcatgcctgcgactgagataactcccaaagcacagcagggaaggaagaggagaacaatgaggaagaaagggagctgagaagggaggggaagcaga

SEQ ID NO: 40976 - DNA, 201 bp, Homo sapiens
tgctcctcacctccagaataaggagactccttcagctttgaagatgtgggaagagcaggggtgagggcaaggaagaggatgtctgagcattgaaaaggccragaaaagaggctggagccctgaaggcaatcagcacctgttcccaagaatgcaaggctgggccttctcccctctcagacacatccatcatctgtcaagatc

SEQ ID NO: 40977 - DNA, 201 bp, Homo sapiens
gagaggagctggaagctttttggaccctgagataaaggctttcctggaggagaacactgaagtcaccagcagtggtagcctcacccctgaaatccagttgmggcttttgacccccagatgcaaattctggtgggagagagctgacctgtggccccacagtgatccttactgggcaatctactggccaggaggccaagccct

SEQ ID NO: 40978 - DNA, 201 bp, Homo sapiens
tgcagttagcttttttgttggaacacaaaaggttggagggttttggaaaacaacacgatgggtaaatttcttaactgacctgttttacagaagcacagggytcaggtggttcaccagtgtcagagactaagtgaatgcaagaaaggagagtaagggaagaggctgggaagactgccagaattctagactgtggattacata

SEQ ID NO: 40979 - DNA, 201 bp, Homo sapiens
tacaggtccttaattaaaagtgtactgttggtttctgctgagttttttattgatatgtgctgctgttttctctggaagcctctttagggaatcgaggagcrcactggtgcaggggctgggtggagccatcctccgatggagcacaggcagatggaagcccccaccccagctgcgtggcctgaagccagcctcccgctcccc

SEQ ID NO: 40980 - DNA, 201 bp, Homo sapiens
cattgatgccaggcactctctttgcagagctccatgcaggagatgggttcaacaacaccatctccttgaacgaagggcaggtgcaacatgccatcaaccayggccagtgctgggctagggtgagagcaggcacagaggggtctccacagacagagactcaagaagtccagggtggcccatgactcagacgcacaaatgggg

SEQ ID NO: 40981 - DNA, 201 bp, Homo sapiens
ggcaggccattgatgccaggcactctctttgcagagctccatgcaggagatgggttcaacaacaccatctccttgaacgaagggcaggtgcaacatgccaycaaccacggccagtgctgggctagggtgagagcaggcacagaggggtctccacagacagagactcaagaagtccagggtggcccatgactcagacgcaca

SEQ ID NO: 40982 - DNA, 201 bp, Homo sapiens
cagaacagtgagctggataattaaagaagctttttcctgcttcttgggcccagtttccatttcttccttttttctgtttttcctggctattctagtgctartttccttcctttcctttcctaggctggccttagagcatcctctcctatgtacagccagaccttctttcaagcttttattaaaatggggaaaggtcatttg

SEQ ID NO: 40983 - DNA, 201 bp, Homo sapiens
tacggagatttattgcaaagtaaaaatacacactcaagaaaggggagcatgggcatactcatgagagagctgcacaaaggggcttggggtttcttatatgrgtttctttacccaaggggtggactattcatgaagattcctggaaaaaggtgaagatttctcagaactgtgatgctgcccattttaacaccaaatacagtg

SEQ ID NO: 40984 - DNA, 201 bp, Homo sapiens
tcattgctgtattcccagtgcctagaacagtacctagcacgcactgtgtacaggtgtttgataaatattcagttaatgatgaaagggtacatactatatakacgtttatatatttgtgttttatgtatgcttatataaatatcaatataatttatatacatatatagtttatatacatatatatacacatttctaaatttc

SEQ ID NO: 40985 - DNA, 201 bp, Homo sapiens
ttagtcacatgctctagcatgtaggctgggcactgtggctcacacttataatcctagatctttgggaggccaaggtgggcagattgcttgagcccagaggktcaagaccagcctgggcaacatggtgaaaccctgtctctaaaaaaaatacaaaaattagctggatgtggtagtgggtgcctgtagtcctagctactcagg

SEQ ID NO: 40986 - DNA, 201 bp, Homo sapiens
tttatttctgcattctcttctgttcctttttaaaatatatctatcctgtcacttctaccccactgtaattttatagtaagtctataagtaagaatatagcrtagtatagttctccaactttgtttttctttttaaaaattgttttatctgttcttggtcctgagggttttactacagattttagataaatgttcttttcat

SEQ ID NO: 40987 - DNA, 201 bp, Homo sapiens
atagcttatcttttttccctcatacatcttctatttttttctatccagtctctctctcctgtattgcttttgcttgttctttctctatactggcatcaaascaaattttctaaaatgcaaaatttagcattatcctccctaaaacattgtagtgactgctctgataggccatggttatttgctagaaatctctttctcatt

SEQ ID NO: 40988 - DNA, 201 bp, Homo sapiens
agtgggtgatctcagcttactgcaacctcctcctcccaggttcaagtgattctcctgccttatcctcctgagtagctgggatcacaggtgtgcaccaccaygcctggctaatttttgtatttttaatagagacaggggtcactatgttggccgggctagtctcaaactcctgacctcaggtgatccgcccacctcagcctt

SEQ ID NO: 40989 - DNA, 201 bp, Homo sapiens
attttcaattgtatctttttaacattttctgtttccagcttatcacatttgttcctgttgctattccttgtatcaatagcttatcttttttccctcatacrtcttctatttttttctatccagtctctctctcctgtattgcttttgcttgttctttctctatactggcatcaaagcaaattttctaaaatgcaaaattta

SEQ ID NO: 40990 - DNA, 201 bp, Homo sapiens
tgaggaaggaggattggttgagcccaggagtttgaggctgcaatgagctatgattgcaccactatgttctaacctgggtgacagagagagaccctgtctcwaaaaaagcaaaactgaaaaaacctacaaaaatatttaatatgtacagtttctgatagacactaactctcttttccaatttcctaagaaacaatgctcagt

SEQ ID NO: 40991 - DNA, 201 bp, Homo sapiens
tatttgggtatgtaaacgtatatgtgtccaagaaaaactgagcgatgccatttacatctgtggtgtagtttcccacgattttgtccttcagatgcaactgracaacttcatttgggattggagagttgtctggattaagcaatttaatctgtacaagaggaagaaaatacatttcggaagcatgtagtaaatttgggaatc

SEQ ID NO: 40992 - DNA, 201 bp, Homo sapiens
caggaggctgaggaaggaggattggttgagcccaggagtttgaggctgcaatgagctatgattgcaccactatgttctaacctgggtgacagagagagacyctgtctctaaaaaagcaaaactgaaaaaacctacaaaaatatttaatatgtacagtttctgatagacactaactctcttttccaatttcctaagaaacaa

SEQ ID NO: 40993 - DNA, 201 bp, Homo sapiens
gtgactcaggaggctgaggaaggaggattggttgagcccaggagtttgaggctgcaatgagctatgattgcaccactatgttctaacctgggtgacagagmgagaccctgtctctaaaaaagcaaaactgaaaaaacctacaaaaatatttaatatgtacagtttctgatagacactaactctcttttccaatttcctaag

SEQ ID NO: 40994 - DNA, 201 bp, Homo sapiens
acatagaatctgataaactgcttcaaatttgttttcagaacagtgagctggataattaaagaagctttttcctgcttcttgggcccagtttccatttcttycttttttctgtttttcctggctattctagtgctaatttccttcctttcctttcctaggctggccttagagcatcctctcctatgtacagccagaccttct

SEQ ID NO: 40995 - DNA, 201 bp, Homo sapiens
actcgtgactgatcatcctgtatccacgcacgagctgcacgaaggccgcgcggtcactgtggctccccgttggcgagtacctgggatttcttgctcagcaktttggggccttaattcttttaggggactttttgtctaatgtctccccttcttctaattatgtgcgatatttacatagaatctgataaactgcttcaaatt

SEQ ID NO: 40996 - DNA, 201 bp, Homo sapiens
aaaaaaaaaaaaacacaaaccgtaaacactggcactcgtgactgatcatcctgtatccacgcacgagctgcacgaaggccgcgcggtcactgtggctcccygttggcgagtacctgggatttcttgctcagcagtttggggccttaattcttttaggggactttttgtctaatgtctccccttcttctaattatgtgcgat

SEQ ID NO: 40997 - DNA, 201 bp, Homo sapiens
actatccgacaggggtctgaacgcagctcgggatcagaaaaaaagcaggtcatttgcaatgtaccggagccagccccccttcccctctggctcttaggacmcccattgctggtgagggaggcaccccccgcgaggcagggactgagagccagcctctcttcctcccctggctcttaggacccccattgcgggggggggagg

SEQ ID NO: 40998 - DNA, 201 bp, Homo sapiens
tactatccgacaggggtctgaacgcagctcgggatcagaaaaaaagcaggtcatttgcaatgtaccggagccagccccccttcccctctggctcttaggasacccattgctggtgagggaggcaccccccgcgaggcagggactgagagccagcctctcttcctcccctggctcttaggacccccattgcgggggggggag

SEQ ID NO: 40999 - DNA, 201 bp, Homo sapiens
ggagggtgagacacaccccagaaggctgggactgagagccagcccctctccccccgctggctattaagacacccaacgcagggggtgaggcaccccctacraggctgggactgagagccagcccctctttcaacctggctcttaggacccccatggcagggggggaggcatcccccacgaggcggggactgagagccagcc

SEQ ID NO: 41000 - DNA, 201 bp, Homo sapiens
ccaacaacaggaaggctttcatgagttaaaggaaaaacttctggcagccccagccctggggctacccgatgtgacaaagccttttccattgtatgcttcasagagagaaaagatggcagctggacttttaacccaaactgtggggacctggctgaggccagtggcctacgtctctaaacaactagacagggtttctaaaag

SEQ ID NO: 41001 - DNA, 201 bp, Homo sapiens
tctttcactcagcataattattctgagattcatccatgttgttgtttgcatcaatattttactcttttttattgctaatattctactgtgtggatttaccrcaattaatttatccatttactctttgatggacgtttaagttgtttccagcttttggctattaaaaataaagctgttatgaacatttggatacgaatcttt

SEQ ID NO: 41002 - DNA, 201 bp, Homo sapiens
aggaaagaaggaagagaagaccgcaaaacagcaagaagacatataacaaaatggcaggagtatgttttatcaataacaatattgaatgtaagtgaactaaattctccaatcaaaagacagagtggctgaatggataaaaacacaagacccaacaatctgtcacctacaagaaacacatttcacttataaaaacacaagtag

SEQ ID NO: 41003 - DNA, 201 bp, Homo sapiens
tatctttttcagtagagatgaagttttgccatgttgcccaggctggccttgaactcctgggctcaagagatccacctgcttcagcttcccaaagtggtatrattacaggcatgagccattgcgcctggcctctatgcatatgttgagaagccccagtctgagctcagagatgacctctggttaaaatgagggacttggttt

SEQ ID NO: 41004 - DNA, 201 bp, Homo sapiens
ttttttgagacagagtctcgccctgtcacccaggctggagtgcagtggtgcaatctcagctcactgcaacctctgcctcctgggctcaagcgattctcttrcctcagcctccagagtagctgggactacaagctcaggccaccacacccaactaattatttttatttttatttttattttttgagacagagtctcactctg

SEQ ID NO: 41005 - DNA, 201 bp, Homo sapiens
tgttaacaacagagcagcatttaaaacttcagaatctgaattttaaaatcctggctactcaactgatactaaaaatcaaaatatggtaatataatcattgytgtaacctaattatggtccacatttcagtgtgtggtaataataaactatatgaaaacatttacttcagaaaagaaaagtcttacattaagctaatcatat

SEQ ID NO: 41006 - DNA, 201 bp, Homo sapiens
aatttaagcagaaagggatttgtcttagtccattctgtgctgctataacagaataccacagactgggtaacttatgaggaacagaaatctattctctcacrgttctggagcctaggacattcaagataaaggcaccaatggttgagtctctggttccatgatgatgccttgttgctgcatcctccagagaagaggaacgct

SEQ ID NO: 41007 - DNA, 201 bp, Homo sapiens
agtatgcagccaagcgcctggtgagcctcatttcttggggggcaggattatgtccaggcagggtcgccctgcttggaggctcatgggtgcgtggccagggycttggtctcccctccatgaccctcactggctatgtgctcccgtacagaagctgggctgtgagtggttgaggcgtggatcctaggagtcgacctctctcca

SEQ ID NO: 41008 - DNA, 201 bp, Homo sapiens
atggaaatttggtaccatttgctgtttgctctcacctttttttgcacagtttttaaaaaaacttttattatttatctatttatttatttattttttaaatkttattttattttaagttctggggtacatgtgcaggatgtgcaggtttgttacataggtgtgccatggtggtttgctgcatgtatcagcccatcacctggt

SEQ ID NO: 41009 - DNA, 201 bp, Homo sapiens
tcttaactaattacatttgtgacagtcctatttccagataaggccacattctgagatgctgggggttaggatttcaacacaggaatttggaggaatacaaytcaatcaggcttatggacaattctggtcttaagtcaagagtagtgttctccagtctgtatgtggaggcgcacacctatggtcccagccacttgggaggct

SEQ ID NO: 41010 - DNA, 201 bp, Homo sapiens
cgtgtcccctttccaataaggatattagccctttaggctgggtcccgtcctagtagtctcatcttaactaattacatttgtgacagtcctatttccagatmaggccacattctgagatgctgggggttaggatttcaacacaggaatttggaggaatacaattcaatcaggcttatggacaattctggtcttaagtcaaga

SEQ ID NO: 41011 - DNA, 201 bp, Homo sapiens
tctgtgcatgtctgcatccacgtgtcccctttccaataaggatattagccctttaggctgggtcccgtcctagtagtctcatcttaactaattacatttgygacagtcctatttccagataaggccacattctgagatgctgggggttaggatttcaacacaggaatttggaggaatacaattcaatcaggcttatggaca

SEQ ID NO: 41012 - DNA, 201 bp, Homo sapiens
ctctctcaactgcatgtgaaagatcttagctgaagatgactgacagtgttatttattccatgttagagttgcctacggcaacccaagcccagaatgactayggaccacagcaaaaatgtgagttaaccaaggtagcatggaagacgatgcatagcaacagtaggctatggatgaatggggagtagaataagtttaaagcag

SEQ ID NO: 41013 - DNA, 201 bp, Homo sapiens
acttttatttatttgaaaaaaacaagccccagagctgccaaggggctgccttctctgtcttgtggagacagtgcttgatcctggagagcagccatgttgaraaaaagatattttgagccctaaaataatgagaaaacaggacagagagaggtgttctgagccagttccagattttgccaactgttgcaagaactctagaat

SEQ ID NO: 41014 - DNA, 201 bp, Homo sapiens
acactaactagagaaggcaatatttgaacacaagcattcagacttcagattttaaactcttctgatacggtgaaatgtttatggtacactgttaagctaawaaaaaggatgatattgaatcgcacatatagtgtatcttaataagagaacatgcatagaagaaaagtacagaagaaaatgtgaaatacttagtgttcttta

SEQ ID NO: 41015 - DNA, 201 bp, Homo sapiens
aacaactaaaagtgctttgtggagcagggattgccaagaggcaaatcaagagtgttcctctgacaagtgctgattcttgttgaggatgacgggaactgcaygggagtgtaggacaagtagatttgtctcttgaatttgagaatcggaaaaagagaaggaagagaaataggtgtacaggaaacatcttgactcagaaacaaa

SEQ ID NO: 41016 - DNA, 201 bp, Homo sapiens
aaggtgtcagcatgcttggtcccttctgagggtcgcgagggaaagatctcttcaggcccctttccttggcttataggggcgtgttctccttgggtatcatsacatcgcctgccttctgtgcatgtctgcatccacgtgtcccctttccaataaggatattagccctttaggctgggtcccgtcctagtagtctcatcttaa

SEQ ID NO: 41017 - DNA, 201 bp, Homo sapiens
cacaaactggggcttaaacaacagaaactgacatcccacagcgctggaggctggagtccgagatcaaggtgtcagcatgcttggtcccttctgagggtcgygagggaaagatctcttcaggcccctttccttggcttataggggcgtgttctccttgggtatcatgacatcgcctgccttctgtgcatgtctgcatccacg

SEQ ID NO: 41018 - DNA, 201 bp, Homo sapiens
atatctttttctatcccttcacttcagtctatgtctgttcttaagtctaaagtgagtttcttgtagacattgcatcactagctactgatttttttttttttgagacggagtctggctctgccgcccaggctggagtgcagtggcgtgatctcggctcactgcaagctccgcctcctgggttctggccatattcctgcctca

SEQ ID NO: 41019 - DNA, 201 bp, Homo sapiens
tggagaatgttctctgtgctcttgaaaagaatatttttctgttgttgggtgaaaatttctgtatatatctgttgggtctatttggtctatcatgttgttcmaatcagctgcttttttaattgattttttgtccatatgttctattcattactgaaagtgggggtagtgaggtctactaatttattgtattgctgtcaattt

SEQ ID NO: 41020 - DNA, 201 bp, Homo sapiens
tttatagtagcattttgcacttgaggataaagagaatatggaaatattaagaaatattttagctttgttagatttttgcctccagatcaaacagaacaackcacctctacacatgtattcaggtagctgaaggcattgacaatcaaatcaaattgttcattttgaacaaccgaaaagggtgaggcaatttcaataaagaaa

SEQ ID NO: 41021 - DNA, 201 bp, Homo sapiens
agttaccatctacccaagctaaggtttcctgggaatacaggtccggaaacggtactgtaatccctttagatcccatcaggaaacatagaggatgatctgawcaataattccctccaattgatagcttaggaagatctctccattctgttattttaaggatttttaaagaccacctcaaccaagattttcaaatcatagtga

SEQ ID NO: 41022 - DNA, 201 bp, Homo sapiens
ttttttgagacagagtcttgctctgtcagccaggctggggtgcagtggtgtgatctaggctcactgcaacctctgcctcccagattcaagcaattctcctrcctcagcctccagagtagctgcgattacaggcacctgtcaccacgcctggctaatttttttttgtatttttagtagagatggagtttcaccatgttggcc

SEQ ID NO: 41023 - DNA, 201 bp, Homo sapiens
aaacttgttggcgtgtttcagttttcagagtcttctataaggtcttataccagccgagaagcagcagaaccatctgtccgtgtaccgaggacggatctcarcagctctctgttcagtggctcctgcctttgtagtggattcccttgctgtgctgtaattaagtcagccggcaggagttcctgttttgagggggcctctccc

SEQ ID NO: 41024 - DNA, 201 bp, Homo sapiens
gggtctgtatctgtttagtgctttgatattttggcaaaagatgtggggagaaggtagactagttgaagctgatatgatttttcctatgtactttttgggtratatacatgtttgcagtgacatttgctagtcctaaatgaaactaaagattggggggggataatagtgtgattggatgatactgggaatgagataataaga

SEQ ID NO: 41025 - DNA, 201 bp, Homo sapiens
gggttcctcagcctccagttccttgacttctgcctctgctctctgtatgcacatgtcccagctcacttgggtcagttcattcccggcgcaccactggatcyacccccttcccccagtgtatttgatttctctttgaaacatcattttcatcaaggttctatatagaacgaggacccttgggcgtctactccctgttctctt

SEQ ID NO: 41026 - DNA, 201 bp, Homo sapiens
gcaaaaccgtgtctggctcctccagccaggctgagtctgctgtgcctccctgcccaggccttgggaaagaggagggtgcagtggctcctggctagttccamagtggagtgtgaaaatggtgagttgtttacatgcagtggccagtacagcgtggtactcacacctctttctggaagttgccattgggtggctctgtgggct

SEQ ID NO: 41027 - DNA, 201 bp, Homo sapiens
actcagcgcatgtgtgaggaaggaggagggatagaggaaagattctgagcaggaggccgagcgcggtggctcacgcctataatcccagcactttgggaggscaaggcaggtggatcacctgaggtcaggagttcatagaccagcctggccaacatggtgaaaccctgtctctacaaaaattagccaagtgtggtggcacct

SEQ ID NO: 41028 - DNA, 201 bp, Homo sapiens
atggtaaggcaaggaactgggtggaatgtcaggttgcctgcccaatgggagaggtagggtttttctagcttgtgtgacagaagtagcaaaatctggtcctyccccctcccagtgtagctgtggctcagagttttttctttttgttgtcacttactcccttgtgattgaattttttctcctgcatccatggcaggatcccca

SEQ ID NO: 41029 - DNA, 201 bp, Homo sapiens
aatatgcatattatatatgtttgtatatatatacataaagcaatataataaagccatataagaaggctgctttcttaaatatagcagaatctgtaaactgmttcccctcgagatcatttaagcttatgctgtactgatttagtagatgttattcattcacaaacaaggtcaattactttctcttaacacgctatggctgca

SEQ ID NO: 41030 - DNA, 201 bp, Homo sapiens
cctgagccacagagctgcaggtaggggaggcagctggaaccctggcgcctggctgtggagtttgaggctctgactcctgcgccgcgctgctgccccaaccstagtcatacgaggtgtttcaccccgccctggatactctgagatcccctctgggttcagcaggctcagagagctgactgcctggagcagaaggcatggggt

SEQ ID NO: 41031 - DNA, 201 bp, Homo sapiens
tctgcactcgtggaaacaagcgtagtgaggccagcctgagccacagagctgcaggtaggggaggcagctggaaccctggcgcctggctgtggagtttgagrctctgactcctgcgccgcgctgctgccccaaccctagtcatacgaggtgtttcaccccgccctggatactctgagatcccctctgggttcagcaggctca

SEQ ID NO: 41032 - DNA, 201 bp, Homo sapiens
ctgctgttgtcatttccatttctgcactcgtggaaacaagcgtagtgaggccagcctgagccacagagctgcaggtaggggaggcagctggaaccctggcrcctggctgtggagtttgaggctctgactcctgcgccgcgctgctgccccaaccctagtcatacgaggtgtttcaccccgccctggatactctgagatccc

SEQ ID NO: 41033 - DNA, 201 bp, Homo sapiens
ataaagatctaatcttcactacagatgtcactgatacccagatacaatctatggttacagccttggttaaggctggcaacctaaaaataaaaaagagaagytgtcaaagggacttcctaaaaataaaagagaagttgtcaaagggacttccaggataatagcttaacctacagaataattgtttagactggctgggcatgg

SEQ ID NO: 41034 - DNA, 201 bp, Homo sapiens
aggcaggagaatcacttgaacctggaaggcagaggttgcagtgagccaagattgcaccactgcactccagcctcggcgggtgacagagcgagattctgtcycaaaaaaaaaaaaaagaataattggaataattatttagactgtaataagaaaaatgagctggaaggactgggcataactactgatttacaagttagatcc

SEQ ID NO: 41035 - DNA, 201 bp, Homo sapiens
cataaaaatattttttaagtaagctaatattaataggttgtttctagaatttatgcaccccaaagagagtctccctccaaataaaaagctttcaataaggraaaaaaccccacttcctagaatagctaaatattatcacctctgaaatagagttctgtgaaggaagtacatgaaagtatataaaagtgccttacctttagt

SEQ ID NO: 41036 - DNA, 201 bp, Homo sapiens
ctttaaaattcacagccctgcctttgtgcatgttgagtgtattcggtgagtagtctaggatggctaagtgtgaagaaaatctgtggaagtccactctgacrtatctaaaagcaagccttctgtgctgttttccagagccccctactgaacactctggatccagaaattctattacataaaaatattttttaagtaagctaa

SEQ ID NO: 41037 - DNA, 201 bp, Homo sapiens
aggctttgaaagaagatgctgcaaccttctcatccctgagagcaatgtttgcaacaaggtaacagtattttcttcctatgactgggtgtggtaggtggggwaaaggctttaaaattcacagccctgcctttgtgcatgttgagtgtattcggtgagtagtctaggatggctaagtgtgaagaaaatctgtggaagtccact

SEQ ID NO: 41038 - DNA, 201 bp, Homo sapiens
taggagggtgaatccaacggcggctgagacgatctttaagtgtttcaaatggaatattcaaactgatcactagatccacttcacagattttgtccagggcytcggcttgtcctaatgtcctaggaaaaccatcaaggagccagtgctggccacgcctattctccaactcggacatcattaggcgtgtgatcacatggtctg

SEQ ID NO: 41039 - DNA, 201 bp, Homo sapiens
gtaacaaagtctgggtggctttaaaacaacagaaatttatcgtctcacagttctggaggccaaaagtcagaaatcatggtgtcggcagggccatgctcccyctggcagctctagggaaaggcctttccttgccccttcctggcttctggtgtttgctggcaatccttgatgttccttggcgtgtagatgggtcacttcggt

SEQ ID NO: 41040 - DNA, 201 bp, Homo sapiens
tcccaacactttgggaggcttaggagggaggatcacttgagaccaggagttcaagaccagcctgggcaacataatgagcttctgtctctacaaaagaaatwaaaaaaatagccagatggtagttgtgtcctacttggaaggctgaggtggaaggatcacttgagtctgggaggtggaggctgcagtgaagcaagatcacat

SEQ ID NO: 41041 - DNA, 201 bp, Homo sapiens
gttggaaaccagcctgggcaacatagtgagatcttgtctctacaaaaaatttaaaaaatagctggttgttgtggcgcatgcctgcggtcccagctactcaratggctgaggcaggaggatcgcttgaacccaagagtttgaggctgcagtgagctatgattgtaccagtgcacttcagcctggacaacagagtgagacctt

SEQ ID NO: 41042 - DNA, 201 bp, Homo sapiens
caccacgcccagctaattttttgtatttttagtagagacggttttcaccgtcttgggcaggttggtcttgaactcctgacctcaggagatccgcccgcctyggcctcccaaagtgctgggattacaggcatgagccaccgcgcctggacccatattcagatttctttttttttttttttttgagacggagtctcactctgt

SEQ ID NO: 41043 - DNA, 201 bp, Homo sapiens
agactagtctgggcaacatagtgaaaccctgtctctacaaacaaaaaaaggaagaagacaaaggagaaagagtagaaggagaaggagaagaagaaggagarggaagaaggaggaagagaaggaggaggaaggaagtggctcttgcctgtaatcccagaacttttgggatgctgaagtgggtggataccttgagcccaggag

SEQ ID NO: 41044 - DNA, 201 bp, Homo sapiens
ttgggagaccaaggtgagagaatcacttgagcccagcaattcaagactagtctgggcaacatagtgaaaccctgtctctacaaacaaaaaaaggaagaagmcaaaggagaaagagtagaaggagaaggagaagaagaaggagaaggaagaaggaggaagagaaggaggaggaaggaagtggctcttgcctgtaatcccaga

SEQ ID NO: 41045 - DNA, 201 bp, Homo sapiens
aagaatactgcagtgaacacctttatgccatttttcctagattcaatcactgaatttttgccatgtttactttaattccacgcccccacctccaccatccrtttatctattgtaagggtagatttcaaaaatgagtttcccatttgccaagaaggaaggaaatctttccctcctccccttcttagagcatttctgtcagaa

SEQ ID NO: 41046 - DNA, 201 bp, Homo sapiens
ccccacaactttgtcctgctcgtccaggcctgggagacgctgggtctgtgacaggctgaaccgtgtgaggagcagccccctccctggcctggccggcccakcactggaaggcaaaggagaggtggcgggggcaggtccacgtgtgttggtaggatgtcatttagctggcaccatctctttgcctctttctttctcctttgt

SEQ ID NO: 41047 - DNA, 201 bp, Homo sapiens
caattggaactccaaaggtaacagttttctcctttcctttccttccttcttcttttctctttttctttctttctttcttcctttcttttttttttttttttggcagggtctcactctgtcaaacaggcaggagtgtagtggtgagatttctggtcactgcaacctccatccacctcctgggttcaagcagttctcccacct

SEQ ID NO: 41048 - DNA, 201 bp, Homo sapiens
aatttggggaggacatgaacattcaaaccaaagccagtagaattaggagcaaaggtggatgacttggtcttggtcttgagcgatagaaggatatttcaggyctggcgcagtggctcagccctggcgcagtggctcagcactttgggaggccgaggcgggcagatcacttgaggtcagaagttcgagaccaacctggccaac

SEQ ID NO: 41049 - DNA, 201 bp, Homo sapiens
cctggaaaatccatgatctcctaaagtaaagcaatttaaaattgttcacattatttgtgtgtgagtgtgagggggcgctttatcaccctccacctctcatycccccaccacaagcagttgccaaattcaaataatttttccttcaatgcctctcccgtgtgaccgctccttttctttcaaaagtaaatcctatgtctggga

SEQ ID NO: 41050 - DNA, 201 bp, Homo sapiens
gtgttcttttagcaatttcccatcctttgacatcctcatgctgttcttggctataaatcttcacttgctcttgctgtttcagagttgagccccttcttttsccccctccaattgcaatggttttgaatgaagtcttccttaccattttaacaagtgtcagaataatttttttaacatctgtctttacaccacagtcaacaa

SEQ ID NO: 41051 - DNA, 201 bp, Homo sapiens
ccctgaggagctgagactcagctccctggaggtgaaaagctaaagcattcccctgttgtgccattttcttccctttctctcatgcattatttttcttactstggttattcttgatgggaatttttagcagagctcagtgccatcttatcccaggaagaaaaaaaaattgtaggagataaatgtatgatgaatggtgcaaaa

SEQ ID NO: 41052 - DNA, 201 bp, Homo sapiens
acattttgatttagggagctgcttttttcaagaaacagaatcacataaacaggatttcaggccagtctcaaaaaactggaagatttcacagagccttgggyccacatttctgtgtggcatcagagggctagaggtgaatgagtcctcctctcctctcctctccccctcctcccctccattcccctcccctccccttccccg

SEQ ID NO: 41053 - DNA, 201 bp, Homo sapiens
cagataagatactgtcgaaaggacgtttggcccagcagcaggacctccaccaatgaacggactccaattcttgatttgagccttgggaaccaatcaacttwgtttccaagagtttatgtgaacttccctcctttaccagtaaaatcttccccctattcttcccttctccagacccgtggcttgccatagctgtacatcttg

SEQ ID NO: 41054 - DNA, 201 bp, Homo sapiens
aattaaacttatataatacagattaatagaagagaagcatacaaattttattataattttacttgcacatgaaagtcctcacaagacaatgaagacccaargaagtgaccagaagtagtaaacttatatatcttttagatgaagaaatgataaatttgtgaagaagtgataagacaaagcagtttggattataggcagtaa

SEQ ID NO: 41055 - DNA, 201 bp, Homo sapiens
tggacaagggcagccactgagagagctggtatccaagcagcttggagatgaagtcctggccccagaaggcactggtgtggaagccacacatctcccttgaragtgcatctggaggtctcagtatgtgaagtgctcttgaagggaagatttcccaccggccattcacagcagagcaccccagtgccccacagatacaccctc

SEQ ID NO: 41056 - DNA, 201 bp, Homo sapiens
gagtcttgctcttgtcgcccaggctggagtgcagtggtgccgtcttggctcactgcaacctcctcctcccaggttcaagcgattctcttgcctcagcctcstgtgtagctgggattacaggcgcctgccaccacatctggctaatttttgtatttttagtagagacagggtttcagcatgttggccaggctggtcttgaat

SEQ ID NO: 41057 - DNA, 201 bp, Homo sapiens
aggtgattaaagtggacaagggcagccactgagagagctggtatccaagcagcttggagatgaagtcctggccccagaaggcactggtgtggaagccacayatctcccttgaaagtgcatctggaggtctcagtatgtgaagtgctcttgaagggaagatttcccaccggccattcacagcagagcaccccagtgccccac

SEQ ID NO: 41058 - DNA, 201 bp, Homo sapiens
acttagctgctgacctctggagaattcactgcagaatcgattgcttgcttggcatgtggggaaaaatccctacacatttggtcacaaaagcattttgttgkgagagtatagtatgggagaaacagattttggtgttttttttcctattcaatcttttgcattatagcttattctttttgtatgttgttaaggaaatctttg

SEQ ID NO: 41059 - DNA, 201 bp, Homo sapiens
gcctcccaaaatactgagattacaggtgtgagccactgcttccggttaatcttcaactatatatatatatatatatatacacatacatatatatatatatwcatatacatatatttatttattgagatggagtcttgctcttgtcgcccaggctggagtgcagtggtgccgtcttggctcactgcaacctcctcctcccag

SEQ ID NO: 41060 - DNA, 201 bp, Homo sapiens
acagggtacaggtgattaaagtggacaagggcagccactgagagagctggtatccaagcagcttggagatgaagtcctggccccagaaggcactggtgtgraagccacacatctcccttgaaagtgcatctggaggtctcagtatgtgaagtgctcttgaagggaagatttcccaccggccattcacagcagagcacccca

SEQ ID NO: 41061 - DNA, 201 bp, Homo sapiens
ctgtatcttttgtaatattctttaaaacaaatgagtaaatgttaagtgttttcctgagttctgtgagccatccagcaaattggacctgaggagggtgtcarggatacctagatttaaagccagtcagtcagaaactcaggccacatcctgtgcttgtgactggcattggaagtgggagacagtcttgtcaggctgagccct

SEQ ID NO: 41062 - DNA, 201 bp, Homo sapiens
cctcaagtgatctgcctgccttggcctcccaaaatactgagattacaggtgtgagccactgcttccggttaatcttcaactatatatatatatatatatayacacatacatatatatatatatacatatacatatatttatttattgagatggagtcttgctcttgtcgcccaggctggagtgcagtggtgccgtcttggc

SEQ ID NO: 41063 - DNA, 201 bp, Homo sapiens
agagtagattttttatttattatttattattatttttgagacagaaaaatatgtcacctaggctggagtgcagttgcgtgatctcggctcgctgcaacctytgcctcccaagttcaagcaattctcttgcctcagcctcccaagtagctgggattacacactgggctaatttttgtattttttgtagagacaaggtttcac

SEQ ID NO: 41064 - DNA, 201 bp, Homo sapiens
atgtttgtctcccccagattcacatattgaagccctaatcctcagtgtgactgtatttggagatggagtgtttaaggaagtaattaaggttaaatcaggtyacaagggtggggccctgatctgataggattaatgttcttgtaagaagagagaccagagccctctctctttcttcccttgtgcacacactgaggaaaagcc

SEQ ID NO: 41065 - DNA, 201 bp, Homo sapiens
ttccctacaaaaataatgcaatatttctatctatctatctatctatctatctatctatctatctatctatctatcatctatcatctatctatgtctatatmtatcagtatgtgtgtatatatatgtatatacatggctgtatattttatgtattcctacacaattatgatgtcatggtttgtactgtagaaaaagtggggg

SEQ ID NO: 41066 - DNA, 201 bp, Homo sapiens
gagttttttatttgtttgtctttagacagcatcttgctctgtcactccaggctaatgtttttgttttgttttgttttttgacacaaaatctcactcttatsccccaggctggagtgcaatggcgtgatctcagctcactgcaacctccacctcccaggttcaagcgattctcctgcctccgcctcctgagtagctgggatt

SEQ ID NO: 41067 - DNA, 201 bp, Homo sapiens
tgctgttctgttctggaatagtcacttgattctttttggtagtttctacttctctgagattcttcaaatttttattcattatgactatattttcttctaaktctttgaacgtatttatgcagatattaaagtccttgtttgctagttccagcatctatgttacataagtttcttttctacttactgacttttctttgatcc

SEQ ID NO: 41068 - DNA, 201 bp, Homo sapiens
tagaaaactggagtcaaaaactcttccctacaaaaataatgcaatatttctatctatctatctatctatctatctatctatctatctatctatctatcathtatcatctatctatgtctatatatatcagtatgtgtgtatatatatgtatatacatggctgtatattttatgtattcctacacaattatgatgtcatggt

SEQ ID NO: 41069 - DNA, 201 bp, Homo sapiens
tttccagatccaggagataatcaactaagagccaagcacccttttagttccgataagaaacattttgcaacctgctctccctgaagtctgctatctgagakcttcctctgcacaataaaacttggtacccacaatcctttatcttaacctgaacatttcctttctattgatcccaggccttcagataaactcaaccaattg

SEQ ID NO: 41070 - DNA, 201 bp, Homo sapiens
cccttttttgtccttccttcctttccagatccaggagataatcaactaagagccaagcacccttttagttccgataagaaacattttgcaacctgctctcyctgaagtctgctatctgagagcttcctctgcacaataaaacttggtacccacaatcctttatcttaacctgaacatttcctttctattgatcccaggcct

SEQ ID NO: 41071 - DNA, 201 bp, Homo sapiens
acattccggaagtggagggccgggccagcgtgattgacaagcgggaacccctgtgtggggacggggcaggcctaggaaggttgtgcctgcggtggaacggsgcggtgcgcaggagtgggcattaacagcagccgcgtgtctgggtcttagatttggcctagctgtgttgagcttttcatggattatgttacgtagataaga

SEQ ID NO: 41072 - DNA, 201 bp, Homo sapiens
agacggagtttcaccgtggtctcgatctcctgaccttgtgatacgaccgcctcggcctcccaaagtgctgggattacaggcgtgagccaccgtgcccggcyggagaagcttgatttaaaggacagaggaagatgtgtgtaagtcatatacaaatactgtaccattttatataaggaacttgagcatttacaagtttttggt

SEQ ID NO: 41073 - DNA, 201 bp, Homo sapiens
tgcaaaggtgggtggcccgtccggagcggaaaaacattccggaagtggagggccgggccagcgtgattgacaagcgggaacccctgtgtggggacggggcmggcctaggaaggttgtgcctgcggtggaacggcgcggtgcgcaggagtgggcattaacagcagccgcgtgtctgggtcttagatttggcctagctgtgtt

SEQ ID NO: 41074 - DNA, 201 bp, Homo sapiens
actgcaatctccgcctcccggtttcaagtgattctcctgcttcagcctactgagtagctgggattacaggtgtgcaccaccacacccagctaatttttgtrtttttagtagagacggggtttcaccatgttggccaggctggtctcaaattcctgacctcaggcaatctgcccaccttggcctcccaaagtgttgggatta

SEQ ID NO: 41075 - DNA, 201 bp, Homo sapiens
cttcgtggtgccactttcttcatatgaattaaagtgaaaattgccagggtcagtggcttacgcctgtaatcccagcactttgggaggctgaggcgggtggwtcaccggggtcgggagttcgagaccagcctgactaacatggtgaaaccccaactctactaaaaatacaaaattagccaggcatggtggcacatgcctgta

SEQ ID NO: 41076 - DNA, 201 bp, Homo sapiens
agattatagtattttatatctgcaaaacttattccaaaacaaatcagtaaatccaggttaaaatacccaggtcagacagtcacatttttactaataaaaawtaactagcagcccgggtgaggtggctcatgcctgtaatcccagcactttcggaggccgcggccggcggatcacgaggtcaggagatcgagaccatcctgg

SEQ ID NO: 41077 - DNA, 201 bp, Homo sapiens
gagagcagccgctggccagccggaagccaccatgcgctgtcctcaacagagcagctccaggctgtatgacccccaggcaattaggcaccaaaagaagatgytcacactttccaaaattctttcccagggctgggggaagggagccagacttggagcccctatgtggaacttagtctccaaggaaagaaagcatgttctcat

SEQ ID NO: 41078 - DNA, 201 bp, Homo sapiens
ttccaaagtaaaatacatcaaggaaacagtgcttaccattactcattgaaattgtctgttctattctatcctattgtattctagtacttttttttttttttaatgctggaatcaactccctaaattgatttcacaaaccacttctgggtcatagcccataggttgaaaacatggttgtctatcatgttacttgtctgtttc

SEQ ID NO: 41079 - DNA, 201 bp, Homo sapiens
ggtctgctccacatcagcatcattctggcagcttctgtgaagggacagcctcaatatggggcattgctggtctccaggcagagagaaaggagagatggcaacacaatgggccacacacaagttcttagaactttggctcagaagtggcacacacttcacttacactcacatttcattggccaaaggagatcagatgtccaa

SEQ ID NO: 41080 - DNA, 201 bp, Homo sapiens
ttagtctgcttgggctgccataacaaaatatcacagaccaggtggcccaaacaacagaaattgatttctcacagttctggagtctgagaggtctaagatcraggtctctgctgatttggttcctgctgagggccctcttcctgcttgtgacagccaccttcttgctgcatcctcacgtgacttttcctctgtgcttgcatg

SEQ ID NO: 41081 - DNA, 201 bp, Homo sapiens
ctaatgtgtgtgtttgcatcttagtttcgaacaaaaaaagtttaaaaaataaaaaaagcttatagattaaggatataaagaaaggaaatatttttgtatcmctgtacaatgtgtttgtgggttttttttttttttttttttgagacagagtcttgctctatcgcccaagctggagtacagaggcatgatctcggctcactg

SEQ ID NO: 41082 - DNA, 201 bp, Homo sapiens
gattgtgaaaaagtgaaggcaaagtcctattttaaaaaggagacatttgaagtgaggacccagctctgatttttttttttttgcccaaattcctgtctaaragatctggggagtcatgccctacaaactataaattctcatcagatgggttttatttaaccttatatatcgtgttttactttccaatctgactcaggcata

SEQ ID NO: 41083 - DNA, 201 bp, Homo sapiens
cctacaaactataaattctcatcagatgggttttatttaaccttatatatcgtgttttactttccaatctgactcaggcataacattacgtgacaaagaaraaaatcaaaatattttatcccaaaacatgtttctttgccatattttgaaatggccctgcaagccatcctttgtgggggaaattttgcatgtgtaaagaat

SEQ ID NO: 41084 - DNA, 201 bp, Homo sapiens
tttttttttttgcccaaattcctgtctaagagatctggggagtcatgccctacaaactataaattctcatcagatgggttttatttaaccttatatatcgkgttttactttccaatctgactcaggcataacattacgtgacaaagaagaaaatcaaaatattttatcccaaaacatgtttctttgccatattttgaaatg

SEQ ID NO: 41085 - DNA, 201 bp, Homo sapiens
ttctaaatccccactgaactctatcctccttcacctccttgcaagccctcctcaggtaattcctatattatataaaataaaatttttatgtctcaccatakgcttcctttctgactctgctgccaaaacacactataggaaccatcagagtttttgaaagataattgcctttgataacctaaaatagaacattgtaggaaa

SEQ ID NO: 41086 - DNA, 201 bp, Homo sapiens
caacaagagtgtcctctgattgtcctctctgctacactccgtccagtgccatgacagtttacaaatgccatggcaacgtcaggaagttaccctatgtggtmtaaaaaggggaaacatgaataatccaccccttgtttagcatatcatcaataaataactataaaaatgggcaaccagcagccctcggggctgttccgttca

SEQ ID NO: 41087 - DNA, 201 bp, Homo sapiens
tgtgccacaatggcagtcctgagtacacacagcagagattctaaagtccacagatttagacttgagttctcaacacagaaatcctaaagctcacagtagaracagggtttctacctgactcagagcctgagaaatttactatgacttagagcctgagaaatttactatgtgaacctttacatgctggggaaagcctgaggg

SEQ ID NO: 41088 - DNA, 201 bp, Homo sapiens
gtgctacaattgcctacagtatttagtatactaacacactgtacaggtttgtaacctaggagcaatttgctattccatatatagtaggctgtatcatctargtttgtgtaagcacactctataaggtttgcacgaggacaaaatcacctcacgcatttctccctgctgttaagcaatgtgtgacctgtatctgtcccacca

SEQ ID NO: 41089 - DNA, 201 bp, Homo sapiens
caggttttgccatttggctaggctggtcttgaactcctgacctcaagtgatctgcccacctctgcctctcaaaatgctgagattacaggtgtgagccaccrtacttggccccaataaacctttatcaaattatttgtgccccaacagccttaattttggtaaacatgtcctatacaggtgtaccattttttatcttttata

SEQ ID NO: 41090 - DNA, 201 bp, Homo sapiens
tatcagcagcagtggctgcagaacagcggatattggtgaaccgcagatgctgctgcctgatcgttcttctggaagttttgtctcagaggagtacctggccrtgtgaggtgtcagtccacccctactggggggtgcctcccagttaggctactcgggggtcagggacccacttgaggaggcagtctgcccgttctcagatct

SEQ ID NO: 41091 - DNA, 201 bp, Homo sapiens
tagcctcccgagtagttgtgattatacgctgtgccaccatgcccagctaatttttgtatttttagtagagacaggtttcgccatcttgcccaggctggtcycaaactcctgaccttgtgatctgcctgccccggcctcccaaagtgctggggttacaggtgtgagccaccgcgcctggccaatttttgtatttttaaaaga

SEQ ID NO: 41092 - DNA, 201 bp, Homo sapiens
tcagctgcaggtctgttggagtttgctggaggtccactccagaccctgtttgcctgggtatcagcagcagtggctgcagaacagcggatattggtgaaccrcagatgctgctgcctgatcgttcttctggaagttttgtctcagaggagtacctggccgtgtgaggtgtcagtccacccctactggggggtgcctcccagt

SEQ ID NO: 41093 - DNA, 201 bp, Homo sapiens
cttccaataaaccgttttttgttgttgttgttgttgtttggagacagattcttgctctgttcccagtctggagtgcagtggcacgatttcagctcacagcmacctctgcctcccaggctcaagtgatttctcgagcctcagcctcctgagtagctgggattatagacacgcaccaccacgcccagccaatttttttttttt

SEQ ID NO: 41094 - DNA, 201 bp, Homo sapiens
tcccatctttgtggttttatctacctttggactttgatgatggtgacgtacagatgggtttttggtgtggatgtcctttctgtttgctagttttccttctwacagacaggaccctcagctgcaggtctgttggagtttgctggaggtccactccagaccctgtttgcctgggtatcagcagcagtggctgcagaacagcgg

SEQ ID NO: 41095 - DNA, 201 bp, Homo sapiens
aacgtagccggacccggcttggttccgtgaacataagtacactctatgatgttcacaccatttggcttccaataaaccgttttttgttgttgttgttgttktttggagacagattcttgctctgttcccagtctggagtgcagtggcacgatttcagctcacagccacctctgcctcccaggctcaagtgatttctcgagc

SEQ ID NO: 41096 - DNA, 201 bp, Homo sapiens
tcgtcagtcattctttgtccagctttgttccgttgctggtgaggagctgcgttcctttggaggaggagaggcactctgatttttagagtttccagtttttstgctgtttttttcccatctttgtggttttatctacctttggactttgatgatggtgacgtacagatgggtttttggtgtggatgtcctttctgtttgcta

SEQ ID NO: 41097 - DNA, 201 bp, Homo sapiens
caataaattctcttctttcctagtttttctgcttcttgttattgggccttgagaaaacgtagccggacccggcttggttccgtgaacataagtacactctrtgatgttcacaccatttggcttccaataaaccgttttttgttgttgttgttgttgtttggagacagattcttgctctgttcccagtctggagtgcagtgg

SEQ ID NO: 41098 - DNA, 201 bp, Homo sapiens
cagagtgttttccaacttggttccattctccccgtcactttcaggtacaccaatcagatgtagatttggtcttttcacatagtcccatatttcttggaggytttgttcacttctttttattctttttgctctaaacttctcttctcgcttcacttcattcatttcgtcttccatcactgataccctttctgccagttgatc

SEQ ID NO: 41099 - DNA, 201 bp, Homo sapiens
tcctgaatttgaatgttggcctgccttgctagattggggaagttttcctatatcctgcagagtgttttccaacttggttccattctccccgtcactttcasgtacaccaatcagatgtagatttggtcttttcacatagtcccatatttcttggaggctttgttcacttctttttattctttttgctctaaacttctcttc

SEQ ID NO: 41100 - DNA, 201 bp, Homo sapiens
tataattgtgtggattgtcacctgtcatgaggattacagtttggtaaaagaaaaataaacccttttttcattttgagcctggaatgtatgttactatacayggtgcaataagggccttattagatctacaggaaaattctgtctccattctaagggagagtggcttgtgggaccttaggaaccctggctctactacccaac

SEQ ID NO: 41101 - DNA, 201 bp, Homo sapiens
tggctggatatgatattctgggttgaaaattcttttctttaagaatgttgaatattggcccccactctcttctggcttgtagaatttctgccaagagatcygctgttagtctgatgggcttccctttgtgggtaacccgacctttctctctggctgcccttaacattttttccttcatttcaactttggtgaatctgacaa

SEQ ID NO: 41102 - DNA, 201 bp, Homo sapiens
attagtagagataaaacagaagttttcagaacttgcaaggaaaattaaaatcaataaagatcttttgatggcagcaggttgtattaaaatgactaatactwcttatagtgaaccagctcagaattctaaattgtctctaaaacaaactgccaaaatccagtctggaccccagataactccagtaatgccagagaatgcaga

SEQ ID NO: 41103 - DNA, 201 bp, Homo sapiens
ctgtagatgtctattaggtccacttggtgcagagctgagttcaattcctgggtatccttgttaactttctgtgtcattgatctgtctaatgttgacagtgrggtgttaaagtctcccattattattgtgtgggagtctaagtcactttgtaggtcactaaggacttgctttatgaatctgggtgctcctgtattgggtgca

SEQ ID NO: 41104 - DNA, 201 bp, Homo sapiens
tctctatttcctccagttctgctctgatcttagttatttcttgccttctgctagcttttgaatgtgtttgctcttgcttttctagttcttttaattgtgaygttagggtgtcaattttagatctttcctgctttctcttgtggacatttagtgctataaatttccctgtacacactgctttgaatgtgtcccagagattct

SEQ ID NO: 41105 - DNA, 201 bp, Homo sapiens
ttattggtgtaaaagaatgcttgtgatttttgcacatcgattttgtatcctgagactttgctgaagttgcttatcagcttaaggagattttgggctgagaygatggggttttctagatagacaatcatgttgtctgcaaacagggacaatttgacttcctcttttcctaattgaataccctttatttccttctcctgcctg

SEQ ID NO: 41106 - DNA, 201 bp, Homo sapiens
gcaggctggatgtagcatgttagccgtcatattctgtgtgctccctgcgatgtgggcacttcccttccatcgtggtgaggccaaagcaaaggcacagagasctgaacacaaacatgaaaaacaccttaccacctgggagtcaggggcaggttcaggcacatccattcctctggcatttgagcagctgttttccacagcatt

SEQ ID NO: 41107 - DNA, 201 bp, Homo sapiens
gagccactgtgcccggtcaacaatcatcttttttttttttttttttttttttttaccaggtacacaatgatgggagagttgagtcctgctttctaacttaraaaacgcatgtgtgttcatcacctggtcactgagaaacagctctggaataggtgccatgcagaagaagagagggaactggaaagacccactgatctgtgg

SEQ ID NO: 41108 - DNA, 201 bp, Homo sapiens
ttttttttttttttttttttaccaggtacacaatgatgggagagttgagtcctgctttctaacttagaaaacgcatgtgtgttcatcacctggtcactgaraaacagctctggaataggtgccatgcagaagaagagagggaactggaaagacccactgatctgtgggtctcacagcctcccgttacacagaaattgcttc

SEQ ID NO: 41109 - DNA, 201 bp, Homo sapiens
tggtcactgagaaacagctctggaataggtgccatgcagaagaagagagggaactggaaagacccactgatctgtgggtctcacagcctcccgttacacaraaattgcttcttttctctcatgttgcgttcttcctcttgattctcgacccttctccactctttcatttactccactcttactttgctttcacctcctttt

SEQ ID NO: 41110 - DNA, 201 bp, Homo sapiens
cttggacaagatcttggccactgtattagtctgcttgggctgccataacaaaatatcacagaccaggtggcccaaacaacagaaattgatttctcacagtyctggagtctgagaggtctaagatcgaggtctctgctgatttggttcctgctgagggccctcttcctgcttgtgacagccaccttcttgctgcatcctcac

SEQ ID NO: 41111 - DNA, 201 bp, Homo sapiens
gggatgaaaaatgagacaggttttatcttgttttgttttatttttgcctctcattaggtatccacctacttttcaaaattgtgttattttaatctttattrcatacagacatattctcagtaaattgaggccaccatatggaagtgtaaggatgaagccaggcgcagtggctcatgcctgtaatcctagcactttgggagg

SEQ ID NO: 41112 - DNA, 201 bp, Homo sapiens
ccacctttctggacgaaaccaatctgtttctcaaatgtatgtgattgatgtctcatgccctccctaaaatgtataaacccaagctgcaccccaaccaacckccttgggcacatgttctcaggacctcctgaaggctgtgtcacagaccatggtcactcatatttggctcaaaataaatctcttagaatattttacagagtt

SEQ ID NO: 41113 - DNA, 201 bp, Homo sapiens
cagggaggtcaaggctgcaatgagccatgattccaccactgcgctccagcctaggatacagagtgagaccctgtctcaaaaaaaaaaaaaaaaaaaaaaaaggccatatgcagtggctcatgtctgtaatcccagcactttgggaggccaaggcaggtggatcgcttgaggtcaggagttcgagaccagcctggtcaacat

SEQ ID NO: 41114 - DNA, 201 bp, Homo sapiens
ctcccgttcttcccccttcctcctccttccttccttccttccctccctccctcccctttcctatcttctgagtagggtcaaacaccagttctctacttctyggaccataagaataaagatctgtgcacaatccattttgtacatattgattcttggactaaaaatagctcaatttggtttcaaactttttctcccacccta

SEQ ID NO: 41115 - DNA, 201 bp, Homo sapiens
tgtggaatgggtaaataagctaattaacatatgcattacttcacatatttgtgtgtgtgaggtgagaacacttaaaatctattttctttttcttttttaaragagacgtttattcagcctcacgatcagactattccatttagcaatcaacagcatgggtgcaaaaaaaaaaaaagtctacattaaaaccctttgttggaa

SEQ ID NO: 41116 - DNA, 201 bp, Homo sapiens
atgtttaagaaaatacaatatccatttatagataataactttacactgaatccaagcatatccttgaacatagagatttcattttattccaagtttccacwtctgtgattacacctatgatttttaaaaatcacagttgtaaaattcctaaactgttataattatctatcaaattctgtattgttataagcatgctcttag

SEQ ID NO: 41117 - DNA, 201 bp, Homo sapiens
gaattatctccagcctgctccctgtaactggttacagcaataaattctcttctttcctagtttttctgcttcttgttattgggccttgagaaaacgtagcyggacccggcttggttccgtgaacataagtacactctatgatgttcacaccatttggcttccaataaaccgttttttgttgttgttgttgttgtttggaga

SEQ ID NO: 41118 - DNA, 201 bp, Homo sapiens
tgagttggtcttgtggaattatctccagcctgctccctgtaactggttacagcaataaattctcttctttcctagtttttctgcttcttgttattgggccytgagaaaacgtagccggacccggcttggttccgtgaacataagtacactctatgatgttcacaccatttggcttccaataaaccgttttttgttgttgtt

SEQ ID NO: 41119 - DNA, 201 bp, Homo sapiens
gcactccagttacacagatttccacagagctgccttaacattgagcaaatagttaaacctagcaaaatcggcacccagacagcaaagctagaaatgaaacrtatggtcagtaggagccttgcgtgggcttctccctaacctggagcaaaccaaaataatacagtctttcattcctagtgcaggacccatctcgggtcaacg

SEQ ID NO: 41120 - DNA, 201 bp, Homo sapiens
gtttaaaaaataaaaaaagcttatagattaaggatataaagaaaggaaatatttttgtatcactgtacaatgtgtttgtgggttttttttttttttttttttgagacagagtcttgctctatcgcccaagctggagtacagaggcatgatctcggctcactgcaacctccacctcctgggttcaagcaattctcctgcctc

SEQ ID NO: 41121 - DNA, 201 bp, Homo sapiens
gactaatgtgtgtgtttgcatcttagtttcgaacaaaaaaagtttaaaaaataaaaaaagcttatagattaaggatataaagaaaggaaatatttttgtawcactgtacaatgtgtttgtgggttttttttttttttttttttgagacagagtcttgctctatcgcccaagctggagtacagaggcatgatctcggctcac

SEQ ID NO: 41122 - DNA, 201 bp, Homo sapiens
aaccttctagtgggacaagacgtagaggtggaagacagtgatattgatgatcctgagtataagtaggcctagactaatgtgtgtgtttgcatcttagtttygaacaaaaaaagtttaaaaaataaaaaaagcttatagattaaggatataaagaaaggaaatatttttgtatcactgtacaatgtgtttgtgggttttttt

SEQ ID NO: 41123 - DNA, 201 bp, Homo sapiens
tgtccctgaaccttctagtgggacaagacgtagaggtggaagacagtgatattgatgatcctgagtataagtaggcctagactaatgtgtgtgtttgcatyttagtttcgaacaaaaaaagtttaaaaaataaaaaaagcttatagattaaggatataaagaaaggaaatatttttgtatcactgtacaatgtgtttgtgg

SEQ ID NO: 41124 - DNA, 201 bp, Homo sapiens
tgtaaaagtgttcctatttctccacatcctctccagcacctgttgtttcctgactttttaatgattgccattccaactggtgtgagatggtatctcattgyggttttgatttgcatttctctgatggccagtgatgatgagcattttttcatgtgtttttttggctgcataaatgtcttcttttgagaagtgtctgttcat

SEQ ID NO: 41125 - DNA, 201 bp, Homo sapiens
tactttataatgataataaaagactatgttactggtttatgtacttactctattctttgttgttattttagagtatactcctacttatttaaaaaaaaaaagttaactgcaaaatagcctccggcaggtcctttaggaggtgttccagaaggcattgttatcatagtagatgacagctccatgcatgttattgtccctgaa

SEQ ID NO: 41126 - DNA, 201 bp, Homo sapiens
acaatggttgaactagtttacagtcccaagaacagtgtaaaagtgttcctatttctccacatcctctccagcacctgttgtttcctgactttttaatgatygccattccaactggtgtgagatggtatctcattgcggttttgatttgcatttctctgatggccagtgatgatgagcattttttcatgtgtttttttggct

SEQ ID NO: 41127 - DNA, 201 bp, Homo sapiens
atgttaatgtccaacaagccacaaatcgggagttacagtcatgcactgaataacaacattttgatcaatggcagactgtatatatgacagcagttctgtargcttataatggagctaaaacattcctattgcctagtgacactgtggctattctgacgtcatagcatactggattactggtgtgtttgtggtgatgctggt

SEQ ID NO: 41128 - DNA, 201 bp, Homo sapiens
ctttgctattgtgaatagtgccactataaacatacgtgtgcatgtgtctttatagcagcatgatttataatcctttgggtatatagccagtaatgggatgkctgggtcaaatggtatttctagttctagatccctgaggaattgccacactgacttccacaatggttgaactagtttacagtcccaagaacagtgtaaaag

SEQ ID NO: 41129 - DNA, 201 bp, Homo sapiens
ttccgaggctttcacacttgggctgaaccacactactgacatcccaaggtctccagctcgcagatggcctgtgatggaacttctcagcctccataattgtgagagccaatccctctaataaatcctttttcctatatctatatttatatctatatcatctatctgatctatatctatcatgtcccattgattctgtctctc

SEQ ID NO: 41130 - DNA, 201 bp, Homo sapiens
aggttggttccaagtctttgctattgtgaatagtgccactataaacatacgtgtgcatgtgtctttatagcagcatgatttataatcctttgggtatatasccagtaatgggatgtctgggtcaaatggtatttctagttctagatccctgaggaattgccacactgacttccacaatggttgaactagtttacagtccca

SEQ ID NO: 41131 - DNA, 201 bp, Homo sapiens
ttaggttggttccaagtctttgctattgtgaatagtgccactataaacatacgtgtgcatgtgtctttatagcagcatgatttataatcctttgggtatayagccagtaatgggatgtctgggtcaaatggtatttctagttctagatccctgaggaattgccacactgacttccacaatggttgaactagtttacagtcc

SEQ ID NO: 41132 - DNA, 201 bp, Homo sapiens
agcattaggtatatctcctaatgctatccctcccccctccccccaccccacaacagtccccagtgtgtgatgttccccttcctgtgtccatgtgttctcaytgttcaattcccacctatgagtgagaacatgtggtgtttggtttttggtccttgcaatagtttgctgagaatgatggtttccagtttcatccatgtccct

SEQ ID NO: 41133 - DNA, 201 bp, Homo sapiens
atgcctgtgattccagctactcaagaagctgaggcagtaggatagcttgagcccaggaggcagaggttgcagtgagccatgattgtgtcactgcattccarcctgggcaacagagtgagactctgtctcaaaaaataacagttaagagccactgccagtcacagtacacagtacttaggaacaactaaaattcatctcaat

SEQ ID NO: 41134 - DNA, 201 bp, Homo sapiens
gaactcatacaaaatcagtaaagctgcaggatacaaaatcaacctacaaaaatctagcatttctataggccaatagcaaacaatctaaaaaagaaatcaakaaagtaatcccatttacaataactacaaataaaattaaatacctaggaactaaccaaataagtgaaaagtccctacaatgaaaactaaaacactggagca

SEQ ID NO: 41135 - DNA, 201 bp, Homo sapiens
tacaataagaattttaaaaatgtgagggagaaaatcacgtttgtatagacaatttaaggaaagtaaatggagacaataaatatgggctggtttttccatgrgtgactggtgtagacagatagctgcttacccaatttcttaggtataatagtccagatgtttgttttcctccctccagcttgaataacctcactgccattg

SEQ ID NO: 41136 - DNA, 201 bp, Homo sapiens
aaaattgatgcaaaaatcctcaacaaaatactagcaaaccaaattcaacaacacattaaaaagatcattcatcatgactaaataggatttatcccagggaygcaaggatagttcaacatatgcaaatcaatcaatctgatatatcatcatatcaacaaaatgaagaacaaaaaccatatgatcatttcaatggatgcttaa

SEQ ID NO: 41137 - DNA, 201 bp, Homo sapiens
caaaaggtttttttttttttgaaaaaaaaaattgacaaactgctagacagactaagaaaaagagaagacacaactaagtaaaaccagagataaagaaggamacattcaactgataccacagaaattcaaaggatcattagtggctgctatgatcaactatatgccaataaatgagaaaatctagagaaaatggataaattc

SEQ ID NO: 41138 - DNA, 201 bp, Homo sapiens
ttggggtgcgtcttgaaagctttgggaaacccagcggtcttttgggggcaggtggcccaaaaagccttctgcgcgcccaggggacgaggaggatgcgcggrccgcgaccgcgatagttttgtttgcttttctcgggagaaagcgttccaggcagtttcctgagcttcggccctcgacgtagcaaaagagcccgggcgccca

SEQ ID NO: 41139 - DNA, 201 bp, Homo sapiens
tactgccaccgggacaaagccctgggaggagctcccgcccccgcgagccggacagggcggaggctcccccgccgcgcgcgccccaccgcttcccagtcccrgacccgtcgcctgcgcctcctcctggcgcgcctcacggtgcagcgggcggcggccccgcgcgccctgcgggaggcgcctcgggatgtttccgtctggtcc

SEQ ID NO: 41140 - DNA, 201 bp, Homo sapiens
ccccgccgcgcgcgccccaccgcttcccagtcccggacccgtcgcctgcgcctcctcctggcgcgcctcacggtgcagcgggcggcggccccgcgcgccckgcgggaggcgcctcgggatgtttccgtctggtccttccctccgccccccgcgctgactccatccgctccccgccccctgctcggagccgccgccacgcgg

SEQ ID NO: 41141 - DNA, 201 bp, Homo sapiens
accctaccttgtgctgctaaccaccgagactgccgttcgcacagcagaaaaggatagacacatcatacccaagtcaaaaaagcgtcatcaccatcaaagtyataggtcattgttccagggtcaagccctaccaagttaaagctaagaaaactttatctatcttttctttcctttaactactccccatcttattaatgtaac

SEQ ID NO: 41142 - DNA, 201 bp, Homo sapiens
cgaaaattttctcccattttgtaggttgcctgttcactctgatggtagtttcttttgctgtgcagaagctctttagtttaattagatcccatttgtcaatkttgtcttttgttgccattgcttttggtgttttatacatgaagtccttgcccatgcctatgtcctgaatggtaatggctaggttttcttctagggttttta

SEQ ID NO: 41143 - DNA, 201 bp, Homo sapiens
agttagttatttgtatttcctctgagttacatgtttatatcctttggctattcactctatcagggtttttttctttttttctttttttgtcttttttcttwtcaatatgtaggcactctttgaggcacatgccacctgcttatttgtcagtcatatgtgttgcaaatattttatattatttgttttcttaaaacattatgg

SEQ ID NO: 41144 - DNA, 201 bp, Homo sapiens
gtgagtggatcacttaaacccaagagtttgagaccatcctgggcaacatggcgaaactctgtctctacaaaaaatacaaaaattagcagggcatggtggcrtgtgcctgtagtcccagatactcgggaggttgaggctgcagtgagctgtgatcataccactgcactccagcctgggtgacagaacaagaccctgccccct

SEQ ID NO: 41145 - DNA, 201 bp, Homo sapiens
gattctgaaagcttctaactaaaagtatttttgctccctgtaatagaaaacttaaatgtatttatgttttgcattgagaaaaatgttttatataatgatcyatagttattcaatattattactgaattctataattttatacttaaaactggacttactacagaatgttgaaagcaaaatacaaaactattttttggtgag

SEQ ID NO: 41146 - DNA, 201 bp, Homo sapiens
caggccaagggtctacgggagttctctgtgtaattcttgcacttttaaaaattatttaaaactaaaaactaagcttacatagataatacaaaaaataacayaaacttatagaatataaattggaattcactcatttatagaacttcacttgatttatactattaatatagctatcaataataaacaagggcaacctctttt

SEQ ID NO: 41147 - DNA, 201 bp, Homo sapiens
ctgaaatggcataaactctgtgtgtgtgtgtgtgtgtgtgtgtgtatgtatgtgtgtgtgtgtaggggtggagagagtgagaaagagaaaacaagtacggygaaatgttcacaaactggtgaatcaggccaagggtctacgggagttctctgtgtaattcttgcacttttaaaaattatttaaaactaaaaactaagctta

SEQ ID NO: 41148 - DNA, 201 bp, Homo sapiens
gttccgaggctttcacacttgggctgaaccacactactgacatcccaaggtctccagctcgcagatggcctgtgatggaacttctcagcctccataattgtgagagccaatccctctaataaatcctttttcctatatctatatttatatctatatcatctatctgatctatatctatcatgtcccattgattctgtctct

SEQ ID NO: 41149 - DNA, 201 bp, Homo sapiens
cattgtttctgggtgtgtctgtgaggatgtttccagaggagactaccatatgagtctgagtggactaagtggggaagattcccctcaatgtgtgtgggcayggtccaacttgctgggggcccagagagaacaagaacagaaagggagaatgtgtccatctgtctgccagagctgggatgcacttttcttcttctgtcctcg

SEQ ID NO: 41150 - DNA, 201 bp, Homo sapiens
gccgagatcatgccactgaacttggggttgcagtgagccgagatcatgccactgaactccagcctgggcagcagagtaagactctgtctcaacaacaacarcaacaacaacaacaacaacaacaacaacaacagttatttacatcaagggtccccaaaccctgttaggaatggggccacacagcaggaggtgagtggtggg

SEQ ID NO: 41151 - DNA, 201 bp, Homo sapiens
tggcctcccaaagtgcagggattacaggcatgagccaccatgcctgcctgattatcactgctttccagaggtgcagggtctcagataaaggtcaacagtgytcagtggtcaggaggaagaaagacctatgtgtcactgagcagagactgtaacttcctgccttcagttattcccagttactcttagaagtggtttatttat

SEQ ID NO: 41152 - DNA, 201 bp, Homo sapiens
ctgccttggcctcccaaagtgcagggattacaggcatgagccaccatgcctgcctgattatcactgctttccagaggtgcagggtctcagataaaggtcawcagtgttcagtggtcaggaggaagaaagacctatgtgtcactgagcagagactgtaacttcctgccttcagttattcccagttactcttagaagtggttt

SEQ ID NO: 41153 - DNA, 201 bp, Homo sapiens
cgggaggctgaggcaggagaattgcttgaatctgggaggcagaggttgcagtgagccgagattgcgccactggactccagcctgggtgacagagtgagacyccatctcaaaaaaaaaaaaaatcacaaacattaaaaacataagatggtgatctatttcaagtactttgttaatttttttttttttttttttacctattct

SEQ ID NO: 41154 - DNA, 201 bp, Homo sapiens
aggcggatcacaaggtcaggagttcgagaccagcctggccaacatggtgaaaccccctctctactaaaaatacaaaaattagcagggagtggtggcaggcmcctgtaatcctagttactcgggaggctgaggcaggagaattgcttgaatctgggaggcagaggttgcagtgagccgagattgcgccactggactccagcc

SEQ ID NO: 41155 - DNA, 201 bp, Homo sapiens
aattgtaattgtatatggacccaacactggatccatataccagtgttggagcacccagatacataaagcaaatattgttacagctaaaaagagagacagaycccaatataataatagctggtaacttcaacatcccattttcagcgttggacagatcttccagagagaaaatcaatgaacatcagacttaatctgtaccaa

SEQ ID NO: 41156 - DNA, 201 bp, Homo sapiens
gagcttgggaggatgaggctgcagtgagccatgattgagccactgcactctgcactccagcctgggcaatagagcaagactgtcttaaaaaaaaaaaaaaagaggtatttctcttttaggggagaaggtttacctgggaggcattatgcagggtgagcagtaatctatctggaggacacacttgggtttggtgaaggtgac

SEQ ID NO: 41157 - DNA, 201 bp, Homo sapiens
actgaatgtaaatggactacattctccaataaaaagacagagtggctgaagggattaaaaaaacaaaaaacaaaaaaacaagactcagtgatctgttgccyacaagaagcacatttcacctacaaagacacacatagactgaaaataaaaggatggaaaaacacattccatgacaatggaaatcaaaaaagactaggagta

SEQ ID NO: 41158 - DNA, 201 bp, Homo sapiens
atggcaaaaccctgtctctactaaaaatataaaaattaactgtgtatggtggcgtgcacctgtaatcccagctacttgggaggctgaggtaggagaatcayttgagcccgggaggcagaggctgcaatgagccgagattgggtcactgcattccagcctgggagacagagtgagactcagtctcaataataataataataa

SEQ ID NO: 41159 - DNA, 201 bp, Homo sapiens
acaataagatataaataaaaacaacaaaaagttagaaagcagggggatgaagttaaggtgtagagtttttattagttttctttttgcttgtgtgtttatgmaaacagtgttaggctatcagtgtaaaataataggttataagatagtatttgcaagcatcatggtaacctctaatcaaaaaacatacaacagatacgctga

SEQ ID NO: 41160 - DNA, 201 bp, Homo sapiens
tgagaccagcctggccaacatggcaaaaccctgtctctactaaaaatataaaaattaactgtgtatggtggcgtgcacctgtaatcccagctacttgggargctgaggtaggagaatcacttgagcccgggaggcagaggctgcaatgagccgagattgggtcactgcattccagcctgggagacagagtgagactcagtc

SEQ ID NO: 41161 - DNA, 201 bp, Homo sapiens
gtgtgtaaattactcttattttaagtagactaaaagataaatcaaaaataactacaacaacttttcaagacacagacagtacaataagatataaataaaamcaacaaaaagttagaaagcagggggatgaagttaaggtgtagagtttttattagttttctttttgcttgtgtgtttatgcaaacagtgttaggctatcag

SEQ ID NO: 41162 - DNA, 201 bp, Homo sapiens
ttataatctccaatgttggaggtggggcctggtgggaggcgactggatcatgagggtggtccttgatgaatggtttagagccatcccctcggtactgttcctcctgatagtgagttatcgcaagatctggttgtttagaagtgtgtagcagctctccgcccctcttcctcctgcttctaatcatgtgagacgtcttgctcc

SEQ ID NO: 41163 - DNA, 201 bp, Homo sapiens
ttgaatctgtatccccaccaaatatcatgtcaaattataatctccaatgttggaggtggggcctggtgggaggcgactggatcatgagggtggtccttgaygaatggtttagagccatcccctcggtactgttcctcctgatagtgagttatcgcaagatctggttgtttagaagtgtgtagcagctctccgcccctcttc

SEQ ID NO: 41164 - DNA, 201 bp, Homo sapiens
tagtcccagctacttgggaggctgaggcaggaagatagcttgaacctgggaggtggaggttgcagtgagcgcagattgcaccactgcacccaagcctgggygacagagcaagactctgtctcaaaaaaaaaaaaaaaaaaaaaaaaaggcttttgtttgggcattgatatctgcatcacactgaggtaagaaagaagccac

SEQ ID NO: 41165 - DNA, 201 bp, Homo sapiens
aaccccatctctaccaaaaatacaaaaattggccagtctcataacccagtctcaaaataaataaataaataaaaatttaaaaataattttttttaaaaaaraaaacatcctttaaaaaatgcccaacacaaaatcacatcagtttttattaagaatctcttacatttttaaaacacagagtgataaaaactgctataattg

SEQ ID NO: 41166 - DNA, 201 bp, Homo sapiens
gcgggcggatcatgaggtcaggagttcgagaccagcctggccaacatggtgaaaccctgtctctactaaaaatacaaaaattagctaggcatggtggcccrcacctgtaatcccagctactcgggaggctgaggcaggagaactgcttgaacccgggaggtggaggttgcagtgagctgagatcatgccactacactctag

SEQ ID NO: 41167 - DNA, 201 bp, Homo sapiens
ggctggagtgcagtggcgtgatctcggctcactgcagcctccgcctcccaggttcaagcgatcatcccacccgaacctcccaagaaactgagattaccggmatgcaccaccacacctgcctggctaatttttgtatttttagtagagatgggggtttgccatgttggccaggctggtctcaaactcctggcctcaagtgat

SEQ ID NO: 41168 - DNA, 201 bp, Homo sapiens
cttaagtgtgagcgcaacccagcccgcctcctcctccacgcccctcacactcacgtgtcgtgggaaactggagtagccaaagctcagaatccccagtgaayacccttctggggatgggagacggggccagctaggggccggccgcagaccccggtcccagagctagtttcagaggccagcgttccccctagcgcctcgctg

SEQ ID NO: 41169 - DNA, 201 bp, Homo sapiens
tggggtcagttagtaactcaattcttgcaccttacctagtgaaataaagtttggtaaaactagaaactaacattttttgattagcacttacattgcacagyggacttctttgatgaacattatacattaaacatatctgggacattcagtgtttggaataggacatttattaaagataataacagagcagtcacaaaatta

SEQ ID NO: 41170 - DNA, 201 bp, Homo sapiens
aattgggtgtagttcttcactgctttgtctcccttaaggttgttacaagagaagtaacagtttacttcctggttgcttatttattccttagacttatttakgaagggctggggtcagttagtaactcaattcttgcaccttacctagtgaaataaagtttggtaaaactagaaactaacattttttgattagcacttacat

SEQ ID NO: 41171 - DNA, 201 bp, Homo sapiens
taatttttaaaacatttttgtagaggcagggtttcgccacactgcccatggtcttgaacccctgggctcaagtgatctgcccgcctcagcctcccaaagtrctggaattacaggcatgagccaccttgcctagacttagttaagattttagtaagagtacatcaacatcaatccagtaagctttgagtttttaagagattc

SEQ ID NO: 41172 - DNA, 201 bp, Homo sapiens
tcccatcccctagtgatctcttccctttggttctggtgcaggaagtatcccttagttatgaatattttggtagtgactctcaattaaggatgtaatgatarcgattccatgtgggccatggcttggctactacagggtgcacaatttcatttacttattgaaagataagaaaaggagaactacagtcgggtcttaaattct

SEQ ID NO: 41173 - DNA, 201 bp, Homo sapiens
ccttgcctagacttagttaagattttagtaagagtacatcaacatcaatccagtaagctttgagtttttaagagattcacaatatctttcctcttgattayatcaaaattaaagagccatgttatatttacctaacactaaatatagtttctctttttaatttattatttatttatttttttaaaggccagtcaagtgaag

SEQ ID NO: 41174 - DNA, 201 bp, Homo sapiens
cctgagctgcacgtctattggagtttgctggaggtccactccagaccctgtttgcctgggtatcatcagcagaggctgcagaacagcaaatattgctgtcygatccttcctctggaagcttcatctcagaggggcacctggctgtttgaggtgtcagtcagcccctactgggagggtctccaagtcaggctacacgggggt

SEQ ID NO: 41175 - DNA, 201 bp, Homo sapiens
tcacaagatattttaaaattttatttttccttattaagcgaattgaattatttcaagcatcagtgagagctgctagactgttatatttcgggggtcttgcrgggtagcttttcttacacatataagcagaagaaaacattttcccaagtcttaaaagagggttatgatgcatttcattgtgtactctttttcttcccatat

SEQ ID NO: 41176 - DNA, 201 bp, Homo sapiens
ttttttaaaggccagtcaagtgaagcagtgggagtggagaaggaacaaagaaatctgtaactgattgtaatgaattagttatcaacaccactgcactcggwcctgcctaaatacacttgcaattactaaaatttattcactgaaaaccaaaatttcacaacacagttattctgtttcaatctcaactgagtgtactgcaat

SEQ ID NO: 41177 - DNA, 201 bp, Homo sapiens
ttagcatcgtgaattggggtccggagttgtttgtatttttctttcacaatagactgatgtatgtaacctagtctcaaatgattcagaaaaaactgaaatgscataaactctgtgtgtgtgtgtgtgtgtgtgtgtgtatgtatgtgtgtgtgtgtaggggtggagagagtgagaaagagaaaacaagtacggtgaaatgtt

SEQ ID NO: 41178 - DNA, 201 bp, Homo sapiens
cctcgtggatagaaaacaaactgataatagagactatatcttctcaacacatgagatatattcgcaaaaactcattatatatttgggcacaaaaatatacyggtggaaatattgctggccatgaagatatagaacttgaaatttaaaagaaaactctaaaataaattcctttttatatgaaaattataaagtactccagta

SEQ ID NO: 41179 - DNA, 201 bp, Homo sapiens
tagagtgaatagactttattctcctttagaagacaaagatatgcatatttaaaacaaaacataatgctgtacttcatacaaaaaacaagtgaagtgcatayttcaaaaggtgaaatccaaaggaaaagtaaaggaaaataataagaatgcaaaggctgcaatcctcctgttatcggaaatcgtagaagtaaggccaaaaga

SEQ ID NO: 41180 - DNA, 201 bp, Homo sapiens
ctgggagatagagcaagactccatctctaaaaaaaaaaaaaaatgctaatgtgagaatataaattgtgggaaatgagtgagggcaaggtggtacttcctcyttctgagctcttcacacgtaatgcaaaaacccggtcttaactgattttgttttttttctgagtatgcatatatgtggttgaatgaaccaatgtgtgattg

SEQ ID NO: 41181 - DNA, 201 bp, Homo sapiens
tgaaattcatcaagccaccagttatcagaacaattgttactctctttgtatttgacctaatggaagaataaataagctgttttatatataatatatatatrattgcaaaaatatataaaaatatgcatattatatatgtttgtatatatatacataaagcaatataataaagccatataagaaggctgctttcttaaatat

SEQ ID NO: 41182 - DNA, 201 bp, Homo sapiens
aaaaaataaacatttagctggggccgggcacggtggctcatgcctgtaatcccagcactttgggaggccaatgcaggcagatcacctgaggtcaggagttygagaccagcctggccaacatggcaaaaccctgtctctactaaaaatataaaaattaactgtgtatggtggcgtgcacctgtaatcccagctacttgggag

SEQ ID NO: 41183 - DNA, 201 bp, Homo sapiens
ggcagacagtttgcttgagcccaggagttcaagaccagcctgggcaacatagcaaaatcctatctctacaaaaaataaacatttagctggggccgggcacrgtggctcatgcctgtaatcccagcactttgggaggccaatgcaggcagatcacctgaggtcaggagtttgagaccagcctggccaacatggcaaaaccct

SEQ ID NO: 41184 - DNA, 201 bp, Homo sapiens
taagctgttgtccttaacatttcttttaggtagcacagtatacaagcttacattaaaatattcacggccaggtgcggtggctcacacctgtaatcccagcmctttgggaggccgaggcaggcggatcacaaggtcaggagttcgagaccagcctggccaacatggtgaaaccccctctctactaaaaatacaaaaattagc

SEQ ID NO: 41185 - DNA, 201 bp, Homo sapiens
ggctggggttggacctcacaatctaagctaactcgattggctaaggtttaaaattgaatagggtctattaggtggagagtccgttactaggtgggaaaagwgtctgttactaggcgggaaggcatatctggacttgtctgggcatggcaaaggcaggaaggttgtttacagaacaggtagctaggagacaaggaagtacaa

SEQ ID NO: 41186 - DNA, 201 bp, Homo sapiens
cctcctgggctcaagcgattctcttacctcagcctccagagtagctgggactacaagctcaggccaccacacccaactaattatttttatttttatttttrttttttgagacagagtctcactctgtcacccaggctggagtgcagtggcaacctcctcctcctgggttcaagcaattctcctgcctcagcctcctgagta

SEQ ID NO: 41187 - DNA, 201 bp, Homo sapiens
cacctcagccttctgagtagctggactacacacgtgctccaccacacccagctaatttttgttcttttttttttgagacagagtctcgccctgtcacccasgctggagtgcagtggtgcaatctcagctcactgcaacctctgcctcctgggctcaagcgattctcttacctcagcctccagagtagctgggactacaagc

SEQ ID NO: 41188 - DNA, 201 bp, Homo sapiens
ccaggctccagtgatcctcccacctcagccttctgagtagctggactacacacgtgctccaccacacccagctaatttttgttcttttttttttgagacasagtctcgccctgtcacccaggctggagtgcagtggtgcaatctcagctcactgcaacctctgcctcctgggctcaagcgattctcttacctcagcctcca

SEQ ID NO: 41189 - DNA, 201 bp, Homo sapiens
gcagtggcacgatctagctcactgcaacctctgcctcctgggctcaagccatcctccccagttcaggctcccaagtagttgggactacaggcacacaccaycatgcccggctaattttgtattttttgtcgagatgaggtttcaccacgttaccccggctggtctcgttacttgtgagctcaagcgacacacctgccctgg

SEQ ID NO: 41190 - DNA, 201 bp, Homo sapiens
tgacctcccaggctccagtgatcctcccacctcagccttctgagtagctggactacacacgtgctccaccacacccagctaatttttgttcttttttttttgagacagagtctcgccctgtcacccaggctggagtgcagtggtgcaatctcagctcactgcaacctctgcctcctgggctcaagcgattctcttacctca

SEQ ID NO: 41191 - DNA, 201 bp, Homo sapiens
cacagaggttcacacctgtaatcccagcactttgggaggctagggcaggtggattgcttgaacccaggagtttgagaccagcctgggcaacatggtaaagycccatctctagaaaaaaaaatataaaaattagctgggcatggtggcatgcacctgtagtcccaactacttgggagactagggtggaaggatcgcttgaac

SEQ ID NO: 41192 - DNA, 201 bp, Homo sapiens
tgcagctttgacctcccaggctccagtgatcctcccacctcagccttctgagtagctggactacacacgtgctccaccacacccagctaatttttgttctyttttttttgagacagagtctcgccctgtcacccaggctggagtgcagtggtgcaatctcagctcactgcaacctctgcctcctgggctcaagcgattctc

SEQ ID NO: 41193 - DNA, 201 bp, Homo sapiens
actcatttcttcctaacacatgggaacaaaaccaggtgacttgtacaaaatgaaactatttaagtattcatctataaactgctttcctttttccttttttwttttttttaacaaattctaaatacttacgtagataaggcttcctctgcccctaagcaaactttctgcacaataactgcacctagcttggtgagacagatg

SEQ ID NO: 41194 - DNA, 201 bp, Homo sapiens
cgtgatcatggcttactgcagctttgacctcccaggctccagtgatcctcccacctcagccttctgagtagctggactacacacgtgctccaccacacccrgctaatttttgttcttttttttttgagacagagtctcgccctgtcacccaggctggagtgcagtggtgcaatctcagctcactgcaacctctgcctcctg

SEQ ID NO: 41195 - DNA, 201 bp, Homo sapiens
ttttttttaattagcttttttttttttttttaaatcagctgagcatggtggtgttcacctgtagcaccagttgcttgggaggctgaggttgggaggatcayctgagcccaccactgcactccagcctgggcaacagaatgagactgtctctgaaaaaaaaaaaaaaaggccaggcgctgtggctcacacctgtaatcccag

SEQ ID NO: 41196 - DNA, 201 bp, Homo sapiens
acggggtctccctatgttgcccaggctgggctatattattaacacagtaaatcagctattttcttttcttttttttttgagatggagtttcgctcttgttstctaggctggagtgcaatggcacgatctcagctcaccgcaacctccacctcccaggtccaagccattctcccgcctcagtctcccgagtagctgggatta

SEQ ID NO: 41197 - DNA, 201 bp, Homo sapiens
acgacactgcactccagcctgggcaacagaatgagacgccatctcaaaaaaaaaaaaaaaagcccctgtctctactaaaaatcaaaaaaattagctgggtrtggtggcaggtgcctgtaattctagcgacttgggaggctgaggcagaaggattgcttgagcctgggaagttgaggctgcagggagtgatgattgtaccac

SEQ ID NO: 41198 - DNA, 201 bp, Homo sapiens
gcttgaacccgggagacagaggttgcagtgagctgagatcacgacactgcactccagcctgggcaacagaatgagacgccatctcaaaaaaaaaaaaaaaagcccctgtctctactaaaaatcaaaaaaattagctgggtgtggtggcaggtgcctgtaattctagcgacttgggaggctgaggcagaaggattgcttgag

SEQ ID NO: 41199 - DNA, 201 bp, Homo sapiens
tgttctttatatagcaggattgtaagtgattatcattttcctctttgtactttggccactatgagcataaatcactttttttttttttttgagacagtttygctcttattgcccaggctagagtgcaatggcacgatcttggctcaccgcaacctctcgtctcccaggctcaagcgattctcctgcctcagcctccaagta

SEQ ID NO: 41200 - DNA, 201 bp, Homo sapiens
tctttcttcttcgcaacgtagaaaagcatatcgcttataaagcttcctaggaaagggtaagacaagcacaagacagtagtatcaaagaaaaaaaaaaaaaaccaagacagtagtatcatgtacttttcattatgtcttttttttttttttttttttttaaacagagtttctctcttgttgcccaggctggagtgcaatggt

SEQ ID NO: 41201 - DNA, 201 bp, Homo sapiens
ccaggaggtggaggctgcggtgagctgagatcgtgccactgcactccagcctgggtgatggagtgagactctatcaaaaaaaaaaaaaaaaaaaaaaaaaattctccaatcagcatttccttccaaagttgaatgatgtccaattgcataagtttattattaacacacagatactttgattttatgtgttttcgttaagat

SEQ ID NO: 41202 - DNA, 201 bp, Homo sapiens
aatgggcaagagggaaaggaagaattctttgtgaacttttgctttcagcaaacttattcttattgctgtcaaccttctttaacccgcattatctggttttscttttcagtactccatggtggaactacaggtaagcggaagtttctttctcttctctgtcagttgtggaagaggaagaatgagaatttggtggtacacctt

SEQ ID NO: 41203 - DNA, 201 bp, Homo sapiens
aatctgattcagggaggcagaggttgcagtgagctgagactgcaccactgcactccatctgggtgacaaagtgagactccgtctcaaaaaaaaaaaaaaawtaagatttgtgacactgggtgcagtggctcacgcctgtaatcccaacactttgggaggctgaagcaggagaatcactttggaccagcctgggcaacatat

SEQ ID NO: 41204 - DNA, 201 bp, Homo sapiens
tggggctgtggtgctttccaggtgtgtgaagttaaaacattttagggccatacggtaggtagcacctgccacatagttgtcttggtcagccccggctgccrtgacaaaataccataaactgggtggcttagacacagaaatgtgttttctcacagtcccagaggcttgggatgtccaggatcaatgtggggaggacacaac

SEQ ID NO: 41205 - DNA, 201 bp, Homo sapiens
aagacctttttctctacaaaaaaaaaaatttttttttaattaggcatggtggtgcacacctgcagtcctagctactcaagggactgaagtgaaaggattayttgagcacagaagttcaaggctgcagtcagctctgatagtgccactgtactgcagcctgggcaacagagtgagaccctgtctctaaaaagaaaacagaac

SEQ ID NO: 41206 - DNA, 201 bp, Homo sapiens
ggaaggatcacatgagcccataagttcaaggctgcagggagctatgattgtgccactgcacttcagcttgggtgacagagtgagaccccatctctaaatayatacacatacattttttaaaattgcgattataattatactgaaattatgtttaaattatcattattattattattgtaacagtattggattctttcacag

SEQ ID NO: 41207 - DNA, 201 bp, Homo sapiens
tggatattgctttccaaatttgaaaatacggtaattaattacttgcatgttgaaatatacataaaggacttgcccacacataagattccacctgtaattayggctttgaggagaggagggcatgaagggctgcatagtcttagtattaaataattcattacgctaaaggagaatgcacgtaaagtcaagtggcaggagatg

SEQ ID NO: 41208 - DNA, 201 bp, Homo sapiens
atggcattagatgcaagacaacctcctagggattgatgcctaactgatggattctctttgagactatttagatattatgtgagcaatttaaagaccagatytaagcaaattttgaaatagatgtttgttttttgtatttctcagtatggaaactaatgctgccactctcatccccgtcccaaccatctctgtcaaaaatat

SEQ ID NO: 41209 - DNA, 201 bp, Homo sapiens
tgggaggtagggtggaacaggcattggatgttactatatgtggaaagtgaggaagacagtggagctgagaatcttctcaggctggataggaggtggttctrtttacaaaggaaggtattatggggcagagcagttttagagggtgaaattgatgctcaagttacatgagtttctgttgtttttgacacagggtttctctct

SEQ ID NO: 41210 - DNA, 201 bp, Homo sapiens
aagcggactatgagtagttagcaccctgtatcacacccagctctatgccctaattctgtattggctgtttgctgcctttgtcttgagacttaaggtgaaarccatcttagctgaggtgaagggcagtgaaaagtatagcacagtactgaatgagaagtgcatagaaatatgaactgataaaagaaacaatctctccataac

SEQ ID NO: 41211 - DNA, 201 bp, Homo sapiens
ttggttttcaacctctcccttagagcctgctccaagttttcctcagtgaggccttttgctggattggtctgaggaacaattctggctggaggtgggaagayggatcacctctaaacttctcaaggtaaggggcttcaaaggaatgcaaaaaaagagagagaggaaaaaggaaagccaaattatgatacttggggaatagat

SEQ ID NO: 41212 - DNA, 201 bp, Homo sapiens
aaaacttgattcaaatattttaggaaataacactacacaaacaaataattcaaaaaatgttagacttgaattatctttaagagcctgagcagtccctctcyctctctcattgtttacattaggagaacacagatgctcagctaacatggtttgcctaaggtgagaattaaagacagagctgaggcttgaattaagagtctc

SEQ ID NO: 41213 - DNA, 201 bp, Homo sapiens
gtttatctttttattgttgaattgtaagagttctttacatattttggatctttgatctttatcagatatataatttgcaaatatttactcctgttctgtgrgttgtctcttcatgcatgatagcgtcctgagacacatagaagtttttagttttaataaaatacaatttaaaacattttttggttcattgtgcttctgatg

SEQ ID NO: 41214 - DNA, 201 bp, Homo sapiens
ccccagttcaggctcccaagtagttgggactacaggcacacaccatcatgcccggctaattttgtattttttgtcgagatgaggtttcaccacgttacccyggctggtctcgttacttgtgagctcaagcgacacacctgccctggcctcaccctgggactacaggtgagcgactgcacacggccttttttaacctttaac

SEQ ID NO: 41215 - DNA, 201 bp, Homo sapiens
gtatgatagagctgaggcctaacacatacatcatatcaatagagtgaatagactttattctcctttagaagacaaagatatgcatatttaaaacaaaacayaatgctgtacttcatacaaaaaacaagtgaagtgcatacttcaaaaggtgaaatccaaaggaaaagtaaaggaaaataataagaatgcaaaggctgcaat

SEQ ID NO: 41216 - DNA, 201 bp, Homo sapiens
tcataagaaaaatagtatgatagagctgaggcctaacacatacatcatatcaatagagtgaatagactttattctcctttagaagacaaagatatgcatakttaaaacaaaacataatgctgtacttcatacaaaaaacaagtgaagtgcatacttcaaaaggtgaaatccaaaggaaaagtaaaggaaaataataagaat

SEQ ID NO: 41217 - DNA, 201 bp, Homo sapiens
atccaaaatatataaggaattcacataaaggatttcacataactcattagcaagaaaacataaagcccaatttaaaaacggacaaaggacttgaatggacrtttttccaaagaagacatacaaatggctgacagacatgtgaaaagttgcccaagattactaatcatgagagaaatgcaagtcaaaaccaccatgagctat

SEQ ID NO: 41218 - DNA, 201 bp, Homo sapiens
aaaagacagcctaaagaatgggacaaaatatttgcaagccatatgtttgataaggagttaatatccaaaatatataaggaattcacataaaggatttcacrtaactcattagcaagaaaacataaagcccaatttaaaaacggacaaaggacttgaatggacatttttccaaagaagacatacaaatggctgacagacatg

SEQ ID NO: 41219 - DNA, 201 bp, Homo sapiens
tatgaaaatgtcagagaattctatacttatgtgatatcctgaggactctagcagagaatgcactttttaaaaatttttatttatttattcctgagacaggktctcattctcttgcccaggctgaagctcagtggtatgataatggctcacagcagcctcgatctcccaggctcaagcaatcttcccgtcccagcctcctgg

SEQ ID NO: 41220 - DNA, 201 bp, Homo sapiens
gggtcactgggacagaatagaaagactagaaataaacccaaacatatatggtcatctaatctttgacaagggtgccaagaatacacaatggggaaaagatmatctcttcaataaatagtgttggaaaaactggatatctatatgcaaaagattgaaattggacccttgatttacaacatatacaacaattcaagtgaattg

SEQ ID NO: 41221 - DNA, 201 bp, Homo sapiens
acttgattatgtggccaaagggacagaaaacccagctggaaacttctgctttaccgctgtgcgtgcgcgcacatgtgtgtgtgtgtgtgtgtgtgtgtgtkttttctcttttccccctacactacacagaagtaagttagcctctcctgaagccaagtttccttgcacttgataggtcaatctggtgatgaagtcgcatcc

SEQ ID NO: 41222 - DNA, 201 bp, Homo sapiens
gcaacatacagattcaatgcgatgcctatcaaaattttaatggcatttttcacagatatcagaaaaacaatcctaatatttgtatggaatcgcaaaagacyccaagtaaccaaagcaatcttgagaaagaaggacaaagctggaggaaccacttcctggtttcaaactacttcctggtttcaaactacattacaaagctct

SEQ ID NO: 41223 - DNA, 201 bp, Homo sapiens
tcacccaggcttgagggcagtggcgtgatcatggcttactgcagctttgacctcccaggctccagtgatcctcccacctcagccttctgagtagctggackacacacgtgctccaccacacccagctaatttttgttcttttttttttgagacagagtctcgccctgtcacccaggctggagtgcagtggtgcaatctcag

SEQ ID NO: 41224 - DNA, 201 bp, Homo sapiens
gcttgagcccaggagttcaaagttacagtaagctataatggtgccactgcactccaatctgggcaacagagtgaaaacttgtctctctaaaaaaataaaawaaaaaaaagatgagtattgaggtaatgggtatgttaattagcttgatttaataatttcacattgtttacatatattacaacatcactccgtaccccataa

SEQ ID NO: 41225 - DNA, 201 bp, Homo sapiens
tgccaaggcaggcagatcacttgaggccaggagttcaaggccagcctaggcaacatagtgaaaccctgtctctatagaaaattaaaaaaattagacagacrtgatggtgtgtgcctgtagtcttagctactcaggaggctgaggtgggaggatggcttgagcccaggagttcaaagttacagtaagctataatggtgccac

SEQ ID NO: 41226 - DNA, 201 bp, Homo sapiens
ggatgccaaggcaggcagatcacttgaggccaggagttcaaggccagcctaggcaacatagtgaaaccctgtctctatagaaaattaaaaaaattagacasacatgatggtgtgtgcctgtagtcttagctactcaggaggctgaggtgggaggatggcttgagcccaggagttcaaagttacagtaagctataatggtgc

SEQ ID NO: 41227 - DNA, 201 bp, Homo sapiens
actttgggaggccaaggcaggcagatcacttaaggccaagagtctgagaccagcccagccaacatggggaaacccgtctctactaaaaaaaaaaaaaaaaattagcagggtatggtggcgcatgcctgtaatcccagctagttgggaggctgaggcacgagaatcgcttaatcctgggaggcagaggttgcagtgagccaa

SEQ ID NO: 41228 - DNA, 201 bp, Homo sapiens
tttgggatgccaaggcaggcagatcacttgaggccaggagttcaaggccagcctaggcaacatagtgaaaccctgtctctatagaaaattaaaaaaattasacagacatgatggtgtgtgcctgtagtcttagctactcaggaggctgaggtgggaggatggcttgagcccaggagttcaaagttacagtaagctataatg

SEQ ID NO: 41229 - DNA, 201 bp, Homo sapiens
aatgttggtcaatgggtacaacatttcagttagacaggaggaatatttttttgagatctattgcacagtatgagaactatagttaataataatgtactgtrtattccaaaaatgctaagtgaatacatttcaaatgctcttcctaccaaaaaaatgatgagtattggctgggcatggtggctcacacctgttatcccagag

SEQ ID NO: 41230 - DNA, 201 bp, Homo sapiens
tgagggaggcccctgacctccctcttcttagagcatttgctttagaaaacttgtaaattttctctctgatacttcgagatgccaattttttttttttttttggtcattttacttttagtcgatgcataatctttaaaaaagctttgtcagttttacaacccaggaaagtctttctccaagacctgggaactatttctttga

SEQ ID NO: 41231 - DNA, 201 bp, Homo sapiens
ccaaaaacaataacaacaacaaaaacaacaaaatctccaggtccagcgtggtggctcatgcctgtaatcccagcactttgggaggctgaggcaggtgggtyacttgaggtcaggagttcgagaccagcctggccaacatggtgaaaccccatctctactaaaaatacaaaaattagccgggtgtggtggggcgtgcctgta

SEQ ID NO: 41232 - DNA, 201 bp, Homo sapiens
ctaaatataattcttataaaacaaaacatctggtcagttgtgaaatgtttaaaacattgcttcttgatcaccaaataattaatatggtgaataacagatakgggcttttgtgcagtagaagattcaagaccaagacaagctcatgtttccctttaggcgggcttcctcctgagggaggcccctgacctccctcttcttaga

SEQ ID NO: 41233 - DNA, 201 bp, Homo sapiens
ctcatgtgatccacccgccttggcctcccaaggtgctggcattacaggtgtgagccactgtgcctggcctcttcgatttaattaaattaattaattaattwatttatttatttattttgagacggagtctcgctctgtcgcccaggctggagtgcagtggcgcaatctcggctgactgcaacctccgcctcccgggttcaa

SEQ ID NO: 41234 - DNA, 201 bp, Homo sapiens
agtaattataatgctataagagaggcaagcctgagtcctgggattacccctttacctctatttaggtttatctattccattccagtaatagttactcaccrctattttaaaaaagaaaagaggctttttgacatcagctgttgctattctatatgttatcttctttctgtaagggaaggtacccttatcaccattctggat

SEQ ID NO: 41235 - DNA, 201 bp, Homo sapiens
cccaaaccctcaatcaatttcttaaaaggttaactaaagcatggtaaggtacctaaatataattcttataaaacaaaacatctggtcagttgtgaaatgtktaaaacattgcttcttgatcaccaaataattaatatggtgaataacagataggggcttttgtgcagtagaagattcaagaccaagacaagctcatgtttc

SEQ ID NO: 41236 - DNA, 201 bp, Homo sapiens
tgacctcatgtgatccacccgccttggcctcccaaggtgctggcattacaggtgtgagccactgtgcctggcctcttcgatttaattaaattaattaattwatttatttatttatttattttgagacggagtctcgctctgtcgcccaggctggagtgcagtggcgcaatctcggctgactgcaacctccgcctcccgggt

SEQ ID NO: 41237 - DNA, 201 bp, Homo sapiens
agccttctgagtagctgggattataggcatgtgccaccacgcccagctaattttgtatttttagtagagacagggtttctccatgctggtctcgaactccygacctcaggtgatctgcccacctaagcctcccaaagtgctgggattacaggcgtgagtcaccgcgcctggctgttttcttttcttttctttgtttagaga

SEQ ID NO: 41238 - DNA, 201 bp, Homo sapiens
aacctgtcacccaggctggagggcagtggtgtgatcttggctcactgcaacctctgcctcccgggttcaagtgattctcccacatcagcctcctgagtagstgggactaaagcaagcgccaccacgtccggctaatttttgtattttttggtagagatgaggtttcaccatgttggccacgtcagtctcgaactcctgacc

SEQ ID NO: 41239 - DNA, 201 bp, Homo sapiens
gcaatctcagctcactgcaacctctgccgcccgggttcaagtgattctcctgccttagcctcccaagtagttgggattacgggggcttgccaccgtgcccrgctaatttttgtacttttagcagagacggggttttatcatcttggccaggctggtcttgaactcctgaccacgtgattcacccaccaaggcctcccaaag

SEQ ID NO: 41240 - DNA, 201 bp, Homo sapiens
gcctgccttggcctcccaaagtgttaagactaccggcatgagccacctgccatgtatgtatgtatgtatgtatgtatgtatgtatgtatgtatgtatgtatttttgaggcagagtttcactctatctcccaggctggagtgcagtggtgcaatctcagctcactgcaacctctgccgcccgggttcaagtgattctcctgc

SEQ ID NO: 41241 - DNA, 201 bp, Homo sapiens
tgcctgccttggcctcccaaagtgttaagactaccggcatgagccacctgccatgtatgtatgtatgtatgtatgtatgtatgtatgtatgtatgtatgtatttttgaggcagagtttcactctatctcccaggctggagtgcagtggtgcaatctcagctcactgcaacctctgccgcccgggttcaagtgattctcctg

SEQ ID NO: 41242 - DNA, 201 bp, Homo sapiens
ctgcctgccttggcctcccaaagtgttaagactaccggcatgagccacctgccatgtatgtatgtatgtatgtatgtatgtatgtatgtatgtatgtatgtatttttgaggcagagtttcactctatctcccaggctggagtgcagtggtgcaatctcagctcactgcaacctctgccgcccgggttcaagtgattctcct

SEQ ID NO: 41243 - DNA, 201 bp, Homo sapiens
tctgcctgccttggcctcccaaagtgttaagactaccggcatgagccacctgccatgtatgtatgtatgtatgtatgtatgtatgtatgtatgtatgtatgtatttttgaggcagagtttcactctatctcccaggctggagtgcagtggtgcaatctcagctcactgcaacctctgccgcccgggttcaagtgattctcc

SEQ ID NO: 41244 - DNA, 201 bp, Homo sapiens
atctgcctgccttggcctcccaaagtgttaagactaccggcatgagccacctgccatgtatgtatgtatgtatgtatgtatgtatgtatgtatgtatgtadgtatttttgaggcagagtttcactctatctcccaggctggagtgcagtggtgcaatctcagctcactgcaacctctgccgcccgggttcaagtgattctc

SEQ ID NO: 41245 - DNA, 201 bp, Homo sapiens
tttttaaaaaattctattaatactttaagggcaagtttaaatgtgatcttctccctatttctcacctcacccagttaacattaataatttcctctgtgctrtcaaaccagttgttattacagtctgttagttatatattacctatattagaacccaggctagtaaaaaacttactcaaatttctttacatcccccttcaca

SEQ ID NO: 41246 - DNA, 201 bp, Homo sapiens
aactaaatgcaatgtggtatcctggattggacagtggaacagaaaaagggtattagtggaaaaattcacgaaatccaaatgaagcctggagtttagttaayagtattattccaatgttaatttcttagttttgatgaatgtaccatggttatgtgaaacgttaacatttggagaaactgggtgaagggtaaacaggaattc

SEQ ID NO: 41247 - DNA, 201 bp, Homo sapiens
aggcagacatgaaggaggtgagacagtgagccaaaagatccttggggggaagagctttccaggcaaccagaacagctaaagcaaagatcataagacaggarcatgctcagattgtctggaaaagagcaagacaaaagcaatataatgagtgaagaggagagaaagctccagaggttacgggcggccagatcatatgaggga

SEQ ID NO: 41248 - DNA, 201 bp, Homo sapiens
catatgagggatctggcttttcctctgaacaaatgggaagtcactggagactttcaaacagaggaatgctgcgctttgaaagaatcactccaggctgggcrtggtggctcatgcctataatcccagcactttgggaggccgaggcgggcggatcatgaggtcaggagttcgagaccagcctggccaacatggtgaaaccct

SEQ ID NO: 41249 - DNA, 201 bp, Homo sapiens
ctagatttgtaaaatctggaaggaatcttagagataagaagatgacagtatcataggaaagaaaaaggaatgatataaagaaaaatctgcaataaatgaargactctaggttcatgcttcacgctctctgtgtggaactcacggttttccagagactgaggcgtctgtgggcaggaggaccaagaggagaagaaccagact

SEQ ID NO: 41250 - DNA, 201 bp, Homo sapiens
attgttacaatttatcatgaaatttagtgagtattacagagctttgtacactgggttagaaaatttgtgtttttttctttttcttttcttttctttctttyttttttttttttttttttaaagagatagtgtcttgctctgttgacaaggctggaatgcagtggtgtgatcacagatcactgcagccttgacctagactcg

SEQ ID NO: 41251 - DNA, 201 bp, Homo sapiens
tcataatcaccataggcagttgaaattgtattgctttcttagtagtttctagataaaaaagaatattttattccaaaggtatttaaccaattaagctgtcwttagaaaatattgaaagtgtaattgttaattacaccaacactaaatcctacaacaaaattaccttggattatctttctaaccttttattttaatctattt

SEQ ID NO: 41252 - DNA, 201 bp, Homo sapiens
catgaggtcaggagttcgagaccagcctggccaacatggtgaaaccctgtctctactaaaaatacaaaaattagctaggcatggtggcccacacctgtaaycccagctactcgggaggctgaggcaggagaactgcttgaacccgggaggtggaggttgcagtgagctgagatcatgccactacactctagcctgcgtgac

SEQ ID NO: 41253 - DNA, 201 bp, Homo sapiens
ctaatatatattcccgggatgactctcccactttgcaattctaagatgaagagttgtgctgaatatttgttacctagatgaagtaagacaaccctactttkgtatttctttccatgctttctgctttattcttatggaactctcagggggaatacaacattgacaagagttggaaaagggaagaggggaattttaaatgtg

SEQ ID NO: 41254 - DNA, 201 bp, Homo sapiens
cttcccagagacctggctctgggatctgtttcctattgggtaagtgatgactcaaaagtacagtaaagggccaggtgcatggctcacgcctgtaatcccarcactttgggaggcttaggagggaggatcacttgagaccaggagttcaagaccagcctgggcaacataatgagcttctgtctctacaaaagaaattaaaaa

SEQ ID NO: 41255 - DNA, 201 bp, Homo sapiens
ttcctgaccttgggattccccgagcttttgatgtcggcttctcacatatttaggatttacatctaataatatccaaagtttccttctttgggtgcagcaawgcaaacactatggtaacatggtcacttttctgtatatttttaatcaggtaatgaaaacagcttggtttctttcagacagtcatgagtgtgcttttactat

SEQ ID NO: 41256 - DNA, 201 bp, Homo sapiens
cattttactatattctcaatggtatccattattccaacatagtttaaaactctcaggtttgaattaacattgctaaagacctgaaaatcaaaataaatcayagttgaatatgtcagcactgaaaaaatattaaattttaaaaatagaatacacattttcacgctctttaaaaataattatactaaacaaagaagggaaatt

SEQ ID NO: 41257 - DNA, 201 bp, Homo sapiens
ataattctgaatatgaaaatgtcagagaattctatacttatgtgatatcctgaggactctagcagagaatgcactttttaaaaatttttatttatttattyctgagacaggttctcattctcttgcccaggctgaagctcagtggtatgataatggctcacagcagcctcgatctcccaggctcaagcaatcttcccgtcc

SEQ ID NO: 41258 - DNA, 201 bp, Homo sapiens
aaaaatgttgcattatttttaatttcaataaactcactaatatatattcccgggatgactctcccactttgcaattctaagatgaagagttgtgctgaatrtttgttacctagatgaagtaagacaaccctactttggtatttctttccatgctttctgctttattcttatggaactctcagggggaatacaacattgaca

SEQ ID NO: 41259 - DNA, 201 bp, Homo sapiens
tttgcatatgttcaacaagacaactttttctactaattgtcttctggtttcttttctatacatatttaaaaatttttttgaattgacatacagaatgtacrttgtatgaccgtggatatttaaatttatttattgtgatgaggtctcactatgttgcccaggctggtcttgaactcctgggctcaagtgatcctctcgcct

SEQ ID NO: 41260 - DNA, 201 bp, Homo sapiens
aggctttagaaaaaataattctgaatatgaaaatgtcagagaattctatacttatgtgatatcctgaggactctagcagagaatgcactttttaaaaattkttatttatttattcctgagacaggttctcattctcttgcccaggctgaagctcagtggtatgataatggctcacagcagcctcgatctcccaggctcaag

SEQ ID NO: 41261 - DNA, 201 bp, Homo sapiens
gtccttattgtcaaaataaccagtcaaactggacttatttctaacagaaaaaaatgttgcattatttttaatttcaataaactcactaatatatattcccrggatgactctcccactttgcaattctaagatgaagagttgtgctgaatatttgttacctagatgaagtaagacaaccctactttggtatttctttccatg

SEQ ID NO: 41262 - DNA, 201 bp, Homo sapiens
caaatacctgtctttcatttattaaggctttagaaaaaataattctgaatatgaaaatgtcagagaattctatacttatgtgatatcctgaggactctagyagagaatgcactttttaaaaatttttatttatttattcctgagacaggttctcattctcttgcccaggctgaagctcagtggtatgataatggctcacag

SEQ ID NO: 41263 - DNA, 201 bp, Homo sapiens
tagtcttaaacaaaacaacccaccttgttggcaaaacagttttcaatctcaagcttgtcagtgtctgcaacaatttctccattaggtaaaacagtgtaaayaagcagatgagcactaggagcagagtctgattccactcgaaaggagaaggaaaacacccctttcactggagaatttaaaaagaagaacaagttcagaata

SEQ ID NO: 41264 - DNA, 201 bp, Homo sapiens
aatctcttgaacccgggaggtggagattgcagtgagctgagatcacaccatggcactccagtctgggcaacacagctagactcagtctcaaaaaaaaaaaagaatgacagtttctaaaatatcgtgtctttgattttctaaattattatacaatttgctgataggtataattttgagttagatctttatctgttgatctgg

SEQ ID NO: 41265 - DNA, 201 bp, Homo sapiens
aaactttgaagactgatataagtacattagtaatttaatatttcaggaacagaaattttgctgaaatatcagttacatatgcgtaagtttaaaagtactayagtaacacaaagtggtcagcacagaaaaaagcatttcaaggattaagacttaccattttgtgctttaggaagaaggggtattaggtccaggagatacaag

SEQ ID NO: 41266 - DNA, 201 bp, Homo sapiens
cctttattttttttttttatgagacggagtctcactgtgtcacccaggctggagtgcagtggtgtggtctcagttcattgcaacctccatctcccaggttyaagccattctcctgcctcagcctcctgagtagctgggattacaggtgcatgccaccatgcctggctaattttatatttttagtagagatgggctttcacc

SEQ ID NO: 41267 - DNA, 201 bp, Homo sapiens
aatgattgctttcttacctggccaaaataagggagtccctgtttgtaggacatatccatattctcaaaactaatcttcaccactgatgagtctatgtataygtacttggagcctgtaagctgcacacctgcagtcaattaagtattattgagaaaatgtcacttccaaaaacagacaaacagagcttctgaaaaaaaccac

SEQ ID NO: 41268 - DNA, 201 bp, Homo sapiens
cttgaacccgggaggcggaggttgcagtgaaccgagatcgtgccactgcactgcagcctaggcgacagagcgagactctgtctcaaaaaaaaaaaaaaaaagatcttgagatgagaatgaactgggtttttgtgaaaatggcaaatggcattttgggtactgcaagcctttgcggctcggaactgtgctgtgcactgtggg

SEQ ID NO: 41269 - DNA, 201 bp, Homo sapiens
attgaacttaaaaattgttaagatggtaaatttgatatgtgcattttttcataatttaaaaaataaaaatagtatagaaaaacacctgtgaggaggaaagwagtattcaggaaaaattgtataaatctgaaaacatggaagtttaacataagtatttataacaagatgctagaaaaaaaaaaccaaaagaggtagaagaaa

SEQ ID NO: 41270 - DNA, 201 bp, Homo sapiens
ccaaagatttaatatacaaatacctgtctttcatttattaaggctttagaaaaaataattctgaatatgaaaatgtcagagaattctatacttatgtgatrtcctgaggactctagcagagaatgcactttttaaaaatttttatttatttattcctgagacaggttctcattctcttgcccaggctgaagctcagtggta

SEQ ID NO: 41271 - DNA, 201 bp, Homo sapiens
ttcaaagtcttccatattgagaatgcagtgcactagcaccctcttctgctggttgcatctcagttcttccatctcttggacaatctttaggaagctattcrtcttggagtaaaatcgatatgcaaagtactcgggctgagggtattgaggcaacacccagccatgagcctggcaattttcattggccttgtaggctgccta

SEQ ID NO: 41272 - DNA, 201 bp, Homo sapiens
gctgggtgtggtggcaggcgcttgtaatcccagctactcaggaggctgaggcaggagaattgcttgaacccgggaggcggaggttgcagtgaaccgagatygtgccactgcactgcagcctaggcgacagagcgagactctgtctcaaaaaaaaaaaaaaaaagatcttgagatgagaatgaactgggtttttgtgaaaat

SEQ ID NO: 41273 - DNA, 201 bp, Homo sapiens
taagttttatcatttatgttaactttgagcttcctcgtggcatataggtacagggatttcattaggttcaaagaagttttaaagaaaagaagcaattttgrttgtggaagaatattttcagctcataccaaataattgaagtctgctgtgtaggttttgtcttcaaagtcttccatattgagaatgcagtgcactagcacc

SEQ ID NO: 41274 - DNA, 201 bp, Homo sapiens
accattcccggctaatttttgtatttttagtagagacggggtttcgtcatgttggccaggctggtctcgaactcctgacctcaggtgatctgcccgcctcrgcctcccaaagtgctgggattacaggtgtgagtcaccacgccaggctgctccgtgacatttaaataaaatcatattttaaagtccagttgtaagcctata

SEQ ID NO: 41275 - DNA, 201 bp, Homo sapiens
agtctcccagtgcttgtctggttttctgaaaggtgtgtttgatatgcaaggtataagcaaggcctgttcatccatctccacccaaaatttaaagaaaagaraataaagtagcaagctgggggtgctccagaaaaaagcttctctcacttcacctttatcagcaactgtgtgcaaatttgcatcagcagacttttgttatga

SEQ ID NO: 41276 - DNA, 201 bp, Homo sapiens
gattcttctgcctcagcctcccgagtagctaggactacaggcatgcaccaccacgcccagctaatttttgtatttttagtagagatggggtttcaccatgwtagccaggatggtcttgatctcctgacctcgtgatccgcccgcctcagcctcccaaagtgctgggattacaggcatgaaccactgtgcccggcctgataa

SEQ ID NO: 41277 - DNA, 201 bp, Homo sapiens
tcaaacttcagtctacttttgtttctttttaaaaatcccttcttgtttgaatgtaaaagtacttacctgtctttcttggaaaagaaagggaaggacaatgrccctttcccattatagtagtgtttggaatataattaatgcactattaattaagtaattattttttcatttggcattgtgcctattcacatgtctttacat

SEQ ID NO: 41278 - DNA, 201 bp, Homo sapiens
ggagtcttgctctgtcgccaggctggagtgcagtggcgtgatcttggctcactgcgacctccgccttctgggttcaagcgattcttctgcctcagcctccsgagtagctaggactacaggcatgcaccaccacgcccagctaatttttgtatttttagtagagatggggtttcaccatgttagccaggatggtcttgatct

SEQ ID NO: 41279 - DNA, 201 bp, Homo sapiens
agatagctgactgtcatcttgcagaaaccctccactgagtttctagccatcctacccactgccaaagagactgccccgacccaccaaatttaatttataargcatttctaggaggagttcataacctattccataaattataaaagaaagaaatagttgaacatttcttattacgtcaaacttcagtctacttttgtttct

SEQ ID NO: 41280 - DNA, 201 bp, Homo sapiens
tgatctgctcacctcggcctcccaaagtgctgggattacaggcatgagccaccgtgcccggcccctagctaactttttaattgttcttttgttgagacagsatgtcactattttgcccaggctagtcttgaactggactcaagcgatctttttgccttggcctctcaaagtgctggaactccaggcatgagccactgcacc

SEQ ID NO: 41281 - DNA, 201 bp, Homo sapiens
cccaggaggtggaggttgcagtgagctgagatggcgcaactatactccagcctgggcgacagagcgagattccatctcaaaaaaaaaaaaaaaaaaaaaaattctgtaaacacaaggtgtcactatgtttcccaggctggtctcaaactctgggctcaaccgatcttcccacctcagcctcccacagtcctgggattatag

SEQ ID NO: 41282 - DNA, 201 bp, Homo sapiens
caaattgaattacacgttaacaaaacttacttaaattttccttgtatatttaattctatctcttcccaggccaagtcaaaaaaaatatgaacctttggaasaattacatctagaagtgaccagtcctagtctaaatatttaaatacataacatgaggaattcaggccaaaagtttattctgataggtctattttttgatgt

SEQ ID NO: 41283 - DNA, 201 bp, Homo sapiens
acggccagctattttttgtatttttagtagagatggggtttcaccatgttgaccaggatggtctcgaactcctgacctcaggtgatctgctcacctcggcmtcccaaagtgctgggattacaggcatgagccaccgtgcccggcccctagctaactttttaattgttcttttgttgagacaggatgtcactattttgccca

SEQ ID NO: 41284 - DNA, 201 bp, Homo sapiens
tgtggaggctgtggcaggacaattgcttgaacccaggaggtggaggttgcagtgagctgagatggcgcaactatactccagcctgggcgacagagcgagaytccatctcaaaaaaaaaaaaaaaaaaaaaaattctgtaaacacaaggtgtcactatgtttcccaggctggtctcaaactctgggctcaaccgatcttccc

SEQ ID NO: 41285 - DNA, 201 bp, Homo sapiens
caatagaacaccagaactcattccttcttcattcttttcagattaaataaaattttaaaacactcgtagagtgtcagatgtgttccaaggactgatccaartgctcaaggcacaaaaatgtatatgacatgttcacagcccatattagcttaaaattttaagccactgtgctccttgttattatagtcatataattttctt

SEQ ID NO: 41286 - DNA, 201 bp, Homo sapiens
cccgggctcaagcgattctcctgcctcagcctcctgagtagctgggattacaactgcacaccaccacggccagctattttttgtatttttagtagagatgsggtttcaccatgttgaccaggatggtctcgaactcctgacctcaggtgatctgctcacctcggcctcccaaagtgctgggattacaggcatgagccaccg

SEQ ID NO: 41287 - DNA, 201 bp, Homo sapiens
attttgtatcatgggatgcaatgaaacatccttctgtaaagcaaagggattgactacctgataatatatttacttatttatttatttatttattattattwttttttgagacggagtcttgctctgtcgccaggctggagtgcagtggcgtgatcttggctcactgcgacctccgccttctgggttcaagcgattcttctg

SEQ ID NO: 41288 - DNA, 201 bp, Homo sapiens
cgattccagctctttagataaactatgttaatcaagtgccaatcagaaaatctttgaatccacctaggacctggaagcacagttccctgccccctttgagstgtcctgcctttctagacctaaccaacgtgtaccacaaatgtatcgattaatgtcgtatgtctccctaaaacatgtagattcaaactgtggcccaaccac

SEQ ID NO: 41289 - DNA, 201 bp, Homo sapiens
tcccaaagtgttgggattccaggcataagccaccgcgtccgacctctagcttttttttttttttttttgagacagagttttgctcttgtggcccaggctgragtgcaatggcatgatctcggctcactgcaacctctgcctcccgggctcaagcgattctcctgcctcagcctcctgagtagctgggattacaactgcaca

SEQ ID NO: 41290 - DNA, 201 bp, Homo sapiens
gggtgtggtagcaggcatctgtaattccagctacttgggagactgaggcaggagaattgcttgaacctgggaggggcaggttgcagtgagctgagattgcrccactgtgctccagccttggtgataaagtgagactctgtctcaaaaaagaaaaaaaaaaggaaagaagagattctggaggtagaaacaagaaatagtttc

SEQ ID NO: 41291 - DNA, 201 bp, Homo sapiens
tgagaagccctttgtccagagcctcagtaggcagctggttcataccaaccaatggtaagcaatgctcatctgttctctcccttaaggcctctctttgtgtraagacccacaagcataagtatctgtggtggggctgtgtcatgagggcaggctcacagtgctctcctctgagttaccactactgaacataatcagggtgtg

SEQ ID NO: 41292 - DNA, 201 bp, Homo sapiens
atcacttgaacccgggaggcagaggttgcagtgagctgagattgcaccactgcattccagcctgggcaacagagtgagactctgcctcagaaaaaaaaaaraaaagaaaaaagaaaacggctggatgtggtggcctgtaatcctagcactttgggaggccgaggtgggtggatcacaaggtcaggagcttgagaccaggct

SEQ ID NO: 41293 - DNA, 201 bp, Homo sapiens
tagtagagacggggtttcttcattttggtcaggctggcctcagactcccgacctcaggtgatccgcctgcctcggcctcccaaagtgctgggattacaggygtgagccactggcccggccagagctacgagttcttaaagcactttattctttgtatctcagtgagaaggcatcaccatgctctaacttagggatgatggc

SEQ ID NO: 41294 - DNA, 201 bp, Homo sapiens
ctcccggattcaagcgattctcctgcctcagcctcccgagaagctgggattacaggcatgtgccaccatgcccggctaatttttgtgtttttagtagagasggggtttcttcattttggtcaggctggcctcagactcccgacctcaggtgatccgcctgcctcggcctcccaaagtgctgggattacaggcgtgagccac

SEQ ID NO: 41295 - DNA, 201 bp, Homo sapiens
ctgtggaaaaagcaaccttcagatactgcaaaagaaaaggagtgtgataaactcagaacaaacacaacagcagttggaatttcaaagcctgctaacatccrcgttaagagtccttgttcagttgtgggaaattcaaattctcagaataaaataagtaatccctcacagcagacagctttgtcgatggtaatgcacaattat

SEQ ID NO: 41296 - DNA, 201 bp, Homo sapiens
gcgtacaccaccatgccctgctaatttttttttatttagtagagatggggtttcaccatgttggtcaggctggtctcaaactcctgacctcaggtgatccmcccgccttggcctctcaaagtgctgggattataggtgtgagccactgtgcctggcctacaattcttaaaccttttcttacctgaagagtcttaaaacaaa

SEQ ID NO: 41297 - DNA, 201 bp, Homo sapiens
gtggagattacaggcatgagccattgtgcccagccacataagtccttttaattcatgttttctttgctggggaagcgtacattgcatgatggattcagatmctcaactttcttttttttctttttttgagatggggtctcattttgtcacctaggctggagtacagtggtgtgatcgtggcttactgcagccttgacctcc

SEQ ID NO: 41298 - DNA, 201 bp, Homo sapiens
gattacaagcgtacaccaccatgccctgctaatttttttttatttagtagagatggggtttcaccatgttggtcaggctggtctcaaactcctgacctcargtgatccacccgccttggcctctcaaagtgctgggattataggtgtgagccactgtgcctggcctacaattcttaaaccttttcttacctgaagagtctt

SEQ ID NO: 41299 - DNA, 201 bp, Homo sapiens
ggaggcgggggttgcagtgagctgagatcgcaccactgcactccagcctgggtgacagagtgagattccatctcacaaaaaaaaaaaaaaaaaaaaaaaaaaaggctagatatggctatctgggagtactgtaatatataactattattatttctcttttaagtttcaggcaaggccaggtctggtggcacacgcctgtaa

SEQ ID NO: 41300 - DNA, 201 bp, Homo sapiens
agtaactggctatggtaatgtagagaagacagatgactgcatcaatatttaagacttaaattttgagttacctcaccttataaaaatatatatcaatataytaaatactcaacaaagatccaggatgtacagtatttaaaaatacatttctcttggatcagcaccaaaaataatcagtttctgttcaacttgtgtcaagtt

SEQ ID NO: 41301 - DNA, 201 bp, Homo sapiens
gagctcaaagtgatctgcctgccttggcctttgaaagtggtgggattacaggcatgagacaccatgcctggccttcaaaaagttaatctaaaaatatatawacatatatcccagaaggagaagcagaagggtcagataggtgagaaccagggctttgaatatcagaaaaaccaggaagagataatatgtcaagtatggagt

SEQ ID NO: 41302 - DNA, 201 bp, Homo sapiens
ttagccaagcgtagtggcagacgcctgtaatcccagctaatcgggaggctgaggcatcagaatcgcttgaacccgggagacagagtgtgttgcagtgagcygtgatcatgccactgcactccagcctgggagacagagcaacacaccatctcaaaaaaaagtaataataatgaaagataagaaagagacagagaaaagaga

SEQ ID NO: 41303 - DNA, 201 bp, Homo sapiens
aaatttcccagtttctgctagaaatgaaggtaaatggaagattcagacagacatttccaagagttttttcaggtcaggcgtggtggctcacacctataatyccagcacttttgtaggatgaggagggaggattacttgaagtcaggagttcgagaccagcttgagcaataaagcaagaacccatctctacaaaaaaaaaat

SEQ ID NO: 41304 - DNA, 201 bp, Homo sapiens
acagaacgagactctgtctcaaaaaaaaaaaaaaaaaaaaaaaaaatctttaaactgggtttcacagtttaaaatctagaggtccacaaactatatttaargattcagcacttcagtcttcacagcagaactgaatgaaaaaattctacagggtccagtgcagtggctcacgcctgtaaacctaagcactttaggaggccg

SEQ ID NO: 41305 - DNA, 201 bp, Homo sapiens
ttaaaaccacaactgaagctacaagtgctctttagtacaaccactttctgaaatttcataaatactgcccatcatttacatgctcatcacttggcactagyttataaataaataagacatgtttgcttaaaaaaaaatcaaagccttgttggtacctgcatgcttgcttgcatatacctggtaaaaatggttaattttatt

SEQ ID NO: 41306 - DNA, 201 bp, Homo sapiens
tcccagctatcccaggaggctgaggcaggaagatcccttgagcccaggaggttgaggctgtagtgagctatgatggcctgttaatagccactgtgctccaytctgggcaacaaagggagactctttatctcttaaaaaaaaaaaaaaaggcacagtggctcatgcctgaaatcccaacagtgggaggccaaggtggaagaa

SEQ ID NO: 41307 - DNA, 201 bp, Homo sapiens
aaactagacaaaattatatcataaataaactctaaagtacaaggacatcaagagaaaattgttcagagaaaactttaaaagcagcacagaggaaaaacaamagaacaaaactgaaaaagaatgaattaaaacaggtcacaaagtgattgaattggaaagcaggcaaggaagatccaacaaatgtacagagatttttttaga

SEQ ID NO: 41308 - DNA, 201 bp, Homo sapiens
attctgatatagtgactctcaggatttgagctgactaaagtcagtagcagaagtgagccatgaacttgaaacattgagggcaaaactgataaacaggagtygtgagtcatagcacaagacactgccacagaaaattgtggtgtagcagctgctataaatttcacagtgtgatcatgagaggtgaggagggaaaggatgaag

SEQ ID NO: 41309 - DNA, 201 bp, Homo sapiens
tacaggtgttggtggttaccttagactttagagcaagttcctgacacatctagaaaaggaatctttatggcctggatctcagttcccactaggccaaattrctttaagatgcgatatccttccctgactttctcttttctttcaacctgtcatctgactcaggattgtgctttgactctgttgttgcagcttcctcttcca

SEQ ID NO: 41310 - DNA, 201 bp, Homo sapiens
ccaaagtgctaggattataggcgtgagccacagcatccagcctctcacctcaaatactgaaagagctccctaactggtctcttgcctctacccctgccctratatagtctacccaacatggcagccacaacagtcattttagaaggcacatcagatcttgtcattactctgctcaaaaccttccaatactttcccatctca

SEQ ID NO: 41311 - DNA, 201 bp, Homo sapiens
tattgaactcaggaaaactagacaaaattatatcataaataaactctaaagtacaaggacatcaagagaaaattgttcagagaaaactttaaaagcagcayagaggaaaaacaacagaacaaaactgaaaaagaatgaattaaaacaggtcacaaagtgattgaattggaaagcaggcaaggaagatccaacaaatgtaca

SEQ ID NO: 41312 - DNA, 201 bp, Homo sapiens
taaacttactgctcttttaataacgacagtttacaaagcacttctgaaatgtagattatttttatttaaattttatgtatttcaatttcgagtagataatrtgtttacatggttcaaaattcaaaaggtacaaaagaaaatagggtaaaaagtctttttcctattttgtctccagtgactgttttttccattccagaggca

SEQ ID NO: 41313 - DNA, 201 bp, Homo sapiens
aacacttggtccaaactcacttttcttctggattcatattttctgatctcacctattatgttatagaactgatatgttacgtttgttttcattgatgcgtstgtacttggcttcagagagcagaacaaggccctgtgagtcactgggagccagattttggatcaaaataaatcactttctgacaagtgtagttgtctagta

SEQ ID NO: 41314 - DNA, 201 bp, Homo sapiens
ctcatctagctattttgtaatttgctaaatcttactgtaaactattgtcagcctactgtgcaatagaacaccagaactcattccttcttcattcttttcarattaaataaaattttaaaacactcgtagagtgtcagatgtgttccaaggactgatccaaatgctcaaggcacaaaaatgtatatgacatgttcacagccc

SEQ ID NO: 41315 - DNA, 201 bp, Homo sapiens
tcaggtttactgtagttaatgaggccaaaaaaaaaaaaggacattttcaaggagaaacagaaacattattagaaaagattctgggctgggcgcgctggctyatgcctgtaatcccagcactttgggaggctgaggcaggcagatcacctgaggtcaggagtttgggactagcctggccaacatggtgaaatcccgtttcta

SEQ ID NO: 41316 - DNA, 201 bp, Homo sapiens
tacttcatccatttatcttttttttttatggtgaagacattcaaaaacctctcatctagctattttgtaatttgctaaatcttactgtaaactattgtcakcctactgtgcaatagaacaccagaactcattccttcttcattcttttcagattaaataaaattttaaaacactcgtagagtgtcagatgtgttccaagga

SEQ ID NO: 41317 - DNA, 201 bp, Homo sapiens
gtcaactccaggtaagagaaagtctagcattgttaaaaatacaaatcatagttttcggactcaacagttcccagtacagcacacagggaaagggcttggastgaatgggcctggaagtggaagcttccaaaaaacatggctaaggggaaataatcagatcacaagaagaggtatgcagatccttggagacagggaatttaa

SEQ ID NO: 41318 - DNA, 201 bp, Homo sapiens
attaaggaaaaggaatatgcttatatctaaaaccagatactcccattataaatcaataaattggcattcttacttctattgtagccttatttgaatgtaayacttgaccatccatcaacatgtgtgtgaaaattttggttgatatatgaaacattcagaatttgaatcagatgaacccaatgaaaagccctcagggaaaaa

SEQ ID NO: 41319 - DNA, 201 bp, Homo sapiens
gcagagaaaaagagagcagaatggcatggagaaatgagaagaaacacacaccaagtcaactccaggtaagagaaagtctagcattgttaaaaatacaaatyatagttttcggactcaacagttcccagtacagcacacagggaaagggcttggactgaatgggcctggaagtggaagcttccaaaaaacatggctaagggg

SEQ ID NO: 41320 - DNA, 201 bp, Homo sapiens
gttttccttctaacagtcagggtcctctgctgcaggtctgctggagtttgctggaggtccattccagaccctgtttgcctgggtatcaccagtggaggctkcagaacagcaaagattgctccctcttccttcctctggaagcttcgtcccagaggggcaccctccacatgccagacagagctctcctgtacaaggtgtctg

SEQ ID NO: 41321 - DNA, 201 bp, Homo sapiens
tgcttcaattttgatttctgtatctagcactaattgtttttgtcttagattattggccattcctatactccaccatttccttatcagacaagtaaataaaygtagacatttgcccaagtttcccttgcagagtttcctctccttcttccttctccttccacctctctgtatctcctctcagttctctccatgtttaccact

SEQ ID NO: 41322 - DNA, 201 bp, Homo sapiens
ctttatttcattaagttgtcttcaatctctgatgtcctttcttccgtgtgattgattcagctatggatacttgttatgcttcacaaagttctcatgctgtrtttttcacctccatcaggtcatttatgttcttctctaaactagttattctagttagcaattcctctaaccttttttcaaggttcttagcttccttgcatt

SEQ ID NO: 41323 - DNA, 201 bp, Homo sapiens
ggtgtcgattttagatctttcccactttctcctgtaggcatttaatgctatgaatttccctctaaacactgctttagctgcatcgcagagattctggtacrttgtttctttgttctcatgggtttcaaagaacttatttatttctgccttaatttcgttatttacccagtagtcattcaggagtaggttgttcggtttcca

SEQ ID NO: 41324 - DNA, 201 bp, Homo sapiens
aattactgcctcaatttcagaacttattattggtctattcaggaattcgacttattcctggtgtagtcttgggagggtgtatgtgtccaggaatttatcartttcttctagattttatagtttatttgcatagaggtgtttatagtattctctgatggtagtttgtatttctgtgggatcagtggtgatatcccctttatc

SEQ ID NO: 41325 - DNA, 201 bp, Homo sapiens
ttaagttctgggatacatgtgcagaacatgcaggtttgttccataggtatacacgtgccatggtggtttgctgcatccatcaacccgtcatctacattagrtatttcttctaatgctatccctcccctagcccccaaccccctaacaggccccggtgtgtgatgttcccctccctgtgtccatgtgttctcattgtacaac

SEQ ID NO: 41326 - DNA, 201 bp, Homo sapiens
aggggctccatgagatccatttagttgcattcatcctcctgtccccaaagtatatcagtaaatgtactgtttcttgacagtttggctgtgttatcccagasgactggatgtgggaatctccaaatggccagataatactctcagcttccaattcagtgaaactattcttaagcatgttaatgaaaatatacttctttcctg

SEQ ID NO: 41327 - DNA, 201 bp, Homo sapiens
cgccatgttggtcaggctggtcttgaactcctgacctcaggtgatccacccacctcagcataatgcctggccagcatttgttgttgttgttgttgttgttktttttttttttaaagacagagtcatgcttgttttggcagcacatatactaaaaaactggaacaatacagagaagattattagcatggcccctgcacgagg

SEQ ID NO: 41328 - DNA, 201 bp, Homo sapiens
gctgaggcaggcggatcatgaggtcaggagatcgagaccatcctggccaacgcggtgaaaccctgtctctactaaaaaaaaatacaaaatattagccgggygtggtggcgggcacctgtagtcccagctactcgggaggctgaggcaggagaatggcgtgaacccgggaggctgagcttgcagtgagccgaaatcatgcca

SEQ ID NO: 41329 - DNA, 201 bp, Homo sapiens
ggtttcgccatgttggtcaggctggtcttgaactcctgacctcaggtgatccacccacctcagcataatgcctggccagcatttgttgttgttgttgttgytgttttttttttttttaaagacagagtcatgcttgttttggcagcacatatactaaaaaactggaacaatacagagaagattattagcatggcccctgca

SEQ ID NO: 41330 - DNA, 201 bp, Homo sapiens
aaatggagtctctctctgtgctaaaccacctggaccttggggggtggggtgtcaccagcacaccgtggccaccacaactgggactgtaccggttcagaccygaagccaggatagcactcgatcttgcccaaggcccggtgtaaccactacctggctaccacctaagtttactccaggccctaggactctgcagtcagcagg

SEQ ID NO: 41331 - DNA, 201 bp, Homo sapiens
cggagtctcactctgttgcccaggctgtagtgcatgtagtgcagtggcacgatattggcttactgcaacctccacctctcaggttcaagcaattctcctgyctcagcctcccaagtagctaggattacaggtgcacactaccatgcccagctaatttttgtatttttagtagagacggggtttcgccatgttggtcaggct

SEQ ID NO: 41332 - DNA, 201 bp, Homo sapiens
gggtttcgctgtgttagccaggatggtcttgatctcctgacctcgtgatccgcccgcctctgcctcccaaagtgctgggattacaggcgtgagccaccgcrcctggccctggtgccttagttctttgggcgaggtcatgttttcctggatggtcttcatccttgtagatatttgtctatgtctgggcattgaagagttagg

SEQ ID NO: 41333 - DNA, 201 bp, Homo sapiens
aaggaagggagacaaagaaaaccagttctagcttcacctactcctgcctaagtctaacacaaatgttgtgttggtccatcctttaaactcttcatctacayaggacagctacaaatagcaactggttaccatatcttttaacagcaaattggtgtgtcactgtcttccttgagtttcttttcacaacaatccagtaatctc

SEQ ID NO: 41334 - DNA, 201 bp, Homo sapiens
taggggaaaatcccttccttgcctcttttagcttctggtggctgttggcattcctgttttttttttttttttttttttttgagacggagtctcactctgtygcccaggctgtagtgcatgtagtgcagtggcacgatattggcttactgcaacctccacctctcaggttcaagcaattctcctgtctcagcctcccaagta

SEQ ID NO: 41335 - DNA, 201 bp, Homo sapiens
acaatctcggctcattgcaagctccacctcctgggttcacgccattctcctgcctcagcctcccgagtagctgggactacaggcgcccgccaccacgcccrgctaattttttgtatttttagtagagacggggtttcgctgtgttagccaggatggtcttgatctcctgacctcgtgatccgcccgcctctgcctcccaaa

SEQ ID NO: 41336 - DNA, 201 bp, Homo sapiens
aaaaaaaaaagcaaggtgtcagcagggctgtattcccttgaaattctaggggaaaatcccttccttgcctcttttagcttctggtggctgttggcattccygttttttttttttttttttttttttgagacggagtctcactctgttgcccaggctgtagtgcatgtagtgcagtggcacgatattggcttactgcaacct

SEQ ID NO: 41337 - DNA, 201 bp, Homo sapiens
taaccaccaccacaatcatgatacagaacatttccatcatccccaaaagttaccctgtgatctttttttttttttttttgagacggagtctcgctctgtcrcccaggctggagtgcagtggagcgatctcaggtcactgcaagttccgcctcccgggttcacgccattctcctgcctcagcctcccgagtagctgggacta

SEQ ID NO: 41338 - DNA, 201 bp, Homo sapiens
aaattttgcaatgaatacattcttgtaaaagcacttaactttacataagtgtttaaaggaaaacacatagatatatccccaaccttcttttttcttttttytttttttttgtggcagggtcttactttgtcacccaggctagagtgcagtggtgtgatcatggctcactgtagtcttgacctccgggtgcaagtgatcctc

SEQ ID NO: 41339 - DNA, 201 bp, Homo sapiens
agtcaccaattttgatgagctttgacaaatggatagtcatgtaaccaccaccacaatcatgatacagaacatttccatcatccccaaaagttaccctgtgmtctttttttttttttttttgagacggagtctcgctctgtcacccaggctggagtgcagtggagcgatctcaggtcactgcaagttccgcctcccgggttc

SEQ ID NO: 41340 - DNA, 201 bp, Homo sapiens
agtagaaatagggttttaccatattggtcacgctggtctcgaactcctgacctcaggtgatccgcccacctcagcctcccaaagtgctgggattacaggcrtaagccaccatgcccggctaacgtttctttcagtaaaattcaagtaggttttttctacactaatgcataaaaattgttaaaatgaaaacctcttataatt

SEQ ID NO: 41341 - DNA, 201 bp, Homo sapiens
gccatgcctgactaatttttgtattttttttgtagacacagggttttgccatgtaagccaggttggtctagaactcttgagctaaggacagtccgcctgtkttggcctcccaaagtgctaggattacaggctaactttcaatttaataaaaaaaattaatttgtgcaattggttgttattttatagaagcctaatttctag

SEQ ID NO: 41342 - DNA, 201 bp, Homo sapiens
ggctcactgcaccctccgcctcccaggttcaagcaattctcctgcctcagcctcccgtgtagctgggactacaggtgccggccaccatgcatggctaattyttttgtatttttagtagaaatagggttttaccatattggtcacgctggtctcgaactcctgacctcaggtgatccgcccacctcagcctcccaaagtgct

SEQ ID NO: 41343 - DNA, 201 bp, Homo sapiens
tttgtagacacagggttttgccatgtaagccaggttggtctagaactcttgagctaaggacagtccgcctgttttggcctcccaaagtgctaggattacasgctaactttcaatttaataaaaaaaattaatttgtgcaattggttgttattttatagaagcctaatttctagaatatgggatataaacaatttaataatg

SEQ ID NO: 41344 - DNA, 201 bp, Homo sapiens
ttcagggtaaatttctagaaatgagattgctgggtcaaaatataagtgcatatgtcgtttattcagatattaccaaatttctctccagaagcgttgaaccmattttcattcccaccagtaatgaatgagactgtgtatttcccttacagtctctccaacagaatatactgtcagtctgtatttttaaatttttgtctatct

SEQ ID NO: 41345 - DNA, 201 bp, Homo sapiens
ttcatactgctcaaggatttcttgcatgaacatttcttttttcttttttgagatggagtctcgctctgtctcctaggctggagtgcagtggtgcaatgtcrgctcactgcaccctccgcctcccaggttcaagcaattctcctgcctcagcctcccgtgtagctgggactacaggtgccggccaccatgcatggctaattt

SEQ ID NO: 41346 - DNA, 201 bp, Homo sapiens
cgagatcacgccactgcactccagcgtgggcgacagagcgagactccgtctcaaaaacaaaaaatcaaacctgcaataaacttatgcatatatatgtttayattgttggaagtttatcttcagggtaaatttctagaaatgagattgctgggtcaaaatataagtgcatatgtcgtttattcagatattaccaaatttctc

SEQ ID NO: 41347 - DNA, 201 bp, Homo sapiens
tacaatctcccctgccctttctctttgatcttacctactactctccctctccctcagctccagccatactggactccttgctgttaccagcacaaactagkgactgtcccactcagggtcttcgcacttgctgtttcttctgcgtgcaatgctgtgcccccaggtgatccatctggcctgcttcctcatgtccttcaaggc

SEQ ID NO: 41348 - DNA, 201 bp, Homo sapiens
ggattgtaggtgtgaactactgtgcctggccttctacattttttttttaaccatttcatagttccctttttctttgaacacttggtccaaactcacttttyttctggattcatattttctgatctcacctattatgttatagaactgatatgttacgtttgttttcattgatgcgtctgtacttggcttcagagagcagaa

SEQ ID NO: 41349 - DNA, 201 bp, Homo sapiens
ggcagagtccgaccggtccccgccccgcgctcgctccgcacggccaccggctcctccgcggacgctaccccggcgggagccgagctgagtccgactccccstctcccgaagaggcccgaaagccgcgtcacgtgcggggccgaaacttcgcggccggggccgggtggctggcgggtgggaggcaggcacggcggtcggggg

SEQ ID NO: 41350 - DNA, 201 bp, Homo sapiens
ttgaacttctgggctcaagtgattctcccacctcagcctcccaaagtgttgggattgtaggtgtgaactactgtgcctggccttctacattttttttttamccatttcatagttccctttttctttgaacacttggtccaaactcacttttcttctggattcatattttctgatctcacctattatgttatagaactgata

SEQ ID NO: 41351 - DNA, 201 bp, Homo sapiens
tccgtatacttttttaattatcacttcaggatgacactgtgtaagtatattctgcattaagctacaatgaaacgaagttgaaaggatactcaagaattagstatgtatcattatatgcagattgtcctctgaaataatgacagagaagtaaattagctcagtgaacaaaaatctgagcaatgatctgctgtctccaaagga

SEQ ID NO: 41352 - DNA, 201 bp, Homo sapiens
tttttggtagagacagggtttcaccctgttgcccaggcgggtctcaaacccctgggctcaaacgatccacctgcttcagtctcccaaagtgctgggattamaggtttgagccaccttagaaccctcttttaccccttgttgttgttaaccactttttactagctaacaattataataaattttcgtgttcaaattactggt

SEQ ID NO: 41353 - DNA, 201 bp, Homo sapiens
gaatgttgatggtatattctctggtcaccagctcactgatggcagaactgtaattcttctcaccacccttctttgcgggaggcattctgaggggcccaagytggaaaggaagagtgcgagggattgtgggcgaagtgcagtggtgtgattatagctcactgcagcctccatcttccaggctcaagtgatcctctcatctca

SEQ ID NO: 41354 - DNA, 201 bp, Homo sapiens
gcttccttatctgtgcagctatgggtatatcctaggcaagctgcctgtgctagttcccttatctgtatctgtagcctgagttttcaggttgttcctttgtytgaaagaattctactgagcacctgccctaaccgccttcctagctggttctttcttttctcctctctcagcttgatgccacactgttgctgtcaacgaaac

SEQ ID NO: 41355 - DNA, 201 bp, Homo sapiens
gtctatataagctgaaaaaaacatcaagctcctcaaacaggttgactagtaaataaatggcccaacacaaaaagggtaatctcagttttaatttttttttraattgacagataaaattatatgtatttactgtgtataacaatattttgaagtatatatacatggtataatgactaaatctagctaacatatgcattacct

SEQ ID NO: 41356 - DNA, 201 bp, Homo sapiens
tcatgttcacagaatttctcagcttgggcgcaggatttaagagagaatgtaagaaagcaatgcctgactattgattaatccaaggcccattgtacacacartcaattataatgctagaatttctaagtctggagaataatcttagctgcctgattttaaatcttcttacataatcttctgaagaaaacataaaatcaacaa

SEQ ID NO: 41357 - DNA, 201 bp, Homo sapiens
tattgcttatcactgcccaaaagttccaagaaatgatgaagtcagtctcatttggcatacatctactttttcagaaggaaacaaagcagagaaaaaattcygagagaaattcatagctagtaaccactctcacttttattttagtttccataactgaaattgctggacttgagagcaatttttccttgctcaacagaatta

SEQ ID NO: 41358 - DNA, 201 bp, Homo sapiens
ttttattaacttttcacctactaaaaacaaattactaagatgttagaatgtatttgtttactttgctcttctttttagttatctttgcatgaagtataatmataaaaaaaataagacaacaaagagaaaaaatataatggaatttctgatactgtgaagggtaaagaccatcacacaatttggacaaggttttggggaaga

SEQ ID NO: 41359 - DNA, 201 bp, Homo sapiens
attccagccatttaagcagctcaaaactccaatatctgcctcctcattttagtaagactgctgttctgtttaggattcatttttgtgctctgtactagaamgtggtcctagatagaaagctagggtgatcattgcactcacctttgtattctctcaaggatcacaatgctgcctgtgtgttcctgaaaatagctgccttgt

SEQ ID NO: 41360 - DNA, 201 bp, Homo sapiens
gatgtcatgttcacagaatttctcagcttgggcgcaggatttaagagagaatgtaagaaagcaatgcctgactattgattaatccaaggcccattgtacasacagtcaattataatgctagaatttctaagtctggagaataatcttagctgcctgattttaaatcttcttacataatcttctgaagaaaacataaaatca

SEQ ID NO: 41361 - DNA, 201 bp, Homo sapiens
aaattggcaaattgtctactgtaccatttattcttgttcttttctttaagagcacggccatcatatttaatccagtattttcacataagctcttcctttcraaagagcaaaccagttttgttttaggcaactgatgtcatgttcacagaatttctcagcttgggcgcaggatttaagagagaatgtaagaaagcaatgcct

SEQ ID NO: 41362 - DNA, 201 bp, Homo sapiens
tttgaattctttgtctgaaaggtcacatatctctgttttttccaggaatggtccctggtgtcttagttcttttttttttttttttttgagacagagtctcrctctgtcgcccaggctggagtgcagtggcacaatctcggctcattgcaagctccacctcctgggttcacgccattctcctgcctcagcctcccgagtagc

SEQ ID NO: 41363 - DNA, 201 bp, Homo sapiens
gagaaaaaacatttcccaataattttaagcacttcttttaaaattacaaaattggcaaattgtctactgtaccatttattcttgttcttttctttaagagsacggccatcatatttaatccagtattttcacataagctcttcctttcaaaagagcaaaccagttttgttttaggcaactgatgtcatgttcacagaattt

SEQ ID NO: 41364 - DNA, 201 bp, Homo sapiens
cttaccacagctcttttgaattctttgtctgaaaggtcacatatctctgttttttccaggaatggtccctggtgtcttagttcttttttttttttttttttgagacagagtctcactctgtcgcccaggctggagtgcagtggcacaatctcggctcattgcaagctccacctcctgggttcacgccattctcctgcctca

SEQ ID NO: 41365 - DNA, 201 bp, Homo sapiens
gattacaggtacatgtcaccatgtctggctaatttttgtatttttagtagagataggatttcctcatgttgaccaggctggtctccaacgccaggcttacyaattctttcttctgcttgatctgttctgctaataagagactctgatgcattcttcagtatgccaattccatttttagtttctgcataattctttttagtt

SEQ ID NO: 41366 - DNA, 201 bp, Homo sapiens
gttggaattacgggcatgagccaccgcgcctggcctaacgtccttttctttctgattgaagtaccatttagcattttttgtaggacaggtctggtgttgayaaaatctctcagcttttgtttgtctgggaaagtctttatttctccttcaagcttaaaggatatttttgctggatacactattctagggtaaatttttttt

SEQ ID NO: 41367 - DNA, 201 bp, Homo sapiens
aataggataaattcttgaaagattgctctgcaaatctgatcatttgtttctcatctcttttttttatattttattttattttatttatttattttttttttgagacagatcttgctctgtcacccaggatggagtgcagtggttgttcgctgcaacctccacttcctgagttcaagcgattcttgtgcctcaccttcccaa

SEQ ID NO: 41368 - DNA, 201 bp, Homo sapiens
gatttcttattgctcattaacgtccttttctttttctttttctttttttttttttgagatggagtcttgctctgtcacccaggttggagtgcaatggcacratctcggctcactgcaacctccgcctcctgggttcaagcaattctcctgcgtcagcctcctgagtagctgggactacaggcgcatgccaccacgtctgct

SEQ ID NO: 41369 - DNA, 201 bp, Homo sapiens
catccatgctgttgcaaatgatatttattgatattttgtattttattcatttcaaatgtatttatttctgctctgatctttattgtttgttctaattttgsgttcggtttgctcttgctcttctagttctttaagatgaatgttaggttatttatttgaagtttttcttctttttgatgtaggccctcataggtgtaaatt

SEQ ID NO: 41370 - DNA, 201 bp, Homo sapiens
gcggaggttacagtgagccaagaccgcaccactgcactccagcttgggcaacagagtaagattccgtctcaaaaaaaaaaaaagaaaaaaaatatatatayccttatcactaacccttattcactcagattcctgggtctttgagttcctaagaaaggcttcagtgaccttaatgtaatacacatctactttatttaccta

SEQ ID NO: 41371 - DNA, 201 bp, Homo sapiens
gggtgggggctaggggagggatagctttaggagaaatacctaatgtagatgatggtttgataagtgcagcaaaccaccatagcacatgtatacctttgtarcaaacctgcacgttctgcacgtgtatcccagaacttaaagtatatataaaaaaaattaccaaaaacctatttatagaaaaaaaaacttttaacaaaatga

SEQ ID NO: 41372 - DNA, 201 bp, Homo sapiens
ttgcctcagcctcccaggtagctgggaccacaggtatgtgctaccacacccagctaatttaatatttattttaaaatatatatatccttgccgggcacgayggctcactcctgtaatcccagcactttgggaggctgaggcgggtggatcacaaggtcaggagttcaagaccagcctggccaatatggtgaaaccccttct

SEQ ID NO: 41373 - DNA, 201 bp, Homo sapiens
cctgcctcagcctcctaaagttctgggattacaggcatgagccaccgcgcctgtccagagaccccttttctagaaatttttttttttttttttttttttttaattagccagccatggtggtgcatgcctgtggtcccaactactcaggggactgaagtgggaggattgcttgagtttgggaaatcaaggctgcagtggagc

SEQ ID NO: 41374 - DNA, 201 bp, Homo sapiens
ggcgtggtggcaggcacctgtaatcccagctactcaggctgaggcaggagaattgcttgaacccaggaggcagaggctgcggtgacccaagatcacaccaytgtactccagcctgggcaacagagcgagactccatctaaaacaaacaaaaaaaattaaatagatttaaattttaaatggctatatgtggctaatggttac

SEQ ID NO: 41375 - DNA, 201 bp, Homo sapiens
gaggccgaagcaggtggatcatgaggtcaggagattgagaccatcctggttaacagggtgaaaccccatctctactaaaaatacaaaaaattagccgggtstggtggcgggcgcctgcagtcccagctactcgggaggctgaggcaggagaatggcgtgaacctgggaggtggagcttgcagtgacccgagattgtgccac

SEQ ID NO: 41376 - DNA, 201 bp, Homo sapiens
gagtgttactctgtggcaaggcatgccacagtatactgaccttttggaagaaagactacactaaactgtagggacttgcttttttttttttttttttttttaacttatataacataacagggtgaggaacaaaatcaaagcagaaaaacattaagtagattttataaaccagatgagagtttgcaatggtctaataaatca

SEQ ID NO: 41377 - DNA, 201 bp, Homo sapiens
tccctgcaacctccgcctcccaggttcaagtgattctcctgcctcagcctcccaagtaggtaggactacaggcgcctgccaccacacctggttaatttttmtatttttagtagagacggggtttcactgttggccaggctggtctcaaactcctgacctcaggtgatccgcctgcctcggctttccaaagtgctgggatta

SEQ ID NO: 41378 - DNA, 201 bp, Homo sapiens
ggagtgttactctgtggcaaggcatgccacagtatactgaccttttggaagaaagactacactaaactgtagggacttgcttttttttttttttttttttttaacttatataacataacagggtgaggaacaaaatcaaagcagaaaaacattaagtagattttataaaccagatgagagtttgcaatggtctaataaatc

SEQ ID NO: 41379 - DNA, 201 bp, Homo sapiens
agtttttttctttttttttttttgagacggagtctcgctcttgtcacccaggttggagtgcagtggcacaatctcggctcactgcaacctccacctcctgygtttaaacgattctcctgcttcagcctcctgagtagctggaattacaggccctgccaccacccccccgctaatttttgtctattttttttttttagtaga

SEQ ID NO: 41380 - DNA, 201 bp, Homo sapiens
tgtaatcccagttatttgggaggctgaggcagaagaattgcttgaacccaggaggtagaggttgcagtgagctgagatcacatgccactgcactccagccygctgcgtgatagagcgagactctgtctcaaaaaacaagaaacaataaaaaaagaaaatgtactgtcagaatatggaaccccatcctgccaccacaacttg

SEQ ID NO: 41381 - DNA, 201 bp, Homo sapiens
gcccaccaccatgcccggctaattttttttaatttttagtagaaacagggtttcaccatattgaccaggctggtcttgaactcctgatctcaggtgatccrcctgccttgccctcccaaagtgttgggattacaggcgttgagtcaacatgcctggcctcattactatttttttaacagaaaaactggcagagaagatgga

SEQ ID NO: 41382 - DNA, 201 bp, Homo sapiens
caatttaaactgatgttttaatacatatttcatattcctataaatatacatcttttctgagaaggagtcttgctctgttgcccaggctggcatgcagtggygcaatcttggctcactgcaacctctgcctcccaggttcaagcgattctcctgactcagtctcctgagtagctgggattacagatgcccaccaccatgccc

SEQ ID NO: 41383 - DNA, 201 bp, Homo sapiens
aaaacttaatttttgcataattacaacttattacttaagaatgagagatttcaatttaaactgatgttttaatacatatttcatattcctataaatatacatcttttctgagaaggagtcttgctctgttgcccaggctggcatgcagtggcgcaatcttggctcactgcaacctctgcctcccaggttcaagcgattctc

SEQ ID NO: 41384 - DNA, 201 bp, Homo sapiens
aaaaatcataaactataaagtaagggaagtgctatgatagggtaaataagggttgctatgggaaaaacatataatagtaggaagacacacattagaaaagraggagctaccaggaaaaaatgaagcccaactgaaacctcaggacgagtataggtcttagtggataaagaagattccaggcagagaggacatgtgcaaaag

SEQ ID NO: 41385 - DNA, 201 bp, Homo sapiens
gacaaagagtaaaaacacaagaaaaatgttaaaatcctattatgttcaaccgctgatgattttcagaatttacatctttaatttttattaacattaggaawgttttgcctatactgtttagcttaattaaagtgtaatggaaatgtaagaatctgacagcacttattaatatctgtttagcaattatacacttgaagttta

SEQ ID NO: 41386 - DNA, 201 bp, Homo sapiens
tcatcccttacttaaattactgcaggcttcccaacagatcttcctgcttctacccttgaacctccctgcatacacacacacaatttagtcttaatacagcyagctgccaggatgatccttttaaaactaagtcagaggtctctctaccctgttcaaatcaggcaatggctccccccattctcttagagtaaaaaccaaagt

SEQ ID NO: 41387 - DNA, 201 bp, Homo sapiens
atcaccaaaaaaatttttataagaagtcaaaaacacaaggaactcagttaagcttacacaaaaataccactttcttcctcctacattagaaatcaacaaasttctctaaaagaaagatataaattacaaggtagagaagggggtacatttgttctactaatgtaaaatatcacattagtcaatgcagtctattagtaaata

SEQ ID NO: 41388 - DNA, 201 bp, Homo sapiens
ggtcacaacttttgtatcccctcaaaattcgtacattgaaacctaatctccaatgtgatagtattaagagttggggtcatttgagaggtgatgaatgggcytcacgcccttataagagggccaaaggagattgtttaccccttccaccatgtgagtgcacagctgtaaggcaccgtctgtgaggaataggctctcaccaga

SEQ ID NO: 41389 - DNA, 201 bp, Homo sapiens
tagaactctcacctctgagaactgagctcaaggttcttgctggggcaaaaattgaaatgagcagaatttttttttgtttgtttgtttgcatttctggcctkcctcctttcttagcctcattattaacaagcacactccccacaataaacctacacccacactgccttctctcacacaaggtaaattgttcaccttgtttag

SEQ ID NO: 41390 - DNA, 201 bp, Homo sapiens
gggcttaggatataatttttggtttacactcttcaggttgatgatcaggcaaagcataaacagttcaaatcaaatgcagctggttttacaatttggcccarttacagtcagatttcatctgagggtccaactcttcatgccttctcaactcaactgttagatacctccaacaaaaccatcaaccatctccattgtggattt

SEQ ID NO: 41391 - DNA, 201 bp, Homo sapiens
ctgggtgctttctgtgttagaactctcacctctgagaactgagctcaaggttcttgctggggcaaaaattgaaatgagcagaatttttttttgtttgtttktttgcatttctggcctgcctcctttcttagcctcattattaacaagcacactccccacaataaacctacacccacactgccttctctcacacaaggtaaa

SEQ ID NO: 41392 - DNA, 201 bp, Homo sapiens
ttgtggcttgtacctggctttagcatgttttcattccgcttccactcttacgttgcttctatgtgtgcctctctggctctatgcaggtgcctggatttttkattcttacccctctcattagaactactacagtgttttgagtctaataataataaaagctaacggatgcatatctcggtggtgcccggcacttttgtaagt

SEQ ID NO: 41393 - DNA, 201 bp, Homo sapiens
ccagtaatttttcttttttttcttttttttttttttgagttgaagtctcactcttgtcccccaagctggagtgcaatggtgcgatctccgctccctgcaamctccgcctcccaggttcaagtgattctcctgcctcagcctcccaagtaggtaggactacaggcgcctgccaccacacctggttaatttttctatttttag

SEQ ID NO: 41394 - DNA, 201 bp, Homo sapiens
gtaaagtgtcaaatggtcgatattgacaaaaatatcaatcttttttctcttttgtgcaatatggagagtggtgtgaatcttcggtttcttattgtaagtcwttttctttgaaaaaagagttttataaaactaagacttagaaacttacttgccctggccttgaaaattacctttggaaaaatgcttgtgctttatgggtcc

SEQ ID NO: 41395 - DNA, 201 bp, Homo sapiens
cctccccccagtaatttttcttttttttcttttttttttttttgagttgaagtctcactcttgtcccccaagctggagtgcaatggtgcgatctccgctcsctgcaacctccgcctcccaggttcaagtgattctcctgcctcagcctcccaagtaggtaggactacaggcgcctgccaccacacctggttaatttttcta

SEQ ID NO: 41396 - DNA, 201 bp, Homo sapiens
ctatttctcaacaatagtgttgctattcattctatataactctttcctccccccagtaatttttcttttttttcttttttttttttttgagttgaagtctyactcttgtcccccaagctggagtgcaatggtgcgatctccgctccctgcaacctccgcctcccaggttcaagtgattctcctgcctcagcctcccaagta

SEQ ID NO: 41397 - DNA, 201 bp, Homo sapiens
tgcctcccgggttcaagcaattctcctgcctcagcctcccgagtagctgggattacaggcatgtgccaccatacctggctaattctgtatttttagtagasacggggtttccccatgttggtcaggcttgtcttaactctcaacctcaggtgatccgcccaccacggcctcacatagtgctgggttgacaggtgtgagcca

SEQ ID NO: 41398 - DNA, 201 bp, Homo sapiens
ggttcaaacgattcccctgcctcagcctcctcaatagctgggattacaggccacaccatcatgtccagccaattttttttttttttttttttgagacagartttcgctctcgttgcccaagctgtagtgcaatggtgcaatctcggctcactgcaatctctgcctcccgggttcaagcaattctcctgcctcagcctcccg

SEQ ID NO: 41399 - DNA, 201 bp, Homo sapiens
ccacccacctcggcctcccaaagttctgggattacaggcatgcaccaccgtgcccggcctgctaattggttttttaactaaagaaataatttatggagaaycaaacataaaaaggtataagacaaaaagaaaaagtcaaatggtgtcaaagaatggtgtcccagactcccaagcaggaatccttgcagaaattttccatgt

SEQ ID NO: 41400 - DNA, 201 bp, Homo sapiens
ttagtagagatggggtttcaccatcttggccaggctggtcttgaactcctgacctcgtgatccacccgcctccgcctcccaaagtgctgggattacaggcrtgagccaccacgcccggccaagaagctgtatttttttttttttttttttttgagacagagtctcactcttgttccccaggctggagtgcaatggcacgat

SEQ ID NO: 41401 - DNA, 201 bp, Homo sapiens
aaaaacttaatttttgcataattacaacttattacttaagaatgagagatttcaatttaaactgatgttttaatacatatttcatattcctataaatatacatcttttctgagaaggagtcttgctctgttgcccaggctggcatgcagtggcgcaatcttggctcactgcaacctctgcctcccaggttcaagcgattct

SEQ ID NO: 41402 - DNA, 201 bp, Homo sapiens
cctcagcctcccgaagtgctgggattacaggcgtgagccaccgtgcctggctccaagaacagtttaaagagcagtcagtggtttttttttttttttttttttagaaggagtttcactcttgtccaggctggagtgcaatggagtgaactcggctcaccacaacctccgcctcccgggttcaagcaattctcttgcctcagc

SEQ ID NO: 41403 - DNA, 201 bp, Homo sapiens
attttaaaaacttaatttttgcataattacaacttattacttaagaatgagagatttcaatttaaactgatgttttaatacatatttcatattcctataaatatacatcttttctgagaaggagtcttgctctgttgcccaggctggcatgcagtggcgcaatcttggctcactgcaacctctgcctcccaggttcaagcg

SEQ ID NO: 41404 - DNA, 201 bp, Homo sapiens
ggggtttcaccgtgttagccaggatggtctcgatctcctgaccttgtgatccacccgcctcagcctcccgaagtgctgggattacaggcgtgagccaccgygcctggctccaagaacagtttaaagagcagtcagtggtttttttttttttttttttttagaaggagtttcactcttgtccaggctggagtgcaatggagt

SEQ ID NO: 41405 - DNA, 201 bp, Homo sapiens
gattttaaaaacttaatttttgcataattacaacttattacttaagaatgagagatttcaatttaaactgatgttttaatacatatttcatattcctataaatatacatcttttctgagaaggagtcttgctctgttgcccaggctggcatgcagtggcgcaatcttggctcactgcaacctctgcctcccaggttcaagc

SEQ ID NO: 41406 - DNA, 201 bp, Homo sapiens
tggcgcaatctcggctcacttcaagctccacctcccgggttcacgccattctcctgcctcagcctccagagtagctgggactacaatcgcctgccaccacrcccggctaattttttgtatttttagtagagacggggtttcaccgtgttagccaggatggtctcgatctcctgaccttgtgatccacccgcctcagcctcc

SEQ ID NO: 41407 - DNA, 201 bp, Homo sapiens
gggtttcatcatgttggccaggctggtctccaactcttgatctcaagtgacccatccacctaggcctcccaaagtgctaggattacaggcatgagccaccrtgcccagcccatcataaatctttaaggatctttcctaaatatgacaatgcagactgtttattgccattcattaggaagcttaataattggcaaaaaaagt

SEQ ID NO: 41408 - DNA, 201 bp, Homo sapiens
gtggcgcaatctcggctcacttcaagctccacctcccgggttcacgccattctcctgcctcagcctccagagtagctgggactacaatcgcctgccaccayacccggctaattttttgtatttttagtagagacggggtttcaccgtgttagccaggatggtctcgatctcctgaccttgtgatccacccgcctcagcctc

SEQ ID NO: 41409 - DNA, 201 bp, Homo sapiens
ttctttcagagagcatacattctggtagaagagtacttagtcctgggcctggcagatttatttctttcaggacccaaggcctctgctgcaaacatgttccrccagatctttggtcagaataagaagcatatgagcttgatcattgttatggtcacaacttttgtatcccctcaaaattcgtacattgaaacctaatctcca

SEQ ID NO: 41410 - DNA, 201 bp, Homo sapiens
ataagtagcaaactgatgtttgaatctaagtttaaaacaatgtttcttctttaaattttttttttttttttgagacagagtcttgctcttgtcgcccaggrtggagtgcaggcgtgagccaccacacccggcccttctttaaatttttaaatgtaattaattgatactacaactagtcagtgaaagtttgataaggagcat

SEQ ID NO: 41411 - DNA, 201 bp, Homo sapiens
ctggccaaaagaagagaatcttggtgatgacttttggggatgagagatgggggaacaacctatacttctcattttaaacacaagttttacctctaacttaraatttactgctgggaaaaaaaaacaggaaaataaccaagtctaagaatttggattcccaggaaatgaaaaattacataagcatcctgtacttaaaattta

SEQ ID NO: 41412 - DNA, 201 bp, Homo sapiens
tattatctacaatctacacatgaggaaactgaggctcagagccatctggtgagttgccctaaggtcacacagctgataagtagcaaactgatgtttgaatytaagtttaaaacaatgtttcttctttaaattttttttttttttttgagacagagtcttgctcttgtcgcccaggatggagtgcaggcgtgagccaccaca

SEQ ID NO: 41413 - DNA, 201 bp, Homo sapiens
tgaacccgggaggtgggggttgcagtgagccaagatcacaccaccgcactctagcctgggtgacagagtaaggctccgtctcaaaaaaaaaaaaaaaaaaragaatttagaaatgactggatgcagctattcctactagcactggccaaaagaagagaatcttggtgatgacttttggggatgagagatgggggaacaacc

SEQ ID NO: 41414 - DNA, 201 bp, Homo sapiens
aatatatttgcttaggcaactaaactactatttctaactgaagtccttggctaatgatcattattttctttagattcctctgacttatttaggcaaacatktcatctctgtatttttctactccatacttccatcttctaagagttgagagcattcatttctagaagagaaattgtcagacatccttaaggagagtttatc

SEQ ID NO: 41415 - DNA, 201 bp, Homo sapiens
gatcgcagaaggacgaaaaagtcacactcaaaaatcttgctggagacaacaatataaaatacataggaatttttttgaacaaggacacataatttaaatayatttgcttaggcaactaaactactatttctaactgaagtccttggctaatgatcattattttctttagattcctctgacttatttaggcaaacatttcat

SEQ ID NO: 41416 - DNA, 201 bp, Homo sapiens
gggaaaaaaaacacataccatgttcaccgcatcttgatcaaaagggttccattctatattctgaggatagtgggcgagaactttggatttgaatgttcttytcaaaggactctggtcaaaattttcgcctacaacaaataatacatagttaatatctagaacttttccaaaagcatgtcatagttttctatttattttata

SEQ ID NO: 41417 - DNA, 201 bp, Homo sapiens
tcacttgaggtcaggagttcaacaccagcctggccaatatggtgaaaccctgtctctactaaaaatacaaaagattagctgggcatagtggtgtgcgcctrtaatctcagctactcgggaggctgaggcaggaggattgcctgaacccaggaggtggaggttgcagtgagccaagattgtgccactgcactccagcctggg

SEQ ID NO: 41418 - DNA, 201 bp, Homo sapiens
tcttttgttacctaaaatatatttatgatgtttcattaggacagacataaaaaatagaatccttatattttcatacagtttgcttaaaagttattgaccaygttttcttcctatgaattcttaggtacaacacaggcttaaagataagatctatcaactagaatattacatagtcatggatgccaataagcagattacctc

SEQ ID NO: 41419 - DNA, 201 bp, Homo sapiens
actgacaaaagactggtgggacgaataatgaattcagttttggatatgttgcatttgagatgccagtgaaatattctagctgcaatgttaaggaaacgggsgagaggatgggggtggcgggggcaaaagggtcttccagcaatggtcctccagcaatgaaagccccattcctataattttactgtgagatatggctaggca

SEQ ID NO: 41420 - DNA, 201 bp, Homo sapiens
tttctggaatgttctccctgacctacccactcaccctcaggttttaccacaaatgctatttcctcacatccaccttccctgacccagccaggccccccatsatgagcctcgcagaacctcatctcccctccacagaggtgatcataacccacagaacccagggccacgatccctggctttgaaccctggctctgccactca

SEQ ID NO: 41421 - DNA, 201 bp, Homo sapiens
agagggtgagtaagtgagaactttcagggtgatgtgtacattgttggacttggcaagtaggtggatggttgtaccattcactgacaaaagactggtgggaygaataatgaattcagttttggatatgttgcatttgagatgccagtgaaatattctagctgcaatgttaaggaaacgggggagaggatgggggtggcgggg

SEQ ID NO: 41422 - DNA, 201 bp, Homo sapiens
gcttccttctttctggaatgttctccctgacctacccactcaccctcaggttttaccacaaatgctatttcctcacatccaccttccctgacccagccagrccccccatgatgagcctcgcagaacctcatctcccctccacagaggtgatcataacccacagaacccagggccacgatccctggctttgaaccctggctc

SEQ ID NO: 41423 - DNA, 201 bp, Homo sapiens
ttaactaaagaaataatttatggagaaccaaacataaaaaggtataagacaaaaagaaaaagtcaaatggtgtcaaagaatggtgtcccagactcccaagyaggaatccttgcagaaattttccatgtttatacaataaccaccataaacattgaacatttactatgtgtcaagtactctcctaaacactttatatgcatt

SEQ ID NO: 41424 - DNA, 201 bp, Homo sapiens
aatggtgtcaaagaatggtgtcccagactcccaagcaggaatccttgcagaaattttccatgtttatacaataaccaccataaacattgaacatttactaygtgtcaagtactctcctaaacactttatatgcattaattcagcagaaagcaaattttttatgttaaagttacatagcaaatattttaggctttgtagagc

SEQ ID NO: 41425 - DNA, 201 bp, Homo sapiens
gaccatagaaccatttcgcccctttccccttcccgggctccctgataatcttaaactctgattggccagtattctgggactttagctccgccctcgttccrtcagctccaatcactatcgaggttgtcgtttcgccttttctggttgcctttctttcaatggggtcccagagtcccgcttccagggcctctcggctcgcgc

SEQ ID NO: 41426 - DNA, 201 bp, Homo sapiens
ccaaaatactgagattacaggtgtgagccactgcttccggttaatcttcaactatatatatatatatatatatacacatacatatatatatatatacatayacatatatttatttattgagatggagtcttgctcttgtcgcccaggctggagtgcagtggtgccgtcttggctcactgcaacctcctcctcccaggttca

SEQ ID NO: 41427 - DNA, 201 bp, Homo sapiens
gagtgtggtggcacaggcctgtaatcccaactactcaggaggctgaggcaggagaatcgtttgaacccagtaggtggtggttgtggtgagccaagatggckccattacactccagcctgggcaacaagaatgaaacagtgtcccccactcaaaaaaaaaaaaaaaaagatcagcaacaacataaaaccaccaagggctaga

SEQ ID NO: 41428 - DNA, 201 bp, Homo sapiens
ggcctcccaaaatactgagattacaggtgtgagccactgcttccggttaatcttcaactatatatatatatatatatatacacatacatatatatatatayacatatacatatatttatttattgagatggagtcttgctcttgtcgcccaggctggagtgcagtggtgccgtcttggctcactgcaacctcctcctccca

SEQ ID NO: 41429 - DNA, 201 bp, Homo sapiens
ttatttatttttattttttatttttattttttgagacggagtctggctctgttgcccaggctggagagcagtggcgcaatctcggctcacttcaagctccrcctcccgggttcacgccattctcctgcctcagcctccagagtagctgggactacaatcgcctgccaccacacccggctaattttttgtatttttagtaga

SEQ ID NO: 41430 - DNA, 201 bp, Homo sapiens
ggcaacaagaatgaaacagtgtcccccactcaaaaaaaaaaaaaaaaagatcagcaacaacataaaaccaccaagggctagagggacaaattgaggagccrgtgtgaccagaggctagaagctgggtgggaagggctgtcctgcctggtgggagctgggtcatatatgagacagatgcagccgctgctgggaagaccccca

SEQ ID NO: 41431 - DNA, 201 bp, Homo sapiens
gtgatctgcctgccttggcctcccaaaatactgagattacaggtgtgagccactgcttccggttaatcttcaactatatatatatatatatatatacacayacatatatatatatatacatatacatatatttatttattgagatggagtcttgctcttgtcgcccaggctggagtgcagtggtgccgtcttggctcactg

SEQ ID NO: 41432 - DNA, 201 bp, Homo sapiens
aaagatgggctctgaaattggaaccaggaaaagtttcttataagaatttccttccaagaacagcttatttatttttattttttatttttattttttgagayggagtctggctctgttgcccaggctggagagcagtggcgcaatctcggctcacttcaagctccacctcccgggttcacgccattctcctgcctcagcctc

SEQ ID NO: 41433 - DNA, 201 bp, Homo sapiens
aaaggggcttaggaactgtagtttgcagggctcagcctctgtgggacagagcagagcagaagggtagggaatgggttggaaagcaaacaggaaatgactgrtgtaaagaatattgtgttttacattttgaaatactatgcagccataaaaaagaatgagttcaatgtcctttgcagggacatggatgaagctggaaaccat

SEQ ID NO: 41434 - DNA, 201 bp, Homo sapiens
ggcctcaagtgatctgcctgccttggcctcccaaaatactgagattacaggtgtgagccactgcttccggttaatcttcaactatatatatatatatatayatacacatacatatatatatatatacatatacatatatttatttattgagatggagtcttgctcttgtcgcccaggctggagtgcagtggtgccgtcttg

SEQ ID NO: 41435 - DNA, 201 bp, Homo sapiens
gtgcccggcccaatgctcccttttatggaaccttagttccaggcctcaggttcagctttttcctattgtgaaaacccaaggccaaaacttccgtcccctgmaaggctcttagtcccctaggctttcgggttcctggcaatgactttgcctcttgggcagcatggtcttacaagttagttacttgtgtttaagttttgggtt

SEQ ID NO: 41436 - DNA, 201 bp, Homo sapiens
ttcagtactaattcacccaatcctttaaaacctatcccttctgggccgggtgcggtggctcatgcctgcaatcccagcactttgggaggcagaggcaggcrgatcacgaggtcaggagatcgacgtcaacctggctaacacagtgaaaccccgtctctactaaaaatacaaaaaattagctgggcgtggtggtgggcacct

SEQ ID NO: 41437 - DNA, 201 bp, Homo sapiens
cggaaaactaaacaccgcatattctcactcataagtgggagttgaacaatgagaacacaagaacacagggaggggaacatcacaccctggagcctgtcagrgggtggggggcaaggggaaggagagcattaggacaaatacctaatgcatgcggggcttaaaacctagatgacgggttgttgggtgcagcaaaccaccatg

SEQ ID NO: 41438 - DNA, 201 bp, Homo sapiens
gacggggtttcaccttgttggctaggatggtctcaatatcatgacctcgtgatccgcccgcctcggcctcccaaagtgctgggattacaggtgtgagccaycgtgcccggcccaatgctcccttttatggaaccttagttccaggcctcaggttcagctttttcctattgtgaaaacccaaggccaaaacttccgtcccct

SEQ ID NO: 41439 - DNA, 201 bp, Homo sapiens
ggaaagaagaaagggataacaagtcccaagtaaaagcccaaaacccaacgggaccaacaacattagattttaaggcctgagagccatcttctttgactccrtgacagaccatctggacacaatgggtgagggttggactctcaaagctcctggtggccctacccccatggctttgctgggtgcagctgtcatgggttggag

SEQ ID NO: 41440 - DNA, 201 bp, Homo sapiens
ttgaaagaccatccttttcccactacattacagcatgttgcttttatcataaataaggtagccatacatgggagagtttattcctggattctgttttgtcycattgtttacttcgcctatccttcaacaatatctcacacacacacacacacacacacacacacacacactatagttttattatagttcttgattttgggt

SEQ ID NO: 41441 - DNA, 201 bp, Homo sapiens
aatgcatgcggggcttaaaacctagatgacgggttgttgggtgcagcaaaccaccatggcacatgtatacctatgtaacaaacctgcacgttcagcacatrtatcccagaacttaaagtataaaaaaaaaaaatgccaaattgcccaccaatgcagctacaaagatttatagttccaagtatgtctattttccagcaaatt

SEQ ID NO: 41442 - DNA, 201 bp, Homo sapiens
ttttttttttttttttttttaaagagacgggattgcttggcacgggggctcacgcctgtaatcccagcactttgggagaccgagggggaggatcgcttgascccaggagtttgagaccggcctgggaacatttcaaaaccccgtctctgcaaaaaatgaccccttgtggactgaagtgggaggatcgcttgcgctcaggag

SEQ ID NO: 41443 - DNA, 201 bp, Homo sapiens
ttgttgggtgcagcaaaccaccatggcacatgtatacctatgtaacaaacctgcacgttcagcacatgtatcccagaacttaaagtataaaaaaaaaaaawgccaaattgcccaccaatgcagctacaaagatttatagttccaagtatgtctattttccagcaaattccccagcaccatggagatttatccatctaagtt

SEQ ID NO: 41444 - DNA, 201 bp, Homo sapiens
ttttgtacttttagtagagacggagtttcaccatgttggccaggcatttttttttttttttttttttaaagagacgggattgcttggcacgggggctcacscctgtaatcccagcactttgggagaccgagggggaggatcgcttgagcccaggagtttgagaccggcctgggaacatttcaaaaccccgtctctgcaaaa

SEQ ID NO: 41445 - DNA, 201 bp, Homo sapiens
ccaagtagctgggattgcaagcatgcgccaccacgcccaactaatttttctgtttttagtagatacgggggtttcaccatgttgcccaggctggtctcgarctcctgatctcaagtgatccgcccgcctcagcctcccaaagtgctgggattacagatgtgagccaccacatccggcctcaaattctttattctatcattt

SEQ ID NO: 41446 - DNA, 201 bp, Homo sapiens
actcgggaggctgaggcaggagaatcccttgaatccgggaggaggaggttgcagtgagccgagatcgcgccattgcactccagcctgggcaacgagcaaawctctgtctcaaaaaaaaaagaaaaaggttgctctaagccaacgtgctactatagtattgttgatttcaacaccatctttttattgaggcaaataaactaa

SEQ ID NO: 41447 - DNA, 201 bp, Homo sapiens
tgatgcttgaggttggaggatacaaggctgcagtgagctgtgatcgtaccactgcactccagcctgggcgacagtgagacccggtctcaaaaaaaaaaaaagaagaagaaaaagctatttttgagtattttataatataatagtagagtagtacatgtatagaatttataagtggacatatcctggagtggagagtcaaaa

SEQ ID NO: 41448 - DNA, 201 bp, Homo sapiens
aggagaatggcatgaacccgggaggtggagcttgcagtgagctgagatcgcaccactgcactccagcctgggcgacagagcaagactccgtctcaaaaaawaataataaataaaataaaataaaaacaaaatcaaagatgagaataaaacctaattggtgaaaatcttacctattaaaagtctattcaattatttgttgtg

SEQ ID NO: 41449 - DNA, 201 bp, Homo sapiens
acatttctaattaacccttaactttgctatctactaacaataccccctcaccatcccacaataaaacaactaaaaattagaggtgtcactgatgatcagaytactactagtaaccagattactttagccaaagcaggcttataatgacaagtgtgtaactttcccagtttgagtcagcaaatgttcttatatttctctaga

SEQ ID NO: 41450 - DNA, 201 bp, Homo sapiens
gctcttccaacaaatcaaaaaaagtaagaactatatatctaatcgggaaacatgaactgcaaaatgctattatttttccatttttaaaagatatacagtaytgttttatatcaggaactacaagatactttctcagaaaacctgagtttcatcagaattgttaaactgtcaggaactacaagaaatctcagaaaacctgaa

SEQ ID NO: 41451 - DNA, 201 bp, Homo sapiens
taagaaaaacccttaggtcaaatacaatctgccacctgatctgtaaatagtttcactgggattcagtcacaaccatccacttatgcactgtctatggatgycttcacactacaacagcagagctgggtgactgtggcagaaactgtatgcccacaatacctcaactacttattatttggttcttcatgaaaaaaattgcca

SEQ ID NO: 41452 - DNA, 201 bp, Homo sapiens
tattttgattaataaggatgtgcttgagcctagttatgatttaaaattctgtccaaaaccacaattacttttgtaccaacctttaaacacgtaagtatggytttgttccaacacaattttatttataaaaacagtcagctggacagatttggcctgggggccatgtatgcccacccctggcctagtcaagtaaaatgcaac

SEQ ID NO: 41453 - DNA, 201 bp, Homo sapiens
aatgctgaaagaactcaagagagaaggagcctcagacaagtagcggctatgtcccaagagcggaagctccccacaacgaggaacacaagataatccgtccrtcagccattcttatccacaccacagtcgcatccccctcaaagctctcccagggtgccagaaattctcgctctgtctagtgtcccgactttccaagcgctt

SEQ ID NO: 41454 - DNA, 201 bp, Homo sapiens
tttccaagagttcatcaaatcccaaagcacggatattttacgttacaggaataaacaaacttatttctcattggcaaaaatgtgttgattgtaatggttcytattttgattaataaggatgtgcttgagcctagttatgatttaaaattctgtccaaaaccacaattacttttgtaccaacctttaaacacgtaagtatgg

SEQ ID NO: 41455 - DNA, 201 bp, Homo sapiens
gttcatcggatagtctcgtttcttagggaccaacttcagatttatatatctgaaggttcctgacacttataatgacatgtgtcggcctaaatatgtttatytgatatttctaaagtcctattatatgtaggtgtcaaataatccttaaatttctacaagctggtctcttggatccagtcttggaaatagctacacttctgt

SEQ ID NO: 41456 - DNA, 201 bp, Homo sapiens
gcagcgggcactggtcaacagaaagggcccaattcttttccacaacaatgcctgaccgcacatcacacaacaaatacttcaaaagtttaacgaattgggcyatgcagtcatgcctcatccaccatgttcacctgacctcttgccaactgaccacttcttcaagcatctcgacaattttttgcagggaaaacgcttccacaa

SEQ ID NO: 41457 - DNA, 201 bp, Homo sapiens
cctcttcagcaacatgaaaagttgctgaagaactcaacgtcgaccattctatggccgtttgacatgtgaagcaaattggaaaggtggaaaaactcggtaastgggtgcctcatgagctgagtggaaattttaaaaaatcgtcatcttggagccaggtgcggtggctcatgcctgttatcctagcactttggaaggctgaag

SEQ ID NO: 41458 - DNA, 201 bp, Homo sapiens
caacatcgacaatgcatttggcccagggactgctaactaacgcacagtgcagtggtggttcaagaagttttgaaaaggagatggcagccttggagatgagragcatagtggctggccatcagaagttgacaatgatcaattgagagtaatcactgaagctgaccctcttcagcaacatgaaaagttgctgaagaactcaac

SEQ ID NO: 41459 - DNA, 201 bp, Homo sapiens
acacaattggtttttgtatttgtaactgtattctgttagtttgccacttattttggcagttgctttttagatttgttaggattttatatttagacaatgartttgtctgctagtttaatatctattttcagacttctggattctgttcatgatggtataactgggactggatttattcttctatcttaaacaactggcaaa

SEQ ID NO: 41460 - DNA, 201 bp, Homo sapiens
atgccaacaagagtcctggagaaaagtgtttctgttataacgtggcatggttagggcctgaagtatacatttgcttatatttgctgtatacctttgtgctktgctctcttaatgatcccccaaaagctcctttcccgccttccccaggccacaatgttgcagaaaaaaagttcaagaattgctaacttgactgtgacttga

SEQ ID NO: 41461 - DNA, 201 bp, Homo sapiens
agtcagtgttttgctctgtcctcaagcctcgagcgcagtggtacaatcacagctcactgctgcctccaccttcagggctcaagcaatcctcccacctcagyctcctgagtagctgagactatgcccagctaattttttattttttgtagagatggggtctcactatgtaacccaggcttgtcttaaactcctgggctcaag

SEQ ID NO: 41462 - DNA, 201 bp, Homo sapiens
aaagctcctttcccgccttccccaggccacaatgttgcagaaaaaaagttcaagaattgctaacttgactgtgacttgaaatgattaaaatgcatgcttasaaaccagtttcttaaaccagtttcttaattcacaaagactagataaaatcacagctgggaataggaaggagatagaagaacaagcagcttgattgcaggg

SEQ ID NO: 41463 - DNA, 201 bp, Homo sapiens
accttagagacatacttctggctattggatgtagactttctttcttttttttttttttttttttttgagtcagtgttttgctctgtcctcaagcctcgagygcagtggtacaatcacagctcactgctgcctccaccttcagggctcaagcaatcctcccacctcagtctcctgagtagctgagactatgcccagctaatt

SEQ ID NO: 41464 - DNA, 201 bp, Homo sapiens
ctcatgaagccaaccatcaggcctcccagatattatcaaggaactgaaacttaccagatcactgcatctggacaatgaggagccagacccctcacccatcrtgattgcctaagcaaccacctgcttcttgttgaccaactcctcccctttacccctccctaattcttgttttcccaaaaatggttacatttcttttctgtt

SEQ ID NO: 41465 - DNA, 201 bp, Homo sapiens
ctgcagcacccaactaaagccttcttccctggcaatacccattgtctcagtgatcaagcagcagtacctagacagaacccctggcatttcggtaacagggygaataaatggatgtgcaaggaaaacctcttcatcttaaataaagggcagatgaacactaagccttaggatggtgccaatgaacacatgttgggttgtttc

SEQ ID NO: 41466 - DNA, 201 bp, Homo sapiens
ataactatggaacaactagagtatttgtgtccactatagtaaatttctctggactctgaatagtgagagctaatcagtgcaaaatcttgctctctggctgkcctttacttatctcttctgacctttgttttgattgcaaactttctttggacagtataaaaatcagtattttaggattagaacccaatcaatatattgagt

SEQ ID NO: 41467 - DNA, 201 bp, Homo sapiens
tcatcacattctatacctaggtaagtactaggagtacttaacaaatatcaaacagctgggtgtggtggctcacacctgtaatcccagcactttgggaggcygaggctggcggatcacttgaggtcaagagttcaagaccagcctggccaatattgtgaaaccccgcctctattaaaaatacaaaaattagccaggcatggt

SEQ ID NO: 41468 - DNA, 201 bp, Homo sapiens
aataaagggcagatgaacactaagccttaggatggtgccaatgaacacatgttgggttgtttccactttttgactattatgaataatgctgttatgaacaytgtatacaagtagaggaaggagtctaaaggcccagggaaacaagaatgatgcatgaatctgttatgaacagcctgccctgccactctgaaagacagtcat

SEQ ID NO: 41469 - DNA, 201 bp, Homo sapiens
gctagaggtgatttgttatacaacaaaggctaactgaaacagacatatcttgagatcatttggctacttgggcaagggctcagaggtgaaaatgttaagarttatcaacttatagtctggtccccagttctcaggcgtgaaaattcaaaattgtgaatgaatccagaattgatgagattccatgaataccaggataaccaa

SEQ ID NO: 41470 - DNA, 201 bp, Homo sapiens
cgggaagtggaggtttcagtgagctgagatcacactattgcactccagccagcctgggcaacaagactgagactccgtctcaaaaaaaaaaaaaaaaaaaaggagtattattacattgctaagctttgcattagttttttggttttttttttgtcaatgttaccatttttcttaggtttatatagattcaaacttcaaagt

SEQ ID NO: 41471 - DNA, 201 bp, Homo sapiens
ctttttgactattatgaataatgctgttatgaacattgtatacaagtagaggaaggagtctaaaggcccagggaaacaagaatgatgcatgaatctgttaygaacagcctgccctgccactctgaaagacagtcatccctggaagagcctggaggacgtcccctatacccaggcattacagatgcaacagtaaggagactt

SEQ ID NO: 41472 - DNA, 201 bp, Homo sapiens
cttgaaaccaggaagcagaagttgcagagagctgagattgtgccactgtgctccagcctgggtgacagagtgagacactgtctccaaaaaaaaaaaaaaaagttataaaaaaaaagaaactgggctttgtttttaacaaaatatacttctaagtttctgtgcttggaaggaaaaatactaatgtgtttacgtcctggggaa

SEQ ID NO: 41473 - DNA, 201 bp, Homo sapiens
ccagttgcaatccttagcttgcagtgacaaggtgtcttagtcagtttgggtttagtcagtcagaataccatagatgggtacttaaacaacgaacatttatygctcaagttctggagactggaagtcctgagattagggtgccagcatggctggtttgcggtaaaggcttgcctcctggttcacagatggctgtcttctcac

SEQ ID NO: 41474 - DNA, 201 bp, Homo sapiens
tgtgagccactgcacctgacctcgaagagggtttcttgatagagtaaacagaagaaattaaaagttaacaattaattgacatgtacttgactggtttcccrgctctaaaccagtggttcccaacctttttggcgccagggacctgtttcatggaagataatgttcccatggctgtcgcaggggctggggagggggaggtgg

SEQ ID NO: 41475 - DNA, 201 bp, Homo sapiens
ttcgtgcctcagcctcctgagtagctgggattacaggcacgtaccaccatgcccagctaatttttgtatttttagtagagacggggtttcaccatgttggmcaggatggtcttcatctcctgacctcatgatccacccgcctcggcctcccaaagtgctgggattacaggcgtgagccaccgcacccagccggattttttt

SEQ ID NO: 41476 - DNA, 201 bp, Homo sapiens
gaaatacttagtgttctttatatagcaggattgtaagtgattatcattttcctctttgtactttggccactatgagcataaatcactttttttttttttttgagacagtttcgctcttattgcccaggctagagtgcaatggcacgatcttggctcaccgcaacctctcgtctcccaggctcaagcgattctcctgcctca

SEQ ID NO: 41477 - DNA, 201 bp, Homo sapiens
tcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttcttttttaaagagggagtcttgctctgtctcccaggctggagtgca

SEQ ID NO: 41478 - DNA, 201 bp, Homo sapiens
gtcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttcttttttaaagagggagtcttgctctgtctcccaggctggagtgc

SEQ ID NO: 41479 - DNA, 201 bp, Homo sapiens
tttccgtcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttcttttttaaagagggagtcttgctctgtctcccaggctgg

SEQ ID NO: 41480 - DNA, 201 bp, Homo sapiens
ggaagggatttccgtcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttcttttttaaagagggagtcttgctctgtctcc

SEQ ID NO: 41481 - DNA, 201 bp, Homo sapiens
cttgtggaagggatttccgtcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttcttttttaaagagggagtcttgctctg

SEQ ID NO: 41482 - DNA, 201 bp, Homo sapiens
acttgtggaagggatttccgtcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttcttttttaaagagggagtcttgctct

SEQ ID NO: 41483 - DNA, 201 bp, Homo sapiens
cttaggaggctctacttggccttaaagggctgtgtgaccttgggtaaattgccttctttgaatctctggtcctttccatttcccattctccaggctaagarctgcactctgatacacggttattcccaataataataaccatccaccccgtgcagtggtcataaaccagagagagaaatgtccacatgaaactatgtgctg

SEQ ID NO: 41484 - DNA, 201 bp, Homo sapiens
gtgccaatcagaaaatctttgaatccacctaggacctggaagcacagttccctgccccctttgagctgtcctgcctttctagacctaaccaacgtgtaccwcaaatgtatcgattaatgtcgtatgtctccctaaaacatgtagattcaaactgtggcccaaccaccttgagcgcatgttctcaggatctcctggggctgt

SEQ ID NO: 41485 - DNA, 201 bp, Homo sapiens
agcacatttaaagggggaggttctaaactggtcacagtcccattgaaaaagcccatgggaaatgaaaagcccacacactcgcccattccattgccacaggmagggggcaggtggaggaggagcggtgggtgctccccacaccactcccaattatcaccgactcctccctttccttcattctccttcccaatctgtcagtgt

SEQ ID NO: 41486 - DNA, 201 bp, Homo sapiens
ttgtggatcttcagtaaaacattccccagaaataagtagggccatttcccagtgtgactataaactggagacaggtaaatattttttttggtggagggggsggctaattgattttggctctgaactgatgctaatccatggagacacaaaataaagtaagatgaaatgaaacaaacgcaacaacaacaaatccagcatagt

SEQ ID NO: 41487 - DNA, 201 bp, Homo sapiens
gctccctgttccaccgcctccaaagacgacatccccattccccatgagaatgtttcctatgaagccaggctggcccttgacctctgcagggctgccactgrccctggcccatcatcatgccagtccctagaggctgatggtgagaagggagcagaaagcgcccactcctgacccagattcgctgcttctcctcccctgcct

SEQ ID NO: 41488 - DNA, 201 bp, Homo sapiens
taaatattttttttggtggaggggggggctaattgattttggctctgaactgatgctaatccatggagacacaaaataaagtaagatgaaatgaaacaaaygcaacaacaacaaatccagcatagtccaccactcagagtagaagtttacagaacccaggtgatagatggaaccttgaccagagtcagtttcccagtgtgt

SEQ ID NO: 41489 - DNA, 201 bp, Homo sapiens
ctcagcattggctattattgcctgcaagacggggagtagtgaggggcttcaggcactcaggaaacccagaactcccacaagtgggcagggcaaagtaggcraaatttcagggaggaggcggtctagagcagatcacctggagagggaagctccaggcttaggagacagacactctgcaagagaacgccacggaggacgaaa

SEQ ID NO: 41490 - DNA, 201 bp, Homo sapiens
acctcgaaggtgaaaaggagctggtgatgtctggtgctcctgtcctggctgacacagctaggtcctcagcattggctattattgcctgcaagacggggagyagtgaggggcttcaggcactcaggaaacccagaactcccacaagtgggcagggcaaagtaggcgaaatttcagggaggaggcggtctagagcagatcacc

SEQ ID NO: 41491 - DNA, 201 bp, Homo sapiens
aatggcgtgatggagccattcagtggttacttctctagtctcagaatgaatggtgggaaaaggtatatttagcaactgttctttgattgatgaagcgaggragggctattatattaagaacattcaagtgaaagcctctgaaaatcctcagatcaccaaaatagtgttcccaaagtaactctgcaatctgggggaaattca

SEQ ID NO: 41492 - DNA, 201 bp, Homo sapiens
ggaacttgtggaagggatttccgtcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttcttttttaaagagggagtcttgc

SEQ ID NO: 41493 - DNA, 201 bp, Homo sapiens
aagcctctgaaaatcctcagatcaccaaaatagtgttcccaaagtaactctgcaatctgggggaaattcagtggcgacagttgtgcaacggtgagtgtacrtaatgccaccgaatgttacacttaaaaacggttaaaaaaggccgggcacggtggctcacgcctgtaatcccagcactttgggaggctgaggcgggcggat

SEQ ID NO: 41494 - DNA, 201 bp, Homo sapiens
gggaacttgtggaagggatttccgtcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttcttttttaaagagggagtcttg

SEQ ID NO: 41495 - DNA, 201 bp, Homo sapiens
aaaaacggttaaaaaaggccgggcacggtggctcacgcctgtaatcccagcactttgggaggctgaggcgggcggatcacgaggtcaggagatcgagaccwtcctggctaacacagtgaaaccccgtctctattaaaaatacaaaaaattggctgggcgcggtggctcacgcctgtaatcccagcactttgggaggccaag

SEQ ID NO: 41496 - DNA, 201 bp, Homo sapiens
gaatcgatgggaacttgtggaagggatttccgtcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttcttttttaaagagg

SEQ ID NO: 41497 - DNA, 201 bp, Homo sapiens
gggcggatcacgaggtcaggagatcgagaccatcctggctaacacagtgaaaccccgtctctattaaaaatacaaaaaattggctgggcgcggtggctcaygcctgtaatcccagcactttgggaggccaagacgggtggatcacgaggtcaagagttcgagaccatcctggctaacacggtgaaaccccgtctctactaa

SEQ ID NO: 41498 - DNA, 201 bp, Homo sapiens
gagaaagagagcagaatcgatgggaacttgtggaagggatttccgtcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttc

SEQ ID NO: 41499 - DNA, 201 bp, Homo sapiens
tgggaatgggaggttgcagtgagccaagatggcgtcactgcactccagcctgggcaacacagcgagagtctgtctcaaaaaaaaaaaaaaaaaaaaaaaaattagcaattacacctcctacggaatgtggtacaggcaaggcctttttagagggcatcagccttcaccaccctactcccagagcttctctccaagcccagc

SEQ ID NO: 41500 - DNA, 201 bp, Homo sapiens
gagaatcgcttgaactcgggaggcggaggctgcagtgagctgagatggagccactgcacaccagcctgggcaaaacaacgagactccatctaaaaaaaaaaggggggggggtgaaatataaaactcttccttatacctccaagcccaagcaggtagggggaattcttagagcaaattagacttccacaggcaaattcttta

SEQ ID NO: 41501 - DNA, 201 bp, Homo sapiens
acaggcgtgcgccaccgcgcccaggcttattttccaatttataaatgaggccgggcacggtggctcgtgtgtgtaatctcagcactttgagaggccgaggygggcagatcacttgaagtcaggagttcgagaccagcctggccaaaatggtgaaagtccgtctctactaaaaatacaaaaaattagccggacgcggtggtg

SEQ ID NO: 41502 - DNA, 201 bp, Homo sapiens
ccaacactttgggaggctgaggcgggtggatcacaaggtcaggagttcgagactgtcatggctaacacagtgaaaccccgtctctactaaaaaaaaaaaaatacaaaaaattagccaggtgttgtggcatgtgcctgtagtcccagctactcgggaggctgagacaggagaatcacttgaacccggaaggtggaggtggca

SEQ ID NO: 41503 - DNA, 201 bp, Homo sapiens
cctttatcaaaaagagtattggggccaggtgcagcggctcacgcctgtaatcccaacactttgggaggctgaggcgggtggatcacaaggtcaggagttcragactgtcatggctaacacagtgaaaccccgtctctactaaaaaaaaaaaaatacaaaaaattagccaggtgttgtggcatgtgcctgtagtcccagcta

SEQ ID NO: 41504 - DNA, 201 bp, Homo sapiens
cttcctttatcaaaaagagtattggggccaggtgcagcggctcacgcctgtaatcccaacactttgggaggctgaggcgggtggatcacaaggtcaggagwtcgagactgtcatggctaacacagtgaaaccccgtctctactaaaaaaaaaaaaatacaaaaaattagccaggtgttgtggcatgtgcctgtagtcccag

SEQ ID NO: 41505 - DNA, 201 bp, Homo sapiens
aggctgaggcaggagaatcacttgaacccaggaggcagaggttgcagtgagccgagcacgcaccactgcactccagcctgggtaacaagagtgaaactctmtctcaaaaaaagaaaagaaattacccaaactgcctgctcaacaccattgctaatgaaaaagcctgccttggtctctccttccctgatcttagcttttctt

SEQ ID NO: 41506 - DNA, 201 bp, Homo sapiens
cctttggggtggtcatgttttgggggaaaccagagagaacctgaagtgaggaaacagcttggggatgaaggtgctgtacagacaccgggccagtcccgccrgctactcatgtttactatgcacagccagcacacccatgggcgaaagaccttcggtgccccctgctcctaagagctaagcactaaatagtgcatccgctgc

SEQ ID NO: 41507 - DNA, 201 bp, Homo sapiens
cagacagaccactagatgtcactgccctatcactgtcctttgctcaaatgtggaagcacgagaggttagatgttatgcatgtcctcccttctttttttttyttttttttttttgccaacatggcaaaaccccgtctctactaacagtacaaaaattagccgggtgtggtggcaggcgcctgaaatcccagctacttgggaa

SEQ ID NO: 41508 - DNA, 201 bp, Homo sapiens
aagggacaaatcagggtgccctcaggtctaatgccagccatgtcctgccatactgggtgcctgcggaacccacatacccctctccaggctgagaagatggmcacctgacctcctttgggaggtcattcctttggggtggtcatgttttgggggaaaccagagagaacctgaagtgaggaaacagcttggggatgaaggtgc

SEQ ID NO: 41509 - DNA, 201 bp, Homo sapiens
caacctcaggtgatccgtcagcttcagcctcccaaagtgttgggattacaggtgtgagccaccgcacctggctgtaccttcatttttcaactgccatgcaraaaaaggaggggttgtaaagggagtagtctctgatatccagtcagcaatcggccttaggttccctgcctctagaccctattttcctgcctcaaatctaga

SEQ ID NO: 41510 - DNA, 201 bp, Homo sapiens
tgtctctaattctcaattttctcttatttctttgaccctcttaaaaatgtttgaagcagaggccaggcattcgagaccagcctggccaacatggtgaaackccatctctactaaaaatacaaaaatgtggcgggtgcctgtaatcccagctactcgggaggctgaggcaggagaattgcttgaacctgggaggcggacgtt

SEQ ID NO: 41511 - DNA, 201 bp, Homo sapiens
tcactctgaaaagcacgatgtgctccaagtgaaggtggcctctttctgtgatgtttttgctaaagccctaccttgccttgttctataatcaagagaaagtkaattacagtgttacttttggggtttgtggtaactctaaggtatcacagaaacttaaccaaatgctcttgagctttggttagtgaatttctattaaaaaaa

SEQ ID NO: 41512 - DNA, 201 bp, Homo sapiens
ttctttgaaccagatgagacttcgctcagagctggaggctatggccccttagttctgtttccacagtgcttccagccctctccccagtttggaggcccccraaatgaggcgcttatctctttgattttgtgaaagaaaatgcacagttcgtctatttggggcttctgaaagatgttaggccctgaagaaggttgactggga

SEQ ID NO: 41513 - DNA, 201 bp, Homo sapiens
tacctcagtcacattctagtaagaaaccattcctccctgtgggaattagagccctgcccccagaaccctggctctgaggtttgacttctgttatgtactgrcagtccccattacgctcatggttccatggtgccagcacaggagtggctgatgacagaggctgacatgtcatgcacatcattctgtctatctcattgttta

SEQ ID NO: 41514 - DNA, 201 bp, Homo sapiens
atctaaccctttgctctataatcaagtcacaacagtaaaatcaggagctttcgaatctggttgtaactaattttatgactcaggtgttatcaactaatgtktgtgcatctcagcttgttaaatgggcataaaacatgcccccctacctccccaaaaggctataggatcactctgaaaagcacgatgtgctccaagtgaagg

SEQ ID NO: 41515 - DNA, 201 bp, Homo sapiens
gagatgaggtcagtccaacctgagcatccctttgtctgctggcctcttctggggcccagactggttgcacttgcttgcagtgcagcccccaagtacctccygggagccttcattatagctcctgagctggtggacttcacctgaccaatacagtgctccaacagagcagccctcatggacatgtactagcctgcccgttcc

SEQ ID NO: 41516 - DNA, 201 bp, Homo sapiens
ttgctgaacaaatcttatttcagcaaatgacaaaataagatttgttcagcacatctcatgtgagtgctcacatagcgtgggctctgtggtcagacaaacastgggcacttctcttggtgttatcaccttaagctgtgtgccttggggaaagttactcaatttctcattccctccatttcctcgtgcacaaaatggcagaaa

SEQ ID NO: 41517 - DNA, 201 bp, Homo sapiens
tagctcaaggaaagggcattagagttaaaatggagggaaaaaatatctactaatcagaatattctactggccacagtctctgaccttctggcaattaaaawtttaaagttaaagattacttaaaattggctgggtgtggtggctcacgcctgtaatcccagcactttgtgaggccgaggtgggtggatcacaaggtcagga

SEQ ID NO: 41518 - DNA, 201 bp, Homo sapiens
tggagtgcagtggcgtgatcttggctcactggcacctccacctcctgggttcaagcaattcttctgcctcagccacccgagtagctgggattacaggtgtstgccaccacacccagctaatttttgtatttttagtagagacagggtttcaccatgttggccaggctgcccttgaactcctgacctccagtgatctgcctg

SEQ ID NO: 41519 - DNA, 201 bp, Homo sapiens
caacagcactaatttcggttagaaataataatgataggtcaggcgtggtggcgcaggcctgtaatcccagcactttgggaggccaaggccggtggatcacraggtcaagagatcgagaccaccttggccaacatggtgaaaccccgtctctactaaaaatacaaaaattagctgggcatggtgatgtgcgcctgtaatctc

SEQ ID NO: 41520 - DNA, 201 bp, Homo sapiens
tgaaattaaataattaaataattaataattaatgacaggattgttttcttttaattaggtaacataatttcctcatttatgatttttcactttttttttttaattttcattattttctaccatttctctgcttgggagtacgagcctgaattcaaagtgaaataacaggtacaaatgaatacagattaagagggaaacctc

SEQ ID NO: 41521 - DNA, 201 bp, Homo sapiens
tgattgaaagtttcctgaggcctccccagcatgcttcctgtacagcctgtggaaccgtgagccaattaagcctcttttatttaaaaattacccagtttccrgtggcacacacctgtaatcccagaactttgggaagctgaggtgggtggatcacctgaggtcaggagttcaaggccagcctgaccaacatggaaaaacccc

SEQ ID NO: 41522 - DNA, 201 bp, Homo sapiens
aggctgaggcgggaggatggcttgaacccagaacttcaagaccagcctggggaacacagggagacctccacccccgacctctaccaaatttttttttttttaaattagccaggtataatggcacatggctgtagtcccagctatttgggaagctgaggttggagggtcacttgagctcgggaggtcaagactgcagcaagc

SEQ ID NO: 41523 - DNA, 201 bp, Homo sapiens
cttttatttaaaaattacccagtttccggtggcacacacctgtaatcccagaactttgggaagctgaggtgggtggatcacctgaggtcaggagttcaagrccagcctgaccaacatggaaaaaccccgtctctactaaaaatacaaaattagccaggcatagtggcgcatgcctgtaatcccagctacttgggatgctga

SEQ ID NO: 41524 - DNA, 201 bp, Homo sapiens
ccccacctctactaaagatacaaaaattagccgggtatagtggcacactcctgtgatcccagctactagggagactgaggcaggagaattgtttgaacccrggaggcgaaggttgcagtgagctgagatcgaatcactgcactccagcctgggcgaccgagaaagactgtgtctcaaaaaaaaaaaaaaaaagtccttgat

SEQ ID NO: 41525 - DNA, 201 bp, Homo sapiens
cacagataaaaaatatttggaaactaaaaattccaccctgcgcttctggacctcagcaccagccccagggctgctctaggggccacatggctgaagggagygcaaggagctaccagaggcagaatgaagagactgaagcaatgacagccacttattttgaggaattacgtgtcattgatgactatgccaaaacattttgta

SEQ ID NO: 41526 - DNA, 201 bp, Homo sapiens
taaggagaaggcacttcactgggaaagctggaagatgggggtgcttacagcagaggagcaggaggaaggaagaaagaaagagcaaataacccgggccacaraaagccaagagttttggctgttgcagtccacagtattatcttgttcctagtattagcttgctcctagttccacaacatcaacaatggagcatgaaaatgt

SEQ ID NO: 41527 - DNA, 201 bp, Homo sapiens
tgtccgggtgttcaagaccagcccaggcaacataatgagaccctgtctctataaaaaattaaaatatcagccaggtgtggtagcatgtgcctgtggtcccrgctacttgagaggctgaggcaggaggatcatttgagccttggagtttaagggtgaaacaagccagaatcgcaccattgcacaccagcctgggtgacacag

SEQ ID NO: 41528 - DNA, 201 bp, Homo sapiens
tgggttcaagcgattcgccgacctcagtacctgggattacaggcagctgccaccacgccccgctaatttttgtatttttagtagagacggggtttcaccaygttggccaggctggtcttgaactcctgacgtcaggtaatccgcccaccttggcctcccaaagtgctggatttataggcatgagccactgcgcccagccca

SEQ ID NO: 41529 - DNA, 201 bp, Homo sapiens
gcccaggctggagtgcaatggcacgatctgggctcactgcaacctcagcttcctgggttcaagcgattcgccgacctcagtacctgggattacaggcagcygccaccacgccccgctaatttttgtatttttagtagagacggggtttcaccatgttggccaggctggtcttgaactcctgacgtcaggtaatccgcccac

SEQ ID NO: 41530 - DNA, 201 bp, Homo sapiens
aagaaaacataaaaagccattaccgggagaatagaatgcattgttctgaatctaaatgacaaagcaatctttgtttgtttgtttgtttgtttgtttgttttgagacagagttttgctcttgttgcccaggctggagtgcaatggcacgatctgggctcactgcaacctcagcttcctgggttcaagcgattcgccgacctc

SEQ ID NO: 41531 - DNA, 201 bp, Homo sapiens
gaaaatcagtgcgcagttgagtcagaaagcttataattgaatttgcttagctaagtatcttagcaactcagttcacgtcagcggaactttgttgaagggtrtattttcatcatttcttgccagatttttaaagcatgacatgttgtgttactaaaactaagtaattcttccagggggaggaagcagtagtgtctattatat

SEQ ID NO: 41532 - DNA, 201 bp, Homo sapiens
ctggagtgcagtggcacaatctcggctcaccacaacctccgcctcccaggttcaagcgattatcctgcctcagcctcccaagtagctgggattacaggatrcccggctaattttgtatttttagtagatatggggtttctccatgttggtcaggctggtctcgaactcccgacctcaggttatccacccgcctcagcctcc

SEQ ID NO: 41533 - DNA, 201 bp, Homo sapiens
ggctcccatcatcaatgcctttccccagccaccgcccacatgggaatctggtaggacagaaaacaagttttttattttttatttttttgagacagggttcycgctcagccccctgagtagttgagactacaggtgtgcaccaccacacctggctaatttttgtgttttttatagagaggtctcattacattgcccaggctg

SEQ ID NO: 41534 - DNA, 201 bp, Homo sapiens
tatgagagatgctccacaaacggtggctgtgatggcagtggggtcaccaccacatgatggctgagcccagcagacaataagacatggaaatcaaccactgygcagccactcgcaacaaggaagaaggtggaaaagctcatgagaaacaaacatccttatgacaggcttgcagggacgcctctgtattcagttatttttttc

SEQ ID NO: 41535 - DNA, 201 bp, Homo sapiens
ctagatggagtgcgtgattctggtatggcctcatgtggacctgcgaaggatggagagaacatggtctctgcttcccagaaaaaaaggagaaatttggtaayaagtgtggagactgctcttaaataatgctccagatttcaagccacttcttcctggaccatgagagagctccctaatgttgtatttatttttcctaggtcc

SEQ ID NO: 41536 - DNA, 201 bp, Homo sapiens
tttaatatgtgtgttggtcatttgatatgctattattttaaagtaataaatatagggtccagacctatggggcttagcgggtgttctctccgtgtgtggaracgagagatctaagaaataaagacacaagacaaagagataaagagaagacagctgggcccgggggaccactaccaccaagacgcagagaccagtaatggc

SEQ ID NO: 41537 - DNA, 201 bp, Homo sapiens
gtcccccaggctggagtgcagtggcgcgatctcagctcactgcaagctccccctcccaggttcacgccattctcaaagagcttagtttaagctcaattcargtgactatttgaggcctggtcaggatatctgctgttatttggaacacaagctgtttgcccaggactaagatcaagtgattttcctaaagcaaacagtgta

SEQ ID NO: 41538 - DNA, 201 bp, Homo sapiens
acctatggctggggaagcttggaataaccctgatgtccaagctatgcccttagatcaagggatttaaattgtggtcttggggctagtagtgccagtatcamttgggatcctcttaaaaatacaagttcttccatggtgtatatgtgtcacattttcttaatccagtctatcatttttggacaccgtggaatactatgcagc

SEQ ID NO: 41539 - DNA, 201 bp, Homo sapiens
acatgttagctgaataaccttaggcaagtaaattatcctctctgggcctcgatcttgttagctattaagtgggaataatgacaattcctaactcaagggtstgttgtgaggattaaatgagtccttacatgtgacatacttgaaatagtacctggtgcagagttagggctgggtgagtgttagctattatattattatttc

SEQ ID NO: 41540 - DNA, 201 bp, Homo sapiens
tctatataatgatgctatagaataaaggaggaaaggaattgaaaaagaaaagtaagaacatctttgtcaggtgcaagtaacagaatacctaaacagacttytaaaaaatcaaacatttataatctcatttggcacaaatcctgagaatggaggactggcattggttcagcagctcatgcatgccatcaaacagtttcctaa

SEQ ID NO: 41541 - DNA, 201 bp, Homo sapiens
aactacaattactcaacctgactttaaaatattaacatattaagaatttggtttgtgtgtaaaacattcattcctttccttgtaaggtagttacagagaargacaaaggccttggagcctcatggtgagtgtttggatcttggttctaccacttctcagatgatcaaccttggatgagttatttgaattccctgtgcttcc

SEQ ID NO: 41542 - DNA, 201 bp, Homo sapiens
gctgggattacaggcgtgagccactgcgcctggccaatagctgactcttaataaaggacgaagatagcactccttctcagctgtctgcagttctttatatwttggttaactctcatggcttcaattaccacctgtgcatctataacaagatgccaaaagtggctgcttctgttgaatcaaaatcaaggactaacgtcaaaa

SEQ ID NO: 41543 - DNA, 201 bp, Homo sapiens
accaagcccaactaatttttgtatttttagtagagatggggtttcatcatattggtcaggctggtctcaaactcctgacttcatgtgatccgcccacctcwgcctcccaaagtgctgggattacaggcatgagccaccacacccgacctgttgtttattctttataagtcatcccgcatatggtatttttttcttttcttt

SEQ ID NO: 41544 - DNA, 201 bp, Homo sapiens
gctaaatctattttgagaactcagtaccaatttctggttggcaatgctctgtatagttattacaatggaagcaatgtaaaaataacaaaggcttaaggaarctctaattgaaaaaaaattaaatattaccatgtcttttttattactaattgttgatgttgtattttccatacgacatatttttatataaaagtatcctgg

SEQ ID NO: 41545 - DNA, 201 bp, Homo sapiens
ccacctcagcctccgaaggtgctaatagctgactttttatttattttttgagatggaatctcactctgtcaccagtgcagtggtgcaatcttggctcactrcaacctctgcctcccaggttcaaatgattctcctgcctcagcctcccgagtagctgggactacaggcgcccgccagcacgcccagctaattttttgtact

SEQ ID NO: 41546 - DNA, 201 bp, Homo sapiens
gcgacagaacaagactctgtctcagaaaaaaaaaaaacagaatgacaacagatattttcagagtatcttgtagtttacaaagcacattcacatagttattygcttgataaatcagagtacttctgcaattaacactcttgccagctatttatgtcactcaagatgtttgaaaaatgccttttgtgaattgtaactgaatgg

SEQ ID NO: 41547 - DNA, 201 bp, Homo sapiens
ctcagcctcctgagtagctgggattacaggcatgcaccaccatatccagctaatttttgtatttttagtagagagagggtttcaccatgttggccaggctrgtctccaactcctgacctcaggtgatctgcccacctcagcctccgaaggtgctaatagctgactttttatttattttttgagatggaatctcactctgtc

SEQ ID NO: 41548 - DNA, 201 bp, Homo sapiens
gagcgtgagaatcacttgaacccaagaggcagaggttgcagtgagccgagattgacccactgcactgctgcctgggcgacagaacaagactctgtctcagaaaaaaaaaaaacagaatgacaacagatattttcagagtatcttgtagtttacaaagcacattcacatagttattcgcttgataaatcagagtacttctgc

SEQ ID NO: 41549 - DNA, 201 bp, Homo sapiens
gaagtttctcttccctgagaggtggaagacgggtgtcagattgcatggttcgttttagagaacgttattttttctagaataacttcctggtagtgtgtagrttgtgtgacagagaacttctaattgtttctctcttcctcatacacatttaccaaacacagaacatcttgtccttcacacatttcacatggcaattctgga

SEQ ID NO: 41550 - DNA, 201 bp, Homo sapiens
ctcaggtcctcaccacatggacctctccagaggaatgctgaagtcttctgccagaacaagtgaaccagcacagagagatcaaggagaaagccacaatggcyggccgcagaaatcacacttcatcatttttgcaatatcatactggtattacaaaaaagctccgttcagtgggaagtgggaataggggtgggctcaggtggt

SEQ ID NO: 41551 - DNA, 201 bp, Homo sapiens
aatagaacacatcatgcattggccctgcctcctgcctttgaagtttctcttccctgagaggtggaagacgggtgtcagattgcatggttcgttttagagarcgttattttttctagaataacttcctggtagtgtgtagattgtgtgacagagaacttctaattgtttctctcttcctcatacacatttaccaaacacaga

SEQ ID NO: 41552 - DNA, 201 bp, Homo sapiens
cctcaataggaaacaaataaaagcaaaacttttaaatggcaaaatgccctactttttctatgaaattataaaggttacaaatataaatactcaatggtaaygaaggtacaatactataaacattctcacatactacttttttttctttctttctttctttttttgagacagggtcttgctgtgtcacccaggcacaatcac

SEQ ID NO: 41553 - DNA, 201 bp, Homo sapiens
gaaactagggtcaaggctcaggcaggtctccttgggacaatagaacacatcatgcattggccctgcctcctgcctttgaagtttctcttccctgagaggtrgaagacgggtgtcagattgcatggttcgttttagagaacgttattttttctagaataacttcctggtagtgtgtagattgtgtgacagagaacttctaat

SEQ ID NO: 41554 - DNA, 201 bp, Homo sapiens
cactaagaaaaacactaagaccccaatagaaagttgagcaaattatatgtaaagaggtttcccagaagaggaaatataaaaagaaacatgaaaaaaaaatwaacctcaataggaaacaaataaaagcaaaacttttaaatggcaaaatgccctactttttctatgaaattataaaggttacaaatataaatactcaatggt

SEQ ID NO: 41555 - DNA, 201 bp, Homo sapiens
attaccaatcaacaggaaagaaggaaattgttctatttattgcataaatagcattgtagaaattggcttgctatttggtgataaaataaataataagtcargtacggtggtgcacgcttgtattcccagctactcggtagctgaggcaggaggatcgcttgagcctaggaattcaaggctgtagtgcaccatgatcacacc

SEQ ID NO: 41556 - DNA, 201 bp, Homo sapiens
aattaccaatcaacaggaaagaaggaaattgttctatttattgcataaatagcattgtagaaattggcttgctatttggtgataaaataaataataagtcragtacggtggtgcacgcttgtattcccagctactcggtagctgaggcaggaggatcgcttgagcctaggaattcaaggctgtagtgcaccatgatcacac

SEQ ID NO: 41557 - DNA, 201 bp, Homo sapiens
tctttcttctctttctttccttctttctttctttccttccttccttccttgcttctttctttctttctttctttctttctttctttctctctctctctctytctttctttctttctttctttctttttctttcctgacagagtctcatcctattgcccaggctggagtgcagtggcccaatcacagctcactgcagtctca

SEQ ID NO: 41558 - DNA, 201 bp, Homo sapiens
gaaatgcaggggagattgggtttaggggctttcctggtctgcattctgctacagccgttaaatgccgctagatggagtgcgtgattctggtatggcctcaygtggacctgcgaaggatggagagaacatggtctctgcttcccagaaaaaaaggagaaatttggtaacaagtgtggagactgctcttaaataatgctccag

SEQ ID NO: 41559 - DNA, 201 bp, Homo sapiens
ttctctctctctcctttctttcttctctttctttccttctttctttctttccttccttccttccttgcttctttctttctttctttctttctttctttctytctctctctctctctctctttctttctttctttctttctttttctttcctgacagagtctcatcctattgcccaggctggagtgcagtggcccaatcaca

SEQ ID NO: 41560 - DNA, 201 bp, Homo sapiens
gaatacaggtccggaaacggtactgtaatccctttagatcccatcaggaaacatagaggatgatctgaacaataattccctccaattgatagcttaggaaratctctccattctgttattttaaggatttttaaagaccacctcaaccaagattttcaaatcatagtgaaacacaaaatttgatcaacttacccacaacag

SEQ ID NO: 41561 - DNA, 201 bp, Homo sapiens
attgcttatcactgcccaaaagttccaagaaatgatgaagtcagtctcatttggcatacatctactttttcagaaggaaacaaagcagagaaaaaattccragagaaattcatagctagtaaccactctcacttttattttagtttccataactgaaattgctggacttgagagcaatttttccttgctcaacagaattag

SEQ ID NO: 41562 - DNA, 201 bp, Homo sapiens
ttggtaagagcataaagaaagcagattgctataggatttaaatagatatttagtaaacaagtttgaatttcattttttctatcttcaacctgtaggtatamtatactagaagatagcctaaaatttgggtaatatttacttttatacttatttatactaaactaaactaaaatccacattaatgaaatcataaaataggat

SEQ ID NO: 41563 - DNA, 201 bp, Homo sapiens
gaaggtagactagttgaagctgatatgatttttcctatgtactttttgggtaatatacatgtttgcagtgacatttgctagtcctaaatgaaactaaagaytggggggggataatagtgtgattggatgatactgggaatgagataataagaaatatcctcagctttattgccaaggccaagcagtttgatactttgcttg

SEQ ID NO: 41564 - DNA, 201 bp, Homo sapiens
cctgtccctagctgcttgggagtttgaggcagagaattgcttgaacccgggaggcagaggttgcagtgagccaagattgcgccactgtactccagcctggygacagagcgagactctgtctcaaaaaataataatgataataataataattttataaaatacagggagtataaagaaaaactgatcacccaaattggagaa

SEQ ID NO: 41565 - DNA, 201 bp, Homo sapiens
gacagagcaagactccttctcaaaaaaaagaaagaaggaaagaaaactcttccttcagcaaatgtattttgaaaagtactagcctaagttaaatgcccaasagtgttcacagctacattgtttataatagcaaaagactggaaacaatccaatcatccattgtcaagagaatggattattaatatgaagtatatatccagt

SEQ ID NO: 41566 - DNA, 201 bp, Homo sapiens
ttggttaccctacccttgatagtaaattggtgtgtcagtgtctttcctgattttcttttcacgacaattgagtaacctccaaacactgtttctgaaatcartgggaatgagaggaatcatacagtatggactgttttgtgactggcttccttgtttccacattatgtctgtgaaattcatccctcttgtggcagacaggag

SEQ ID NO: 41567 - DNA, 201 bp, Homo sapiens
cccacaaggattagaaataaaactctcccaggccgggagcaggggctcatgcctgtaatcccagcactttgggaggctaaggtgggctgatcacctgatgwcaggagttcaaggccagcctggccaacaaggtgaaacctcatatccactaaaaatacaaaaattagctgggtgtggtggtgcatgcctgtaatcccagct

SEQ ID NO: 41568 - DNA, 201 bp, Homo sapiens
atgtttctcatgtatacaatcaaactcgcaccctagtattattggcaggctaatatatgcccatgagacatgtagcttaaatctctatgggataggataartattctccctttgtttgtgatttgaaagctttccatggatgctaaagcgatttgttaaaataccttcacctgtaagtgtttttcctctcttaaaagccta

SEQ ID NO: 41569 - DNA, 201 bp, Homo sapiens
tatctcatttgccagctctcggtctcttctttggcctctcttctttggcctctcgaacctgtgctatccctatccaactcaataggggtctggcacaatarcatgtaactaacaattaggaaacagaaacctgtcttttagaatgtgggacttctcttcatcaaaagcactgtaaaatgagttaagaaacaacccataaat

SEQ ID NO: 41570 - DNA, 201 bp, Homo sapiens
ttgaacacctgggctcaagagatctgcccgcctcagcctccccaaatgctgggattataggcgtgagccaccgcaccaggcccaaagttaaaataacttamtgaataaggtttggatgatgtcaggtaccccttttttctcaggggaactggctcctacttagatatcttatgaccattagtgggacattataggatagcc

SEQ ID NO: 41571 - DNA, 201 bp, Homo sapiens
gcagtggcacgatctcagctcactacaacctctgcctcccaggttcaagagattcttatgcctcagcctccggagtagctgggattacaggcatacttcaycatgcccaactgatttttgtatttttggtagaggcggggtttcaccatgttggccaggctggtcttgaactcctgacctcaggtgatctgcccaccttgg

SEQ ID NO: 41572 - DNA, 201 bp, Homo sapiens
tttccccctacactacacagaagtaagttagcctctcctgaagccaagtttccttgcacttgataggtcaatctggtgatgaagtcgcatcccaccataaygaccctggggaatttgtgtttattgttgttttaagctactatgttattggctaatttattttttttatttttatttatttatttatttatttgagacaga

SEQ ID NO: 41573 - DNA, 201 bp, Homo sapiens
taacctgtgtaaaacccttccatttgttgaatttggcaccaaaggctcttaaaggccatttgttgggaatgtgtggataataggctgacttacatctgtaytggaaaaactctatctttgcctttggagaattatggacgtttggttttttacctttagcggatagaagggcagcaagatttgtcatgtgctgtttaaaat

SEQ ID NO: 41574 - DNA, 201 bp, Homo sapiens
tgtgcctaagttaggacagtcccttctgagcaacatcctggcataaggggaagttcttaaccacatttcttcccattagctgcagaggcggtgtaggtackgtcctgctagcgttcttgtgaacactgcccttctccagagaccctccctctctatctgcctaaccagcctctaactgccttctctctcagcaggaagtct

SEQ ID NO: 41575 - DNA, 201 bp, Homo sapiens
ttctttctctctctctcctttctttcttctctttctttccttctttctttctttccttccttccttccttgcttctttctttctttctttctttctttctytctttctctctctctctctctctttctttctttctttctttctttttctttcctgacagagtctcatcctattgcccaggctggagtgcagtggcccaat

SEQ ID NO: 41576 - DNA, 201 bp, Homo sapiens
cacataagaaatgaatgaaaagtagtgaatgatctcaagtatgtctacaaggcgagaggaaagtgatcctattcaccagacatgctagggaggcatttggygctgttggctctgctgttgcacaataggcctgggactctgaaggctggcacttcctcatcctaaacctcaaattttaatgaattacctccaagtgggcaa

SEQ ID NO: 41577 - DNA, 201 bp, Homo sapiens
tgtattaatttattctttggtgacagagtctcattctgttgccaaggctgcagtgcagtgacatgatctggcctcctaggatcaaacaattcttatgcctyagcttcccaagtagctgggattacaggcgtgtgccaccacgctcggctaattctttttgtatttttaatagagatagggtttcaccatgtcgaccaaact

SEQ ID NO: 41578 - DNA, 201 bp, Homo sapiens
caaagtgatgccttgacaccctctgaggttctacaggctcttccaaatcaaagagaggtcacatcatgcatagtattatttgggggttagcatacgttttrtaataattatgttaaaattggtaatccctttttgggttcaatgatagctctattaattatattgtcttgttaactgaaatattccactctgtcaatggga

SEQ ID NO: 41579 - DNA, 201 bp, Homo sapiens
cagggtatggtggcgcatgcctgtaatcccagctagttgggaggctgaggcacgagaatcgcttaatcctgggaggcagaggttgcagtgagccaataacktgctgctgcactcttacctgggcaacagagtgagattctgtctcaaaaaaaaaagaagtgaatggcatcaatcgtgaaaggtatcacataaatatgaaag

SEQ ID NO: 41580 - DNA, 201 bp, Homo sapiens
ggtaggagcctcggtaagagttggtgttcatccgcttgcggaggaaagcgaggtacttcaacttgtttctgtagaaattgccagaaatgttgatgccttcrcagcgtacgaccaccaccttccggcccagcagtacctgtttaccacgatggccgccaggcggcccaggagatggcctcgaccatcaagcaccaggacctg

SEQ ID NO: 41581 - DNA, 201 bp, Homo sapiens
tactaaaaaaaaaaaaaaaaattagcagggtatggtggcgcatgcctgtaatcccagctagttgggaggctgaggcacgagaatcgcttaatcctgggagscagaggttgcagtgagccaataacttgctgctgcactcttacctgggcaacagagtgagattctgtctcaaaaaaaaaagaagtgaatggcatcaatcgt

SEQ ID NO: 41582 - DNA, 201 bp, Homo sapiens
gccccagataggcaaactttcttgtaggcttcagacgcacaaccttgagggcaacaggaaccaccatccgctttttcttgtcgtagggcggtgggatgccrtcaaacaccttgaggcggtccagagcggcctggcctcgcttggtcttgtggggcagcatacctcgcacggtccgccagaagatgcggctgggggcccgga

SEQ ID NO: 41583 - DNA, 201 bp, Homo sapiens
ggtggctgtccctgcctggtacttccagccaaactcgtgagccaggcgccccagataggcaaactttcttgtaggcttcagacgcacaaccttgagggcarcaggaaccaccatccgctttttcttgtcgtagggcggtgggatgccatcaaacaccttgaggcggtccagagcggcctggcctcgcttggtcttgtgggg

SEQ ID NO: 41584 - DNA, 201 bp, Homo sapiens
agggcaaacagtgatggattacaagaaaagtggctggccagaatgccgtttccatctctctcggtttctcttctgcatgattctcccaacctctccccacrtgggctatctatcacctatcaccgtgcaagcacttcctcagaggaatgcttttgttttggaaacaggtttggaggcaaagggataagggaagtaagatga

SEQ ID NO: 41585 - DNA, 201 bp, Homo sapiens
caaaggagattcataaatgaatcatgtaattttaagcaattctcactagatggagctagttacaaataaatacttttttaatatttttcttctttatttttaattttttatttttatttattttttattttttgaggaattaacagtctttattgggctcagatcaggaggccgtgggtcttgaggacctctgtgtatttg

SEQ ID NO: 41586 - DNA, 201 bp, Homo sapiens
tttaaagatgatgatcatcctttcccccaaaactcacaatttggtttcttccttaaaccttttaacccagacttctcaaagaatcatcttaaagatgtgasgacaggttagaatagagaattttaattatggggctctgctcaaccagcccgctactgcagggcaaacagtgatggattacaagaaaagtggctggccaga

SEQ ID NO: 41587 - DNA, 201 bp, Homo sapiens
agccaggtgtggtaagcgcctgtaatcccagctactcgtgaggctgaggcaggagaatcgcttgaacccgggaagcagaagttgcaatgagttgagatcayggcactgcactccagcctgggcaacagagactctgtctcaaaaaaaaaaaaaaaagaaaaaagaaaaaaatagaaaatatatatttactattcattacat

SEQ ID NO: 41588 - DNA, 201 bp, Homo sapiens
ataagatgatttcctgattacttgccatttttaaaggaatgccttataagttatagtcttcatcttcactttttaggacccaatggtgagtcagggtctayggtgtctcaagaattcggccacctccacgaccaacctctacacacaggccctgttggcttacattttctccctggctggggaaatggacatcagaaacat

SEQ ID NO: 41589 - DNA, 201 bp, Homo sapiens
aggagttcgagaccagcctgaccaacatggtgaaaccctgtctctactaaaaatacaaaaattagccaggcatgatggcacgtgcctgtaatcccagttaytcgggagactgaggcaggaaaattgcttgaacccagagggtggaggttgcagtgagctgagatcgtgccactgcactccagcctgggcaacagagcaaga

SEQ ID NO: 41590 - DNA, 201 bp, Homo sapiens
gaagggtttagggaaatttgccaggaacttaccatgagtcatgggacaaatgggaacccgtcattccctctgcaaaacctgttcttgagaagccctttgtycagagcctcagtaggcagctggttcataccaaccaatggtaagcaatgctcatctgttctctcccttaaggcctctctttgtgtgaagacccacaagcat

SEQ ID NO: 41591 - DNA, 201 bp, Homo sapiens
gagtttgctcttgttgcccaggctagagtgcagtggcacaatctcagctcacagcaacctcttcctcccaggttcaagcaattctccagtctcagcctccsgagtagctgggattacagccacccgtcaccaagcccaactaatttttgtatttttagtagagatggggtttcatcatattggtcaggctggtctcaaact

SEQ ID NO: 41592 - DNA, 201 bp, Homo sapiens
acgaatccgtggaggtagaaactcatctaggaaaagttagagagcaagccacttgggtacaacagcctcccagactgtctctgaggactggttttcttttytgttttcttggattcctcgtggaaaacagtctatgttttctgggtggctaaaactaggcatgtcagtcttgttaattgtgcttatgctttctattatgac

SEQ ID NO: 41593 - DNA, 201 bp, Homo sapiens
gtacagaaatccctggattatagaaagttcttctaaaattttgtcttgagaacccctgccattccccatcttctattgtgtcacctttttttctgcatctsacaggaaaggtggcatctgaatctgtctccctggagctcccagtggacattgttcctgactcgaccaaggcttatgttacggttctgggtaagcagttag

SEQ ID NO: 41594 - DNA, 201 bp, Homo sapiens
gggcctcactcagtatctcatcacatgaatctctctggtggggtgcctcatcacacaacagctgtttttcccagagcaagcagtttgagaaaaggggtgcrcccaagatggaagctgcagtcttttagtagctgggattacaagtatgcccccccatgcctggcttttttttttttttttttttttgtatttttagtagag

SEQ ID NO: 41595 - DNA, 201 bp, Homo sapiens
acacagagtgtgacttccagaatcctaataagaatagcagctatcgcctgtaatcccagcactttgggaggccgaggcgggcggatcatgaggtcaggatrtcgagaccatcctggtgaacacggtgaaaccccgtctctactaaaaatacaaaaaaattagccgggcgtggtggcgggcgcctgtagtcccagctactcg

SEQ ID NO: 41596 - DNA, 201 bp, Homo sapiens
gaggcgggcggatcatgaggtcaggatatcgagaccatcctggtgaacacggtgaaaccccgtctctactaaaaatacaaaaaaattagccgggcgtggtrgcgggcgcctgtagtcccagctactcgggaggctgaggcaggagaatggcgtgaacccgggaggcggagcttgcagtgagccgagatcacgtcactgtac

SEQ ID NO: 41597 - DNA, 201 bp, Homo sapiens
ataaaaatataagtatatgagtgaagaactgatttttgaattttgctttaattaatttaaatttaagtggtcacatgtgggtagtggccaccgtattggaycacagaaccttaagcagtaggaagctttttgctacgtgatgtattataaatctttccactgtctcagcaatctaaacataaaaccaacatgtctaaattt

SEQ ID NO: 41598 - DNA, 201 bp, Homo sapiens
gcaaagttaccctagtcttaactggaagagcatggctcccttaaagagtctaaaataagccttttcctttagtgactcccagctctggtcttgtcaggttscatttttctcctaaccttcttctttcctaatcctcactcactaattcaaaaatgttattctgccttccagaacatcacactttgtaaacattttgttaat

SEQ ID NO: 41599 - DNA, 201 bp, Homo sapiens
actatactttctgcaaatgctcacagtcacatgtccagggacaggcttcccatatgtgtatctgtcatgagaacattcccaaaggaatcagagcagacacygaacctccccattttctagctatttatatctcccctttagctacagtatattccctgtctgtacttccctctgctctctgctgggctcacacaatattga

SEQ ID NO: 41600 - DNA, 201 bp, Homo sapiens
gcctgagctcagacttgaatttcttttttagactttcattttctccctttatgaagtggcaaagtcagttaagtatagatgtggccgtctatgtccctgarcttctgggttcaataatcagctctgcgactcctcttaaagaatccagaggatttcctgcctggaccttgaagtcacctccccgctacatatttcccagct

SEQ ID NO: 41601 - DNA, 201 bp, Homo sapiens
ggatggtctcgatctcctgacctcatgatctgcccacctctgcctcccaaagtgctgggattacaggcgtgagccaccgcgcccagctttttttctagttmtgtgaagaatgatgatggtattttgatggaaattgcattgaatctgcagattgcttttggcagtatgttcattttcgcaatattgattctactgatccat

SEQ ID NO: 41602 - DNA, 201 bp, Homo sapiens
tatgcgattagccatagcaaccaaaactcaggatcacaacaatgagaccaggggtacatcatcaatctcaatgtttgtgcaaagcaaattagcaagccagyatggcatggtacattgctccaagtgtacacaacaaaatcatcaattagtgacataaagaacatcctaagaacatttccgagggtttgccaagggtcaatc

SEQ ID NO: 41603 - DNA, 201 bp, Homo sapiens
aacatcctccgtaggttcagactgacctggctaaatcgcatgagtaccagctagaatcatgggcagattctcagacctccagttgtctctgtgctgatgamgcaaaaacccaccactggaacatcacagctgtcaaattgggtaagagagggaagtggtagacgggcgaggaaagccagcagcagaagaccagtgactgag

SEQ ID NO: 41604 - DNA, 201 bp, Homo sapiens
ccaggctcccttggaggtgtaaggactgagcaactagacctacttgctatgtagatttatctcagaaatggcctcttaaagagaattctcatcattctagwacctcatttgtcaacaggatttatacactaaaattcaatcttcctaaagaattgagaacaaatttaataaggagtaaactcagattgcaaagataattgt

SEQ ID NO: 41605 - DNA, 201 bp, Homo sapiens
gagagaggtgtgggaaccaggatggaagagtcaggcctccagatagcgtttacttctcctttcttccttgaatcactgtctcagagataattaggttcagragaggaggaaaaaaaagatgacgtcaacatggagcagagtttttcttagaccttagcctagcaaggaaagagaaatgcctggtctcagtgctgggaagct

SEQ ID NO: 41606 - DNA, 201 bp, Homo sapiens
ttcctgacgccatcaccgagtggaaggcgatgagtttctgcacttcccagtcaagaggcttcgggctttcacccactgttggactaactgctttcaagccrttctttgttgacctgactctcccttactcagtagtccgtggggaatcctttcgtcttactgccaccatcttcaattacctaaaggattgcatcagggtga

SEQ ID NO: 41607 - DNA, 201 bp, Homo sapiens
attcctagtctgaggaattgcctattcaaggaatcatttttggtgatatatctgcctagtagccaaatactctgataagaacaaaaacccgtgtgtgtgtstaagattagctgatgcttcacttttctcaatgttttatattgcatattatcataagaagtctcactggatcaggccgggcgccatggctcacactggtaa

SEQ ID NO: 41608 - DNA, 201 bp, Homo sapiens
tttctaaaatatcgtgtctttgattttctaaattattatacaatttgctgataggtataattttgagttagatctttatctgttgatctggaggagtttcygggactttttttttttttaaagaagcacacaagttgcccagaaatgtatatagtataatccaaattttgtaagacaaacaataacatgtatgtatatgtt

SEQ ID NO: 41609 - DNA, 201 bp, Homo sapiens
gagctcaggcaatccgcccgcctcggcctcccaaagtgccgggattacaggcctgagccaccgtgcccggcccaggcagagttttaattgaccaccatccyttgtccgactcctagaaactttcacctggattccttaaagtgatgccttgctgacctgattggataactcagtattcattgctgagtagctgaggtaagc

SEQ ID NO: 41610 - DNA, 201 bp, Homo sapiens
tcccaatccttgccagacctcatttaactaatagcttccttttcaaggactgcaggcagaggcagagtgcttgctgttacatgaagtgtgctccagtgctkgtggcttgggacaatgaattcatgcagatctcaggcgatggcaggagaagtattggatgctcctgatcagttggtacatctgtatatgaaatacaggagg

SEQ ID NO: 41611 - DNA, 201 bp, Homo sapiens
aggagaagtattggatgctcctgatcagttggtacatctgtatatgaaatacaggaggaaacaggccgggcagtcctgcccgctgtacagagaaagtggtygacacagcaggggaatttaaagatcacctctaaccatctcagttcttaagtggcatctttagttgggcctaggaattaaattgacataaggcagattaac

SEQ ID NO: 41612 - DNA, 201 bp, Homo sapiens
tctttgtacaaacatgaagatcctaggagaagcccaatcaattttagagagacaagtggatgaagatagggattaaaagaattgtgcttgactgagcagaragactgatgatctgaaaggacaccaggtaaaatgtttctttttagctttacaaatgcactgcttgttaacatctatgaattcatgtacttgcttttccat

SEQ ID NO: 41613 - DNA, 201 bp, Homo sapiens
gcaatggtggaaggaggggaacgggagtcatttcatcagaaagatgcattgtatctactggagaattttcttgtcttagaaacactagaaattatattttytggaaatttcaaattttactaaaatgtggtcattgtcaattatgtaacaggggctttccttttcaatatagcgactatcagtaatagtgctggaaatatg

SEQ ID NO: 41614 - DNA, 201 bp, Homo sapiens
ggactgaactcagttttcacactgaaagtgaggaatctaaatggaaaatcatgatatctgtccagcatgttgttaaagtataggaaaaggggatttagtakaatatggttgaaagcactgatttgaggaaaaataattttttcatatatactccccactgagttgagactcataaaatggttactggttgaggacaccaac

SEQ ID NO: 41615 - DNA, 201 bp, Homo sapiens
tttttatatacatcgtgttagaaaacaggagatctctgagtcagagacaaagacgtgtattcacagtaaaagcagcagccaaggtgacttcagagcttggrttccctgagccccaattcccataaggcaacatagggagggccagatggtacttacaggtgctttcaggtgcaatacaggaggcgaagtctgagtttagga

SEQ ID NO: 41616 - DNA, 201 bp, Homo sapiens
ggaaagatgtctgtaaatctctcggtgaaagttaccgttttgatctttatttatctaggaatgtaaatacatttgcttcaggggaagtccttgtctttatytctccagggctgcctgcttgcactaggcattcctagaaagataatcctggcacacaggagcgaaacatgtaggagtgctgaagattcacagacagtcgtc

SEQ ID NO: 41617 - DNA, 201 bp, Homo sapiens
gaagttttttttcccttaaacttctccttttggacattccccttcattttccttttaaaaatctcatcctttccaacactttcagttgtaagaatttccawatcaagcactcaatatcaaaacaatgtgtgtgacaaacttaaagtgttgaatctgactatgtcagcagaaagcataattatcgatgatgtatgggacagc

SEQ ID NO: 41618 - DNA, 201 bp, Homo sapiens
atatgattccctcctacataacccaaggataccctggatcccttcgaatgaggaaaaattttatttgaggttttttttttttcctctagcttgatgtgatrtatctctgaagtcaatctttatcttgtccttgagagggtgaacagctccaatcagattttggagaggaggttctccttagattcttttgatcacactaca

SEQ ID NO: 41619 - DNA, 201 bp, Homo sapiens
agtttatttaaggtatcctgtttttatccaaaggtaaagacataaaactatactgtgggtggtaaacaaagatggttttaatcactcacagtttgtgctgrcagctgaccataattccttagtagcaataccctctggtctaccgcccaaagagcataaagagagtttgaagcagccgagacttgaagatcgacattggat

SEQ ID NO: 41620 - DNA, 201 bp, Homo sapiens
attacacaaaggcatgaagatgaaacttcaggtgtaacttttttgggggtattactttttaaagtaatggttttattcataggccgcaaatccaactttgsctgcagtttttttctttttttttttttgagacggagtctcgctcttgtcacccaggttggagtgcagtggcacaatctcggctcactgcaacctccacct

SEQ ID NO: 41621 - DNA, 201 bp, Homo sapiens
catttttgaatcgatgctgaaccagctaattacttcaggaacatgctacctaaataatgcctccttcattagatccattaatttaattctcactgtttatrcccctctgctcactgcctgtctgactgattcctcctccagtgctttctccatttctccttttactctcttcagtgctgccgaagtttaaggtggaagtgg

SEQ ID NO: 41622 - DNA, 201 bp, Homo sapiens
actcagtgctgttatttagcagctgtgtgtatgacttcataatttagggggctgtctgttttgtgttctaagccacgtggctgctgtggtgactgctttaraaactttcagttccctttgctgtgaaacaggtttcagtgcatcgtccctgtgtataaggtcaggtttcttacatggactcactctgtttctgtaaatttg

SEQ ID NO: 41623 - DNA, 201 bp, Homo sapiens
ctagaaatagtcaccatagatagtattcttaaaaaaaaaaaagttgctggccgggtatggtggctcacacctgtaatcttagcattttgggaggccgaggygggtggatcacttgataccaggagttcgagatcagcctggccaacatagtgaaaccttgtttctactaaaaatacaaaaattagtttggcatggtgatgc

SEQ ID NO: 41624 - DNA, 201 bp, Homo sapiens
tagagtctctcactctgttgcccaggctggagtgcagtggcacaattttggcttgctgcaacctccacctcctgagtggaggttactcaggcaatcctccwgcctcagcttcctgagtagctgggactacagccatgtgccatcacacctgaataatttttatattttttgtagagacaggatcaccccatgttgcccagg

SEQ ID NO: 41625 - DNA, 201 bp, Homo sapiens
cctcccaaagtgcttggattacaggcgttagccatcacacctgacctatttttaaattttatattaatatattaactggatttttgtcaaatagagaattmtctttaaataaccatctcctcacttcacacttagtctgggaaaaaatgagagcaaatttctgtgcatccagggagcatatcaccaaccaggcatgaagct

SEQ ID NO: 41626 - DNA, 201 bp, Homo sapiens
tatttcaaacactattctctgttgtattgtattcactattgtaatccatgagaagagaaaaccttggtattagtgtcctgaggagagtggtttccacatamctgttgattgaattcttcacagatactttgtgaatgtgtgttgtggcagtcggaacggcatagtgaatatcttctgcatacactaagtgtcaccagacca

SEQ ID NO: 41627 - DNA, 201 bp, Homo sapiens
gttggtgtggaagaggcagggctcagctgtttaatatcttctgtttattttgtcttgtggtccttcctttccatctcttctgtctcttctttccctcttgkcctctttgctcttcctcttcctctccttgccagccacagctgggaaacctattgcaggtaaaccgaaccctgggtcggaatgtgcctctagcctcccaac

SEQ ID NO: 41628 - DNA, 201 bp, Homo sapiens
agcctcttgctttttctctgacccacagtggacactggaggaaaccttcccttccttcccttttctcttagctcccaccagcctaagggctgtggaaaccmgtaccttttgtctgcacccagccccctctcctccctttggtggcttcctgtgtgtccagggctagcgtcttctaggtgaatctaagatgtcagtacctta

SEQ ID NO: 41629 - DNA, 201 bp, Homo sapiens
tctcttagctcccaccagcctaagggctgtggaaaccagtaccttttgtctgcacccagccccctctcctccctttggtggcttcctgtgtgtccagggcyagcgtcttctaggtgaatctaagatgtcagtaccttagccctcggctgcttgctcagagcctggtttgtgttctttccccagctctgccaggcccattcc

SEQ ID NO: 41630 - DNA, 201 bp, Homo sapiens
tctgacgacccagaggggactatagtgtggaaactcccaactcaaaggctaactttggttaagtgttggggtctgataacatctttctcatgaaccacaartgggacaatactgaaaatacttctcaacccaaaggaaacagactgcagcactaattggccaactttgggtaattggggtacccaagtaaaggatgggatt

SEQ ID NO: 41631 - DNA, 201 bp, Homo sapiens
ttctctctctcctttccctttcttattttttctattactcagggtaaccatctttcccagagatcacaagtcaaaactctctggtcagaggttggattaaygatgatggggcccaacagggggcaagtttgagccttgccagtttgatattgggtgctaagcagagtggcaggtcataaactgcttctttgacttttacaa

SEQ ID NO: 41632 - DNA, 201 bp, Homo sapiens
tcagcttgaaataatcagtacatcacatcagccaattttggggtggctcatccttaactcctgcaacacttttgcttagtggttttatcattatatattgyataaatatatatatatagtatacatctataaccatttatttattatacttacattaatttttttcctatagactcttccagcaagaataaggtttttttt

SEQ ID NO: 41633 - DNA, 201 bp, Homo sapiens
ctttccctttcttattttttctattactcagggtaaccatctttcccagagatcacaagtcaaaactctctggtcagaggttggattaatgatgatggggyccaacagggggcaagtttgagccttgccagtttgatattgggtgctaagcagagtggcaggtcataaactgcttctttgacttttacaaattgttcaatt

SEQ ID NO: 41634 - DNA, 201 bp, Homo sapiens
tataaagaaaaagattttatataacaaaggatcttgtatggtaaattcttgttctaaagtaaaatggttgtttgacaagaggtatgtttaggacaagtccraaagtccaagcatgtcataaatggtctgtgtaagtcataaaaatatgaaaataatttatgcaaaaaatgttgtacaatttaaaggtaattaggcttccta

SEQ ID NO: 41635 - DNA, 201 bp, Homo sapiens
agcctcctgagtagctggaattacaggccctgccaccacccccccgctaatttttgtctattttttttttttagtagagacggggtttcaccatgttggcyagtctggtcttgaactcctgactgacctcagatgaaccacccgcctcagactcccaaagtgtcaggattacaggcgttagccaccgtacctggcctgctc

SEQ ID NO: 41636 - DNA, 201 bp, Homo sapiens
ctcggatctaaaaaaatcttatctaagattccttctatggaacagagttccaatttacaaaaagcttatgtgaaaaataattattcttgctacactttatrcaaacaatcaggccaagtataataaagcaagttggtgttaccataatttgtctttaataaaaatgggaaactggagacagaaaacttaatgtttcaagaa

SEQ ID NO: 41637 - DNA, 201 bp, Homo sapiens
gtttcaccacgttggccaggttggtctcaaactcctgacctcaggtgatctgcccacctcggcctcccaaagtgctgggattacaggcgtgagtcactgcrcccaggccaatgctttctaactaagctcctctctaccgtaaacacaaaagaccctaatagttaggcaggaatatcattgcccctattcagcataaagaag

SEQ ID NO: 41638 - DNA, 201 bp, Homo sapiens
aaaacccaccaaaaccaagatggtaccaagagtgacctctggtcatcctcactgctacactcccaccagtgccatgacaacttacaaatgccatgacaacrtcagaaagttattatatatggtctaaaaatgagaggcatgaataacccaccccttgtttagcatattaagaaatagccataaaaatgggcaaccagcagc

SEQ ID NO: 41639 - DNA, 201 bp, Homo sapiens
attacaggccctgccaccacccccccgctaatttttgtctattttttttttttagtagagacggggtttcaccatgttggccagtctggtcttgaactccygactgacctcagatgaaccacccgcctcagactcccaaagtgtcaggattacaggcgttagccaccgtacctggcctgctcccagtttttacaagatgtt

SEQ ID NO: 41640 - DNA, 201 bp, Homo sapiens
tgacaacttacaaatgccatgacaacgtcagaaagttattatatatggtctaaaaatgagaggcatgaataacccaccccttgtttagcatattaagaaayagccataaaaatgggcaaccagcagcccttggggctgctgtctatagagtacccattctttcactcctttactttcttaatacattgttctcactttaat

SEQ ID NO: 41641 - DNA, 201 bp, Homo sapiens
agactcccaaagtgtcaggattacaggcgttagccaccgtacctggcctgctcccagtttttacaagatgttaattcccaataatctgagagcaatgtgtkaatatgaatattaattcttctaaatgaatattcatccttatttcctacttgtataggtggatgaataaagatccaatagtataatagaaagactattagt

SEQ ID NO: 41642 - DNA, 201 bp, Homo sapiens
aaccagctgtggggtaagtgtaagatttaatctctctattccttaagtgttcccatccacaaagtaagaaggctggatgaggtgtgtcaatcctagcacaytaacctaagtcatcccccaggttgcctagacctgtcaggagcatggccttatgaagatacaaacatgaaatcctgggttggacccctctatagtttctga

SEQ ID NO: 41643 - DNA, 201 bp, Homo sapiens
gtacaaaatgtatccaagctaagaggtcaggagagaggaaatcaaagccaagaagttgaatattttctggtaaaaagacagtgatgagacagtgtaaagawagctaaagggaaaacccattattttaaacccaatttaatgtactttaagagtttaaagtacattagaaagtctatgcacattaaagacattctctattct

SEQ ID NO: 41644 - DNA, 201 bp, Homo sapiens
aaatgtctgatcctgcttgaagtaaattatcaaagccatctacgttgagagatgaaatgtattacgtctctcctgctaacttgaggagtaaaggaatttaytaaaaagttactaggatgtttttattccttttctttttttttcttgcagtgaagcctgtagatccttaagattctttaccagttgtgtggtcttaatttc

SEQ ID NO: 41645 - DNA, 201 bp, Homo sapiens
gtcatagctggggcatatttgctgatgacccaaattatgttgtttcccttcctttccaggctgacctgatccccaagttatacctttcccttccccaggtktcccttggcttctccccctcccagcagcttccaggagcagaagtggagctgcagctgcaggcagctcccggatccctgtgtgcgctccgggcggtggatg

SEQ ID NO: 41646 - DNA, 201 bp, Homo sapiens
attcccagctactcggtagctgaggcaggaggatcgcttgagcctaggaattcaaggctgtagtgcaccatgatcacacctgtgaatagtcgctgcagtcyagcctagacaatatagtaagactctgtctctaaagataaataaataaatcccagatgaattagagatccaaatataaaataaaaccaaaaactatatcat

SEQ ID NO: 41647 - DNA, 201 bp, Homo sapiens
gcaaccaggccattttctccacacagcaacacggtgaggcttcctctctgtggggcataacacacagtgccaaagaaaaatctcctgcatctatgtctaaraaaaacactagagaagcaagtgctgaaggtagctatatgaagcatgtttttacagctaccagaaagcttacaaatgaaaattcaagcaccccatattgcc

SEQ ID NO: 41648 - DNA, 201 bp, Homo sapiens
ttaacaacaacaacaacaacaacaacaaaaacaggaaaaattcatcatgacaataaattttacttcttgtatccaaaatattgctccaacatgtaataaayatacaaaaatgttagtgagatattaaatctttgaaatccagtgagtattttacatctacagctcatttcattttgaactagtcaagtttcaaatactcaa

SEQ ID NO: 41649 - DNA, 201 bp, Homo sapiens
agttttaaaaattagccagacatggtggcatatacctatagccccagctattcggaaagctgaggtataggatcacctgagcccaggaggtcaaggctgcmgtgagctgtgatcgctctactgcacagcagcttaggcaacatctgtctcaaaaaacaaaaaaaaaagaagaagaaaaaaaaaagaatttaagcgactctc

SEQ ID NO: 41650 - DNA, 201 bp, Homo sapiens
gagccaagattgtgcccccgcactccagcctgggcaacagagcgagactccatatcaaaaaaaaggaaaaagaaaaaagaaaatgattctatggaaacagyagacactggggactccaaaagaaggacaaagatgtaagaactacctattgggtactatgtttattatttgggtaaggaattcagcaggaacccaaacctc

SEQ ID NO: 41651 - DNA, 201 bp, Homo sapiens
tccagtgcacacagacttttaccaagatagcacatattctggccataaaacaagttttaatacatttacaaggactgaaatcatgcaaagtatatttgacsaaaacagaattaaactagacatcattaataaaacaatacctggaaaatccccaaatatttgaaaattaacagtttttctataacccatgggtcaaagaag

SEQ ID NO: 41652 - DNA, 201 bp, Homo sapiens
ttagtccaacaaatgaataatgtacattcttttccagtgcacacagacttttaccaagatagcacatattctggccataaaacaagttttaatacatttamaaggactgaaatcatgcaaagtatatttgaccaaaacagaattaaactagacatcattaataaaacaatacctggaaaatccccaaatatttgaaaatta

SEQ ID NO: 41653 - DNA, 201 bp, Homo sapiens
gtaccagagaaaagagagatgcgcaaagagtgagctctagataactacagaggaatcctctcaagcctttggttgagttctgagctgaaccacttcaaagkagtaggcagaacaactcttagatctcacacagtgctaggaatagtgttttcacctgccagagtggaaagatgttcttaatatatgggattttcagtaaag

SEQ ID NO: 41654 - DNA, 201 bp, Homo sapiens
tatatggaacaatggcttcctgatattggacaacaggtaacacaagacagtgattcctgagaggaggggaataagttaggcgagccccacaattccccctrcttaatgcatggagagactatccaaggtgcagtgcaggaagggggaacccagacagagcctgccagtttcactgagcttcagagggagagagtgtggagt

SEQ ID NO: 41655 - DNA, 201 bp, Homo sapiens
gttgttgcctcctctccctggctgggctcgagctgcttcagggcaggaaccacgtctttacagtttgatgttcccagagctgacccagtgtttggcatagrggtgtgctcaataaaatcgagttgacatgaatgagcagatgctgcctcgttgcagtctggtagtgtaattccaggctgcccatgtggacttcgacttctg

SEQ ID NO: 41656 - DNA, 201 bp, Homo sapiens
tcgcttgagcccaggaggtcaaggcttcagagagccgtggttgcaccactgcactccagcctggacaacagagtgataccctgtatcaaaaaaaaaaaaaatcctgctggggttacaattggggttgatatgaatctgtagataaatttggggaaaattgacatcttaatgttgagtcttataattcatgaatatgaaacc

SEQ ID NO: 41657 - DNA, 201 bp, Homo sapiens
agaactgggaaatagtaaaaactcagataggataacctctgcatttattgtcagctgtttcctaagatacattccctgaaaaggaaaaatgagtagtgatwctaaatgaaaaagggggctggtaactcttagaaaaccagttagagtgctgtcagtccaagagaagcaaaggcccagacaaaatgtgacagcgtgtgattc

SEQ ID NO: 41658 - DNA, 201 bp, Homo sapiens
gtgtatagttgaggtaggactgaggttcctttttttccccatatggatatataatgacttcctataacattgtttgactatttttcctctcttaattgcgycagagctttgttgagaatcagttgattgtataaatgtagttctgtttctggacttaattctgtttagttgatacctttattattaagctaataacacact

SEQ ID NO: 41659 - DNA, 201 bp, Homo sapiens
cagtgatgcaaacctgtagagagagaaagacatctatacttaagaactgggaaatagtaaaaactcagataggataacctctgcatttattgtcagctgtytcctaagatacattccctgaaaaggaaaaatgagtagtgatactaaatgaaaaagggggctggtaactcttagaaaaccagttagagtgctgtcagtcca

SEQ ID NO: 41660 - DNA, 201 bp, Homo sapiens
ctagggtccatgagtgccagtggcagtgaggacagtcaccggcctggcctgtgtcctctcagctgtcctcacagcagctcaggcagggcaggaacatttgygtctgcaccttatacacaaggaggctgcagccccacaaggagagactccttggctgaggccacaagcctcggcagtggagagctgggctagaactcagcc

SEQ ID NO: 41661 - DNA, 201 bp, Homo sapiens
tttttaaagaccacctcaaccaagattttcaaatcatagtgaaacacaaaatttgatcaacttacccacaacagtgaaaaagcctctggctgacccttctdctacatcatttggcaagtccaaaactccctgcttggaggctttggcacctagaatgaaaatactgatttaaaaaatgtgatggcttctttatatcagcag

SEQ ID NO: 41662 - DNA, 201 bp, Homo sapiens
tatataaacagatatatatcactatctgtttatcctttcaccagttgatgtatattggggttgtttccatttttggctattatgaataaatctctcaaaayatctgggtacaagtctgtgtagatatatgtattcatttcttttgtgtacatatctaggagtaagattgctgggccaagcgtacggtaagtgtgcatgtat

SEQ ID NO: 41663 - DNA, 201 bp, Homo sapiens
actgctttgttaataaactaaggacctattaggtacctttgttattctacttgtggttataatctatagataaaaagccccttcactgataaacttctgtratttttccctaaataccgcctctatattcatgttctgtggctgccttctgtggctgctgtaatagactcacaaaacttggtggcttgagtgacagaaata

SEQ ID NO: 41664 - DNA, 201 bp, Homo sapiens
tttcgccatgttggtcaggctggtcttgaactcctgacctcaggtgatccacccacctcagcataatgcctggccagcatttgttgttgttgttgttgttkttttttttttttttaaagacagagtcatgcttgttttggcagcacatatactaaaaaactggaacaatacagagaagattattagcatggcccctgcacg

SEQ ID NO: 41665 - DNA, 201 bp, Homo sapiens
cactaacaatacaaaaaattagccgggcgtggtggcaggtgcctgtagtctcagctactcgggaggctgaggcaggagaatggcgtgaacctgggaggtgsagcttgcagtgagctgacatcacgccactgcactccagcctgggtgacagagcaagactccgtctcaaaaaaaaaaaaaaaaaaaaaatcagcaaaggtg

SEQ ID NO: 41666 - DNA, 201 bp, Homo sapiens
tgcaggtggagctgcctgccagtcctgcgccgtttgctcgcattcctcagcccttgggtggtcgatgggactgggcgccttggagcagggggtggtgctcrtcggggaggctcgggccgcacaggagcccacagagggggtgggaggctcaggcatggcgggctgcaggtcccgagccctgccccgtgggaaggcagctaa

SEQ ID NO: 41667 - DNA, 201 bp, Homo sapiens
caagtacaaaataaagcaatgataataggaatagcaaaaatgaatactaattaaattctgacttctaaaatctgataatgaaaagatcactgaccccaacwatgtgctggatgacaacatcagaattgtaagttcttttttttggttaattttaatttttaatttttatgggtacctagtagatgtgtatatttatggatt

SEQ ID NO: 41668 - DNA, 201 bp, Homo sapiens
gtctcccagcccagtgacagctgaagctgactgcttccgatatcacaggcagcacagaagagccgccctccaggtgctgctgggaaatgctgcctggaacyctttgccatttactttctatcaaaagctgagggaaatggtacatatggggctttcctaaaaatatgggatccatccatttgtcagcaatgtcattctatc

SEQ ID NO: 41669 - DNA, 201 bp, Homo sapiens
gaacttcctcagctcactttcaaatggagggcactggctttctaaccattgtgtctcccagcccagtgacagctgaagctgactgcttccgatatcacagrcagcacagaagagccgccctccaggtgctgctgggaaatgctgcctggaactctttgccatttactttctatcaaaagctgagggaaatggtacatatgg

SEQ ID NO: 41670 - DNA, 201 bp, Homo sapiens
  misc_feature (1)...(201): n = A,T,C or G, or insertion/deletion polymorphism (see Tables 1-2)
tgatagtcaccttttaagccttctacaggtctatcaagttgagtcaccattaccacttggtgtgtgctgtgccttgtgtaacactgcagttccgggagtcntccaacctggaatgcatgctttgcggggatctatgatgccctcgaattgtatgttacatgtgaacctgtgagcattttctaggggctctgcacctttgtg

SEQ ID NO: 41671 - DNA, 201 bp, Homo sapiens
attctgaggatagtgggcgagaactttggatttgaatgttcttctcaaaggactctggtcaaaattttcgcctacaacaaataatacatagttaatatctwgaacttttccaaaagcatgtcatagttttctatttattttatagtcctactactgactgataatgttgagatctgattcaatttctgcctctaaccatct

SEQ ID NO: 41672 - DNA, 201 bp, Homo sapiens
caattgatagcttaggaagatctctccattctgttattttaaggatttttaaagaccacctcaaccaagattttcaaatcatagtgaaacacaaaatttgwtcaacttacccacaacagtgaaaaagcctctggctgacccttctactacatcatttggcaagtccaaaactccctgcttggaggctttggcacctagaat

SEQ ID NO: 41673 - DNA, 201 bp, Homo sapiens
tttacaaataaactttttaatagcataatatttagttctatgcattgctacttaaccaatgacattaatgttgagcatttaagttatttctactgacttaytttttatcaagtaactcaacacagctttactgagcaattactatgtgccaaaaccacagaatatataatatagatcttggggatacagcagagaaaaaag

SEQ ID NO: 41674 - DNA, 201 bp, Homo sapiens
accattttgcttgatgggtatttcaaacactattctctgttgtattgtattcactattgtaatccatgagaagagaaaaccttggtattagtgtcctgagsagagtggtttccacatacctgttgattgaattcttcacagatactttgtgaatgtgtgttgtggcagtcggaacggcatagtgaatatcttctgcataca

SEQ ID NO: 41675 - DNA, 201 bp, Homo sapiens
ggtaaagtgtctgcattgctgtgcagatttgcttacttgtaacttcttcataaaaagtgagaacaaaaccataggtgcgagaaccatcttccctggtaatkataaatgagtgaaactgggggtctttattgtccgtttgtgtcctgaaagatagccctttaggcatgcacaactgtgaaagaaagaaaaaaaaaaatcaga

SEQ ID NO: 41676 - DNA, 201 bp, Homo sapiens
cccagcactttgggattccggggcaggaggatcacttgaggtcaggaattcaagactagcctgggcaacatagtgagaccccttctttcaaaaaaaaaaaatcagctgggcttggtggtgcacacctgtagtcccagctgcttgggagcctgaggctggaagattgcttgagcctgggagttggaggctgcagtgagctat

SEQ ID NO: 41677 - DNA, 201 bp, Homo sapiens
ctatgaaaaatatttctgaaaatctcattactagagagaggaggaagttaggagaatgcatttgtttgcttgtttgctagttttttttttaatcaatcaaycctatgaattacaaagtgtaatccatcccttccaagagatgttcatgttaataacagacaaagaagtttgcctttcgtatcaacaacaaacatttctcct

SEQ ID NO: 41678 - DNA, 201 bp, Homo sapiens
agtcccacactgtggctcatgcccgtaatcccagcactttgggattccggggcaggaggatcacttgaggtcaggaattcaagactagcctgggcaacatrgtgagaccccttctttcaaaaaaaaaaaatcagctgggcttggtggtgcacacctgtagtcccagctgcttgggagcctgaggctggaagattgcttgag

SEQ ID NO: 41679 - DNA, 201 bp, Homo sapiens
ttcttactgtggagcaagaaaagaggaggaggagaaaaacaaatctttggtgtctctttctcttttatgaggacaagggctgctcccttatggctgctcckttatgacctcctttacccttgaaggccagatctgtagtacagtcacatggcagggttaggatttcaacatatgtttgtttgttaagatgggcagtctcac

SEQ ID NO: 41680 - DNA, 201 bp, Homo sapiens
agcccacagctgggctgcgactgctcagaccagccagctggagggaggggctcagcagctctgggtttggccctgagagagtagttggattttaggctggycattgctgtatcaggacccaatcaattggcctagacgggatctctcagccttacaagccctctccaggtggtaggtacagagtggagagaggctgagttt

SEQ ID NO: 41681 - DNA, 201 bp, Homo sapiens
tttccttcatgaatatatgttgtttccttttttcaaaaatgtatcagtcccacactgtggctcatgcccgtaatcccagcactttgggattccggggcagraggatcacttgaggtcaggaattcaagactagcctgggcaacatagtgagaccccttctttcaaaaaaaaaaaatcagctgggcttggtggtgcacacct

SEQ ID NO: 41682 - DNA, 201 bp, Homo sapiens
tttggcataggggtgtgctcaataaaatcgagttgacatgaatgagcagatgctgcctcgttgcagtctggtagtgtaattccaggctgcccatgtggacytcgacttctgcccctgcccagggcagagaccaccgtgttgctttatgcctcgctggtgagagggggtcataaacagtttgtgctccatgaaccgttcctg

SEQ ID NO: 41683 - DNA, 201 bp, Homo sapiens
tgaaatgaatccaaatacccaaatgactggtaaccaactgaatttgaagaacatggaaactccaagtacttctaatgtaagtggcagggttttggacaacwccttttgcagtggacaagaatcctcaacaaaaggaatgcctgctaaaagtgacagtagctgttccatggaagtgctagcaacctgtctttccctgtggaa

SEQ ID NO: 41684 - DNA, 201 bp, Homo sapiens
gaaagttgaagatccagattctggcagggttctggttctggggagggggtctcttcctggcttgcagatggctgcgttcttactgtggagcaagaaaagasgaggaggagaaaaacaaatctttggtgtctctttctcttttatgaggacaagggctgctcccttatggctgctcctttatgacctcctttacccttgaag

SEQ ID NO: 41685 - DNA, 201 bp, Homo sapiens
tataattctaagttttagtctctgctgagtgaaccagtgcgttatgattatgttttgaacataattttgtcttgaacaatatgtcttaatattctgttttytctagttaataattgcccttttaaagttagtttagtttttaatatacctatgccagttcctcccacatcatccagtggcctctcaatatgattttccgta

SEQ ID NO: 41686 - DNA, 201 bp, Homo sapiens
ctctcactgccacagccaggagtagtagtagcagtccagtcctccagcagctgtagaaagggaacatcctttgggagagagtgtgtgttggggagggcagrtaggatcaggagagagaggaaagagataaagcgtatgaatgtgtaataaatcgatggtattttaattatccagaaagtacaagattctctggcatatgca

SEQ ID NO: 41687 - DNA, 201 bp, Homo sapiens
aagtatttgggtgaataaaaggactctaggctacagaattctggctagagttggctgggcgcggtggttcatgcctgtaatcccagcaccttgggaggccraggtgggcagatcacgaggtcaaagatcaagaccatcatggccaacattgtgaaaccctgtctctgctaaaaatacaaaaattagctgggcatgatggca

SEQ ID NO: 41688 - DNA, 201 bp, Homo sapiens
ttgcagactgagtagtttgcaaaaaaaagtttgagctcttaaaatttaactggtaaactttgattaatttgatgaaaagtggtggtggtggttggtatttktaagtctagtgtgaaactcattaaaagtatttgggtgaataaaaggactctaggctacagaattctggctagagttggctgggcgcggtggttcatgcct

SEQ ID NO: 41689 - DNA, 201 bp, Homo sapiens
tttcttcattttaaaacaccagggtgtgggggagggatgcaaacaaataacaaaaaagatgcttttgtaacattattttccctgtttagaaagaaaaaaaatcactccaatagtattgaaaagtccaaagatgaaatagtttcattttcttttcctaaggcttataaaaggccccctgcctgttgattccatccctctttt

SEQ ID NO: 41690 - DNA, 201 bp, Homo sapiens
gtgaagaaaggactggacaaagggatccaggttggggacagtaaattctaggggagtcactaggagatttatggggggatgtaaacctagtggaagataakgatttattaagtaagtttatctgtacaggtccagctcagtggcagttcccagtccctggagataagggttattttcttgccctggtaccggaaaggcctc

SEQ ID NO: 41691 - DNA, 201 bp, Homo sapiens
agctgcaaaagtcattatgagcaacacccttgatcttaggggtgctggtctttgagaagagagctctaagccttttgtagaggtattagaaaggtatcggmgccacggtgaaatgcaggggagattgggtttaggggctttcctggtctgcattctgctacagccgttaaatgccgctagatggagtgcgtgattctggta

SEQ ID NO: 41692 - DNA, 201 bp, Homo sapiens
tgaggaggagagcaatgtctgaaaaggtgagaaaaatggtagaaggctctcatgtcattgattctgtggggaatgaagaacccatggaggttcaatacccsagtaaagagcacatgaggtcaatgccacagtaaaagttttcttctagcaaaattacatgcttaaatgggggttaactcagttcatcttagcctcacacat

SEQ ID NO: 41693 - DNA, 201 bp, Homo sapiens
gaagtagcttcggcttgtgaatgtgcattgcagagacgtgggagaagaaagctgcaaaagtcattatgagcaacacccttgatcttaggggtgctggtctktgagaagagagctctaagccttttgtagaggtattagaaaggtatcggcgccacggtgaaatgcaggggagattgggtttaggggctttcctggtctgca

SEQ ID NO: 41694 - DNA, 201 bp, Homo sapiens
tagtctttttattgggaatacaaaaggttgtgaagtcaggactgtggttgggacaaaaaaatttaggtgtttagatcacaaatccaaggttctgcaggagyccagctgttctcagatcactgatttcctccactcctttccccatacagtaagacttaacatacctctagcctcctgggcagtgctctccaatctaaccct

SEQ ID NO: 41695 - DNA, 201 bp, Homo sapiens
atgattttccaggacttcacaacgggataaagtgaagtagcttcggcttgtgaatgtgcattgcagagacgtgggagaagaaagctgcaaaagtcattatragcaacacccttgatcttaggggtgctggtctttgagaagagagctctaagccttttgtagaggtattagaaaggtatcggcgccacggtgaaatgcagg

SEQ ID NO: 41696 - DNA, 201 bp, Homo sapiens
ggatgcatctttcagtccatatgcatgtttaatatatactttttcctaaaagcctttgagttaattgcagatcgtacaaccaacagtagaatcaagaaaayatactcaaaacaaccgaaatgttcaacagtagagggtagtatacaatgaaatctcatgcagtcattaaaaaattcaaatttctaataatatgagaatgct

SEQ ID NO: 41697 - DNA, 201 bp, Homo sapiens
ttcctcagtaaaaggatgaaaattggtttcagttgtcttactctattccagtctttgcccactttcacacaaatgacaaggccaatatgttttgtttgttktttaatcattaagagtttttgtacaaaaagtgatggttttttttcttcattttaaaacaccagggtgtgggggagggatgcaaacaaataacaaaaaaga

SEQ ID NO: 41698 - DNA, 201 bp, Homo sapiens
ttattttttaaaatctttacagttctcaccatttcacgtaccttaatccaatctttataaaagaggcagtctagagaactaggactgctcagccttatccyggagtggagcatttagcccaggtcttaattctccaagaggaggaatacatagtatggtaaggcaaggaactgggtggaatgtcaggttgcctgcccaatg

SEQ ID NO: 41699 - DNA, 201 bp, Homo sapiens
ataaatccaaataaccacagaaagattcacagtagtctagaaatcagttcaccttcaccaataaacatcttacttttcatacatcaaatagcctttttttwaaaaaagtgggccaaagatctggcttttgatattcagaccctcatagactataaaattttaggtcaacaacgatttggcttgtacgactagtatgtcctg

SEQ ID NO: 41700 - DNA, 201 bp, Homo sapiens
tctgctcttctccccaagccgaccccaaactcacagccagctttagcaagcaggcccgtcatccttccaggtgctatgtaatattaagaagcagcagctarcaattattagtgctactaggggcaggagatttgcagttccctcgctttcacacaaaagtatgaggtctgttttattattcccactctaaaggcaaaatgg

SEQ ID NO: 41701 - DNA, 201 bp, Homo sapiens
acagcagcaacagcagcagccgcaagccaccaccctcactgcccctcagccaccacaggtcccacctactcagcaggtcccaccttcccagtcccagcagmaagcccaaaccctggtcgttcagcccatgcttcagtcttcacccttgtctcttccacctgatgcagcccctaagccaccaattcccatccaatccaaacc

SEQ ID NO: 41702 - DNA, 201 bp, Homo sapiens
cctcataccccgtgtcttcgcttttccagtcctttggctgccctccggtttcttccctcacatacctgtctgactagttcctagaagcctggcagaaattsttctccgattttaatctggctgccacaaatgaaagaccttggagtccaaatactcctctctcaaagcaaaatctaaatggatataatttataagcaaaga

SEQ ID NO: 41703 - DNA, 201 bp, Homo sapiens
ttaccaactgggagacagaggtgaggtaaatcacaagcatggatgttagcagggctgcagaagtttataaataaatgatcttagaatctccagcagccccrttctttcatttggtaaccggcctcctccctgccctcatccctgtagcgcccttcccccatgagggtgaagggtcagctctaaaaatgcagtcaggaagga

SEQ ID NO: 41704 - DNA, 201 bp, Homo sapiens
tctctaattcatttctatataattctattttatttgctcctttttcttccgtagaatgtgttgccttcttttgagatttattgtcagccactttagaattyaatattcttggaatggaggataaattatatataaaggattgtagaagaggacaaatcttgcttgattatgaaggacattgctagcaatttagtcatgttt

SEQ ID NO: 41705 - DNA, 201 bp, Homo sapiens
gctggagtgcagtggcatgatctcagctcactgcaacctccgcctcccgggttcaagtgattctcctgcctcagcctccagagaaggtgggactacaggcrcgcaccaccatgcctagggaatttttgtatttttagtagagacggggtttcaccatgttggccagaacggtcttgatctcttgacctcataatctgtcca

SEQ ID NO: 41706 - DNA, 201 bp, Homo sapiens
ggggtggaatgtaactatatgcagtagcggtaattctgctccatttgtaaggagggtgaaatgcgatatggtcatgtaccctcttggtacacaagttccayaggctatagaaaaacaagtccataccctctgatatctgcattccttattcttgttatagcttacaaatcttctttagacacttaacagtgataattctcc

SEQ ID NO: 41707 - DNA, 201 bp, Homo sapiens
tcctatttcaagatccctatcacatctgcaaaaatcctttttccaaataaggcaatatttacagattctagaggttagaattttatatttttgggagacaytatttagtctattaaagcctacattagtaatttagtctattaaagcctacattagtataaattagaagtttactatattactaaaaatgacacatgaaca

SEQ ID NO: 41708 - DNA, 201 bp, Homo sapiens
cctcaggtgatccacccacctcagcataatgcctggccagcatttgttgttgttgttgttgttgttttttttttttttaaagacagagtcatgcttgtttyggcagcacatatactaaaaaactggaacaatacagagaagattattagcatggcccctgcacgaggatggcaagcaaattggtgaagcattccatatttt

SEQ ID NO: 41709 - DNA, 201 bp, Homo sapiens
gctgggattagaggtgcctgcaaccatgcccggctaatttttgtatttttactagagatggggtttcaccatgttggccaggctggtctcgaactcctgayctcgtgatccacccacctcagcctcccaaagtgttgtgactacaggcgtgagccaccgtgcccggcctgtttttttcttttctgtgtgtgtgacggagtc

SEQ ID NO: 41710 - DNA, 201 bp, Homo sapiens
actaaaaacacaaaaattagccgggcatggtgacatatgcctatatacagatgtgtgatttgggaggctaaggcaggagaatcgcttgattcccaggggayggaggttgcagtgagctgagattccaccactgcactccagcctaggtgacagagccagacaccatctcaaaaaaaccaaaaacaataacaacaacaaaaa

SEQ ID NO: 41711 - DNA, 201 bp, Homo sapiens
gcatgaacaaccacgcccagctaatttttgtatttttagtagagatggggtttcaccatgttggccaggttggtctcgaactcttgacctcaggtgatccrcccaccttggcctcccaaaatgccaggattataggtgtgagccactgctctggcctctttgggtcttacattttccttctgaagtctcccacgtacatgt

SEQ ID NO: 41712 - DNA, 201 bp, Homo sapiens
ttataccataaagataaagcatgaaacacaagaatcctccatgagttatttaaagtgaaatcacagggcacatggactcatgtggaaggagaggacatgamctgattcttttggtgaattttatttaggactaatttgactccctaaaagatcctcttaccttctgtacagataaggaaactctgggtcctttccttttca

SEQ ID NO: 41713 - DNA, 201 bp, Homo sapiens
agatggagaggctatttcctgttttagcttaagtgtgaattggccttatgctccctgcctccagaccctattttcctgcctcagcacaatctcagctcacygtaaccatctcccaggttcaggtgattctcctgcctcagcctcccgagtaactgggatcacaggcatgaacaaccacgcccagctaatttttgtattttt

SEQ ID NO: 41714 - DNA, 201 bp, Homo sapiens
ccttcccacagaaacagtcgattaacacatattttgtatgtggtgggtattatatcctgtatctttacaataaagtaagctagagaaaaggaaattataargaagaaaatatacatttacgctgggcacggtggctcacgtctgtaatcccagcactttgggaggccaaggcgggtggatcgcctgaggtcaggagttcga

SEQ ID NO: 41715 - DNA, 201 bp, Homo sapiens
aggaaattatctactctgctatttaataacctttaaaatcagaggctgaaggttaagccctaatctcacgggctgtttagcagaacaaagagtgattaacyatctttttctagtgcttggggctctctgccttggagctcatcactccagcccctctccaggcctccaccccctatgtcagcttagtagggccgaaacaga

SEQ ID NO: 41716 - DNA, 201 bp, Homo sapiens
ctgcagcattctttcccgccttcttggagttgaggtgagggattaaacaatcaaccttctctctcctttctctcattctcaaagtttttctcgccttttcyttcctttcctttgcttcatttcttttcccagtctatcgtttctctaggggtcgttgctttgctctttctccctctctgtctgttggtccctttgatcctt

SEQ ID NO: 41717 - DNA, 201 bp, Homo sapiens
gtcttgaactcctgacctcaggtgatccacctgccttggcctcccaaatttctgggatgacaggagtgagccaccgtgcccagcctaattttttttttttwagagatggagtctcactctgttgccaggctggagtgcagtggcgcgatctcggctcactgcaagctccacctcctgggtttaagtgattctcctgcctca

SEQ ID NO: 41718 - DNA, 201 bp, Homo sapiens
ccaaatttctgggatgacaggagtgagccaccgtgcccagcctaattttttttttttaagagatggagtctcactctgttgccaggctggagtgcagtggygcgatctcggctcactgcaagctccacctcctgggtttaagtgattctcctgcctcagcctcccaagtagctgggactactggctggcgccaccacgccc

SEQ ID NO: 41719 - DNA, 201 bp, Homo sapiens
gagtttatttgatttttaaaatctatcaaccattaccagcagagaagtcaaatgtaacaaggtctatataaatggtctgaaggttagtttttatttatttmttattattattttttttcttgagacgaagtctcgttctgtcacccaggctggagtgcagtggctcggtcttggctcaccacaaactccgcctcctgggtt

SEQ ID NO: 41720 - DNA, 201 bp, Homo sapiens
ggcataaccttatatataatagggtcctaacttataaataggttatattgtaacagttatctgtaagtcagttgtctggatcttagaacatgtatccacayatctataacagtatctggcacatagctggtgctcaaaaaatagttcttgaataaatgaatgaacaaatggaaagtgcaaatggctgttatattccctgac

SEQ ID NO: 41721 - DNA, 201 bp, Homo sapiens
tatatataatagggtcctaacttataaataggttatattgtaacagttatctgtaagtcagttgtctggatcttagaacatgtatccacacatctataacrgtatctggcacatagctggtgctcaaaaaatagttcttgaataaatgaatgaacaaatggaaagtgcaaatggctgttatattccctgacaacgagaaga

SEQ ID NO: 41722 - DNA, 201 bp, Homo sapiens
atgaatgaacaaatggaaagtgcaaatggctgttatattccctgacaacgagaagaaactgaatatgctttgtgatggttagttttatatgtcagattggygaagtcatagtacccagtttattcaattaaacacaaagctaggtgaaggtattccatagatatggttaacagctacacttaattgactttaaataaaaga

SEQ ID NO: 41723 - DNA, 201 bp, Homo sapiens
tccctgacaacgagaagaaactgaatatgctttgtgatggttagttttatatgtcagattggcgaagtcatagtacccagtttattcaattaaacacaaakctaggtgaaggtattccatagatatggttaacagctacacttaattgactttaaataaaagagataatctttcataacttaggtgggcttcatccaacca

SEQ ID NO: 41724 - DNA, 201 bp, Homo sapiens
aaactgaatatgctttgtgatggttagttttatatgtcagattggcgaagtcatagtacccagtttattcaattaaacacaaagctaggtgaaggtattcyatagatatggttaacagctacacttaattgactttaaataaaagagataatctttcataacttaggtgggcttcatccaaccaggtttaaattttttctc

SEQ ID NO: 41725 - DNA, 201 bp, Homo sapiens
ataataacatcttcactgagatacaggtatacttcagagataagcccatatatcaggaatatcaggttttgtgatatcaggttttgttctagaccactgchataaagtgaatattgtgataaagcaagtcacacaaattttttggtttcccagtgcatgtaaaagttatgcttacactatactgtaacctactaggtatgc

SEQ ID NO: 41726 - DNA, 201 bp, Homo sapiens
aggcaggagaatcgcttgaaccaggaggcagatgttgtagtgagccgagatcacgccactgcactccagcctgggagacagagcgagactccatctcaaamaatttttatttccaagagtataaaattattctgcatttaaaagcaacattataaccccacatctaaaagacccagggaggagtgaaaaacatttgttgga

SEQ ID NO: 41727 - DNA, 201 bp, Homo sapiens
agtaggtctcaacagtgggattaaaatattcggtcaattggccaggtgtggtggttcatgcctgtaatcccagcacttaggaggctgaggcaggtggattkgttgagctcaggagttcaagaccagcctgggcaacatggcaaaaccctgactctaccaaaaatataaaaaaattagccaggcatggtggtatgcacctgt

SEQ ID NO: 41728 - DNA, 201 bp, Homo sapiens
ggtttctcctttaaatatttgtatcaaataatttaactcaactgccttattgataactgtaactcctttttttttttttgagatagagtctcgctctgtcrctcaggctggagtgcaatggcgagatctcagctcactgcaacccccacttcccgggttcaagccgttgacctgcttcagcctccctagtacctgggatta

SEQ ID NO: 41729 - DNA, 201 bp, Homo sapiens
atgtaaattaagcagaatctaagatttactgttttaaataaatatcctttcttggatatagagaagaggtgagaagtaaaaatgaaacataaggccgggcrcagtggctcacgcctgtaatcccagcactttgggaggccgaggtgggcgatcacgaggtcgggagatcgacaccatcctggctaacacagtgaaaccccg

SEQ ID NO: 41730 - DNA, 201 bp, Homo sapiens
aactgaatatgctttgtgatggttagttttatatgtcagattggcgaagtcatagtacccagtttattcaattaaacacaaagctaggtgaaggtattccrtagatatggttaacagctacacttaattgactttaaataaaagagataatctttcataacttaggtgggcttcatccaaccaggtttaaattttttctca

SEQ ID NO: 41731 - DNA, 201 bp, Homo sapiens
tgtgatggttagttttatatgtcagattggcgaagtcatagtacccagtttattcaattaaacacaaagctaggtgaaggtattccatagatatggttaasagctacacttaattgactttaaataaaagagataatctttcataacttaggtgggcttcatccaaccaggtttaaattttttctcaaagtaaaaaatatt

SEQ ID NO: 41732 - DNA, 201 bp, Homo sapiens
caagatcttgtctctaaaaaggttttttaaaagaaggagggtaaatggagtgaaagtgtttaaagccctcacattgtccagaaactggtgacaatacttayattacaattgtaattaagcaaggatttgtattataatctctggggtaaccattaaaagagtagtaaaacaatgaataacaagctactggcagggacatgg

SEQ ID NO: 41733 - DNA, 201 bp, Homo sapiens
ccactgcactccagcctgggtgacagagcaagactccgtctcaataaaaaaaaataaaaataaaaaataaaagaggaagtgtgataatggaagcttttggrgtttttttttgccttctaaaaaaagcatggtatacaatataaaagaacatttattaggttctcaactctggaataaactcttgactgtatcatttaaaaa

SEQ ID NO: 41734 - DNA, 201 bp, Homo sapiens
atggagtgaaagtgtttaaagccctcacattgtccagaaactggtgacaatacttacattacaattgtaattaagcaaggatttgtattataatctctggkgtaaccattaaaagagtagtaaaacaatgaataacaagctactggcagggacatgggggatagaataattttaaaaactactccaaataaaggcaagaaa

SEQ ID NO: 41735 - DNA, 201 bp, Homo sapiens
ttttaaaaactactccaaataaaggcaagaaaagtgaggaaaagtgagcatacaaaacagatgggataaaatagaaacaaatagtaagatggcagacaaayccaaatatgtctgtttacactcaatgtaaacagattaatcaaatgagaatagttgtcagactggaattttaaatgattctattttgataccgatagtaag

SEQ ID NO: 41736 - DNA, 201 bp, Homo sapiens
aatctatgctatatccttgccaaaagtaaaatccacatctactaagaaaacaaccaaacctggacaacatagtgagaccccatccctaccaaaaaagaagwtagccaggcatggtggcacaggcctgtagtcccagatactcaggaggctgaggcaagagaattgcttgagcccaggcattcagggttacagtaagctata

SEQ ID NO: 41737 - DNA, 201 bp, Homo sapiens
aaccatatttttttgaagtcaagaaatgtatattgcttcatgttgcaaaatttgtatgctatgtcaaagaagcattgccagaaaatgatctgaaatgtagmacaataaagttacattatagatgtcttaggtgaaccaagagaaaaattagtgtcagagttaaaaagatgcaagtcaggaattaaggcaaaacattgaccc

SEQ ID NO: 41738 - DNA, 201 bp, Homo sapiens
tctctactaaaaatataaaaattagcctggagtggtggtgcacacctgtaatctcagctacttgggaggcaggagatttgcttgaacctgggaggcgggggttgcagtgagctgagatcacgccactgcactccagcctaggtaaaaaagcaagactccgtctcaaaaaaaaaaaaaaaagaaaagaaaaaaagaagaatg

SEQ ID NO: 41739 - DNA, 201 bp, Homo sapiens
ttctactaaaaatacaaaaatttagccaggtgtggtggccatgcacctgtaatcccagctactcgggaggctaaggcaggagaatcactgaacccgggagrcagaggctgcagtgagcagagatcgagccattgcactatagcttggcaacaagagcaaaactccgtctcaaaaaaaaaaaaaaaaaagaaactgtcaatg

SEQ ID NO: 41740 - DNA, 201 bp, Homo sapiens
tgattaaatcatttgcctttggtgatcaacttaaccttcagcccttctttgctccctggaggttgaggggtggggctgaaagtcccaattcttattctgaygttggtttttgaggtaaccagaccccactgaagctacctagaggctgccaaatttaagtcaactcgttagcatacaaaaagacacatcactttgaagatt

SEQ ID NO: 41741 - DNA, 201 bp, Homo sapiens
aaaggttgctaagagagcattctctttagggcaaaaggtcaaagtaagtgtagcttgacaccgacaccttcctggtgacccgagtttcttctgcccacctygttttctgtgaggagtccttctgagctcatacgcctggtcttatggaaggaagtggctttgagtgcacctctacctgtctatactcagccagagctgaag

SEQ ID NO: 41742 - DNA, 201 bp, Homo sapiens
cccagaaacaggggctgtttatccctttatttaggtcttctttcatttctttcaacaatgctttataattttcagagtacagatggtccttgacttgtgawggttcgtctagacttttttatttaacaatggtgttaaagcaataccatttagtagaaaccatactttgagtacctatacaactgttctgtttttcatttt

SEQ ID NO: 41743 - DNA, 201 bp, Homo sapiens
ttccaatggctcacaaaatggtaagtatacgtttggttgtttccctcaggatactgtagttgctctccaagctcttgccaaatatgccactaccgcctacrtgccatctgaggagatcaacctggttgtaaaatccactgagaatttccagcgcacattcaacatacagtcagttaacagattggtatttcagcaggatac

SEQ ID NO: 41744 - DNA, 201 bp, Homo sapiens
tgcctattaggggcgagtgaagctggttctggagaagggatctctgggaaatagtgaattatataccttagacaaagaggctggagaacagtgaaccaacyatgaagtgagagaaaaatgccatgaactcccaatctgctataaagaaacatacatctggcctggtgtggggcccatgtgtgtcatcccagcacttgggag

SEQ ID NO: 41745 - DNA, 201 bp, Homo sapiens
gcgcatgcctgtaatcccagctactcgggaagctgaggcaggagaatcacttgaacccaggagatggaggttgcggtgagctgagattgtaccactgcattccagcctgggcaacaagagcgaaattctgtctcaaaaaaaaaaaaaaaaaatcctgtaggtttgttatcaagaaaatgctgatgactataattaggacta

SEQ ID NO: 41746 - DNA, 201 bp, Homo sapiens
gggagagtttattcctggattctgttttgtctcattgtttacttcgcctatccttcaacaatatctcacacacacacacacacacacacacacacacacamtatagttttattatagttcttgattttgggtagtataatcctctagattttgtgattcttcttcaagatagccctagctattcttggcattttgaatttc

SEQ ID NO: 41747 - DNA, 201 bp, Homo sapiens
agctgagaaaaataccaaaaccaataaatgtcaaactgattgagatcaatagtcactgaatctactattctgtctctaatgacaagaaaacttttttttttgcattaagtaagttaattgaccttcgagaacttaatactcatatctgctttgtaacctccaaagttagtcgtccaaatgagaatcttgttgactaagaac

SEQ ID NO: 41748 - DNA, 201 bp, Homo sapiens
atgtaacccacctttgatatgttttcatatacattatggggaaaccatatttttttgaagtcaagaaatgtatattgcttcatgttgcaaaatttgtatgmtatgtcaaagaagcattgccagaaaatgatctgaaatgtagaacaataaagttacattatagatgtcttaggtgaaccaagagaaaaattagtgtcagag

SEQ ID NO: 41749 - DNA, 201 bp, Homo sapiens
tggtaaattggcccaaaggtattagcaaagttttataggaattccaacctgagataagggcaataagtttactagctatgagatattacagataacatttygtactgatgcctctttttggtattatgtatatttattttggtcagaaatattggatgagtcactaaattgcatcatctcaagaaatgttcctgcatttac

SEQ ID NO: 41750 - DNA, 201 bp, Homo sapiens
gattcggggtatgcttatgagcacaggaataaaggaaaaaggcagtaatctaagttgcatatataatgcctataaaacaaaaggcaccgtttgacaaggtrtctggctgatataatgggaaaaccaagaattcaggcttcaaaggaggttttttaatgcttaaatgatgtggtttgtctgatttaattatataatcagcag

SEQ ID NO: 41751 - DNA, 201 bp, Homo sapiens
cccggctaaatttcccctccgttcagaaggtttgtttggacctgagccctgggtacagtgatgttaaattcacggttactctggagaccaaggacaagacycagaagttgctagaatactctggactgaagaagaggcacttacattgtatctcctttcttgtaagcacagactcagccctcactcgaatcccttacttgc

SEQ ID NO: 41752 - DNA, 201 bp, Homo sapiens
tgccagaacaagtgaaccagcacagagagatcaaggagaaagccacaatggctggccgcagaaatcacacttcatcatttttgcaatatcatactggtatyacaaaaaagctccgttcagtgggaagtgggaataggggtgggctcaggtggtggtacttacacaacagcagtaataacagaaaaggggaccatattgtta

SEQ ID NO: 41753 - DNA, 201 bp, Homo sapiens
gcttctgttctcttttgacaagttcttataattctttgagcatgtctagctgacacaagatgttctaggctcatcttgttcttccctaccctgttactagmatcagcgatttctccaagagccctggtttcttagtggaaaagggtgtatacaaaccaagatctgtctgctaagtatgatcaaaggttgtttctcctttca

SEQ ID NO: 41754 - DNA, 201 bp, Homo sapiens
caagctggcttctgttctcttttgacaagttcttataattctttgagcatgtctagctgacacaagatgttctaggctcatcttgttcttccctaccctgktactagaatcagcgatttctccaagagccctggtttcttagtggaaaagggtgtatacaaaccaagatctgtctgctaagtatgatcaaaggttgtttct

SEQ ID NO: 41755 - DNA, 201 bp, Homo sapiens
gtctttctgtgactgacctatttcacttagcataatgacttctggttccatccatgctgttgcaaatgatatttattgatattttgtattttattcatttyaaatgtatttatttctgctctgatctttattgtttgttctaattttgggttcggtttgctcttgctcttctagttctttaagatgaatgttaggttattt

SEQ ID NO: 41756 - DNA, 201 bp, Homo sapiens
ctcagacagccaccgtccttgttgattgataggcccttttgggtactgtcactcacccagagttttaggagtcactgtccaagacaaggtttgtctctcayttccacagatacaataggattcttctccctttgtattttgggaagctaggaaggctggagaggctttcagctgcacactgacctatcaccccatgtgagg

SEQ ID NO: 41757 - DNA, 201 bp, Homo sapiens
tacacaaggaggctgcagccccacaaggagagactccttggctgaggccacaagcctcggcagtggagagctgggctagaactcagccggcctggctctasatctcaggctctgaggcagctgactgcactgggtaacctttgaggtgccaaccgtcaaggcgtccttagcctgagctttccttctcccataaagcctctg

SEQ ID NO: 41758 - DNA, 201 bp, Homo sapiens
tctgggctcgagggatcctcccacctcagcttcccaagcagctgggactacaggtgcacgccaccagcccactgctaatttttttttttttttttttttttgcagaggtagagtcttactatgttactagggccgatctagaactcctggcctcaggcgatcctccccccttggcctcccaaagttctgggattataagca

SEQ ID NO: 41759 - DNA, 201 bp, Homo sapiens
ttgtggaaacattaacaagaccaaggaagtgagatctgggcatttggggcagtaagttatgggaaggtaaatatatcggaggcactaatggaagataatgrccattttagtaagatttgtttacgcagattcaagttggtgctgactttctgtctcttgtcatataagttattctccttctcctgatatgggagaggggga

SEQ ID NO: 41760 - DNA, 201 bp, Homo sapiens
gttgtggaaacattaacaagaccaaggaagtgagatctgggcatttggggcagtaagttatgggaaggtaaatatatcggaggcactaatggaagataatraccattttagtaagatttgtttacgcagattcaagttggtgctgactttctgtctcttgtcatataagttattctccttctcctgatatgggagaggggg

SEQ ID NO: 41761 - DNA, 201 bp, Homo sapiens
aacatggtgaaaccctgtccctactaaatatacaaaattagctgggcgtggtggcatgcgcctgtaatcccagctactcgggaggctgaggcaggagaatygcttgaacccgggaggcggaggttgcagtgagctgggattgcaccactgcactccagcctgggggacagagtgagacttggtgtccaaaaaaaaaaagaa

SEQ ID NO: 41762 - DNA, 201 bp, Homo sapiens
ttaccttatgagcttcaaaattgtttttagtaatccttagtaaattagcatttatgcctcttatcattattgtgacttccaacctttaagacctatgtgayttctgaaactttaagccttgcagataatgttttgcgcacaattctatttcccttgtggtaactgctccttagcttttcttcaaagtgcacttattttttt

SEQ ID NO: 41763 - DNA, 201 bp, Homo sapiens
cagttctggctcagggtttttcatgaggtttcattccacctggtggccagggcttcggcggtctgaaggcttagccagggctggaagatctactcccaagkcagctcattcacatagtagttggcggaggcctcaggtcctcaccacatggacctctccagaggaatgctgaagtcttctgccagaacaagtgaaccagca

SEQ ID NO: 41764 - DNA, 201 bp, Homo sapiens
accctaatatttagcaatttaaatattttaaagaaccataacatttattatctcacatagtttctactagacaggaatctgggagcatcttggcctagacrgttctggctcagggtttttcatgaggtttcattccacctggtggccagggcttcggcggtctgaaggcttagccagggctggaagatctactcccaagtc

SEQ ID NO: 41765 - DNA, 201 bp, Homo sapiens
acaggaaccaccatccgctttttcttgtcgtagggcggtgggatgccatcaaacaccttgaggcggtccagagcggcctggcctcgcttggtcttgtgggkcagcatacctcgcacggtccgccagaagatgcggctgggggcccggaagtggtaggagcctcggtaagagttggtgttcatccgcttgcggaggaaagcg

SEQ ID NO: 41766 - DNA, 201 bp, Homo sapiens
acataaaattacaggatttatagttctttaaaatggaaaagtgctctcaaaaaatgttactagttcaaaggagattcataaatgaatcatgtaattttaarcaattctcactagatggagctagttacaaataaatacttttttaatatttttcttctttatttttaattttttatttttatttattttttattttttgag

SEQ ID NO: 41767 - DNA, 201 bp, Homo sapiens
cccaaagtgctgggattacaggtgtgagccaccgcacccggcctcttttttttttttttttttttttgagatggagtttcgctcttgttacccaggctggwgtgcaatggtgccatctcggctcactgcaacctccgcctcccgggttcaagcaattctcctgcttcagccttctgagtagctgggattataggcatgtgc

SEQ ID NO: 41768 - DNA, 201 bp, Homo sapiens
agtcatctaattccaaaattcttgtatttacttaatttcccctgaaactctcaacctcctatatgtgtcacttgccagcctatccccttctaccagtttcrtgtcccagtttgccacctgtaaacatgtgaacactggcactggcatggatgcctggggcaactagcgcttcacctatgatgggggctagcgctctaccag

SEQ ID NO: 41769 - DNA, 201 bp, Homo sapiens
tatcttatgacccaggacacaggcacacagacacacatacgtgactgaattaatacttagccttacaccattgcactgttttattttctttccttttcctttttttttttttttgagacggagtcttgctctgtgcccagcccaggctggagtgcagtggcgcaatcttggctcactgcaaactctgcctcccgggttcac

SEQ ID NO: 41770 - DNA, 201 bp, Homo sapiens
ctgtgtcaacccaaattgagagaccaagatgggaatctcaatcaaacaaagtttatcaggccgagcttgaggatgtgcgcccaggaagcacaggttccaayaggttataacctgtgtttcaaagcagattacacgaggcacggtattcatacatttttttaaacagggggatacctgcagtacagtgaagcaacaattaca

SEQ ID NO: 41771 - DNA, 201 bp, Homo sapiens
ttatcttatgacccaggacacaggcacacagacacacatacgtgactgaattaatacttagccttacaccattgcactgttttattttctttccttttcctttttttttttttttgagacggagtcttgctctgtgcccagcccaggctggagtgcagtggcgcaatcttggctcactgcaaactctgcctcccgggttca

SEQ ID NO: 41772 - DNA, 201 bp, Homo sapiens
ggatggtctcgatctcctgacctcatgatccgcccacctcggcctcccaaagtgctgggattacaggcgtgagccactgcacccggcctaatttttcatakttttttgtagagatagggtttcgccatgttgcccaggctggtctcaaacccctgagctcaagtgattggcttgtcctcccaaagtgctgattataggcgt

SEQ ID NO: 41773 - DNA, 201 bp, Homo sapiens
cagtggcgtgatctcagctcattgcaacctccacctcccgggttcacgccattctcctggctcagcctcccaagtagctgggactacagatgcccgccacyacgtccggctaatttttttgtatttttagtagagacggggtttcaccttgttagccaggatggtctcgatctcctgacctcatgatccgcccacctcggc

SEQ ID NO: 41774 - DNA, 201 bp, Homo sapiens
ttcgacttcctgggctcaagcaatcctcccatctcagcttcctgaatctctggggctacaggcgtatgccatcatgcccagctaattttcgttgttttggytttttgttttttgttttttgagacggagtctcactctgtcgcccaggctggtgtgcagtggcgtgatctcagctcattgcaacctccacctcccgggttc

SEQ ID NO: 41775 - DNA, 201 bp, Homo sapiens
tgactccaggtaaattcaggatgaatggagaggaatggcagcttcactcaccaccacaaggtgctgcctcctgctgtgttccagacagtcccaaagccccrgaagcacagcgcagggactccagagtgagactgaatgaaaacatatccacacgtaagtgccactcacacactctgtgtccggggcgtggaataggccagg

SEQ ID NO: 41776 - DNA, 201 bp, Homo sapiens
ataaatatatatatatagtatacatctataaccatttatttattatacttacattaatttttttcctatagactcttccagcaagaataaggtttttttttgtttttgttttgagagggagtcttgctctgtcacccaggctggagtgcagcagcatgatctcagctcactgcaacctccgcctagcgggttcaagcgact

SEQ ID NO: 41777 - DNA, 201 bp, Homo sapiens
ctccaccttggaaacacaagaaaggagccgtggctgcagagaaaaacagaggctggaaacaggggtacatgggcagggtggtggtggtgagagaattgccygaatcagctgccaaatggtgcccaggttggaaaagcaaatgtgcacacatgggttcttcccactctaaccctgaggaattagaggcctgcttctgacaca

SEQ ID NO: 41778 - DNA, 201 bp, Homo sapiens
gtacatcacatcagccaattttggggtggctcatccttaactcctgcaacacttttgcttagtggttttatcattatatattgtataaatatatatatatwgtatacatctataaccatttatttattatacttacattaatttttttcctatagactcttccagcaagaataaggtttttttttgtttttgttttgagag

SEQ ID NO: 41779 - DNA, 201 bp, Homo sapiens
actatttcataaattcaggcatatttgcttaaaataatctcctgtagagaggcaagaaacagaagcccatttttttgtttttaggaaattcatagaagccwttggtaaggttcttttaagttggcaaactctattttcagaagacttctatgttgacacttgtgacctacagaattgctttaagaggtcagcactgataaa

SEQ ID NO: 41780 - DNA, 201 bp, Homo sapiens
gcgagccggagcgcgccagacccagggcgagactgcagtgacgcggcccgggagacatggcggacgggcgtctctgaataagcagaatccggagcccctcsctacccgcggccgccgcagcccgggccatgccgcacggctgctgaccgcacgcaggggccggccccgaggacacatgcggcggcctttgccgcctcgccc

SEQ ID NO: 41781 - DNA, 201 bp, Homo sapiens
catgaacccaggggacggaccttgcagtaagcagagatgcgccactgcactccagcctcggtgacagagacagactctgtctcaaaaaaaaaaaaaaaacaaaaaccataaacagggtattgttaatagtgttatcaaaattagctgggatgggtttggtagacttgcactttgcacttctagcttctatcatggtctcat

SEQ ID NO: 41782 - DNA, 201 bp, Homo sapiens
gcctggctatttttgtgtatctttttcagtagagatgaagttttgccatgttgcccaggctggccttgaactcctgggctcaagagatccacctgcttcascttcccaaagtggtatgattacaggcatgagccattgcgcctggcctctatgcatatgttgagaagccccagtctgagctcagagatgacctctggttaa

SEQ ID NO: 41783 - DNA, 201 bp, Homo sapiens
ttaagcaaaggtgaattggatgttcgagttcttttcaaggtgcttcctcagcgacacctctattctggtctaaacgctgttgccacctctcagttcagatsaacagcctatgtgccaggtgctgtgctaggttggacagacacaagaatccatagggcatgattcttgtcctctgtaaacttagaagccagcccagatgta

SEQ ID NO: 41784 - DNA, 201 bp, Homo sapiens
gagaaaatacaatcaacctgacaactgggagtaggaggaattcagatctgaaaatttttaaagtagttcatctgtctagagtattatcagaacctcctacyctctaaaagcactaatttccttataagatactttttctgatacttacctcaaggtatatcagtggaatctatatgataaaaggaaagaagagatgtgatt

SEQ ID NO: 41785 - DNA, 201 bp, Homo sapiens
agattgcagtgagctgagatgcgccactgtactacagtctggtgacagagccagactctgtctcaaaaaaaaaaaaaaaaaagtatttgagttgatgctcygtcaaaactcatttatcaagaggatttggttttaggcaacgaaaccttgcctcaaactcatttccaactcagcgggtttgaagatgtgcaaggattcatc

SEQ ID NO: 41786 - DNA, 201 bp, Homo sapiens
gcttgaaccagggagtcggagattgcagtgagctgagatgcgccactgtactacagtctggtgacagagccagactctgtctcaaaaaaaaaaaaaaaaaagtatttgagttgatgctctgtcaaaactcatttatcaagaggatttggttttaggcaacgaaaccttgcctcaaactcatttccaactcagcgggtttga

SEQ ID NO: 41787 - DNA, 201 bp, Homo sapiens
gcattttggcagaccgaggcaggaggatcgcttgaattcaggagtttgagaccagcctgggcaacatagcaagaccttgctctgctaaaaacaaacaaaaraattagccaggcgtagtgatatgtgcctgtggtcccagctactcaggaggctgaggcaggaggattgcttgagtttgggaggtggaggctgcagtgagct

SEQ ID NO: 41788 - DNA, 201 bp, Homo sapiens
ttttgttttcctggcaggaaacggagattctttaattaaaaattaaaatttgaggttgggtatggtggctcatgcctgtaaacccagcattttggcagacsgaggcaggaggatcgcttgaattcaggagtttgagaccagcctgggcaacatagcaagaccttgctctgctaaaaacaaacaaaaaaattagccaggcgt

SEQ ID NO: 41789 - DNA, 201 bp, Homo sapiens
gcatgaacccaggggacggaccttgcagtaagcagagatgcgccactgcactccagcctcggtgacagagacagactctgtctcaaaaaaaaaaaaaaaacaaaaaccataaacagggtattgttaatagtgttatcaaaattagctgggatgggtttggtagacttgcactttgcacttctagcttctatcatggtctca

SEQ ID NO: 41790 - DNA, 201 bp, Homo sapiens
cattcaagataaaggcaccaatggttgagtctctggttccatgatgatgccttgttgctgcatcctccagagaagaggaacgctgagtcctcatgtggcasaagtgcaggagagagagaacacactcctgcaagcttgttttatggcaaagttaatccattcaccagggcagagccctcatgatttaaccacctctcatta

SEQ ID NO: 41791 - DNA, 201 bp, Homo sapiens
taccacagactgggtaacttatgaggaacagaaatctattctctcacagttctggagcctaggacattcaagataaaggcaccaatggttgagtctctggktccatgatgatgccttgttgctgcatcctccagagaagaggaacgctgagtcctcatgtggcagaagtgcaggagagagagaacacactcctgcaagctt

SEQ ID NO: 41792 - DNA, 201 bp, Homo sapiens
tgttaggtttttttattattattattttattttttatttttatttttttgagatggagtctcgctgtgtcacccaggctggagtgcagtggcgtcatctcrgctcactggaagctcggcctcctgcgttcacgccattctgcctcagcctcccgagtagctgggactacaggcacctgtcaccatgtccggctaatttttt

SEQ ID NO: 41793 - DNA, 201 bp, Homo sapiens
aattagatgggcgtggtggcacacgtctgtaatcccagcgacttgggaggctgaggcaggagaatcgcttgaaccccggaggcggaggttgcagtgagccragattgtgccattgtgctccagcctgggcaaccagagcaaagctctgtctcaaaaacaaacaaacatttgcttttttgtttttaatattactattttact

SEQ ID NO: 41794 - DNA, 201 bp, Homo sapiens
agtaatgcaatctagccaatttaagcagaaagggatttgtcttagtccattctgtgctgctataacagaataccacagactgggtaacttatgaggaacasaaatctattctctcacagttctggagcctaggacattcaagataaaggcaccaatggttgagtctctggttccatgatgatgccttgttgctgcatcctc

SEQ ID NO: 41795 - DNA, 201 bp, Homo sapiens
agtagagacggagtttcaccgtgttagccaggatggtctcgatctcctgacctcgtgatctgcccacctcggcctcccaaagtgctgggattacaggtgtragccaccgcgcccggcacctatttttattttttttgagacagagtctcgatctgtcacccaggctggagtgcagtggcgtgatcttggctcactgcaatc

SEQ ID NO: 41796 - DNA, 201 bp, Homo sapiens
tcaggttcttaattccaagcaaagtaatgcaatctagccaatttaagcagaaagggatttgtcttagtccattctgtgctgctataacagaataccacagwctgggtaacttatgaggaacagaaatctattctctcacagttctggagcctaggacattcaagataaaggcaccaatggttgagtctctggttccatgat

SEQ ID NO: 41797 - DNA, 201 bp, Homo sapiens
gcacctggccgggcgctgtggctcacacctgtaatcccagcactttgggaggccaaggtgggcggatcatctgaggtcaggagttcgagatcagcctgacsaacatggtgaaaccccatctctactaaagatacaaaattagccaggtgtggtggtgcatgcctgtaatcccagctacttgggaagctgaggaaggagaaa

SEQ ID NO: 41798 - DNA, 201 bp, Homo sapiens
ctttgggaggccaaggtgggtagatttcttgaggccaggagttcaagaccagcctgggcaacatcgtgagccctcatctctactaaagataaaataattakccgggtgtggtgtcatgagcttgtagtcctaactgctcaagaggctgaggtgggaggatcccttgtgcctaggaggtggaagttgcagtgagtcgtaatc

SEQ ID NO: 41799 - DNA, 201 bp, Homo sapiens
aaaaaaaaaaaaaaaaaaaggtaaagctgatctgaagaaagagcaggtctgtggcagagatttgctacattactttccatcccttcaatcttttcttcccrctgaccaaaccctggctcaggccaccgaaggggatatttgaatctgtagagcatctacatttagttcagtattgctgtcccatgtaagccccaggtggga

SEQ ID NO: 41800 - DNA, 201 bp, Homo sapiens
caaaattagccaggtgtggtggtgcatgcctgtaatcccagctacttgggaagctgaggaaggagaaatgcttgaatccaggaggtggaggttgtagtgcrccgagaccatgccattgcactccagcctgggcaagaagagtgagactccccctaaaaaaaaaaaaaaaagagagagagagattgtttgcatctacaatgt

SEQ ID NO: 41801 - DNA, 201 bp, Homo sapiens
tggtggcgagcacctgtaatcccagctacttgggaggcttaggcaagagaattgcttgagcctgagaggcagaggtcgtggtgagctgtgatagcaccacwgcactccagtctgggtgagagagtgagagaccctgtaggaaagaaaagaaggagggaaggagggaaggagggaaggaaggaaggagggagggagggaaag

SEQ ID NO: 41802 - DNA, 201 bp, Homo sapiens
ttgtagtgcaccgagaccatgccattgcactccagcctgggcaagaagagtgagactccccctaaaaaaaaaaaaaaaagagagagagagattgtttgcayctacaatgttcattttcagcctccatccagaagagccaagtatggtttggacctaatattatgaagtaaatagctttaaacatggtttggtggattaata

SEQ ID NO: 41803 - DNA, 201 bp, Homo sapiens
atggtggcgagcacctgtaatcccagctacttgggaggcttaggcaagagaattgcttgagcctgagaggcagaggtcgtggtgagctgtgatagcaccaytgcactccagtctgggtgagagagtgagagaccctgtaggaaagaaaagaaggagggaaggagggaaggagggaaggaaggaaggagggagggagggaaa

SEQ ID NO: 41804 - DNA, 201 bp, Homo sapiens
catttgaacccgggaggccggaggttgcagtaagccaagattgtgccactgcactccagcctgggtgacagagtgagacttcgtctaaaaaaaaaaaaaaacagataaaaatgtgttatttgtaaattagctgggtgcagtggtgtgggcctgtaatcccagctactcatggggctgaggtgggagaatctcttgagccaa

SEQ ID NO: 41805 - DNA, 201 bp, Homo sapiens
ggctttgggaggagcgtgccgccttccacagtgagcagcgaggctgggacctgcagggatgaggtcccgggaggggatgcggcagcccttgagtgctggtbggggaaggagagctgcccccagtgaggaggcgccgagctgagtggcccagactccttaggagaggcctggttttgggcttcctggtgattttccttcatg

SEQ ID NO: 41806 - DNA, 201 bp, Homo sapiens
ccacccttagagtcatcttttaacaatcttgaaacaaacagagttattctagagaaaagtagtttggagcatgccactgaaaaaagcacagctaacgatamgtgctcgtcagctgctattcaggaggatatttaccctcaggaaatagatgcatccagcaactatactccccaagatcctgcaagaaatgaaatccacagt

SEQ ID NO: 41807 - DNA, 201 bp, Homo sapiens
tctcagtcctgttcagcttcagccactactatcctttgtctattaatacagcaccaaccacttggtcccaaaggaacgttctggcgagaaatgtgcagagwgaatcagttcgccagcaggtgcgattctggaattgtttggctgccagagacccggtatttggtgtgtccgtcattactgggtgtttgtgtccccaagcca

SEQ ID NO: 41808 - DNA, 201 bp, Homo sapiens
tctttagggaatcgaggagcgcactggtgcaggggctgggtggagccatcctccgatggagcacaggcagatggaagcccccaccccagctgcgtggcctsaagccagcctcccgctccccgaaggtggtctccacacagaactgggacagttccatccccgccccttcctccagggcagcagggctgaggatcccattct

SEQ ID NO: 41809 - DNA, 201 bp, Homo sapiens
tgggctcagtggctcacacctgtaatcccagcactttgggaggcttacacaggacgataatttgagcctaggggttttttttttcttttttttttttttttgagatggagtttcactcttgttgcccaggctggagtgcagtggtgcaatctcagctcgctgcaacctccgcctcccgggttcaagcgattctcctgcctc

SEQ ID NO: 41810 - DNA, 201 bp, Homo sapiens
gatatgtgctgctgttttctctggaagcctctttagggaatcgaggagcgcactggtgcaggggctgggtggagccatcctccgatggagcacaggcagayggaagcccccaccccagctgcgtggcctgaagccagcctcccgctccccgaaggtggtctccacacagaactgggacagttccatccccgccccttcctc

SEQ ID NO: 41811 - DNA, 201 bp, Homo sapiens
cagttgagccagggaggcagaggttgcaatgagctgagattgcatcactgcactccagcctgtgtgacagagtgagaccctgtctcaaaaaaaaaaaaaaacttaaaatcttttttttaattctctcaatttcaatctcacttacttcttctttcaaagccaccactgtctgaacctggtgcccttccttctgattatagt

SEQ ID NO: 41812 - DNA, 201 bp, Homo sapiens
ccaggagttcaagaccagcctgggcaacataatgagcttctgtctctacaaaagaaattaaaaaaatagccagatggtagttgtgtcctacttggaaggcygaggtggaaggatcacttgagtctgggaggtggaggctgcagtgaagcaagatcacattgcttcactcctgcttgggtgacagagcaaaacccttctcaa

SEQ ID NO: 41813 - DNA, 201 bp, Homo sapiens
ctcctgaataactgggattacagtcacgcaccaccacgcccagctaatttttatatttttagtggagacagggtttcaccatgttggccaggatggtctcratctcttgacctcatgatctactcgccttggctttccaaagtgctggaattactggcttgagccaccacgcccagcggtgtgtagctttttatctttttt

SEQ ID NO: 41814 - DNA, 201 bp, Homo sapiens
tcggctcactgcaatctccgcataccaggttcaagcgattctcctgcctcagcctcctgaataactgggattacagtcacgcaccaccacgcccagctaayttttatatttttagtggagacagggtttcaccatgttggccaggatggtctcgatctcttgacctcatgatctactcgccttggctttccaaagtgctgg

SEQ ID NO: 41815 - DNA, 201 bp, Homo sapiens
ggcgcgtgcctgtaatcccagctacctgggaggctgaggcaagtgaatcacttgaaccccggaggcggaagttgcagtgagctgagatagcaccactgtaytccagcctgggcaacagagcaagactccatctcaaaaaaaagaaaagaaaagaaaagaaagatttatatacatctcacaggggcagagagaatttacaat

SEQ ID NO: 41816 - DNA, 201 bp, Homo sapiens
ctgcctctcgggttcacgccattctcctgcctcactcagcctcccgagtagctgggactacaggcacccgccaccacacccggctaattttttgtttttgktttttttttttttttttttttagtagagacggggtttcaccgtgttagccaggatggtctcgatcttctgacctcgtgatctgcccgcctgggcctccca

SEQ ID NO: 41817 - DNA, 201 bp, Homo sapiens
aagcaggccaattactcagaagaagccaacgattctaggtagtaagaccagacatagatttattctgcagaacacaaaatgttcttgtaaaaagagacacygtgtgagctaatggataatgagctcaacagcatccttgtttagacaaggtgaccactgatatggtttggctgtgtccccacccaaatctcatattgaatt

SEQ ID NO: 41818 - DNA, 201 bp, Homo sapiens
tagccggcttctttactgcaaactgttttatcaacaacctgttctatggtctgtatcttgtgctgacctcctatctcatcctgtgatttagaatgccttawcctcctgggaatgcatcccagcaggtctcagcctcattttacttagcccctattcaagatggagtcactctggttcatacgcctctgacagtgttacata

SEQ ID NO: 41819 - DNA, 201 bp, Homo sapiens
agacatagatttattctgcagaacacaaaatgttcttgtaaaaagagacaccgtgtgagctaatggataatgagctcaacagcatccttgtttagacaagrtgaccactgatatggtttggctgtgtccccacccaaatctcatattgaattgtagtttccataatccccacgtgtcatgggagggacccggtgggaggta

SEQ ID NO: 41820 - DNA, 201 bp, Homo sapiens
tttttaatagagacggggtttcaccatcttggccaggctcatcttgaactcctgacctcgtgatccacccgcctcggcctcccaaagtgctgggattacasgcgtgagccactgcgcccggccttaagtctctaaatttttaaaaaatgcatttaatactaaggtctcaaacagttttctagacatgtaaatcaaaaaccc

SEQ ID NO: 41821 - DNA, 201 bp, Homo sapiens
aaactctccctcttaagtctctaaacttttttttttttttttgagacggagtctcgctctgttgcccaggctggagtgcagtggtgcgatctcagctcacygcaacctccgcccctccaggtttaagcaattctcctcctcagcatctagagtagctgggattacaggcgtgtgccaccacgcccagctaattttttttgt

SEQ ID NO: 41822 - DNA, 201 bp, Homo sapiens
tgggggctctgggtctttatgtagattggggaaaaatctcttccaaggcctgataatctctaagagtttttattttatttatttatttattatttattttwtttatttatttatttatttatttatttatttatttatttattttcagacagggtctcactctgtttgttgcccaggatggagtgtactggctcccttgag

SEQ ID NO: 41823 - DNA, 201 bp, Homo sapiens
tttttagcagagatagggtttcaccatgttggccaggctggtctccaatgcctgacctcaagtgatctgcccacctggacctcccaaagtgttggaattayaggcactagcctcagcacctggccccaaacacttatataacctcttttcagaggggtgggggagatggggaatataggtagttcagtagaggggcattaa

SEQ ID NO: 41824 - DNA, 201 bp, Homo sapiens
gctaaaggaccatttaaaaatgtaaaaggacaatcccctggatgagagaaaatcattccaaatcaaatatctgataaggggcttgtatctagagtatacaragaacccatacattcagtaataaaatgataactaactcaaacaatagacaaaggatctggacaggcattttgccaacaaagataaacaaatggccaagaa

SEQ ID NO: 41825 - DNA, 201 bp, Homo sapiens
tttaaagcactggtgaagtgtgaagaaaatgagaccgattagggaagaaaacccgagaagctcagagtttgggtgaccctggggatgtgggaaggtggtgwaaatggtaccctgagggtagcatggatggtaagtgaaagaggaaaaggtgtaggtttgcataaaagaaactgatggaatttggatgccccatagcagacc

SEQ ID NO: 41826 - DNA, 201 bp, Homo sapiens
gaaggtggtgtaaatggtaccctgagggtagcatggatggtaagtgaaagaggaaaaggtgtaggtttgcataaaagaaactgatggaatttggatgcccmatagcagacccaggggaatgataccaggggaaaagatggacagttttgtgggtaaattagcagtgattttgattccttgtcttgttagctgctgatggag

SEQ ID NO: 41827 - DNA, 201 bp, Homo sapiens
gctttcaacagcagtggcaaaaccctaatgaaaatgtcagcacaattggaaatttcactaacttgaaagtaaataccaacagcaaacagccttttaacggwcccattagatcttctgtggatggtgttcagactcttgctcaaactaatgaagagaaaataatggattcttgcaatccaacttcaaatcaagtactggaca

SEQ ID NO: 41828 - DNA, 201 bp, Homo sapiens
gtataatttaaaaaaaaagaaaaagagaaaagcaggggttgcaatactaatttcagacaaaacagactttaaaccaagaaaggtcaaaaaaaaaaaaaaaagacaagagaattgcataatggtaaagggtttaattcaatgagaagacctaactaaacaaaatctacatgcacccaacacaggagcacccagattcataaa

SEQ ID NO: 41829 - DNA, 201 bp, Homo sapiens
tatcatacctcttaatactatcacattggattttaggttccaacatacaaattttgggaggacatgaacatctggacagtagcaatgctagtccattattytggtctgtctgaaggttttatctaggcagggaaaagcgtatgttttttccttgaccttgaaaatttagcttgggctttctttgtacaaacatgaagatcc

SEQ ID NO: 41830 - DNA, 201 bp, Homo sapiens
caagatgagatttgggtggggacacagccaaactgtatcaactatcatacctcttaatactatcacattggattttaggttccaacatacaaattttgggrggacatgaacatctggacagtagcaatgctagtccattattctggtctgtctgaaggttttatctaggcagggaaaagcgtatgttttttccttgacctt

SEQ ID NO: 41831 - DNA, 201 bp, Homo sapiens
gaaccatgttatacacctatgagaaaaaacatttcccaataattttaagcacttcttttaaaattacaaaattggcaaattgtctactgtaccatttattyttgttcttttctttaagagcacggccatcatatttaatccagtattttcacataagctcttcctttcaaaagagcaaaccagttttgttttaggcaactg

SEQ ID NO: 41832 - DNA, 201 bp, Homo sapiens
atgtactctattggcagattacagacacgaatctcaaagtataggaagaaaactacataattaagaaaacattaatatgcattatgaatactaaaaattgygatgaaatattttccaaaatccttagtgatcttaccctgacaatattatagatatctccatccccatagttgcttacaggtgtgtaatataaaccattgt

SEQ ID NO: 41833 - DNA, 201 bp, Homo sapiens
cataattttctgtttccagataaagcggcttagggagtggcagccttctctccatcacacatacttctggttttcggtaatggagattggtaaagactttkagacccatgttctttaaagaaacaaacaacaaaaatattgttcattcttttcatgcaagaactataaaaggcctattatttatattgcaaagataaatgg

SEQ ID NO: 41834 - DNA, 201 bp, Homo sapiens
acttgaccatgcacatggagaaaaccagtgtgattgctcaatatcccaataggacacaaataataataataattattattatttttaattttttgagacasagtctcactctcttggccaggttggagtgcagtggcacaatcccagctcaccacaacctccgcctcccaggtttaagcaattctcctgtctcagcctcca

SEQ ID NO: 41835 - DNA, 201 bp, Homo sapiens
atcccacattcagtcttcaaaaaggtcttaagaattctactctcccattccactccttcctcaatataaatccatgtacttcttttcccagctgctatcayctcagtctaggccatgattttctttttcctggacaactgcaacagcttcctaactagggaccctacttctatcttttgatatcttccaacttttttgtgt

SEQ ID NO: 41836 - DNA, 201 bp, Homo sapiens
aataccaccttaacagaatcttagttgtgtctcagaagagggaactgtgtctgcacacacacacttacacataggctaaaaaactgtgactaggccaggcrtggtggctcacacctgtaatcccagcactttaggaggctgaggcaggtggatcatgaggtcaggagttcgagaccatcctggctaacacggtgaaacccc

SEQ ID NO: 41837 - DNA, 201 bp, Homo sapiens
cattccactccttcctcaatataaatccatgtacttcttttcccagctgctatcacctcagtctaggccatgattttctttttcctggacaactgcaacarcttcctaactagggaccctacttctatcttttgatatcttccaacttttttgtgtgtgcagtagaaaaattttaattaaaaaaattttttttgtagggac

SEQ ID NO: 41838 - DNA, 201 bp, Homo sapiens
tgcactccagcctgggcgacagagcaagactccgtctcaaaaaaaaaaaaaaaaaggttttatggctgggcttggtggctcacacctgtaatcccagcacytttggaggctgaggtgggaagattgcttgagcccagaagtttaagaccaaacaaaacaacaaaaccaaaaaagccagacccagtggtgcccaagtgcctg

SEQ ID NO: 41839 - DNA, 201 bp, Homo sapiens
ttttcttcctttcttcctttctctttcttttctttctttctttctttcctctttcttctttccttcttttccctccctccctccctcccttccttcgttcmttccttccttccttccttctctctttctctctttctttgcatctgctgttcctgaatcatcttcagctcaaaacagtccttatttaggggtggcatattc

SEQ ID NO: 41840 - DNA, 201 bp, Homo sapiens
tgcctcagcttcctgagtagctgggactacaggcgcctgccaccacggccagctaattttttgtatttttggtagagatagggtttcaccctattagccargatggtcttgatctcctgacctcgtgatctgcctgcctcagcctcgcaaagtgctgggattacgggcgtgagccaccgcgcccggccttcattaactttt

SEQ ID NO: 41841 - DNA, 201 bp, Homo sapiens
tcctgcctcagcctcccgagtagctgggattacaggcgcccaccaccacacccagctaatttttgtatttttagtagagatggggtttcaccatgttggtygggctggtctcgaactcctgacctcagatgatccgcccacctcggcctcccaaagtactgggactacaggtgtaagccaccgagcctggcctttttttct

SEQ ID NO: 41842 - DNA, 201 bp, Homo sapiens
tttttttttttttttgagacggagtctcgctctgtcacccaggctggaatacagtgatgcgatctcggctcactgtaacctctggctcccgggttcaagckattcccctgcctcagcttcctgagtagctgggactacaggcgcctgccaccacggccagctaattttttgtatttttggtagagatagggtttcacccta

SEQ ID NO: 41843 - DNA, 201 bp, Homo sapiens
cctatacttcattaacttttttttttttttttttgagacggagtctcgctctgtcacccaggctggaatacagtgatgcgatctcggctcactgtaacctytggctcccgggttcaagcgattcccctgcctcagcttcctgagtagctgggactacaggcgcctgccaccacggccagctaattttttgtatttttggta

SEQ ID NO: 41844 - DNA, 201 bp, Homo sapiens
ttagctgggcgtgatggcccgcacctgtagccccagttactcaggaggctgaggcaggagaatcgcttgaacctgggaggtggaggttgcagcgagcagasatcacatcactgtactccagcctgggcaacagagcaagactctggccactccaccccaccctccaaccaaaaaaaatcaaaaatcaaaaaagagataaaa

SEQ ID NO: 41845 - DNA, 201 bp, Homo sapiens
gagcccaggagtttgggagatcaagcctgcagtgagctatgatcacaccactgcactccagcctgggcagcagagtgagaccttatttctaaaaaaaaaaagagcgagctttttcactatgaggttttacataatgatacaagaacttttttgtcaaaagaatatttcttcttctacaggtttttctcaaaaagggacaac

SEQ ID NO: 41846 - DNA, 201 bp, Homo sapiens
aactcacctacaaatagtctgaaagagtggtgtatatcaaatacgtgggtagtgttgcatttcaaatgaggctcttctggttgaaatgatatatttataaraccagaatatcacaaatgggtgatgtataatgtctctttagttttttggtatttggcctcttttaaagcctgtcggatgtatgggagaaaacaatgaacg

SEQ ID NO: 41847 - DNA, 201 bp, Homo sapiens
ggtgggcggatcaccggaggtcgggagttcgagaccaacctgaccaacatggagaaaccccgtctctattaaaaatacaaaattagccgggtgtggtggcrcatgcctgtaatcccagctactagggaggctgaggcaggagaatcacttgaacccgggaggtggaggttgcggtgagccaagatcgtgctgttgcactcc

SEQ ID NO: 41848 - DNA, 201 bp, Homo sapiens
gaacgtgctttgatttcctatcagtcactcttaagaacatacatattgtttaagtaactcggtcttttttatctgattcttgaggcactatgggtagcaartaaccacttacaaatttaaatgtaatatacactccttttctgtgtgtcaagtccttatttttaggtgcatattgacatttaaatgttaattattgtttgg

SEQ ID NO: 41849 - DNA, 201 bp, Homo sapiens
tctcgatctcctgaccttgtgatccccccgccttggcctcccaaagtgctgggattacaggctgagccaccgcacccggccggaactttgtttttttttttccaagtggctacttttatttatttgaaaaaaacaagccccagagctgccaaggggctgccttctctgtcttgtggagacagtgcttgatcctggagagca

SEQ ID NO: 41850 - DNA, 201 bp, Homo sapiens
ctttgggagaccgagggggaggatcgcttgagcccaggagtttgagaccggcctgggaacatttcaaaaccccgtctctgcaaaaaatgaccccttgtggrctgaagtgggaggatcgcttgcgctcaggaggtggaggctgtagtgagccatgatcgtttcactgtattccagcctgggcaacagagtgagaccctgtct

SEQ ID NO: 41851 - DNA, 201 bp, Homo sapiens
cagctttcaacagcagtggcaaaaccctaatgaaaatgtcagcacaattggaaatttcactaacttgaaagtaaataccaacagcaaacagccttttaacrgtcccattagatcttctgtggatggtgttcagactcttgctcaaactaatgaagagaaaataatggattcttgcaatccaacttcaaatcaagtactgga

SEQ ID NO: 41852 - DNA, 201 bp, Homo sapiens
tagtttcttttatatctttaagttctaaatcacaaaatcatatggcaagaaaaaccccagatttcttttccaatctatgaataaacataaagagacagttwatacttaattgatctatctgaactatgatttttaacttctctcattgtttttatttttttattttattttattttattttgagatggagtctcgcacttt

SEQ ID NO: 41853 - DNA, 201 bp, Homo sapiens
tcatctgaaataaggaccagctttcaacagcagtggcaaaaccctaatgaaaatgtcagcacaattggaaatttcactaacttgaaagtaaataccaacarcaaacagccttttaacggtcccattagatcttctgtggatggtgttcagactcttgctcaaactaatgaagagaaaataatggattcttgcaatccaact

SEQ ID NO: 41854 - DNA, 201 bp, Homo sapiens
attatgaaagtggaaattgataccttttcctcttgggatttaattaagtctataaaattgaggtgttgcaatacataatgtctatgatttttttttaccasctctaaatctctgagatggctgtgttttagagctgcatgttctgcttatttactgcctgtcctttacatttcaaattcattcaatatttttccaaagtac

SEQ ID NO: 41855 - DNA, 201 bp, Homo sapiens
aaagagttctgtaattgtaaaaatgtgacataggcattctctaatgtgcaatgaatagtcatttttaagcatttcatacattgttcctgtactgcactggrtctccttgtgctgaactgcatgggataggccatttccatacaatctcatcctctgaataaggaaccatgatgctcctaaagacatactaaatatagatct

SEQ ID NO: 41856 - DNA, 201 bp, Homo sapiens
cactaagtgaagcatgattgtatttctgacattgtattttatcaataaaaataaactacatctcacatctgaagctaatttcttgttatagccaaaagcaygtctagtctgtcttattctgctttatccaactataggatgtctaattgtagccaaaaacatggcataattcacacataaaattccaaaattgcatcattt

SEQ ID NO: 41857 - DNA, 201 bp, Homo sapiens
catctaggtttgcgtaagtacactctatgatgttcgcacaacaatatcacctaacaatgcatttttcagaacaaattctccatcactaagtgaagcatgaytgtatttctgacattgtattttatcaataaaaataaactacatctcacatctgaagctaatttcttgttatagccaaaagcatgtctagtctgtcttatt

SEQ ID NO: 41858 - DNA, 201 bp, Homo sapiens
cacaaatagttatcatcgtggtacaactgcctacagtattcagtatagtcacatgctgcggaggtttgtagcctaggaaaaatgggctgtaccacatagcmtaggtgtgttgcaggctacagcatctaggtttgcgtaagtacactctatgatgttcgcacaacaatatcacctaacaatgcatttttcagaacaaattct

SEQ ID NO: 41859 - DNA, 201 bp, Homo sapiens
aatttgctattccatatatagtaggctgtatcatctaggtttgtgtaagcacactctataaggtttgcacgaggacaaaatcacctcacgcatttctcccygctgttaagcaatgtgtgacctgtatctgtcccaccaacagaagttatttgcatttcttcctgacaaaaatcttcaagttaacaagtaatttcacgaatt

SEQ ID NO: 41860 - DNA, 201 bp, Homo sapiens
tcaccaagttatgctcccttttaaggtcacttggcagacaggcaggtaggaactttcctggtgaaccctccctgtatgaccatgcagctttccactgggarcttttacaggttgctgctatttttataaaaatgatagactgtaatgttgccggggacagtggctcatgcctgtaatcccagcagtttaggaggctgaggt

SEQ ID NO: 41861 - DNA, 201 bp, Homo sapiens
atattatcagggtgtaaggtctccataaaacacctcactttcctgtatcacagtcacttactatgactgttttcctgtatcaccatacattgcctgttccyctacacagtcaggtaccacataatgacactgtgatcaatgacagaccacttagactacagtggtcccataaagttagaatggagctgaaaaattcctacc

SEQ ID NO: 41862 - DNA, 201 bp, Homo sapiens
gtttatttgtttattgttctctcctactagaatttaaatttaaatctatgaggacaggaactttgtttttttgtttgtttgtttgtttgagatggtgtctygctctgtcgcccaggctggagtgcagtggtgcgatctcctctcactgcaagctccacctcccgggttcaagccattctcctgcctcagcctccccagtag

SEQ ID NO: 41863 - DNA, 201 bp, Homo sapiens
tgctagagaaaaaaataaaataaaatgtatgataagtacatgcaaatcaatgatacatattttacaaatatggtactgttttatatacccaggaataaacmtgaagaaagaaaaagaaaatagaaataaagacacataggagagaaaatggttaaaactcactcgacactgacgaggtcccacatccatgtctctgggaag

SEQ ID NO: 41864 - DNA, 201 bp, Homo sapiens
aggcacgcattcatcatgcttagctaattttgtatttttagtagagacggggtttcaccatgttggtcaggctggtctcgaactcccgacctcaggtgatycgcccacctcgcctcccaaagtgctgggattacaggtgtcggccactgtatctggccctcaaatgttctaagcagactctacctcgaggcctttgcacag

SEQ ID NO: 41865 - DNA, 201 bp, Homo sapiens
cggattacaggtgtgtgccactgcacccagccaacattttccctttttaaagaaaagaaacataattcagacatacatataaagcatacaattcagtgatatttttttagtatatttataaagttgtacaaccatcaacactatctaatttcagcagattttcatcatctccaaaagaaactccatatccattagcagttc

SEQ ID NO: 41866 - DNA, 201 bp, Homo sapiens
tctatgttgcctgggctagtctagaactcttgatctcaagtgatcttcctgccctggcctcccaatgtgctgggattataggcatgagacaccatacccartgataagaacttattatttatttatttatttttgagacagagtcttgctctgtcatgcatgctggaatgcagtggcggaatctcagttcactgcaacgtc

SEQ ID NO: 41867 - DNA, 201 bp, Homo sapiens
ttttgtggttttagtagagaaggggtctcactatgttgcccaggctggtctcctactcctgggttcaagcaatcaacctgccttggcctcccaaagtgctyggattacaggtgtgtgccactgcacccagccaacattttccctttttaaagaaaagaaacataattcagacatacatataaagcatacaattcagtgata

SEQ ID NO: 41868 - DNA, 201 bp, Homo sapiens
cctcccaatgtgctgggattataggcatgagacaccatacccaatgataagaacttattatttatttatttatttttgagacagagtcttgctctgtcatscatgctggaatgcagtggcggaatctcagttcactgcaacgtccgcctcctgggttcaagtgattctcctgcttcagctgcacgagtagctgggattaca

SEQ ID NO: 41869 - DNA, 201 bp, Homo sapiens
gcttaataggcccatttataaagtgccatggcaacaagaaaggaggtctgcatggacttctcactgaggcttctctgcccatgcaccaagagtcaaggctrtgctgggcccctgactgatcacaccattctccagggaaccaatgagcctcttggtggtagattgatacattggaccctttctacacagaaggagaagcaa

SEQ ID NO: 41870 - DNA, 201 bp, Homo sapiens
gctggaatgcagtggcggaatctcagttcactgcaacgtccgcctcctgggttcaagtgattctcctgcttcagctgcacgagtagctgggattacaggtrtgtgccaccacatctggctaatttttttgtattttttttttttttagtagaaatggggttttgccatgttggctaggctggtcatgaactcctggcctca

SEQ ID NO: 41871 - DNA, 201 bp, Homo sapiens
gtgaaaccctgtctctactaaaactacaaaaaaattagccgggcatggtggcgggcgcctgtagtcccagctactcgggaggctgaggcaggagaatggcrtgaacctgggaggcggaggtggcagtgagccgagatcgtgccactgcactccagcgtgggcgacacagcaagactccatctcaaaaaaaaaaaaaaaaaa

SEQ ID NO: 41872 - DNA, 201 bp, Homo sapiens
cctcctagtgctgggattacaggtgtgagccaccacacccagccttttcaaaattttctttatactttttgtataagctcttttttattaaatttttttttaactttttttcaaattgaaaactaaaagatgggcacagtggctcaccaaggtcaggagatgactggacacagtgcctcatgcctgtaatcccagcacttt

SEQ ID NO: 41873 - DNA, 201 bp, Homo sapiens
aggcatgggccactgcatcaggccattaattgtaattttttttattcatttcaagacagggttaagaaactgctaattttgtatttctggtagagacaggrttttgccatgtttcccaaaacagtctcaaactcatgggctgaagcaatcctcccgcctgggcctcccataataaagtgctgggattacaggtgttagcca

SEQ ID NO: 41874 - DNA, 201 bp, Homo sapiens
ttgagcccaggaggcagaagttgcagtgagccaagatggtgccactgcactccagtctgggtgacagagccaaaccctatctcattaaaaaaaaaaaaaaagagagagagaagaaaagggaaaagaagatatgcagttgttcctgcaccatttgttgaaaagactggaatgttgattttaataatgcatgtaaattctcca

SEQ ID NO: 41875 - DNA, 201 bp, Homo sapiens
aaaatctacaaacccatgaaatgtttaaaaaaacaacaaaaaaaaaacactacttaatccctagagcaaaaccaaggacataaaatggtctctgaaaccargttactttatatatttaacaaagtactgggtgggcgtggcataacttgattttaaactggagatttgttttttcaagcaatctggtggttctttagaata

SEQ ID NO: 41876 - DNA, 201 bp, Homo sapiens
tttttgtgtgtggtgtgaggtagggattgaggttttttttttttccaatatagatatgcagaatttaggctgggtgtggtagatgacatctgtaatcccascactttgggaggccaagatggttaattgcttgacgtcaggagttcgagactagcctgggcaatatggtgaaaccctgtctctaccaaaaatacaaaaaaa

SEQ ID NO: 41877 - DNA, 201 bp, Homo sapiens
aaaaaaaagaataattggaataattatttagactgtaataagaaaaatgagctggaaggactgggcataactactgatttacaagttagatccagtttatrttacggtgtggacctattataggggtaatatgaaagggtgccatggtttctagggtaggaggatatataccatggctcttatacaggcaaaatgggctac

SEQ ID NO: 41878 - DNA, 201 bp, Homo sapiens
catttatatcacatatcttttagatttttataaattttgttttccataattgttttttttttttttttgagatagagtcctgcccactcttgcccaggctkgagtgcagtgaggagatcttggctcactgtaacctctgccttccaggttcaagctattctcctgcctcagcctcccaagtagctgggattacaggcaccc

SEQ ID NO: 41879 - DNA, 201 bp, Homo sapiens
gatagtgaaatgtcttctatgaactagaaaataagaaaatagacacttaaagttcagagtagagaaggaaactcaaagagacataatggttccagggcagsctaactgtacagtacccttaagaaaagtattcgtatctatatctctactgcagtaggccaagtgctgtggcacatgcctaaaattgtagcactttgggag

SEQ ID NO: 41880 - DNA, 201 bp, Homo sapiens
attatggtttaaaccagcaaaatatgtcttcttagatatacgaaacattttgtcaaatagcccctggcatcatctgggctaaatgaagaatcaccaggacrtgtgatacagtgaaactattccacttatagtaacagcacttagtaattgctttcattaatccaggcaggttaatattctatctacttgcataacaatgtc

SEQ ID NO: 41881 - DNA, 201 bp, Homo sapiens
atgattaaaagtaagcaagtaatgagtaaactagatttgtaaaatctggaaggaatcttagagataagaagatgacagtatcataggaaagaaaaaggaakgatataaagaaaaatctgcaataaatgaaggactctaggttcatgcttcacgctctctgtgtggaactcacggttttccagagactgaggcgtctgtggg

SEQ ID NO: 41882 - DNA, 201 bp, Homo sapiens
ctcttgaccttgtgatccgcccgcctcggcctcccaaagtgctgggattacaggtgtgagccaccgagcctggcctagtccaatattttataatctgcatygtcaactagtcaggccccagaatctgtgggttcagcatccttggattctgcatccttggattgaaaatatttggaaaaaaaattgcatcggtactaaacg

SEQ ID NO: 41883 - DNA, 201 bp, Homo sapiens
cgtgatcacagtggtgtagaattgccaatcttcaacctgcctgtattttccaaagcgatcataccaatttatttaccttccagcagtgtatgagaattctstattctcaccatcattggatattgtcagattttaacatttggctcaactgatgggtgtataatggtatcctatggtacttataatttgcattatccctag

SEQ ID NO: 41884 - DNA, 201 bp, Homo sapiens
gaatttctatgagcgtgatcacagtggtgtagaattgccaatcttcaacctgcctgtattttccaaagcgatcataccaatttatttaccttccagcagtktatgagaattctctattctcaccatcattggatattgtcagattttaacatttggctcaactgatgggtgtataatggtatcctatggtacttataattt

SEQ ID NO: 41885 - DNA, 201 bp, Homo sapiens
tgcataaaatgaatagaagagaaactcttggtgaagggaaaacaatgctagagaaaaaaataaaataaaatgtatgataagtacatgcaaatcaatgatayatattttacaaatatggtactgttttatatacccaggaataaacctgaagaaagaaaaagaaaatagaaataaagacacataggagagaaaatggttaaa

SEQ ID NO: 41886 - DNA, 201 bp, Homo sapiens
atggtaggtgaaggacccagcgagaagtcaaataattaaggtggcattaatgatagcatggccttcatttgggatatggcatatgccaaacatatagtccrtgataggtcatgccagttagcatttatattgtattttaattacattatgctcttgtaaaaatgaatggtggttttgatctacacagcattaacaaccaga

SEQ ID NO: 41887 - DNA, 201 bp, Homo sapiens
gcagcaattttcttgaaggtggcctgggttcatgatggtaggtgaaggacccagcgagaagtcaaataattaaggtggcattaatgatagcatggccttcrtttgggatatggcatatgccaaacatatagtccatgataggtcatgccagttagcatttatattgtattttaattacattatgctcttgtaaaaatgaat

SEQ ID NO: 41888 - DNA, 201 bp, Homo sapiens
aatgaatatagtacattaaagaacatttgaatggccattttttaaaagtagtgattaaaagtgtcacgcacatcgtatctagcattccttgtttactagarttttaaactttttccattccatgtattttcaatatttcaataggagacaagtttatttttccatcttgcagatagcataggcactaagacaatattctca

SEQ ID NO: 41889 - DNA, 201 bp, Homo sapiens
tggctggctaatttttttgtatttttggtagagatggggtttcatcatgttggccaggctggtcttgaactcctgaactcaagtgatcctcctgcctcagyctcccaaagtgctgggattacaggtgtaagccactgtgcccggccagttgtgagaattttgtatgtattctgactaccagtcctctgtcagatatatgta

SEQ ID NO: 41890 - DNA, 201 bp, Homo sapiens
cgacaggcacgtgccaccttggctggctaatttttttgtatttttggtagagatggggtttcatcatgttggccaggctggtcttgaactcctgaactcargtgatcctcctgcctcagtctcccaaagtgctgggattacaggtgtaagccactgtgcccggccagttgtgagaattttgtatgtattctgactaccagt

SEQ ID NO: 41891 - DNA, 201 bp, Homo sapiens
acgacaggcacgtgccaccttggctggctaatttttttgtatttttggtagagatggggtttcatcatgttggccaggctggtcttgaactcctgaactcmagtgatcctcctgcctcagtctcccaaagtgctgggattacaggtgtaagccactgtgcccggccagttgtgagaattttgtatgtattctgactaccag

SEQ ID NO: 41892 - DNA, 201 bp, Homo sapiens
ggttgtctttttattactaagttgtaagagtttttttttttttttttttttttttttttttttttttttttttgagatggagtcttgctctgtcacccagrctggagtgcagtggtgcaatcttggctctctgcatcctttgcctcctgggctcaagccatcctcccacctcagcctccagagtagctgggacgacaggca

SEQ ID NO: 41893 - DNA, 201 bp, Homo sapiens
cagtcaggttgtctttttattactaagttgtaagagtttttttttttttttttttttttttttttttttttttttttttgagatggagtcttgctctgtcrcccaggctggagtgcagtggtgcaatcttggctctctgcatcctttgcctcctgggctcaagccatcctcccacctcagcctccagagtagctgggacga

SEQ ID NO: 41894 - DNA, 201 bp, Homo sapiens
gtctgagaccctttcagggttgtgaactgaactagttacttttctcatggaacaccatttttactttttaaaagaatgattgatatggtttgactgtgtcrccacccaaatctcatcttgaattgtagctcccacaattcccatgtgtcgtgagagggacccggtgggaggtaattgaatcatgggggcaagtctttcctg

SEQ ID NO: 41895 - DNA, 201 bp, Homo sapiens
tttggtttgggcagccagtcaggttgtctttttattactaagttgtaagagtttttttttttttttttttttttttttttttttttttttttttgagatgragtcttgctctgtcacccaggctggagtgcagtggtgcaatcttggctctctgcatcctttgcctcctgggctcaagccatcctcccacctcagcctcca

SEQ ID NO: 41896 - DNA, 201 bp, Homo sapiens
gtttggtttgggcagccagtcaggttgtctttttattactaagttgtaagagtttttttttttttttttttttttttttttttttttttttttttgagatrgagtcttgctctgtcacccaggctggagtgcagtggtgcaatcttggctctctgcatcctttgcctcctgggctcaagccatcctcccacctcagcctcc

SEQ ID NO: 41897 - DNA, 201 bp, Homo sapiens
ttgcagtgggccgagatcacgccactgcactgcagcctgggcaacagaacgagactctgtctcaaaaaaatacacacacacacacacacacacacacacamtatgtgcatacacacatacgtgcacgcacatgtacatatatacatacgtgcacgcacatgtgcatatatacatacatgcacgcatgtgtatatatacata

SEQ ID NO: 41898 - DNA, 201 bp, Homo sapiens
cccctccaaaggacagctgtgcagggccatttcaaaatatggcaaagaaacatgttttggggtaaaatattttgactttcttctttgtcacataatgttaygccagagtcagattggaaagtaagtcacgatatatagggttaaatcaaacccatctgatgagaatttatagtttgtaggccatgactctccagaccctta

SEQ ID NO: 41899 - DNA, 201 bp, Homo sapiens
tggtggggacctccacaaaacttacccagcacccctagcaagacattccagtcataagctgaggaatattcttcttagacataggggagaataggctgatrtcttaggattcataatccattttcatatagttccgtgaccttacttttgtcctgacaaaattattctgcctgaacatctgagagggatctaaatcctagg

SEQ ID NO: 41900 - DNA, 201 bp, Homo sapiens
agcaagacactatatatatatgcagatttcacacagaaaaaaatcaaaacttacttgttgtataattatggtcttattttcaaagagtacaaataaaagtktaaggatcttaatttaaaaatagttttaaaacactttcaaaaatataaagtagatttagagattcaagaaaaaaaactggtgccagcaagccaagaacaa

SEQ ID NO: 41901 - DNA, 201 bp, Homo sapiens
agattgtggagacttcgctggcctggtggctcacgcctgtaccccagcacttaggccaggcgcagcggctcactcccgtaatcccagcacttaggccagtygcattggctcacatctataatcccagcactttgggaggccgaggcaggcggatagcctgaggtcgggagttcgagaccagcctggccagcatggtgaaac

SEQ ID NO: 41902 - DNA, 201 bp, Homo sapiens
attacaacagccttcgcttcacatctgactcttgcagcattcttataaagagatctcacaccatatttgagggcttcattagttttctaagccttaaaaawatttcatcattaagattattctctcatgaagcacccaaaatatagacagcttttcttattttcttttcttcaattgttgacagtctaatgctgccagatc

SEQ ID NO: 41903 - DNA, 201 bp, Homo sapiens
tgaataaaatgttacttgcatctcctcattgtcacagtgttcgtattacatacttcgtgtgtgtagttttggcatttaaggaaacagagctaaaaaaaaaacaaaggacaataactgcatcaacaacatgttatacaccagaggaaatgcggcgacttaggttctgtgatgggaaacccggatttttttgttgtacttgaa

SEQ ID NO: 41904 - DNA, 201 bp, Homo sapiens
tttcactgattttaatgcacaactgtcctgagctgtggcttacagaggagctgtggaattaggcatcctgtggtatattacagtctcaggtgtgccgaacsacacgtatgatatgctgaagacactagaaacggccaagacatacaggattgtcagagggattgacttgggatcagttagtcaatcgatggtaggaagggg

SEQ ID NO: 41905 - DNA, 201 bp, Homo sapiens
aagactttgacctttatgcacttttaccttccttaataactcttcaaaagaggccttgaaaaaaatgcaatgactagcaagttatgggagtactggaatgmaatgactgttcaaaggttggtttcacccatagccatgagtgtcatagtcccaggaagatgggttgaattcagggccactctaggaattttgcttgcggtt

SEQ ID NO: 41906 - DNA, 201 bp, Homo sapiens
aaaatgttggggtttagtttcttcaggtgaataaaatgttacttgcatctcctcattgtcacagtgttcgtattacatacttcgtgtgtgtagttttggcatttaaggaaacagagctaaaaaaaaaacaaaggacaataactgcatcaacaacatgttatacaccagaggaaatgcggcgacttaggttctgtgatggga

SEQ ID NO: 41907 - DNA, 201 bp, Homo sapiens
tttcacgaatttgagtttggatacaatgtttgtgatttcactgatcctgtttgcagtgacttccaggtctgaaaaatataaagagtcagtacttttagaarttactttagtcataaaatttctttcttacaaatgacctttattttgttatggaaagtaaactattgttttatttcccatattcgttcattactcacacct

SEQ ID NO: 41908 - DNA, 201 bp, Homo sapiens
agtgagccgagattgtgccactgcactccaggctgggtgacagagagagactccgtctcaaaacaaaacaaaacaattctggctagagtcttcattttgcrtaagtttttcactgattttaatgcacaactgtcctgagctgtggcttacagaggagctgtggaattaggcatcctgtggtatattacagtctcaggtgtg

SEQ ID NO: 41909 - DNA, 201 bp, Homo sapiens
atatattatttgctgttaaaataatacaatgaatatagtacattaaagaacatttgaatggccattttttaaaagtagtgattaaaagtgtcacgcacatygtatctagcattccttgtttactagaattttaaactttttccattccatgtattttcaatatttcaataggagacaagtttatttttccatcttgcagat

SEQ ID NO: 41910 - DNA, 201 bp, Homo sapiens
aaagtttattaaccgagatactggtagtattgattgaaaactgtgcaagaccctgctcattggtggttgcattggagtaataattggcgtcattcacagaratgaagaagagtttattggggatgggcacaccttttccatccaccagaagcacctaaagaagaaaagtacttgatagttgatgtgaacaacacccagaga

SEQ ID NO: 41911 - DNA, 201 bp, Homo sapiens
gttacttttttattgtattatttaccaggagtaaatagctaccttgtataacttatttatctgtatgggagggaattggaccataggtgcttacatggtcmtctccagcaatatgacttttaagaaatatcaccaccatagcacaaaaatcagtgggtaaagttttgcagactgagtagtttgcaaaaaaaagtttgagct

SEQ ID NO: 41912 - DNA, 201 bp, Homo sapiens
tttgggaggctgagtcaggtggatcacctgaggtcaggagtttgagaccagcctgaccaacatggtgaaaccccatctctactaaaaatgcaaaaattagmcgggtatggtggtgcacacctgtaatcctagctactcgggaggttgaggcacaagaatcacttgaacctgggaggtagaggttgcagtgagccaagatcg

SEQ ID NO: 41913 - DNA, 201 bp, Homo sapiens
gattttcatgattccttacattaaatgataaatttacttaattaaaacttaagaaattttaggaaaagtaacattttacaaagttgtctgagtcaatttcytgatattgattgtttataaaggttacttatgacaatataggctaataatgtcagcgaactagggctcctaacttcccaaaatcaagcaagcatagtaaaa

SEQ ID NO: 41914 - DNA, 201 bp, Homo sapiens
tggtcttctgctacccatgaatagtgaaaacacaagttgggatgcacagtgaaaacctgagtaaacagaaaagcaaagaaagaatactgtcttgaaattcktcaccttagcttctcaccaaaatgaatagttacaacggtgtcttccactctaaaatacactatgcctctccctcatactggtcgacagccaaataaatga

SEQ ID NO: 41915 - DNA, 201 bp, Homo sapiens
tctgggagataggtgaaaaaaaactggcagaagaatccagtaccccttagaaatcacaggacaaggaaagctggtatattttctgacttctctttccaaartctttggaattgttttacacttacagccataaaacttaatttagtcactctttttctccttttatcttaaaatgagatagagaaatttggcttctgaaac

SEQ ID NO: 41916 - DNA, 201 bp, Homo sapiens
gatgaactttatgctgttttaattcatttaaaatggcatgtcttgtgtcaaaagtaaatgttgtcaactaattaagtctcttcaatgagaagatcttttartacaaaacctcttagatgtctgtttcttttcaggaaaagcttgactgtttgcatatccatacctctactaagaagcttttgaccacagtgtctttccagt

SEQ ID NO: 41917 - DNA, 201 bp, Homo sapiens
gggaggcggaggttgcagtgaaccgagatcgtgccactgcactgcagcctaggcgacagagcgagactctgtctcaaaaaaaaaaaaaaaaagatcttgaratgagaatgaactgggtttttgtgaaaatggcaaatggcattttgggtactgcaagcctttgcggctcggaactgtgctgtgcactgtgggactgtgtgg

SEQ ID NO: 41918 - DNA, 201 bp, Homo sapiens
ttcgtttaacttactttcaaagtgatatttgggtatgtaaacgtatatgtgtccaagaaaaactgagcgatgccatttacatctgtggtgtagtttcccaygattttgtccttcagatgcaactggacaacttcatttgggattggagagttgtctggattaagcaatttaatctgtacaagaggaagaaaatacatttcg

SEQ ID NO: 41919 - DNA, 201 bp, Homo sapiens
gctaagaatacacatgatggaaaaaaaaatagataggagcagaccagcctcagaaagtgaactaaaaaccacctcctgaatattctttttgatggataaamttataccataaagataaagcatgaaacacaagaatcctccatgagttatttaaagtgaaatcacagggcacatggactcatgtggaaggagaggacatga

SEQ ID NO: 41920 - DNA, 201 bp, Homo sapiens
gaggagctaagaatacacatgatggaaaaaaaaatagataggagcagaccagcctcagaaagtgaactaaaaaccacctcctgaatattctttttgatggmtaaacttataccataaagataaagcatgaaacacaagaatcctccatgagttatttaaagtgaaatcacagggcacatggactcatgtggaaggagagga

SEQ ID NO: 41921 - DNA, 201 bp, Homo sapiens
gggttcaccatgttagccagactagtctcaaactcctgacctcatatgatccacccacctcggcctcccaaagtgctgggattacaggcgtgagccaccgygcccggcctgagcgcctatattcaactgcacatttaacatttccacttgaatatcccattgaatggcaccaacattcatccaatttctcctttcaggagc

SEQ ID NO: 41922 - DNA, 201 bp, Homo sapiens
ggattacaggcacaagccaccgtgcccagcctctgagctcctattttccttttattattattattattattattattattattattattattattattattttgagacggagtctcactctgtcacccaggctatagtgcagtggcacgatctcggctcctgggttcaagcctcctgggttcaagtcattctctagcctca

SEQ ID NO: 41923 - DNA, 201 bp, Homo sapiens
gggattacaggcacaagccaccgtgcccagcctctgagctcctattttccttttattattattattattattattattattattattattattattattattttgagacggagtctcactctgtcacccaggctatagtgcagtggcacgatctcggctcctgggttcaagcctcctgggttcaagtcattctctagcctc

SEQ ID NO: 41924 - DNA, 201 bp, Homo sapiens
tgggattacaggcacaagccaccgtgcccagcctctgagctcctattttccttttattattattattattattattattattattattattattattattattttgagacggagtctcactctgtcacccaggctatagtgcagtggcacgatctcggctcctgggttcaagcctcctgggttcaagtcattctctagcct

SEQ ID NO: 41925 - DNA, 201 bp, Homo sapiens
caggcatgagccaccaagcaccagctaatttttgtatttttttgtagagaaggggttttgccatgttgcccagactggtctcaaactcccgagctcaagcratctactggcctcggcctcccagacagctgggattacaggcacaagccaccgtgcccagcctctgagctcctattttccttttattattattattattat

SEQ ID NO: 41926 - DNA, 201 bp, Homo sapiens
gggtctcactctgtcacccaagctggagtgcaatggtgcgatcatggctcattgcagccttgacttccagtgctcaagccatcctcccacctcagcctccsaagtgtctgggactacaggcatgagccaccaagcaccagctaatttttgtatttttttgtagagaaggggttttgccatgttgcccagactggtctcaaa

SEQ ID NO: 41927 - DNA, 201 bp, Homo sapiens
ccggccaatttttgtattttttaattagcaacggggtttcaccacgttggccaggttattaaccacatccatggctctgattaccacctgtggataaataygtccccagttctcctctgagctcctattttcctttttttttagagggtctcactctgtcacccaagctggagtgcaatggtgcgatcatggctcattgca

SEQ ID NO: 41928 - DNA, 201 bp, Homo sapiens
tctctcttcccttttatgtctacgtttctcacagtcatctacactccctgtcacttgtacttattcccttgacactgcaatctagcttcatccactccccyaaaatgactcttcccaacgctatcaatgacccctttgtctttccatccagtggctgtttttcaatcctcgtattccttaactctcagcagcattctgtga

SEQ ID NO: 41929 - DNA, 201 bp, Homo sapiens
aatgactagtaaatagtaataacaaaactgttatttatggagggatgagtctgtggcctatctctcttcccttttatgtctacgtttctcacagtcatctmcactccctgtcacttgtacttattcccttgacactgcaatctagcttcatccactcccccaaaatgactcttcccaacgctatcaatgacccctttgtct

SEQ ID NO: 41930 - DNA, 201 bp, Homo sapiens
ggccgaggcgggtggatcacaaggtcaagagatcgagaccatcctggctaacatggtgaaaacccgtctctactaaaaatataaaaaattaaccgggcgcrgtggcgggcgcctgtagtcccagctactccggaggctgaggcaggagaatagtgtgaacctgggaggcagagcttgcagtgagccgagatcgtgccactg

SEQ ID NO: 41931 - DNA, 201 bp, Homo sapiens
gcagatcgtgccactgcactccagcctgggcgacagagcgagactccatctgaaaaaaaaagaaaaagaaaactgagcttatagtacagagcattcccatrtaagagctttataggaacctcccatctccaaaactctaaggttccactattagcaacttggattagtcatactgatatgttattattaaagtccatcact

SEQ ID NO: 41932 - DNA, 201 bp, Homo sapiens
aggtgaaaaaaaactggcagaagaatccagtaccccttagaaatcacaggacaaggaaagctggtatattttctgacttctctttccaaaatctttggaaytgttttacacttacagccataaaacttaatttagtcactctttttctccttttatcttaaaatgagatagagaaatttggcttctgaaaccaaactgtta

SEQ ID NO: 41933 - DNA, 201 bp, Homo sapiens
tctcctgagctcaggaggtcaaggctgcagtgagctgtgccaccacattcctgcctgggtgacagagtgagaccctgtctaaaaaataaaataaattattycctcagaatctcagggcaagatatgacaagaacaaagttgcaaaagcagctctgtttcagtttttctcttaactttttgtctaccagttactgtgaagat

SEQ ID NO: 41934 - DNA, 201 bp, Homo sapiens
catcagtgagagctgctagactgttatatttcgggggtcttgcggggtagcttttcttacacatataagcagaagaaaacattttcccaagtcttaaaagwgggttatgatgcatttcattgtgtactctttttcttcccatatactctgcaggcatttgggcagtccttctccatccaccggaaggttgctgaagatgga

SEQ ID NO: 41935 - DNA, 201 bp, Homo sapiens
tcattaagctggaaaatgtggatcttaagaaaaaaatttctgcgttaaaagtaaatatttctttatgatcatacagaaaataggtcagttctattccactrtaattaaagaattaaatggtttcatttgaatagttttaagggggtgtgggtaggtgggaaacatcacactctttgcttcttaaaatcatgggtagacgaa

SEQ ID NO: 41936 - DNA, 201 bp, Homo sapiens
cccactaaaaatgtacaagatacagtgtaacattgttattatttttgagatggagtctcgctttgttgcccaagctggagtgcaatggtgcgatcttggcrcactgcaacctccacatctcggattcaagcgattctcctgcctcagcctcccaagtagctgagattacaggcgcccaccaccacaccaggctaatttttg

SEQ ID NO: 41937 - DNA, 201 bp, Homo sapiens
gagatggagtctcgctttgttgcccaagctggagtgcaatggtgcgatcttggcgcactgcaacctccacatctcggattcaagcgattctcctgcctcarcctcccaagtagctgagattacaggcgcccaccaccacaccaggctaatttttgtatttttcgtagagatggggattctccatgttggccagggtgatct

SEQ ID NO: 41938 - DNA, 201 bp, Homo sapiens
tagtcagtgaatgtaaattaaggaagtttactttttttcccattaatttacaaaaattttaaatatgataatatacagtgacaaaatttttttttttttttgagatggagtctcgctctgtcgcccaggctggagtgcactgggcaatctcggctcactgcaagctccgcctctcgggttcatgcccttctcctgcctcag

SEQ ID NO: 41939 - DNA, 201 bp, Homo sapiens
aaggaaagcataacaaattagagtcagctatccattctcctatgaacgatcagcaaatctcacaggagtcaaggaatagtactgttgtgagtagtgatacrttacagattgacaatatttgttctctggttgaaggtgatacctcttacaattcccaaatagcaaagatattcagctctcttcccttgaaaatggttgagc

SEQ ID NO: 41940 - DNA, 201 bp, Homo sapiens
agatagtgagaaaagagtagaggcaatgtgtaaagagataatggctgtgaatttcccagaactggtgagaagcatatacccacagatcttgaaagcaaagaaaaaaaaaaataaggaaacagggaaacaaatttaaaatataatttttaaaaaattgcagagaaaaaggaaacgagtctaaaaatgtaaaatggcatatta

SEQ ID NO: 41941 - DNA, 201 bp, Homo sapiens
gcagctcctgaagtaagagcaaagactaatcatggagtacttgacccctgtcctcagtatgacatcaatgtggagccaccacaccacctaagccacccaayctaaacatgtttgtctgtaacaagcttcactgtgaccaaaaaatgtcaaagaaagggctaattgtagattaaacacaggtaaagagagaattcataaagc

SEQ ID NO: 41942 - DNA, 201 bp, Homo sapiens
catcaagaactcatcttcagaggaagagaaacaaaaagagcagtgttgtcctttggataccaacagttgtaaacaaggagagagaacttctgatagagatrtcactgttgttcaatttaagagccttgtaaataatccaaagactcctccagatgggaaaagtcattttcctgaactacaagacgacagtagaaaagatac

SEQ ID NO: 41943 - DNA, 201 bp, Homo sapiens
aggcaatgtgtaaagagataatggctgtgaatttcccagaactggtgagaagcatatacccacagatcttgaaagcaaagaaaaaaaaaaataaggaaacagggaaacaaatttaaaatataatttttaaaaaattgcagagaaaaaggaaacgagtctaaaaatgtaaaatggcatattactaaaaaagattccaagtag

SEQ ID NO: 41944 - DNA, 201 bp, Homo sapiens
ctaaacatgtttgtctgtaacaagcttcactgtgaccaaaaaatgtcaaagaaagggctaattgtagattaaacacaggtaaagagagaattcataaagcwggagacagatgtggagaaattacccagaatgcagcacagagacacacagaaaattggaatgaggctgggtgtggtggctcacgcctgtaagcactttggg

SEQ ID NO: 41945 - DNA, 201 bp, Homo sapiens
caaaatatcatttgattcagtaattgtgaggtgaataaggtaaagattctgctcctagttttgcatatgagaaaacaaggtcaaaaggtgatacgactttycagtcacaggattaggaaacaggaggagaacctggtcacatgatccccagccccaaacccttttgttacttttttattgtattatttaccaggagtaaat

SEQ ID NO: 41946 - DNA, 201 bp, Homo sapiens
ggcaatgtgtaaagagataatggctgtgaatttcccagaactggtgagaagcatatacccacagatcttgaaagcaaagaaaaaaaaaaataaggaaacagggaaacaaatttaaaatataatttttaaaaaattgcagagaaaaaggaaacgagtctaaaaatgtaaaatggcatattactaaaaaagattccaagtagt

SEQ ID NO: 41947 - DNA, 201 bp, Homo sapiens
ggtgcagtggctcacacctataatcccagcactttgggaggctgaggcagaggactgcttgagcccaggacttcacgaccagcctggacaagacagtgagwcccccatctctacaaaaagaaaaaaaaaaagtaagaaaaaaattagcccagcatggtggcgtgtgcctgtagtcccagctatcaggaggctgaggcagta

SEQ ID NO: 41948 - DNA, 201 bp, Homo sapiens
tttactgtgttcagttcttttgcaaaatatcatttgattcagtaattgtgaggtgaataaggtaaagattctgctcctagttttgcatatgagaaaacaasgtcaaaaggtgatacgactttccagtcacaggattaggaaacaggaggagaacctggtcacatgatccccagccccaaacccttttgttacttttttatt

SEQ ID NO: 41949 - DNA, 201 bp, Homo sapiens
ccacaaccctgctcccccaacgtccaccgtgatccacatccgcagcaagacctccgtgccccaccatgtcgtctggtccctgttcaacaccctcttcatgracccctgctgcctgggcttcatagcatttgcctactccgtgaagtctagggacaggaagatggttggcaacgtgactggggcccaggcctatgcctccac

SEQ ID NO: 41950 - DNA, 201 bp, Homo sapiens
gcagaggactgcttgagcccaggacttcacgaccagcctggacaagacagtgagacccccatctctacaaaaagaaaaaaaaaaagtaagaaaaaaattakcccagcatggtggcgtgtgcctgtagtcccagctatcaggaggctgaggcagtaggattgcttgagcccaggagttcagtcgcatcactgcactccagcc

SEQ ID NO: 41951 - DNA, 201 bp, Homo sapiens
ctggtttagtgcctgaactatttatgtatgaaaaaatgtaaaaactacactgactgtaacacataaaacaacacacacaaaaggtaaagcttgaagactcwgatgaaggagtataatcagatcaccatcaaccaggtaaaataatacccctcatggccataaaaccggagactgaggggcaggggcagtgatgtatctatg

SEQ ID NO: 41952 - DNA, 201 bp, Homo sapiens
aaaccagttagagtgctgtcagtccaagagaagcaaaggcccagacaaaatgtgacagcgtgtgattctatggccaagaataatcaccattaagtatatgmttccatttctctagaagttctcataatctaatgaaataatataaaaattgcctagtcctgcagtaggggaaaaaagcacctccaaatgcaaatctatacc

SEQ ID NO: 41953 - DNA, 201 bp, Homo sapiens
ggtgcctgtagtcccagctacttgggaggctgaggcaggagaatggtgtgaacccgggagacggagcttgcagtgagccgagattgcaccactgcactccrgcctgggcgacagagcgagactccgtctcaaaaaaaaaaaaaagtcatattgttagatatgaattctaaacttgttttcaaagaatatgtcagtatgttc

SEQ ID NO: 41954 - DNA, 201 bp, Homo sapiens
ggactgcttgagcccaggacttcacgaccagcctggacaagacagtgagacccccatctctacaaaaagaaaaaaaaaaagtaagaaaaaaattagcccakcatggtggcgtgtgcctgtagtcccagctatcaggaggctgaggcagtaggattgcttgagcccaggagttcagtcgcatcactgcactccagcctaggc

SEQ ID NO: 41955 - DNA, 201 bp, Homo sapiens
attccattacttatttttattttacaagttgtttattagaggagatgaatttggagttttgacccagtttaggataatagtacattcagaaaatggcatayaaatctgtgtgttagattgtggcccccgttcttcactggtttagtgcctgaactatttatgtatgaaaaaatgtaaaaactacactgactgtaacacata

SEQ ID NO: 41956 - DNA, 201 bp, Homo sapiens
gcctcggcctcccaaagtgctgggattacaggcatgggccaccatgcctggcctgcttattttttaaaaaaataaaattaatgttaaaataattaattaasgctgggcacagtggctcacacctgtaatcctagcactttaggaggccgaagcaggtggatcacttatgcccaggagttcgagaaccagactgggcaacat

SEQ ID NO: 41957 - DNA, 201 bp, Homo sapiens
caccacgcccggctgatttttatatttttagtagagatggggtttcaccatgttggccaggctggtctcgaactcctgacttcagatgatctgcctgcctyggcctcccaaagtgctgggattacaggcatgggccaccatgcctggcctgcttattttttaaaaaaataaaattaatgttaaaataattaattaaggctg

SEQ ID NO: 41958 - DNA, 201 bp, Homo sapiens
tgccttggcctcccacagtgctgagattacaggtgtgagccaccgtgcctggcctctttctgaattttgaagcatttggatgtattgctttttttttttttgagacggagtctcgctctgtcaccaagctggagtacagtggcgagatctcggctcactgcaacttccacttcccgggttcaaacgattctcctgcctcag

SEQ ID NO: 41959 - DNA, 201 bp, Homo sapiens
ggctaatttttgtatttttagtatagatggagtttcaccatgttggccaggctggtctcgaactcctgacttcaggtgatccgcctgccttggcctcccamagtgctgagattacaggtgtgagccaccgtgcctggcctctttctgaattttgaagcatttggatgtattgctttttttttttttgagacggagtctcgc

SEQ ID NO: 41960 - DNA, 201 bp, Homo sapiens
cttcccgagtagctgggattacaggtgtgcatcgccacacccggctaatttttgtatttttagtatagatggagtttcaccatgttggccaggctggtctygaactcctgacttcaggtgatccgcctgccttggcctcccacagtgctgagattacaggtgtgagccaccgtgcctggcctctttctgaattttgaagca

SEQ ID NO: 41961 - DNA, 201 bp, Homo sapiens
tctcggctcaccgcaacctccgcctcctaggttcaagtgattctcctgcctcagcttcccgagtagctgggattacaggtgtgcatcgccacacccggctmatttttgtatttttagtatagatggagtttcaccatgttggccaggctggtctcgaactcctgacttcaggtgatccgcctgccttggcctcccacagtg

SEQ ID NO: 41962 - DNA, 201 bp, Homo sapiens
aactttcactgaacttttagttctttctgaatttttttttttttgagacagagtctcccccttgcccaggatggagtgcagtggcacgatctcggctcacygcaacctccgcctcctaggttcaagtgattctcctgcctcagcttcccgagtagctgggattacaggtgtgcatcgccacacccggctaatttttgtatt

SEQ ID NO: 41963 - DNA, 201 bp, Homo sapiens
gttcaggaatacggtgaaaagtaaactttcactgaacttttagttctttctgaatttttttttttttgagacagagtctcccccttgcccaggatggagtrcagtggcacgatctcggctcaccgcaacctccgcctcctaggttcaagtgattctcctgcctcagcttcccgagtagctgggattacaggtgtgcatcgc

SEQ ID NO: 41964 - DNA, 201 bp, Homo sapiens
ataaagtacagctgccccaggaaggaaactaggggttcaggaatacggtgaaaagtaaactttcactgaacttttagttctttctgaatttttttttttttgagacagagtctcccccttgcccaggatggagtgcagtggcacgatctcggctcaccgcaacctccgcctcctaggttcaagtgattctcctgcctcagc

SEQ ID NO: 41965 - DNA, 201 bp, Homo sapiens
tcctgtgtttcatgtattggcttttcatgtgaaactcgaggagagcttgtccgttgctacaagctgttttttgaatgtctctacacagtccaggcaggaartagaagcactcacatcaggagctcagtgtcaggcaggcaagcctcctgcaggggagccccgccctgctcaggtggcctcatctcccctcccagctggtgg

SEQ ID NO: 41966 - DNA, 201 bp, Homo sapiens
aaatcacttgcctacgaagctccaccagtctcagcttctagggaaatagactgaagacactcacgtatgcacaaaatgacatatacaagattatccattgyttcattcataatagaagactgttaacaagcaaatgttcatcactaggctcctggttaaataaagtacagctgccccaggaaggaaactaggggttcagga

SEQ ID NO: 41967 - DNA, 201 bp, Homo sapiens
tggtggcgtgtgcctgtagtcccagctatcaggaggctgaggcagtaggattgcttgagcccaggagttcagtcgcatcactgcactccagcctaggcaayagagtgagaccttatttcaaagaaaaacaaaataaggtcactatgagtaaatttaaacaaaaccaagtgtatagaataaaaatgtctaatttgagggatt

SEQ ID NO: 41968 - DNA, 201 bp, Homo sapiens
agtggatgaggatgaggatgacctggaggaagaacacataactaaggtaacacgagtgtcctcagctggtgctgtgctgggggctatgggctgggctgtgyacccttggggaagaggctggagtcactcggctacttctcaccctcctctccacaaaggaggagcttccagcacttggactctgttgcttcttgcacgcaa

SEQ ID NO: 41969 - DNA, 201 bp, Homo sapiens
aagccacaatgggcatggagttaaagcattttatagttatctgtgaagattctataacataagagtaactgttcatgttgaaatctcaaaatttatcattmagaaaaagagcatataacatctaaacagaaaaaactgcaatgagaaaaaaatttaaatcaattcaaaacatcaaaaacagagagagagagaaaagcaaga

SEQ ID NO: 41970 - DNA, 201 bp, Homo sapiens
atgggcatggagttaaagcattttatagttatctgtgaagattctataacataagagtaactgttcatgttgaaatctcaaaatttatcattaagaaaaakagcatataacatctaaacagaaaaaactgcaatgagaaaaaaatttaaatcaattcaaaacatcaaaaacagagagagagagaaaagcaagacaaatggc

SEQ ID NO: 41971 - DNA, 201 bp, Homo sapiens
tagtactacattacttactagctgtatcatcttgggcagattacttagtttccccaagcctcaatctcctcctcaacaaaaaatgcacaacagcactaacycactgctgttgagaggattaaatgtagggaaaagatccaaaatatacaatgcctttttgtagcacaattcctaacatagagtgattttagtgaatggtta

SEQ ID NO: 41972 - DNA, 201 bp, Homo sapiens
ataacgttatgacaatcatcaaaagtatagcagcatacaaacaagttgctaggaaaaaaagagaaagcccacagacactagtatatgtaattacttagcaygtaataaaaggaaaattagaaaacagaaagggaatgtttattcaataaacacagactggaacatgtggctggtttttgaaaaataatctactcagatcct

SEQ ID NO: 41973 - DNA, 201 bp, Homo sapiens
gaggctgaggtaggagaattgcttgaacctgggaggtggaggctgcagtgagccaagatcgtgccactgcactccagcctgggcaacagagcaaaattccrtctcaaaacaaaatcaaaaacacataccatcacaccggagattagggcttcaacagagaaattttgaaggaacacaattcagtccatagcaagtagtaca

SEQ ID NO: 41974 - DNA, 201 bp, Homo sapiens
gtgctaccattttgaaaaaaggtgagaaattagaaaaaggttagtcctattagaaattctcttataacgttatgacaatcatcaaaagtatagcagcatayaaacaagttgctaggaaaaaaagagaaagcccacagacactagtatatgtaattacttagcatgtaataaaaggaaaattagaaaacagaaagggaatgt

SEQ ID NO: 41975 - DNA, 201 bp, Homo sapiens
ttctgggctcctgtgaattagggagtggcagctcctcagtctaactcctattgtgaccaggttgcctaattggccctttggtttgggcacccactgtccttctgcgtggttggatagatgctgctcccaatgtccctgatctcttacagacccctctgattcttcactcttggctttgagagcccctgatgccctgcagtc

SEQ ID NO: 41976 - DNA, 201 bp, Homo sapiens
ctaaaaatacaaaaattagccaggtgaggtggcgactacctgtaatcctagctactcaggaggctgaggcacaagaatcgcttgaacctgggaggcagagrttgtagtgagccaagactgtgccactgcactccagcctgggcgacacagtcagactctgtcccgccccccaacccccccaccaaaaaaaaaagaaaagaa

SEQ ID NO: 41977 - DNA, 201 bp, Homo sapiens
cccccagctggtcatcccccacaccacgatatgctgcaggcacatttcgaggtttagaacggcagacaaagtcacagccatcctgtagggggagaaaaaaraaggaaataattcgcagcatctaactttaggatatgagaaagtgtacttatggtctaggaatgtggcaagaattggttttctatagggataatgagaaaa

SEQ ID NO: 41978 - DNA, 201 bp, Homo sapiens
gactcctcccccagctggtcatcccccacaccacgatatgctgcaggcacatttcgaggtttagaacggcagacaaagtcacagccatcctgtagggggaraaaaaagaaggaaataattcgcagcatctaactttaggatatgagaaagtgtacttatggtctaggaatgtggcaagaattggttttctatagggataat

SEQ ID NO: 41979 - DNA, 201 bp, Homo sapiens
ctcccagtgtagctgtggctcagagttttttctttttgttgtcacttactcccttgtgattgaattttttctcctgcatccatggcaggatccccagccartatagagacttggttggcatcttctgctgcagggactaaaagtatttgactggggcacatgtggctgttgtcattctttctgcatcccactgttcccctc

SEQ ID NO: 41980 - DNA, 201 bp, Homo sapiens
gaccacctcaaccaagattttcaaatcatagtgaaacacaaaatttgatcaacttacccacaacagtgaaaaagcctctggctgacccttctactacatcrtttggcaagtccaaaactccctgcttggaggctttggcacctagaatgaaaatactgatttaaaaaatgtgatggcttctttatatcagcagatttgggg

SEQ ID NO: 41981 - DNA, 201 bp, Homo sapiens
gctttttaaaactgttagattcagggggtacatgtgcaggttagttacagggatatactgcatgatgctgaagtttaggcttcaattgaacccatcacccmaagagtgaacacagtacttgacaggtagtttttcaatccttgcttcccttcctccttcctcccttttgaagtccccagtgtgtatttttcccatctttat

SEQ ID NO: 41982 - DNA, 201 bp, Homo sapiens
ttttccttaacctcacagttcacaacattggccctctttgtgtatacaaagccaatcacttcactgcaacagaccacagctgagcaaacaaatacagacgytgatagatgaaccactgacaacaactcctaacaaaaacaacaataataacaacaataaacaaggtagcttgcaaaataccagacattaaaaaaaaattaa

SEQ ID NO: 41983 - DNA, 201 bp, Homo sapiens
tgaactctatcctccttcacctccttgcaagccctcctcaggtaattcctatattatataaaataaaatttttatgtctcaccatatgcttcctttctgaytctgctgccaaaacacactataggaaccatcagagtttttgaaagataattgcctttgataacctaaaatagaacattgtaggaaattattttttaacct

SEQ ID NO: 41984 - DNA, 201 bp, Homo sapiens
ataaaaactatcaaactcttgtgcagatttggcctgagggatggcgggatctgagcaaatctcagtgggttgtgacagcgtgtgtggcttgatagtttccytgtttgattctcacatagtgcccacccacagacagcttttttttttttaaagatggagtttcgctcttgtcaccctgctgggttcaagcgattctcctgc

SEQ ID NO: 41985 - DNA, 201 bp, Homo sapiens
aacctgggaggtggagcttgcagtgagcagagatcacgccactgcactccagcctgggtgacagagcgagactccgtctcaaaaaaaaaaaaaaaaaaaaacccaagctgtgccccgaccaccttgggcgcatattctcagaatctcctgagggctgtgtcatgggccatggtcactcatatttggctcagaataaatctc

SEQ ID NO: 41986 - DNA, 201 bp, Homo sapiens
tgaagggatcagactgctaagcaaatcgtcatgagactgaaggaacattgttgcattagaattggaatcactaaatctttagttttatctatttctcttcygtaaattgactttgaaacccactttgcttctaaatccccactgaactctatcctccttcacctccttgcaagccctcctcaggtaattcctatattatat

SEQ ID NO: 41987 - DNA, 201 bp, Homo sapiens
gaacctgggaggtggagcttgcagtgagcagagatcacgccactgcactccagcctgggtgacagagcgagactccgtctcaaaaaaaaaaaaaaaaaaaaacccaagctgtgccccgaccaccttgggcgcatattctcagaatctcctgagggctgtgtcatgggccatggtcactcatatttggctcagaataaatct

SEQ ID NO: 41988 - DNA, 201 bp, Homo sapiens
tgaacctgggaggtggagcttgcagtgagcagagatcacgccactgcactccagcctgggtgacagagcgagactccgtctcaaaaaaaaaaaaaaaaaaaaacccaagctgtgccccgaccaccttgggcgcatattctcagaatctcctgagggctgtgtcatgggccatggtcactcatatttggctcagaataaatc

SEQ ID NO: 41989 - DNA, 201 bp, Homo sapiens
ttcagtgagctatgatcgtgccactgtaccccagcctgggtgagagagtccctacctcaaaaaaataaaaccaaaaaactactggggccacgtcagaactraaagagttctgcaggcccttcagagaaaggagaagtgagagtcaattaacctcaagattacatttaaaagcattttcctctttagtatagaggtgtgtta

SEQ ID NO: 41990 - DNA, 201 bp, Homo sapiens
ctggctaacacggtgaaaccccgtctctactaaaacaaaaaattagccaggcgcagtggcaggcacctgtagtcccagctactcgggaggcttgaggcagragaatggcgtgaacctgggaggtggagcttgcagtgagcagagatcacgccactgcactccagcctgggtgacagagcgagactccgtctcaaaaaaaaa

SEQ ID NO: 41991 - DNA, 201 bp, Homo sapiens
gaccagcacaagtgcaaatgaggatgggaaagtgagtttttaaattgaacacatggctatttcaaataaaagcagggttctattacaaaaaatggggtgtrtgtgtgtgtgtgtgtgtgtgtgtatgtgtagagggggatattttttaaataggcaactaatagtgttgacttcatccagcaattttacctccaggaatgt

SEQ ID NO: 41992 - DNA, 201 bp, Homo sapiens
gcccacagagggggtgggaggctcaggcatggcgggctgcaggtcccgagccctgccccgtgggaaggcagctaaggcccggcgagaaatcgagcgcagcrccggtgggccagcactgctgggggacccagtacaccctccgcagccactggcccgcgtgctaagtcccccattacctggggccagcagggctgactggct

SEQ ID NO: 41993 - DNA, 201 bp, Homo sapiens
ccgcacaggagcccacagagggggtgggaggctcaggcatggcgggctgcaggtcccgagccctgccccgtgggaaggcagctaaggcccggcgagaaatygagcgcagcgccggtgggccagcactgctgggggacccagtacaccctccgcagccactggcccgcgtgctaagtcccccattacctggggccagcaggg

SEQ ID NO: 41994 - DNA, 201 bp, Homo sapiens
cagggggtggtgctcgtcggggaggctcgggccgcacaggagcccacagagggggtgggaggctcaggcatggcgggctgcaggtcccgagccctgccccrtgggaaggcagctaaggcccggcgagaaatcgagcgcagcgccggtgggccagcactgctgggggacccagtacaccctccgcagccactggcccgcgtg

SEQ ID NO: 41995 - DNA, 201 bp, Homo sapiens
aaggtagaaactctggacatatctgaaggaacaaactcctgacacaccatctttaagagctgtaacactcaccacgaaggtctgcagcttcattcttgaastcagtgagaccaagaacccaccagaaggaaccaattctggacatgctggcatcaagtcatctgctcaccttggcctcccaaagtgctgggattagagatg

SEQ ID NO: 41996 - DNA, 201 bp, Homo sapiens
cttgagctaaacacagggtgctgattggtgtatttacaatccctgagctagatataaagactctccacgtcctcaccagagcagctagatacagactgtasactggtgcactcacaaaccttgagctaaacacagggtgctgattggtgcatttacaatccctgagctagatataaagactctccacgtcctcaccagagc

SEQ ID NO: 41997 - DNA, 201 bp, Homo sapiens
ccttgagctaaacacagggtgctgattggtgtatttacaatccctgagctagatataaagactctccacgtcctcaccagagcagctagatacagactgtmgactggtgcactcacaaaccttgagctaaacacagggtgctgattggtgcatttacaatccctgagctagatataaagactctccacgtcctcaccagag

SEQ ID NO: 41998 - DNA, 201 bp, Homo sapiens
taatacataccttcattctacattcttttaataagccttctacgaatttacagttggtctgtgcaataactgcaggagagaggtctgacagtttgggttgyctcaggttttttcctaaacttcgtgcctcttgcatatatttctaaaaaatcaaggagtatttttaatgcgtaaacattagctattcttctaatcttctta

SEQ ID NO: 41999 - DNA, 201 bp, Homo sapiens
acatggtgaaaccccatctctattaaaaatacaaaaaataagccaggcgtggtggcaggtgcctgtaatcccagctacccgggggctgagccaggagaatmgcttgaacctgggagatggaggttgcagtgagccgagattgcgccactgcactccatcctgggcgacagagcaagactccgtctgaaaagaaaaaaaaaa

SEQ ID NO: 42000 - DNA, 201 bp, Homo sapiens
actcagtatcccatgaggtatatggcattctcttccttcccaccatagcaggtgtttaatagatggttatggtattgcactgatttaggctgggaaaaaawtaaagatgaagttattaagacagccagttgtggtcgggcacagtggcgcacgccggtaatcccagcagtttgggaggctgaggcgggcggatcacctgag

SEQ ID NO: 42001 - DNA, 201 bp, Homo sapiens
gtccttctaatttcactttcccgaatctatatgggactctgagaagcacagagtaagacgtgccgtgccctcttcggtggagttaaccagcggtgcatgtmtaggggctgtcatgaagggatcagactgctaagcaaatcgtcatgagactgaaggaacattgttgcattagaattggaatcactaaatctttagttttat

SEQ ID NO: 42002 - DNA, 201 bp, Homo sapiens
cgactaagacccccttcagggaaaagaagttttcattaactcagtatcccatgaggtatatggcattctcttccttcccaccatagcaggtgtttaatagrtggttatggtattgcactgatttaggctgggaaaaaaataaagatgaagttattaagacagccagttgtggtcgggcacagtggcgcacgccggtaatcc

SEQ ID NO: 42003 - DNA, 201 bp, Homo sapiens
ttcaagttgacttcctaatttttttctgggttgacattatcttctgtaatgtcagcaattttacagtatttgattctcatcttatgatgtagctgcatttytcactaaatttttggataaaatgtttttgtgtaattaactatgatacctcccatggggaaaaaattttttttttcagtggagcagggtattagaaactaa

SEQ ID NO: 42004 - DNA, 201 bp, Homo sapiens
attacatggcatcaaccctgtgttcctgtccagtaatcccagccgttggagtgtagaggaggtgtacgagtttattgcttctctccaaggtactgaccctytcttcaacagaacccaggttgttttccttaacatcatcccacaggggccttgataagagggaaagtaattgacttttaagcagtaggagcttgaatgcta

SEQ ID NO: 42005 - DNA, 201 bp, Homo sapiens
atatttgcggagcctacattttgtgggggaagagagatgataaacaaaatgaatgagttaagtagatagcacgttagatcatccaaaatgctatggggggraaaaaccctgggaatagggagatggcatgtgaagtggaagaaggttatgattttcaatagagtgatcagagaaagcctcattgagaagacacgctaagga

SEQ ID NO: 42006 - DNA, 201 bp, Homo sapiens
ttttttcaagagtaccaatgtgtccggaattggtgggttcttggtctcacttcaacaatgaagctgcggaccctcgcggtgttacagctcttaaggtggcrcgtctggagtctgtcccttctgatgttcagatgtgtttggagtttcttccttctggtgggttcgtggtctcgctggctcaggagtgaagctgcagatctt

SEQ ID NO: 42007 - DNA, 201 bp, Homo sapiens
ctaataatgtcttctgctggtttcccactgctatatattacagagaactagaaaagattaaagccagtatctgtatttagggtatggtcaacttaatgagrcattagcttttattttattgttactctattttcacataaccctttctaaaaagcctgttatcatgcacttctttacctatgaaattttggccaaatctaa

SEQ ID NO: 42008 - DNA, 201 bp, Homo sapiens
cgcatgttctcactcataggtgggaactgaacaatgagaacacttggacaccgggtggggaacatcccacactggggcctgtcgtggggtgggggcagtgrggagggatagcattaggagatatacctaatgtaaatgacaagttaatgggtgcagcacagcaacgtggcacatgtatacatttgtaacaaacctgcatgt

SEQ ID NO: 42009 - DNA, 201 bp, Homo sapiens
tctaagctttgtgtctccttgtgaaggcaaatctcctgaataaatgcttacttagcacgcgcatccacttggaatccatcatctgaaatagttactgttcrtggtgcattgactttaacttcaaacttgggcaacactggaaacaaagagaaatatacttcagcccccacaatcactggtgagcaaaatttattgcaatca

SEQ ID NO: 42010 - DNA, 201 bp, Homo sapiens
attctagttaaaatcacattttttcccatctggtttccagtagctatttaatcttctgcatttccttgctgcttcattcttgtctaaaccattctatacakcctgagctaacctgatcatgttactctctttcttaaaaccattagtcacttctcaatccaaaattcttaccatatcttaaaagaccttaataactgttct

SEQ ID NO: 42011 - DNA, 201 bp, Homo sapiens
aatatttttaactgtttatgtaaagtgcaagagagttattgattaggagagtagctctgaagccgaacagcctaggtctaaatcccggttctttcatcaayaagctccattactgttgataagttatttgaattatcggtgtcttagtatctttccttatagaggtgatgattgctcctacctaatagcactgtagcaatc

SEQ ID NO: 42012 - DNA, 201 bp, Homo sapiens
gaaggagctcctgtctgctgaggacacggttccatccaatgaggtcagcagggctatcagcagcttccgttaattccgttggggtaggcgtgtggcaagcrgcagttatttgagctgaggatgctgggatggattttcacatgagcagttggcccttagatcatgagaccagcctaagtgcccaaggaaatggaacagcag

SEQ ID NO: 42013 - DNA, 201 bp, Homo sapiens
tggccgctctggggaattttcacatgaatgaggttgttcgtttgagaggttctgtacagcaaacatggaaggagccccgtgaagagcttctcttgtgggamagagacatcgatgtgtttaatgcaggagacacagtcccttcctcatttgtttccatacttcagggactaataagtgctggggttttgttgtacagattga

SEQ ID NO: 42014 - DNA, 201 bp, Homo sapiens
cccataaaagcctcgggctcaggcagagcaagagagaggatggagggacaggaagaccagttgcagagagaagctgccctctctgctaatagcaggagacratgggacaaccagctgcacagaggaactaccctctctgctgagagcttcagagacctgcagagacttcgggactacagtgcagagaggagcaaggagcac

SEQ ID NO: 42015 - DNA, 201 bp, Homo sapiens
ctcccaagtaactgggactacaggagcataccaccatgcttgggtaatttttttttttttttttgagctggaatctcactctatcacccaggctggagtgyagtggtctgatctcagctcactgcaacctccacctcccaggttcaagcgattctcctgcctcagcctcctgaataggtgggactacaggtgcctgccacc

SEQ ID NO: 42016 - DNA, 201 bp, Homo sapiens
aaaatctagatcaattgttaggtcatggggagaatcaaggaagtgatacagtttctatttgaaagactttgagagtagattttgggaatttgcaaataaartgctgcttatttcacatatgataagatgagtttttcttctacgcccaacccagggtggtttgggaagaaagagagaggaataaacctttgacactgacct

SEQ ID NO: 42017 - DNA, 201 bp, Homo sapiens
ggatcgtctcatagctgatattttatgtctccctccttgcttttattcccttccccaaatcagctcataagcagaaattcacatttagagcagggtggtcytctgtggcactattgacatcctatatatgccctgtcctgtaggtacaatgtgagctgtagccatcagttccggctgaagaggaaaaaaatgaaagagttt

SEQ ID NO: 42018 - DNA, 201 bp, Homo sapiens
ccaaacattgtatagagaccagttactactcttgattaccgtattgaaagtgattctctctgaaccagacttggtcattaactcagagatccaagcagagrcataattgatggggaaatgttggggaaagctatagagaagcagaaggggatcaggctaacttaactctcaatgttttctgggacaggtgggttgttctca

SEQ ID NO: 42019 - DNA, 201 bp, Homo sapiens
tgctgtcatatcctcacccctttctgcttttacaaatgttttccctcagtttaagacatcccccactcaatccttgcccacttagcaaacatctgctcatrgtgcagagttacattctcagtgaaaatttccccatctcccactagggagagttagataaacacctctaaacgctgatttacagcatctatcacattgtgc

SEQ ID NO: 42020 - DNA, 201 bp, Homo sapiens
ggtttctgtaaaagggaagcctctaggatctttaaaagtatttttttctatttttaaatataacattcattgtagaaagtttggaaacatagtacaagtayaaggaagaaaatttttataacttacaatcacattgctgaggataacattttgttaatgtttttgcatagttttttttccaatttttgtcttcctcttgtc

SEQ ID NO: 42021 - DNA, 201 bp, Homo sapiens
gtgaatcgagaactggaggacttagctctgcaaatacagcagccctctatacttcggtacatctttggcttgtgaaaaccaaacatcttttcttctgggcratagtctgtaaagccaagggaattgacatatctttgttgagggctgtaacaaggaaccattaaagagttctctctgctccaccccacccccaagcaactt

SEQ ID NO: 42022 - DNA, 201 bp, Homo sapiens
acatgctgatgttattagtacagacattgccgttctttttgtcattgaccaagtctttcagaaccatattcttcagtttgctggtactctcactgcaatgyaggctgccctcaggagggatcccaaattgaacaagaacctcagagagttcttggataaaatccactttattggggaactgtggaaattcttcaggcaact

SEQ ID NO: 42023 - DNA, 201 bp, Homo sapiens
gcccaggctggtgtgcagtggcgtgatctcagctcattgcaacctccacctcccgggttcacgccattctcctggctcagcctcccaagtagctgggactrcagatgcccgccaccacgtccggctaatttttttgtatttttagtagagacggggtttcaccttgttagccaggatggtctcgatctcctgacctcatga

SEQ ID NO: 42024 - DNA, 201 bp, Homo sapiens
atctgtttcttcctccaggaaataaggttaacaacacaggtggtgaaagcccagcaacctccgattgcacaaggatactgatgccatggctttgcttttcrgccacaactgggaataaaactgggagctctgctgaggcaattttgctgctaaaaatgtacaaatgcctaattagagttacaggacctaccagaagatgag

SEQ ID NO: 42025 - DNA, 201 bp, Homo sapiens
tgactcaaaacccccacaggccatcgtgaagccccagattctcacccacatcattgaaggctttgttatccaggaaggagcagaacctttcccggtgaggrcagggccataaggtgggactttgaagtggggacttggtctgattgttgtcttttcaaactccagtaaaagtaaaaggcacagaactatttaatgaaagaa

SEQ ID NO: 42026 - DNA, 201 bp, Homo sapiens
ccttgcaatatcccaggcacagcttccaagcttatcatttcatgggtcatgctcagttacaagggatgaaggtaaagcaagatggaccaccttggcactgsgaagctcttctactatctgctctttgactttttataacttattagtcatatcattcctcagggtgtgtataacttaataaataactttttttttttttga

SEQ ID NO: 42027 - DNA, 201 bp, Homo sapiens
attccattgtaaaggatatgtccatcttcaagacacggcactttaaggccatcttctaagttaagtcctctgaaataatagccatgtagttcgctggaatrtagctgactatacacctagatggtagaagagagtcaactgtattttttcatagaaaacaattcatttttccccacaagcagtatataaataacctatata

SEQ ID NO: 42028 - DNA, 201 bp, Homo sapiens
gctggagtgcagtgacacgatctcagctcactacagcttcgacttcctgggctcaagcaatcctcccatctcagcttcctgaatctctggggctacaggcktatgccatcatgcccagctaattttcgttgttttggttttttgttttttgttttttgagacggagtctcactctgtcgcccaggctggtgtgcagtggcg

SEQ ID NO: 42029 - DNA, 201 bp, Homo sapiens
catggacgagaagagcagtcttggaggtgagtaactgacttctaatgctgttggagagcacacagagtagaggaatgttctgagtgagctaaaagataaawctggttgagtagaaaatgggccagaagttggtggacaaatgaatagatccaaaaacagggaatccaggtgaattgtcaagggtggacatagattattatg

SEQ ID NO: 42030 - DNA, 201 bp, Homo sapiens
ttgttcagtgaatgatgataactcttagagggtcccttcttctctgtacccctaccttctctctctccttttggatcccaggagacattatgggcacagcyctgcagaacctggatggtctggtgcagatgcccagtggctgtggcgagcagaacatggtcttgtttgctcccatcatctatgtcttgcagtacctggaga

SEQ ID NO: 42031 - DNA, 201 bp, Homo sapiens
cggtatagggtaaaccccagacattggctgtcaaacgcaaggctgactctgaggaggagagagatgatgtctccacattgggttcaatgcttcctgccaargcatctccagtagcagaaagcccaaaagtcatggacgagaagagcagtcttggaggtgagtaactgacttctaatgctgttggagagcacacagagtaga

SEQ ID NO: 42032 - DNA, 201 bp, Homo sapiens
ataaaaacagagcatgcaagttttttaaaaaattagattttaacatctaaactcttccggcttttgaatatttatgaattttcctcaactttcttctttttaaaatctcctcactacattcattaacacaactgttttctatcaaatggtcacatgaagcctacatcataggagcacataagaaaaatttaaataaattta

SEQ ID NO: 42033 - DNA, 201 bp, Homo sapiens
ttagcacaaaccataactattgtgctaattaggtaacagtacatgggttgatgagtgaactggaaaatactccacctgcccaaagaagggaattccctgtygaaagtgtgagtccactttcacaaatgagagtttggttatggttcttgtgatttcactggactgccttccagtcaattccaccactgaaaaaagagaaaa

SEQ ID NO: 42034 - DNA, 201 bp, Homo sapiens
aaaaaaaaaaggctagatatggctatctgggagtactgtaatatataactattattatttctcttttaagtttcaggcaaggccaggtctggtggcacacrcctgtaatgccagcactttgggaggctgaggcaggcagatcgcttgagctcagaagttcaagaccagcctgggcaacatggcgaaaggcagtctataaaa

SEQ ID NO: 42035 - DNA, 201 bp, Homo sapiens
gaggcagaggttgcagtgagccaagattgtgcctctgcactccagcctgggtgatagagccagactttgtatatatatgtgtgtgtacatatatatatatrtgtgtgtgtgtgtgtatatatgtaatacatatatattacatacctaatatatataatatatatgtaataaacatcatgtatatatgatgtttattagccc

SEQ ID NO: 42036 - DNA, 201 bp, Homo sapiens
caaggaaagttttttgttagtgtgtttgttacgttttattgtgtgaataacttgaacatgttcataggcttggacgtagggttgtattctattctgcatgrtaggaactcagtaaatattttttgaaaaaatgaaaagattgcgaagccgatgcaggtagatcatttgaggtcaggttttcaagaccagcctggccaacat

SEQ ID NO: 42037 - DNA, 201 bp, Homo sapiens
ttaattgaataggggaataaagagttaagagggttaatattggtatttatctgcttcttctgtaagagagtgacacattatataatatctgaactttataytcctaaatttgttgctgatactattctgggtttttgggtatgtaataagttagatcaagatagccttaaccaaatcagtctttgaaaaaacaacagttct

SEQ ID NO: 42038 - DNA, 201 bp, Homo sapiens
cttcacccttgtctcttccacctgatgcagcccctaagccaccaattcccatccaatccaaaccacctgtagcacctatcaagccgcctcagttaggggcygctaagatgtcagctgcccagcaaccaccaccccatatccctgtgcaagttgtaggcactcgacagccaggtacagcccaggcacaggctttggggttgg

SEQ ID NO: 42039 - DNA, 201 bp, Homo sapiens
tgtaataaattccattgtaaaggatatgtccatcttcaagacacggcactttaaggccatcttctaagttaagtcctctgaaataatagccatgtagttcsctggaatgtagctgactatacacctagatggtagaagagagtcaactgtattttttcatagaaaacaattcatttttccccacaagcagtatataaataa

SEQ ID NO: 42040 - DNA, 201 bp, Homo sapiens
agtgaacctgaagcaggaggctttttcaacactagcaagtggcaacagcaaaatggcagctctgatgaagacagagaatggaccattggcagttagttttwagaaaatgagtttctagattctcaacttctgtctatgctttttcttaaaagagatcttctatcatgctagctctcagatgttacccagtcctactcttcc

SEQ ID NO: 42041 - DNA, 201 bp, Homo sapiens
attgtgaaagaatactccactggagcaaacaaggttagaaggaacagagtatgggggaaatggaatcagagagtggcacattggacaatttttctttgcartcagccaattctggaagggtcattaaggaggttgttccacattccaatgcttgtttaaactcaacagtaggccaaagttcaggggcctcaggggaaaaga

SEQ ID NO: 42042 - DNA, 201 bp, Homo sapiens
agtctcgctctgtcacccaggctggagtgcagtggagcgatctcaggtcactgcaagttccgcctcccgggttcacgccattctcctgcctcagcctcccragtagctgggactattgacacctgccaccatgcccggctaattttttgtatttttagtagagacggggtttcaccatgttagccaggatggtctcgatct

SEQ ID NO: 42043 - DNA, 201 bp, Homo sapiens
aggtaaagttcaacattgccaacctttttgtttgtttgtttgtttgtttgtttttgagatggagtttcgctctgtcgcccaggctggagtgcaatggtgcratctcagctcacagcaacctccgcctcccaggttcaagtgattctcctgcctcaggctcccgagcagataggattacaggtgtctgccaccacgcccagc

SEQ ID NO: 42044 - DNA, 201 bp, Homo sapiens
tcagctattagtgttaagttcaggaatgacagaaggactcattagatacaatttgtttccataatatagatgcttattccatgcaaactgcttcattatgmagaatccacaattacatttttggcatcctgatcattttatctaaggatccaagatcacaaggatttcttaagcagttgctgttatttttcaacaaaatta

SEQ ID NO: 42045 - DNA, 201 bp, Homo sapiens
cattccaaaagagctttgatcagtattattataaaactgattttaaaaattttcagttctctgaataccattttacatataacatactgtgagaaaatacygttatccatttctgagtcttgggtcatttagacttttctgcttatagcatgagaaaagaaagtacgattaaaaaaaaatgggggataaaagcctctcaga

SEQ ID NO: 42046 - DNA, 201 bp, Homo sapiens
gctgtagcacctcaatgaaaggttatacaacaaatagccccaacaaccagatacacttcaggtggaaaaagcatggtccacacaacattctacacttaccrtaacttagtacattttgagaactaattttgcaagaaagtaaattcagggtcagcttcccaggtgtccctggacctggaccaagagtttcaattctctgag

SEQ ID NO: 42047 - DNA, 201 bp, Homo sapiens
gttgcttaaaaatataagacttccttgatgtccaagaatactgagatttatatgattagaaatttctatacaaagctggaaacagtggagcatgttcccayatagaagcacaggttcccagctcccccagaggccctcatacagagctgcagctgcctgtgatggagcctgcacagattcttccagtagacagtcactttc

SEQ ID NO: 42048 - DNA, 201 bp, Homo sapiens
attatctgtttaatgtttattatctctattacactataaactccataaaagcagtgataaaagtgcctctctacatcaccattttattcctaatactgatrtagactatataatttattgtccaaacttggacacttttagagtgaagtggttgtaactattaacagttacaacttgataaaacatatacaccaggacaga

SEQ ID NO: 42049 - DNA, 201 bp, Homo sapiens
aaggcaggcctctgtctgatttgcctatgggctgtggtttgtcagctcctgatgtagagtagttaaatggtcagtatttcactgacatagcacctatcacractacaataattctttgtaaaattatctgtttaatgtttattatctctattacactataaactccataaaagcagtgataaaagtgcctctctacatcac

SEQ ID NO: 42050 - DNA, 201 bp, Homo sapiens
cctaaatattacttcctcagggaaactttccatgatcatttagtccagattttagcaaacttcttttgtaaaacaccatggtctctctctcatatattttkttattttttaaataatcttttaaaaatgttaaaaccactcatagttcactggctgtatcaaggcaggcctctgtctgatttgcctatgggctgtggtttg

SEQ ID NO: 42051 - DNA, 201 bp, Homo sapiens
acaattaaatctacagaagctctggggtctagggcatttgctggctatccctctaccacttctactctaaccacaaattttgtgttctaagtggcagagarggtgatagaggtatcaaagagataaagagaattctggccaggcaccgtggtgcacgccattagtcccagctatcccaggaggctgaggcaggaagatccc

SEQ ID NO: 42052 - DNA, 201 bp, Homo sapiens
agagactcttataatgactccatgattcttcaatggacaattaaatctacagaagctctggggtctagggcatttgctggctatccctctaccacttctaytctaaccacaaattttgtgttctaagtggcagagagggtgatagaggtatcaaagagataaagagaattctggccaggcaccgtggtgcacgccattagt

SEQ ID NO: 42053 - DNA, 201 bp, Homo sapiens
taaaaaaatatacaaccataatcacacatactagagaagaaaacttaaaactctaagtaattcttaggtaaaaataaaaataaaaataatgaaatcatcaraaatgattttaattgaacttaaaaattgttaagatggtaaatttgatatgtgcattttttcataatttaaaaaataaaaatagtatagaaaaacacctgt

SEQ ID NO: 42054 - DNA, 201 bp, Homo sapiens
gtgtaataaattccattgtaaaggatatgtccatcttcaagacacggcactttaaggccatcttctaagttaagtcctctgaaataatagccatgtagttmgctggaatgtagctgactatacacctagatggtagaagagagtcaactgtattttttcatagaaaacaattcatttttccccacaagcagtatataaata

SEQ ID NO: 42055 - DNA, 201 bp, Homo sapiens
tgtgtaataaattccattgtaaaggatatgtccatcttcaagacacggcactttaaggccatcttctaagttaagtcctctgaaataatagccatgtagtwcgctggaatgtagctgactatacacctagatggtagaagagagtcaactgtattttttcatagaaaacaattcatttttccccacaagcagtatataaat

SEQ ID NO: 42056 - DNA, 201 bp, Homo sapiens
caactccctgagatcttcaccttccccatcctgccacaggcaaggcttttctctctctcctttccctttcttattttttctattactcagggtaaccatcyttcccagagatcacaagtcaaaactctctggtcagaggttggattaatgatgatggggcccaacagggggcaagtttgagccttgccagtttgatattgg

SEQ ID NO: 42057 - DNA, 201 bp, Homo sapiens
gagttagttattactatacttggtatttatatactctagcagttctatttctaaattgctttatcatcacatgctttgatctctggacaatctggtacaayatggagaagtagagtttgtcactcccagtttacagtggaggaaactgagttaggtcagagctgacaggtgctgactctcaagactcagatggtggtctaa

SEQ ID NO: 42058 - DNA, 201 bp, Homo sapiens
gacagggcaagactctgatagtttatacttgctttcagactgcgggtaagatgtagttagatgtgtgtatcttatttggtcatgttgatttttgccttttyttgtttctagtaccttagttgttgatgtatttagataatttactcacaaaaaaattaagagttagttattactatacttggtatttatatactctagcag

SEQ ID NO: 42059 - DNA, 201 bp, Homo sapiens
gtccttccaactggcaccagaggcaatgctgggcacctacactgtggcagtggctgagggcaagacctttggtactttcagtgtggaggaatatggtaggkggggaaatggacaggccaaagtattgggcataatctcatcttaaaatcagcaaaggtggagccgggcgcagtggctcacgcctgtaatcccaggactttg

SEQ ID NO: 42060 - DNA, 201 bp, Homo sapiens
atagcatcccagggtccatgggtccaggtggaggtgggcaggcacatggtggtttgggtcagttgccttcctcaggaatgggtggtgggagctgtcccagraagggtacaggagtggtgcagcccttgcctgcagcccaaacagtgactgtgagccagggcagccagacagaggcagaaagtgcagcagccaagaaggcag

SEQ ID NO: 42061 - DNA, 201 bp, Homo sapiens
ctatccgagggttcttttagtactctcttaatctagccatagcccttagatctatcctcaccgtaagaaacacatgtttttctccaattactttaggggckactactgtatgtcaaagatcatgtcacttgattttatttatcttttcgttgcaacactattcacaacttgtcacttttgaaaaaacacaaggtcagttag

SEQ ID NO: 42062 - DNA, 201 bp, Homo sapiens
gagttagataaacacctctaaacgctgatttacagcatctatcacattgtgcagtagaaaaggctaagctgagagtcaataacctttggaaacttcttagraaagcatggccatatcaggaactaaaatttgctgtactctgcagtcctaaattcatgtacctccctttgaaagctgggctgatcccaatttcctaggtga

SEQ ID NO: 42063 - DNA, 201 bp, Homo sapiens
gatctatcctcaccgtaagaaacacatgtttttctccaattactttaggggcgactactgtatgtcaaagatcatgtcacttgattttatttatcttttcrttgcaacactattcacaacttgtcacttttgaaaaaacacaaggtcagttaggtagatcacatgactattcttagtttttcatactctgtatccaaattt

SEQ ID NO: 42064 - DNA, 201 bp, Homo sapiens
ttctccaattactttaggggcgactactgtatgtcaaagatcatgtcacttgattttatttatcttttcgttgcaacactattcacaacttgtcacttttkaaaaaacacaaggtcagttaggtagatcacatgactattcttagtttttcatactctgtatccaaattttacctttatactctttgccatgtgactttgc

SEQ ID NO: 42065 - DNA, 201 bp, Homo sapiens
ttgtcacttttgaaaaaacacaaggtcagttaggtagatcacatgactattcttagtttttcatactctgtatccaaattttacctttatactctttgccrtgtgactttgcagttctccccactagggaagggatgtatttcctgtgagttactttgactaatgaaatatgagttgaggccgggcatggtggctcacgcc

SEQ ID NO: 42066 - DNA, 201 bp, Homo sapiens
gggggcagatcacctgaggtaaggagttgagagcagcctgaccaacatggagaaaccctgtctctactaaaaaatataaaattagccaggcatggtggctygtgcctgtaatcccatcactttgggaggccgaggcaggcaggtcaccagatgtcagaagattgagaccaatttggccaacatggtgaaaccccatctcta

SEQ ID NO: 42067 - DNA, 201 bp, Homo sapiens
tggtggcttgtgcctgtaatcccatcactttgggaggccgaggcaggcaggtcaccagatgtcagaagattgagaccaatttggccaacatggtgaaaccscatctctactaaaaaaatacaaaaattagctgggtgtggtgacacacacctataatcccagctactcgggcagctgaggcaggagaatggcttgaacccg

SEQ ID NO: 42068 - DNA, 201 bp, Homo sapiens
tcccagctactggggaggctgaggtgggagaatggcgtgaacctgggaggcagagcttgcagtgagccgagattgcgccactgcactccagcctgggagacagagtgagactccatctcaaaaaaaaaaaaaaaaaaaaaagaaagtttgaatagatactttcctttagatatgaagacattcagcatcaattcattgctc

SEQ ID NO: 42069 - DNA, 201 bp, Homo sapiens
ggtggcttgtgcctgtaatcccatcactttgggaggccgaggcaggcaggtcaccagatgtcagaagattgagaccaatttggccaacatggtgaaacccmatctctactaaaaaaatacaaaaattagctgggtgtggtgacacacacctataatcccagctactcgggcagctgaggcaggagaatggcttgaacccgg

SEQ ID NO: 42070 - DNA, 201 bp, Homo sapiens
tttgggaggccgaggcaggcaggtcaccagatgtcagaagattgagaccaatttggccaacatggtgaaaccccatctctactaaaaaaatacaaaaattmgctgggtgtggtgacacacacctataatcccagctactcgggcagctgaggcaggagaatggcttgaacccgggaggtggagattgcagtcagctaagat

SEQ ID NO: 42071 - DNA, 201 bp, Homo sapiens
ggaagaaaacaaactagcggattacagacactcctctttaggactgtgaactgtgaaaacaaatcacagcagagaatcagacagatgtccatggtaatggytcattctctaatggaatagactgcaatgatgctgctaatcaagtatacaccatccagactgctgccactgctgccaggatcagcagtctgcacactgtaa

SEQ ID NO: 42072 - DNA, 201 bp, Homo sapiens
gataaactgatttgcaaaaatttcctagagcaaaaagttaggttgacataagtggtgttgattctcaggccccacagttggcacaggcagtctcatttctyaagacaaaatgaaaagaagtcagctaaaacttataatctttaaaagctgtaaaacaattggggagacgggtggatatcccaaccaatattagttgctcta

SEQ ID NO: 42073 - DNA, 201 bp, Homo sapiens
tgtgaaccactgcgcccggccttacctgttaaattaatgttagtggaaacacattgccaaactcaatttttcaagtacatgtatcttcaaaatacaaatayacttcaaagctactgtactttgaaatatgttatcttcaaaaatgacattatcactaagaatataggaagccttaagaattgaatatggtggttcaaaatt

SEQ ID NO: 42074 - DNA, 201 bp, Homo sapiens
agaccccaccctgtggaagtgggtctcaacattacacaaccccctctcgggcccgtggacagttgctgtcctctctgttttctctctttgtgcctgtgccmccctcagagaagaagaaaggagctgaggaggagaagccaaagaggaggaggcaggagaagcaggcagcctgccccttctacaaccacgagcagatgggcc

SEQ ID NO: 42075 - DNA, 201 bp, Homo sapiens
caggcaggcaagcctcctgcaggggagccccgccctgctcaggtggcctcatctcccctcccagctggtggtgctgccctatcagatgctgctgcatgcgrccactcggcaggctgcgggcatccggctgcaggaccaggtggtgatcatcgacgaggcgcacaacctgatcgacaccatcacgggcatgcacagcgtgga

SEQ ID NO: 42076 - DNA, 201 bp, Homo sapiens
ggcgaggaaagggataattgaagagatattttgaaggaataaaagaccacacttgatgataaacttgctagtgagtgaagatggctgaagaatcagatacrgagccagagttcctccttaggaggtaggaaggccttaaagtatatggtaaaggcagagatacgagctgaggtattctgtggaatacgacacaatagcagt

SEQ ID NO: 42077 - DNA, 201 bp, Homo sapiens
gagaacagcaagcgtaagagtatagtcatatatttaaatacgagtatgtgtggtaggcgttggagatgaggggataaataaaatagaatcaacaggcatgrtgatagaagaggtcattgctggggtagagcatataaaggaggttgtagttaacttcataggtcacagggatcattgctagctattgaacagcagattaac

SEQ ID NO: 42078 - DNA, 201 bp, Homo sapiens
gtcagaataccatagatgggtacttaaacaacgaacatttattgctcaagttctggagactggaagtcctgagattagggtgccagcatggctggtttgcrgtaaaggcttgcctcctggttcacagatggctgtcttctcacatggcaaagagagtgagagctcttctctttctcttctctaaggacactaatcctatag

SEQ ID NO: 42079 - DNA, 201 bp, Homo sapiens
ggatttctgaccatttgccctgccttttaaaaaataggtctaattgcaggatggtgtcataattaaggctactattgaccacccattgttccaggctggasagcttataatggggacaaacagtattggagaaacaaaaatcatacgttttctctttagattgtcagggtcaaattgatttcaatcccagaggatgcagcc

SEQ ID NO: 42080 - DNA, 201 bp, Homo sapiens
gaacccgggaggtggaggctgcagtgagctgagactgtgccagtgcactccagcctgggcaacagagtcagactcagtctcaaaaaaaaaaaaaaaggctyaagtaggcacagtagctcacacctgtaatcatggcacttttagaggctgaggtgggtggatcacttaagcccagaagttcaagaacaatctgggcaacat

SEQ ID NO: 42081 - DNA, 201 bp, Homo sapiens
atgtgctagacacactggaggtgctggggtataagggaccattgctagaggagcaagcccttatgaaggcagcagagtggactatatgtaggagcatatayggtataggattatatatataggcttttatacaggaagaaggtggtatatactgtaaaggaatagatatataaactatataaattcctatacaggatatgg

SEQ ID NO: 42082 - DNA, 201 bp, Homo sapiens
acaagcactaactaaccacctctgccctttctcatcccttaatcattcagacaagatttccttgtttacttcctcctataaaaaccctaagtctatttcaytttctttgaaaagattcctctgcattaatggatgttgtccttactacaatagcatgaaaaaaaaaaaaagtctccttaatgcagcttagcaattttccag

SEQ ID NO: 42083 - DNA, 201 bp, Homo sapiens
gtgttctggtgaagatcaagtgagataaggcacacttagcaaaatgcctggcacatggcacaaaattttgtattcctcttcagatgtttatttcataagtrtatggactcctactatcagtcagtttgaccagagaaacataaacactatgagtaacagagtatggtttacgatagagattatgaggatttatcataggga

SEQ ID NO: 42084 - DNA, 201 bp, Homo sapiens
cctctgccttaattatcaggaatgttgagtgaattgttttgcttctctgaggctcattcaaaaggggaaggtaataaattagccccaccatttgtctctgycatgcctttgttggaactatggaaaaaacaaaacaaaacaaaacaaaaatcaggtctccttcttgaagccatcatactgccatctgctgggaaatggtaa

SEQ ID NO: 42085 - DNA, 201 bp, Homo sapiens
tggttacaagatggcacagagtttataagtagaaattctcttgactgcacagctttccatagtctagcaatgtgcccttgggaaaatgtattcatctcttygagctcaatgtcttcacctgtacaatggtgttctggtgaagatcaagtgagataaggcacacttagcaaaatgcctggcacatggcacaaaattttgtat

SEQ ID NO: 42086 - DNA, 201 bp, Homo sapiens
acctctgccttaattatcaggaatgttgagtgaattgttttgcttctctgaggctcattcaaaaggggaaggtaataaattagccccaccatttgtctctkccatgcctttgttggaactatggaaaaaacaaaacaaaacaaaacaaaaatcaggtctccttcttgaagccatcatactgccatctgctgggaaatggta

SEQ ID NO: 42087 - DNA, 201 bp, Homo sapiens
attcctagagttcacatgcctctcaaatatctttaaattatctctggccacagtaatttctctatttttggtcccagatgcccctttccacttactgaaaytgtgagaaaaggtgatatgtagttggtggtgtccatggaaatgttcaccaaaccatgctcatcagtagttgcactgaaatagtatctagtattcacatga

SEQ ID NO: 42088 - DNA, 201 bp, Homo sapiens
gtctcatttctcaagacaaaatgaaaagaagtcagctaaaacttataatctttaaaagctgtaaaacaattggggagacgggtggatatcccaaccaatawtagttgctctacgttttatacttaaaagaaacaacctattactatttggccaaatcatcatatggtgaattgatctaacaaataaaagagttttggcaac

SEQ ID NO: 42089 - DNA, 201 bp, Homo sapiens
gcaagtgtcaaatagtagacctttagcaattgttatttatttttaaaagtgttgctcattttttccataagagaatcagtataattggagtagagtcattktacatgatttctaacctaaaatattttttatgcctggaactctggacaatttttttctcctctagtttatttaaggtatcctgtttttatccaaaggtaa

SEQ ID NO: 42090 - DNA, 201 bp, Homo sapiens
gaagtctatttacccacctcttgaatcttgggctggtcttgtgactttgaccaataaaatggagaagtgatgacttctgaatttcattttgaaaaggtctyctggcttctgctcttgctcttagaattctgccctgagactattgtataaagaagctcagtatagcgtattaaagatgaggccacggcctgaagtatacaa

SEQ ID NO: 42091 - DNA, 201 bp, Homo sapiens
ctcaaatttctcctggggataacattactattgtaaaacataagattagtgcttgagacattttgcagaccgtacacttgatggatcagctggcactaccyagcttggtaaactggctcatctaatcttgtagcccccgcccaggacctgactcaagcaaaaggacagctttgactccctgtgatttcatctctgacccaa

SEQ ID NO: 42092 - DNA, 201 bp, Homo sapiens
gtttgaagattttcctgtttccaaaaatcacatactttcctcttttgagtattctatagaataactctctacatttcctagtttgtggaaattttctctayggcataactactctaaattgtgcaattttcctcatatcagacttatttttctctatacctggttccctagcaaacctgagctttatttatatatctgata

SEQ ID NO: 42093 - DNA, 201 bp, Homo sapiens
atacatgtttggactacatgcctacgtgcagtatcacatttgcctaagtttatcagtaattaattttgcttcaactagaaggtcagaggccaaaaatgccytctaaatctacctaatccgtgagggtcctcgtaccagggtgattaagaaatgtctcctaaatttacttaaggaggatcctggcaccagagcaattacttc

SEQ ID NO: 42094 - DNA, 201 bp, Homo sapiens
tctataagattagaaattaatctgtaaacattgatacattgttaggatgcttttgccacctgatagagacattaattccaaatgttccaggtctttattgycctgagaaagttaagcaatcttataactaatttagcaaatttgtgtaaggattttgcctttcaatatgaatgtatgttcaaagacaaaggtctggaaaga

SEQ ID NO: 42095 - DNA, 201 bp, Homo sapiens
ttctgggatcacaggcgtgagccaccgcccccaactgcttttttaaaaatattttgatctgcagttggttgaatcctcaaatgtaaaacccacaaatatgragagccgacaagaaccaacatctgacgaaggtacagaaaaactactgcactactgctctataagattagaaattaatctgtaaacattgatacattgtta

SEQ ID NO: 42096 - DNA, 201 bp, Homo sapiens
tgtactcaggctggtctcaatctcctgggctcaaatgatcctcccccatcttgttctcccaaagttctgggatcacaggcgtgagccaccgcccccaactrcttttttaaaaatattttgatctgcagttggttgaatcctcaaatgtaaaacccacaaatatggagagccgacaagaaccaacatctgacgaaggtacag

SEQ ID NO: 42097 - DNA, 201 bp, Homo sapiens
agtgatctcggctcactgcaacctccacctcctgggttcaaggaattctcctgcctcagcctccagagaagctgggattacaggcgtctgccaccatgccygactaattttctgtatttttagtagagatgaggtttcaccatgctggccaggctggtctcgaactcttgacctcaggtgatccagccacctcggccttcc

SEQ ID NO: 42098 - DNA, 201 bp, Homo sapiens
ctaaacagcagagaccttctgatgtctggcaatgctgggtgcagcttccatgcccctccaccacacagcatgctcagctgcaagaggtgaggctgaagcgygtgcagaagacttgacctctgggcagccaccctttccattctctacctatgtgtagtccatgcttgctgcatagcctctgggagaaagtgctaaatcaca

SEQ ID NO: 42099 - DNA, 201 bp, Homo sapiens
aacctgagctttatttatatatctgatatgcaccccatctccacagctggcattcaattgcaactctaaattctaaagtgctcagagtcaatataatgcaytgacgattcagacctgactgggcattttcactgcataaatctaaaaagtaaacaatctcattatgtttgagaggatggatggggagaagactgatctata

SEQ ID NO: 42100 - DNA, 201 bp, Homo sapiens
tcactggaaggcaaaggagaggtggcgggggcaggtccacgtgtgttggtaggatgtcatttagctggcaccatctctttgcctctttctttctcctttgytgcagaacctttgtgtaaatgaagacgtgagaagcctaggttctgtgcagcttatcaacgaccgctgcgtggacatgcagagaagcaggcacggtagcca

SEQ ID NO: 42101 - DNA, 201 bp, Homo sapiens
ttgtgaagtcagaaactgaaaagtctgagattttctgctacttgcaagctaacaagttaccgtgccacaattttttttttttttttttagacagagtctcrctctgtcgcccaggctggagtgcaatgcagtgatctcggctcactgcaacctccacctcctgggttcaaggaattctcctgcctcagcctccagagaagc

SEQ ID NO: 42102 - DNA, 201 bp, Homo sapiens
cgagtagctgggactacaggtgcatgccactacgcccagctaatttttgtatttttagtagagacagggtttcacagtgttggctaggatggtctccatcwcttgacctcgtgatccgcccacctcggcctcccaaagtgctgggattacaggcgtgagccaccagcacccggcctactaaatcttacaaacaagagtgtt

SEQ ID NO: 42103 - DNA, 201 bp, Homo sapiens
tcggagctgtacattgagctggtagtcccttagttctgcctcttcacaatgcagttttaaatccttgtctttttcacccagagaagcagagaggtccattytttccacagccacaccagtacgcttggccagagcctgcaagcgggctatggtttcattgcccttcagtaactcatacatgctgatgttattagtacagac

SEQ ID NO: 42104 - DNA, 201 bp, Homo sapiens
tgcactccagcctgggagtcggagggagactctgtcccagatttaaaaaaaaaaaaaaaaaaaggctatggtaatgacctgtctccctcttgcttaagttytttctttctttctttctttctttctttctttctttctttctttctttctttctttctttctttcttttttaatctatctttctttctttctctctctctc

SEQ ID NO: 42105 - DNA, 201 bp, Homo sapiens
accatgcccagctaattttttattttttatagagacgggggtctccctatgttgcccaggctagtcttcaactcctgggctcaagcaatcctccagcctcmgcttcccaaagcgttgggattacagatgtaaaccactgcacctggcctgagttttcagtaaaccaaataattaatgtaattctgactgtattagaaccta

SEQ ID NO: 42106 - DNA, 201 bp, Homo sapiens
actcaatgttggctagaattgtccatttagctggaggggaagagggagggaaggatggatggaggagtgaagtatggaagcaggcatcaggccacttcccrtacctctcccaaactccaaaggcaatgatcacattggagggtcagctaaacacaaagggaagtgaagaaagaagtttgaagattttcctgtttccaaaaa

SEQ ID NO: 42107 - DNA, 201 bp, Homo sapiens
tgcatttataatcccagctatctggaggctgaggcaagaggatccctcgagccccagagttcgaggctgtagtgaactatgattacaccactgcactccarcctgggtgatagagtgagaccctctctctctcaaaaaaaaaaaaaaaaaaaagatttatatgtattatatatgtataaatacatagcctaaatatcaact

SEQ ID NO: 42108 - DNA, 201 bp, Homo sapiens
ttttttatgcctggaactctggacaatttttttctcctctagtttatttaaggtatcctgtttttatccaaaggtaaagacataaaactatactgtgggtrgtaaacaaagatggttttaatcactcacagtttgtgctggcagctgaccataattccttagtagcaataccctctggtctaccgcccaaagagcataaag

SEQ ID NO: 42109 - DNA, 201 bp, Homo sapiens
cgagctgctactgaaattcttctttataatttgatagtgttggacttgaaggtcccatctggttacacagtaatttaccactttactgtgggttctggtaygccaaagaaggcagtactctccagtctttgtttaaacaactctaggatcagaatgttcctggtttgtcctggtaccagagacactgtttgaaattgtttg

SEQ ID NO: 42110 - DNA, 201 bp, Homo sapiens
aatattttttatgcctggaactctggacaatttttttctcctctagtttatttaaggtatcctgtttttatccaaaggtaaagacataaaactatactgtkggtggtaaacaaagatggttttaatcactcacagtttgtgctggcagctgaccataattccttagtagcaataccctctggtctaccgcccaaagagcat

SEQ ID NO: 42111 - DNA, 201 bp, Homo sapiens
ttttaacgtttagaaacccacgtttctagcagagcgtggtggcacacatctgtagtcccagcactttgactgggtgaggctggtggatcgcttgagcccargagcttgataccaacctgggcaatacagtgagacctcacctctatagttgaaagaaagaaaaaaagaagggcagggtagggcagcggaggggaggggagg

SEQ ID NO: 42112 - DNA, 201 bp, Homo sapiens
tagggcagcggaggggaggggaggggaaggcaggggaggggagggatgtttccttggatgaaatgtgtttcttcttgtggtccccgaccagttttaaactytagaactgtggcactactaactggcttctaggcagcctcttccacttagatgggtttgaagtacagaaatgatttcatcagcctgaccattgaggctcta

SEQ ID NO: 42113 - DNA, 201 bp, Homo sapiens
atgttgcctaggctggtcttgaacccctggcctcaagtaatacacctgtctcggcctcccaaagtgctgggattacaggcgtgagccactgcactggcccrgattgtcagagctttctttcagaggctggagtgtgagagggaagaagtggtgtttgagggaagagttggatctcaagtggaatttcccaactctgactcc

SEQ ID NO: 42114 - DNA, 201 bp, Homo sapiens
aagaggagaggaattcaggctgggtgagatggcccacactttgggagaacaaggtaggaggattgcttgaggccaggagttcaagaccagcatgggcaacrtagtgagacgaagtctctacaaatatatatttttttgattagccagcatggcagcatgcatttataatcccagctatctggaggctgaggcaagaggatc

SEQ ID NO: 42115 - DNA, 201 bp, Homo sapiens
tggggctctacgaggaaaacagtgatcctcccacccccagaaaaggaatatgtggccttcaaggggtcctcaaggagacccaggactgttataagtcttcrttaccagctgggctcagtggctcatgcctataatcccagcactttgggaggctgaggtgagagtattgcttgaggccaggagttcaagaccagcctaggc

SEQ ID NO: 42116 - DNA, 201 bp, Homo sapiens
gaaaaagagtagagagttagacctgagaggaacctatccacccacagctcttggggctctacgaggaaaacagtgatcctcccacccccagaaaaggaatmtgtggccttcaaggggtcctcaaggagacccaggactgttataagtcttcgttaccagctgggctcagtggctcatgcctataatcccagcactttggga

SEQ ID NO: 42117 - DNA, 201 bp, Homo sapiens
ttatttttaagttaatttggtaccatgtagacaatacacaaacatatgtatagacatataaatacatgtagatacaacatatatcatacacatgtatgtgyctatttggctttgtttctttgtttgggacatggtctcgctatgctgtccaggatggcctcaaactcctgagttcaaatgatctttctgcctcagcgacct

SEQ ID NO: 42118 - DNA, 201 bp, Homo sapiens
aatcgacttttgacttttgactttttagagcatgagaatcccttgaacttgggaggcagaggttgccatgaaccgagatcgtgcccctgcactccagcctsggtgacagagtgagactctgtctcaaataaccaaacaaacagagccaaaagtatataagcttaaactcgaatttagtaattaatgtcttagcattatatc

SEQ ID NO: 42119 - DNA, 201 bp, Homo sapiens
gctcactgtagtctcgacattccaggctcaagtgattctcccacctcagcctcccaagtagcagagacttatacatgcatgtgccaccatgcctggctaawtttttaaaaaaaatttttgtagagatggctttctcactatattccccatactggtttcagactcctggactcagagatcctccagccttggcctcccaaa

SEQ ID NO: 42120 - DNA, 201 bp, Homo sapiens
gatctctgatgccaccatggacccaagcaaaggtacctgcaggacgcttttgcactccattgatcttgatagccctggaattcactgggtgagtcctcttrtgttctaaacctcctgacatggttcagattgaggccttttttcaggtgttttctgttgccacttttaattacaaggatggcttcattgttttggggagtg

SEQ ID NO: 42121 - DNA, 201 bp, Homo sapiens
aagtgggatacagagcagttccctcttgatctctgatgccaccatggacccaagcaaaggtacctgcaggacgcttttgcactccattgatcttgatagcyctggaattcactgggtgagtcctcttgtgttctaaacctcctgacatggttcagattgaggccttttttcaggtgttttctgttgccacttttaattaca

SEQ ID NO: 42122 - DNA, 201 bp, Homo sapiens
cataaggagttgggagttgaaccccagtcacgtacacacccagaaggaatttgacctctttgaactgagccaaatttaaaacttctttaagaagcagctgyatttgatttgaactatttacaccaggtctaatcaccaacctcctgaggagacaactgtgctgaattaagctcattactgcctagagacatacaagctgtc

SEQ ID NO: 42123 - DNA, 201 bp, Homo sapiens
tttgaagtacagaaatgatttcatcagcctgaccattgaggctctagagattcaagcatgtggagaagttctgagtgctcaatctcaatgccaatcatttyactggtgaaaataaggttcatagcttgaataagaggaaacatctatccacctgacatcaggttttgttcctgattaaggatacattttgatactggagtg

SEQ ID NO: 42124 - DNA, 201 bp, Homo sapiens
acatacccacgactgggtaatttatttaatggacttgcagttccaggtggctgcggaggcctcacagtcatggcagaaggtgaaggaagaccaaaggtacrtcttacatggcagcaggcaagagggtgtgtgcaggagaactcccctttataaaaccatcagatctcatgagacttactcactatcatgagaatggcatgg

SEQ ID NO: 42125 - DNA, 201 bp, Homo sapiens
aagagggcataaggagttgggagttgaaccccagtcacgtacacacccagaaggaatttgacctctttgaactgagccaaatttaaaacttctttaagaarcagctgtatttgatttgaactatttacaccaggtctaatcaccaacctcctgaggagacaactgtgctgaattaagctcattactgcctagagacataca

SEQ ID NO: 42126 - DNA, 201 bp, Homo sapiens
ccaggaggcagaggttacagtgagctgaaattgcaccactgcaccccagcccggcaacagagcgagagtctgtctcaaaaaaaaaaaaaaaaaaaaattarctgggcatggtggtacacgcctgtaatctcagctactcaggaggctgaggcaggaaaactgcttgaaccggaactggggaggcagaggttgcagtgaact

SEQ ID NO: 42127 - DNA, 201 bp, Homo sapiens
cgcctgtaatcccagctactcaggaggctgaggcaggagaatcgcttgaatccaggaggcagaggttacagtgagctgaaattgcaccactgcaccccagyccggcaacagagcgagagtctgtctcaaaaaaaaaaaaaaaaaaaaattagctgggcatggtggtacacgcctgtaatctcagctactcaggaggctgag

SEQ ID NO: 42128 - DNA, 201 bp, Homo sapiens
gacaacacgatgaaatcccatctctactaaaaatacaaaaactaggccaggcatggtggctcacacctgtaatgccagcactttgggaggcttaggcgggygaatcacgaggtcaggagttcaagaccatcctggccaatgtggtgaaaccctgtctctactaaaaatacaaaaattaactgggcgtggtgtgcgcctgta

SEQ ID NO: 42129 - DNA, 201 bp, Homo sapiens
taagcccagcacttagggaggttgaggcgcgaggatcacttgagcacaggagtttgagaccagcctggacaacacgatgaaatcccatctctactaaaaayacaaaaactaggccaggcatggtggctcacacctgtaatgccagcactttgggaggcttaggcgggtgaatcacgaggtcaggagttcaagaccatcctg

SEQ ID NO: 42130 - DNA, 201 bp, Homo sapiens
tcttagcactttgggaggccaaggcaggaggttcccttgagcccaggagttcgagaccagcctgggcaacatagggagacactgtctttattttttttaayaaataaatagtttttttaaatgaagattctaaggattttagaagttgtgtgcccagaaacaagatgaagaccaaatatacatttcagagaaatcacaata

SEQ ID NO: 42131 - DNA, 201 bp, Homo sapiens
actcgttagcatacaaaaagacacatcactttgaagattctaaggaggccgggcatggtggctcacgcctgtattcttagcactttgggaggccaaggcargaggttcccttgagcccaggagttcgagaccagcctgggcaacatagggagacactgtctttattttttttaataaataaatagtttttttaaatgaaga

SEQ ID NO: 42132 - DNA, 201 bp, Homo sapiens
tggctataatacctattttcttagctgatatccatttaatcattcatttgataaatatttattgtatgtgacattagtattaactttatagaaagcaatgytgcttttaaagtgattagtagggtgataaatgagctatttgctagtatatccaagttatctagtaagaagggtttactgagcaaagaagtatgggtaata

SEQ ID NO: 42133 - DNA, 201 bp, Homo sapiens
attatatgatttcctttgcatatgttatgtgacatgatgttaacaataatcttctgaaataaatattgccattttatagtcagcaagactgaggctcagaraagtgtaataacctgcccatgcgcacaatcactgtattgcagattctgtatttcagcctcagtcttctacctaaactctttctacatactgtttctattg

SEQ ID NO: 42134 - DNA, 201 bp, Homo sapiens
cagtatgaagccaacaatgaggaatttcttccgagctctcccctggagatggggtggcgggagggcatgcctgcgactgagataactcccaaagcacagcrgggaaggaagaggagaacaatgaggaagaaagggagctgagaagggaggggaagcagacaggagatgaggcggtgcatggaagagagcctggtgccaccc

SEQ ID NO: 42135 - DNA, 201 bp, Homo sapiens
gaccatctctaacggcagcctttgatctcaaaaatgccccagcctctaagtaacccatggcagtatgaagccaacaatgaggaatttcttccgagctctcycctggagatggggtggcgggagggcatgcctgcgactgagataactcccaaagcacagcagggaaggaagaggagaacaatgaggaagaaagggagctga

SEQ ID NO: 42136 - DNA, 201 bp, Homo sapiens
ccagggcagctcattgctgggaaggccacagcacccagctccctctgctgccagattccaggccctgtggacagcatgtgtcacacagcaggtgcacactkactgtcatctcccttccttagtcctggaggtggtctctgctgtggctctgcatgccaccaatgctctctgaccatctctaacggcagcctttgatctcaa

SEQ ID NO: 42137 - DNA, 201 bp, Homo sapiens
ccttcaagatcattgcaaagaaaaactaagttaacataagaaacagtgcctggtggctagtgaacattctacaggtgttggatgctgttgtcatcattgtyatcattatcagaatggacaagacagaaccccacagtcattcatttcagctctctttttggtgaagaaatgtgttgagcatttagctggaaacctggcact

SEQ ID NO: 42138 - DNA, 201 bp, Homo sapiens
tatccttccccaaaacctcagcccaactcagcctcatttttccatctcttctcccttcctccatgggagagctttctgttggcacaggaatagctgagaartgggaaagatcaagtgtagtaaaagctgccccagataatctacagaaaactttgctggaatgaggttgtgcatctctgaacctgagctagatttgttggg

SEQ ID NO: 42139 - DNA, 201 bp, Homo sapiens
aatctaacatgtataattagggtttcagaaagaggacaaatttggcccaaatttttccaaatgagataaaaactaaaaactcatagatcaaagatgctcartagattttaggcagaagaaacatgaaaaattatatatactgagctacattattaagctgctgaaagtcaatgataaagagaacatgttaaaagcagccag

SEQ ID NO: 42140 - DNA, 201 bp, Homo sapiens
gttattgagttgaatgcaataatgcatgtgaggccatgagcagaggctctaagtatattttgaattgtttttccctttagatgttttcccaggtacctggytctctgggcctaggacacataatcccagagggtataaatctagtgcttggtcccaacatggttttgctccctaaatactgaaatagtagacaagacgaca

SEQ ID NO: 42141 - DNA, 201 bp, Homo sapiens
gggtaacaaatgaatatgtctgaacctcagctataatactttctactacctttgcaaggagatgggataggaacaatcactcagaggaggcgttgcatggrcagggtcatagggggaagaaaggtggtttagctgttttatttagccattcagggggctctccagagaggagacggtggtagagggtgaactagagaagat

SEQ ID NO: 42142 - DNA, 201 bp, Homo sapiens
cgaatctaaacaaggaagtagcaagtccattcaagcattaagaggctgattagtggtttattcattctgtctacaagcatctactgatcatctattcagtrcagaccattatcacaacaaaggtgaataagacactatgcaatagccagggaaacagcctcaaaaacagttaaactctaatccagccatgagtacaatgct

SEQ ID NO: 42143 - DNA, 201 bp, Homo sapiens
catttccactgtcctctcttctttcacagccattttcttcctctttctttgctcattgttttttcattattaggacttggctttttaggtcaagactcctrataaaaggactcctttcttctgctgttgccttaccagtcacatatgtggtgctgtctctagtgggctttgctttaaaagcaaaaaacaaaaaaccaacaa

SEQ ID NO: 42144 - DNA, 201 bp, Homo sapiens
gtagagacggggtttcaccgtgttggccaggacggtcttgatctcttgacttcatgatctgcctgcctcagcctcccaacgtactgggattacaggtgtgmgccaccgcacccagccaagtcttattatttttatatggaaccagtacatatctttgtctccccaccaactgtaccagaacatgtactctagtttatcttt

SEQ ID NO: 42145 - DNA, 201 bp, Homo sapiens
atatcacctgatgcaaatggggcatttccacaactggctcgttttacagcctctccctcaaccgatgcctctgacctaatttgtgctgtccctagtgcccrctttattcatggctcaatatcaatggtgcaacatctgattgtattaaatgtataaagaataactcttcctatatctctactatagtggatgtctctctgg

SEQ ID NO: 42146 - DNA, 201 bp, Homo sapiens
ctatacagcccttcctacaccctttcatgaccttttaacaggaaacataaccataatctataaactccaaaaaggagcttccttttttgaaagagctgacrccctggtaggtgattatgccccttccagggccaatcaagccaacaaatcatttcaaacctattacaactccctacaatgcctcaagccccaaggccctcc

SEQ ID NO: 42147 - DNA, 201 bp, Homo sapiens
ccaaccaatcttgttacagacctttattggtaccattatgaaactcccattatccatcctgatcagctccttactattctatgggacttacggcttcaagsaattttccaggactttactcctactcaaataacctttttctccttttgcttgtttctttcaatataaattctgtaatcacatcaaccttaccaatacaac

SEQ ID NO: 42148 - DNA, 201 bp, Homo sapiens
gtcactgtttcacaaactgcctttgttctgcttctgtaagcctgcttgcccgccctacaggttttgcaccatcaaactggtgagcccctttttggatgcaygtatagccaacccccttttggatgcatgtataaaagtcaagccctgtctttgttcggggctcagcctttggatgttaatcctctgggctggtacacacct

SEQ ID NO: 42149 - DNA, 201 bp, Homo sapiens
acaggtgtgagccaccgtgcctggcctcatttccccacttctacataccatctgccatttcatttgggaatatgctgacgaatacctgacacgacccatcrccgacttctctaatcacttcctacagccaggagactgggttctggtaaaagatcccagtcctctcctcaatcctcccctcacacttaaatggaatgggtc

SEQ ID NO: 42150 - DNA, 201 bp, Homo sapiens
caataagataaattttaaaaccacttggaaggccatctctataaaaatgattttcccaggacagtaaccagatgtaacctaacctaacaccatcttaaccrgcagaggttcagtgggctagagctttgtgctcctcccctacaccaagtttttataatacaaatgccacaagaaaaagaacttcagtactgtttcctctta

SEQ ID NO: 42151 - DNA, 201 bp, Homo sapiens
gtcagagaggttagacaactcttccagagtcacacagctgggaagtagcagctccaggagcagaagctggggccgcttcctggtgcaccgatggtcttcargtgttttgtggaaactcgggggcctccggggcgaccttgaggacatggacaaggctaagcaggggttcccttcacccagccctgcccttggtttactcag

SEQ ID NO: 42152 - DNA, 201 bp, Homo sapiens
gacctcaggtgatccgcccgccgcagcctcccaaattactgggattacaggtgtgagccactgcacccggcctttcaaagctcatttcaatcccacctccktcacaaagcattcttcagccaccttcgttttcatcctttttttctctgcactctttctacccttatcatttacttgacactatgcaaattctacatgtat

SEQ ID NO: 42153 - DNA, 201 bp, Homo sapiens
caggagccatggtggtgcagaccaggagctgtgtctagcaaggcttatgccctgccaagcactgccaatggagatgtgaagctgctggtggtatccagcaygcctctggtggacttcctgatgtagctggaggattatacacctatgatcctggatgctgtgactgattattttttatttttgagatggaatctcgctctg

SEQ ID NO: 42154 - DNA, 201 bp, Homo sapiens
agaactcccctttataaaaccatcagatctcatgagacttactcactatcatgagaatggcatgggaaagacctgtccccatgattcaattaccttccacygggtccctcctacaacacatgggaattatgggagctacaattcaagatgagatttgggtggggacacagccaaactgtatcaactatcatacctcttaat

SEQ ID NO: 42155 - DNA, 201 bp, Homo sapiens
ccatccaccccgtgcagtggtcataaaccagagagagaaatgtccacatgaaactatgtgctgcatgctggccatcactcatggatcattaatgaaaactracttggaatcactattttaaggacaggatggcggggaggcatgcttgtaaacagagcccttggcgactcaattcatctgcaactcatttttcatatatgt

SEQ ID NO: 42156 - DNA, 201 bp, Homo sapiens
cccctgtctctagcctctcccaggcctctagccaggccctagcggtggcacaggcttcctctggggccacaaaccagtccctcaaccttagtcaagctggyggaggcagtgggaatagcatcccagggtccatgggtccaggtggaggtgggcaggcacatggtggtttgggtcagttgccttcctcaggaatgggtggtg

SEQ ID NO: 42157 - DNA, 201 bp, Homo sapiens
aacaaactggggagagttgggttagatgatgactaagctgtcttccagctctgagaatcttaggagtttacaaatgtttaggcaagcaaacagtgaaatcyggtctttcaaataaggatttaaaaaacacattcagtccatctagctagattctaactaaccctttctcatactggattgccaggtttttaatctttggcc

SEQ ID NO: 42158 - DNA, 201 bp, Homo sapiens
ggagtctgggtttaggggaggaaggcatggcggcgcccgctaggatttccagttgtcctcttcttcctctgcctgtggctgctgggggttagcagacacgrtttgttgtctgacatacgggctctctcctcccggcccctcaccagccccagaggtgaaaaggctggagggcaaaggctgagtgagggaggtctgtgggga

SEQ ID NO: 42159 - DNA, 201 bp, Homo sapiens
aattatcaattccttctctgtgttatcttcaatttctttgagtttccttaccacagctcttttgaattctttgtctgaaaggtcacatatctctgttttttccaggaatggtccctggtgtcttagttcttttttttttttttttttgagacagagtctcactctgtcgcccaggctggagtgcagtggcacaatctcggc

SEQ ID NO: 42160 - DNA, 201 bp, Homo sapiens
aatcagctcagttctgacactatccacctggagatagcatcagattccacaggttgaggactcaattcccgagactgccctgttttccattcagatgccarttgcaagctccaggttgttttacctgtgcttctgactgaccaagctatacatcgggtttcccaaaaacccctccttgggtttgatggatttgctacagca

SEQ ID NO: 42161 - DNA, 201 bp, Homo sapiens
ccacttttaattacaaggatggcttcattgttttggggagtgtctcaaataagaacctatgagggaaagaaaaaaattatattttctcctctacaatttgrcaactcagttgggaccaatagagacactccactcactccaagacctataagtggaatcctgggagaacttgcagaagccaatataaataggtaggatttt

SEQ ID NO: 42162 - DNA, 201 bp, Homo sapiens
gggattacaggtgtgagccaccgtgcctggcctcatttccccacttctacataccatctgccatttcatttgggaatatgctgacgaatacctgacacgamccatcaccgacttctctaatcacttcctacagccaggagactgggttctggtaaaagatcccagtcctctcctcaatcctcccctcacacttaaatggaa

SEQ ID NO: 42163 - DNA, 201 bp, Homo sapiens
aattgatcctaaatgaagctacaagaagaaacaacatgtaaaaaagactttgggtaagtataaaatattaactataaaacaatgataatgtttagtaatakttaaatttgaaagaaaaaagataatattaaaacatatgacaggtctgtgttctggaggagataaagaaatagattaactttgtaatttaagtaatcacaa

SEQ ID NO: 42164 - DNA, 201 bp, Homo sapiens
ttgttagtatagcgttctatgcttctaccatagtaaatatgtaatcatgtttatcaaatctactcgatgaacattttctgtcaattattaattttcaaatyctccaatatgattgaatataaatttgtctgtttcttcttttttttttttttggagatagagtctcactctgttgccaggctggagtgcagtgacgcaatc

SEQ ID NO: 42165 - DNA, 201 bp, Homo sapiens
catagctgatattttatgtctccctccttgcttttattcccttccccaaatcagctcataagcagaaattcacatttagagcagggtggtcttctgtggcrctattgacatcctatatatgccctgtcctgtaggtacaatgtgagctgtagccatcagttccggctgaagaggaaaaaaatgaaagagtttcaagaagcc

SEQ ID NO: 42166 - DNA, 201 bp, Homo sapiens
cattcaggtagaaaaagacaaaacaagaccccattattcagaagaaaatagctgcagcaggaatgaaatgtacagatagtccctgacttggcagtggtttracttaggatttcttgactatgatggtatgaaagtgatacacattcagtagaaagtgtatttcgcatacccatacagcaattctgtttgtttgtttgtttg

SEQ ID NO: 42167 - DNA, 201 bp, Homo sapiens
atgatacattttattgagccaagagtaaggtagaacagaacagcccagggcaatgaggatggggcaaggaggcaggagtagaaaacagcccccaaaagaarggcaagatgtcacgtgtatataacttacaattctataagtgaagagctatggttctgaaacttttgcttaactccttgccttaattttttatccctccaa

SEQ ID NO: 42168 - DNA, 201 bp, Homo sapiens
agattccatacttgaggaattcagcctcttgctttttctctgacccacagtggacactggaggaaaccttcccttccttcccttttctcttagctcccacyagcctaagggctgtggaaaccagtaccttttgtctgcacccagccccctctcctccctttggtggcttcctgtgtgtccagggctagcgtcttctaggtg

SEQ ID NO: 42169 - DNA, 201 bp, Homo sapiens
aggacctaccagaagatgaggacttacagtaactagccaatactacatttacttaacttctttataaactatcaaactggaaagttactcacaacttttgktctttcaaaattgttgccacctcttgctttgcttccattttgtcagcctgtgctgccagtggcttttagcttctctgggtcagttgttttacattattac

SEQ ID NO: 42170 - DNA, 201 bp, Homo sapiens
cccgccccttcctccagggcagcagggctgaggatcccattctggctgtgtccacgtccgggccatggctggagtctgggtttaggggaggaaggcatggyggcgcccgctaggatttccagttgtcctcttcttcctctgcctgtggctgctgggggttagcagacacggtttgttgtctgacatacgggctctctcctc

SEQ ID NO: 42171 - DNA, 201 bp, Homo sapiens
atatgtgctgctgttttctctggaagcctctttagggaatcgaggagcgcactggtgcaggggctgggtggagccatcctccgatggagcacaggcagatrgaagcccccaccccagctgcgtggcctgaagccagcctcccgctccccgaaggtggtctccacacagaactgggacagttccatccccgccccttcctcc

SEQ ID NO: 42172 - DNA, 201 bp, Homo sapiens
cccatattggtgtttctaagtaaaaatcaaaggatttgtttacttgaccttttattgtacctctttttctcttaagcctgaacatgtgtgctacattaacwtacttatctgctctatcctataatatacttaaaagttttgaaatcatagtaccaatattacttctaacaatagatctgattgaaattgcctttcctcttt

SEQ ID NO: 42173 - DNA, 201 bp, Homo sapiens
ctgagggtcgcgagggaaagatctcttcaggcccctttccttggcttataggggcgtgttctccttgggtatcatgacatcgcctgccttctgtgcatgtytgcatccacgtgtcccctttccaataaggatattagccctttaggctgggtcccgtcctagtagtctcatcttaactaattacatttgtgacagtcctat

SEQ ID NO: 42174 - DNA, 201 bp, Homo sapiens
agagaacagcctcatcttgtacttttggacagaaagataactgagagataggggagcgaaggtcagagagaccttgaggatacttttttttttttttttttgagacggagtcttgttctgtcaccaggctggagtgcaatggcatgatcttggctcaccgcaacctccgcttcctgggttcaagggattctcctgcctcag

SEQ ID NO: 42175 - DNA, 201 bp, Homo sapiens
tcacttgaatctaggaagcggaggctgcagtgagatgagattgcgccactgcactctggcctggcgacagagtaagatgccgtctcaaaaaaaaaaaaaaattggtgttttcttggtttgttttgtgttttagtttaaggagacacatttcctcatcttaaggacttttttgctgctctgatgctggtcatctagtccatt

SEQ ID NO: 42176 - DNA, 201 bp, Homo sapiens
atgactagaaagcactgggtagatagcataagcgctgctggtaaattggcttaaaactaaaataaatgtgggattgttgttattaaacagaacaaatatamacattaagaaacataatataattaacaaaaattgagaagttgtagagagaaaaaggaggtggaaggaagaagaaagctactaatttaattattagcaatt

SEQ ID NO: 42177 - DNA, 201 bp, Homo sapiens
aaacagagccaaaagtatataagcttaaactcgaatttagtaattaatgtcttagcattatatcttatttggaaatgacctagatattcaatgactatccrtaatttaatttagcttagcaaaattctaaaggtaaccattttttattactgtatgttaggtaaatatcataaaagtaagaaacttaaagttaaatacatg

SEQ ID NO: 42178 - DNA, 201 bp, Homo sapiens
ctggagccggccctcttgtgtgattgaattagtcagtgatggttctcaggactagattagattgttactcttaaaataattacttaaaaaaaaaaaaaaaacttccataacttgaaaattttgtggccaggtgtggtggctcacgcctgtaatcccagcactttgggaagccgaggtgggcggatcgcttgaggtcaggag

SEQ ID NO: 42179 - DNA, 201 bp, Homo sapiens
tggaggtcactgtgtaaaatctacgcttctaaataaatgttatgatatctcagcatactataccatacttataacatgtatgcttataacagcatactatwccatatagtatagttcccaagaaaagggaatgtttcttcccccctaaaaaaaggaaaattcccattatctaatatataaaacaaacttttttgatgattt

SEQ ID NO: 42180 - DNA, 201 bp, Homo sapiens; identical to SEQ ID NO: 11270

SEQ ID NO: 42181 - DNA, 201 bp, Homo sapiens
gcttaattgggaaaagtttcattagagtaacaaagtaaatttttctctgtctcacttaccagtgatgagatagccaacggccttggccttgatctcctgcrtcagctgctgggtttcattcagatagttcaagacatagatgttaggagcaaataggaccatgttctgttctccacagccatatggcatctggaggagatt

SEQ ID NO: 42182 - DNA, 201 bp, Homo sapiens
aaaatactaagacaaaagtaaaggttacctgattctacacctgtgagataacactattaataatccaactgtgcatttgtgagatttttttgtatatatakagagaggtcaagtatcctctatgtatgtaatgagcttctgagtatcacagtgtcttctattttttgtttgattgttcgcttttcaggataggagctggaa

SEQ ID NO: 42183 - DNA, 201 bp, Homo sapiens
actgcagcctctgcctcccaagttcaagcgattcttgtgcctcagcctcctgagtagctgggatgacaggcacgtgccatcacgcccagctaattttttttgtatttttaatagagatggggtttcgccatgttggtcaggctggtctcaaactcctggcctcaggtgatccgcctacttcagcctcccaaagtgctggga

SEQ ID NO: 42184 - DNA, 201 bp, Homo sapiens
aagcatgagccaccacactcagccctgttattgtcttttggaagctattgttgatagaaagtgagctttccttttttgtcttaaactttttttttttttttaaacaggatctggctctgttgcccaggctgcagtgcagtggcgtgatctcagctcactgcagcctctgcctcccaagttcaagcgattcttgtgcctcag

SEQ ID NO: 42185 - DNA, 201 bp, Homo sapiens
cacttgagcctgggacgttgaggctgcggtgaactgagatcccaccactgcactccagcctggtgacgacgtgatagcctgtctcaaaaaataataataawaaaaaaattcaggtagtactggaaacctcgaagattccaagattagtcagatccttaaaaggtataccttctggtagtctttttaattgggttaatcttg

SEQ ID NO: 42186 - DNA, 201 bp, Homo sapiens
ggaaattgaatttttgcaactttttgtacttttgtatttttcagaagttcttgtttttaaaatgtcaatgtaaaagcacacacacaataaatgtctccatsaactctttgtccacgactagagaaatggtttagtaaactatatttcttttccttggaaacatattcaatcattaaaattatgtttataaggattacatta

SEQ ID NO: 42187 - DNA, 201 bp, Homo sapiens
ggtgaagatcaagtgagataaggcacacttagcaaaatgcctggcacatggcacaaaattttgtattcctcttcagatgtttatttcataagtatatggamtcctactatcagtcagtttgaccagagaaacataaacactatgagtaacagagtatggtttacgatagagattatgaggatttatcatagggattagagt

SEQ ID NO: 42188 - DNA, 201 bp, Homo sapiens
tcacttgtggcttctaaaacttgttcatgtttcttctgtggtcaactgcaactcagaatcattcagggaaggaagctgggacacttagtttgaatttatcyaagtcgacagagtacaaagccatcacacttttgtattacttataaccctggctactttagtctgaaactaaaaacttggaggcaaaaaacacacagcata

SEQ ID NO: 42189 - DNA, 201 bp, Homo sapiens
aaaaagagctttcttttcttttttctttttaaaaattattcatctattcagaggggaggctgttttgcaatctgcacataattcttgcagctgctgcctgytgccctgactcactgcctccctgtttgcctctagggtggtgttgatgatgaggtctccttgactgcgtatgtcacagctgcattgctggagatgggaaag

SEQ ID NO: 42190 - DNA, 201 bp, Homo sapiens
ccatactccagtccaaccaggcagcttcaactttctccttccctggccccttgaacatttgcctaatccacacccacggcctatgaaagcacctaaaaccsggcacctcataggcactcaacaaatgttagtttacctaattaaaatgtctgtcttcatcaatagctgcctttttcgtcccatcatgaagcccattgtcaa

SEQ ID NO: 42191 - DNA, 201 bp, Homo sapiens
tggaaatgcttaaaaaagaaaatacaaattaccaaatatcagatatctccaagagaatcaaaattagcattttaggctttttcccacaagttctatttctytttatatttatcatttatattaatatgtttgagattgtgtgtgtatatgtgtacatgcacacatacactcaatatgtgcaaatgtgtatgtagttttaca

SEQ ID NO: 42192 - DNA, 201 bp, Homo sapiens
tttattaatagtaagaattgtaatatatgtgtattattaaaaatggaaatgcttaaaaaagaaaatacaaattaccaaatatcagatatctccaagagaaycaaaattagcattttaggctttttcccacaagttctatttctttttatatttatcatttatattaatatgtttgagattgtgtgtgtatatgtgtacatg

SEQ ID NO: 42193 - DNA, 201 bp, Homo sapiens
atctcccaggttcaagtgattctcctgcctcagcctcctgagtagctggggttacaggcacccaccaccatgctcagctaatttttgtattttttttttttagtagagacagagtttcaccatgttggccagcctggtcttgaactcctgacctcaggtgatctgtctgcctcggcctcccaaactgggattacaggtgtg

SEQ ID NO: 42194 - DNA, 201 bp, Homo sapiens
tttatgttttgcattgagaaaaatgttttatataatgatctatagttattcaatattattactgaattctataattttatacttaaaactggacttactayagaatgttgaaagcaaaatacaaaactattttttggtgagatctcaagtttgtaaaatatatatgccttcagaaaagagacttgaaaaattacagcaaaa

SEQ ID NO: 42195 - DNA, 201 bp, Homo sapiens
tccccccctccgttattaactctacagtgtgtattcaggttctattgggaaatcatagaaaggaagtagtgctaggatctgttgggattgcaccctgaggscttcagcttttgcttctctatcagcctttctgttcctttgtgccataggagttaagttcctttgatgccccccacaatggattatagctacggcctttgg

SEQ ID NO: 42196 - DNA, 201 bp, Homo sapiens
ggtaagggtcaaagattcttccctggccctcttccccatggatatgtagatcacccagcaccatttaatgaaaagatcactcttttctttttttttgagasgcagttttgctctcgttgcccaggctggagtgcaatggcacgatctcggctcactgcaacctccacctcctgggttcaggcgattctcctgcctcagcct

SEQ ID NO: 42197 - DNA, 201 bp, Homo sapiens
ctgtcgcccaggctggagtacagtggcacaatcttacctcactgcaacctccacctccctggttcaagcaattctcatgcctcagcctccgaaaaagctgrgactacaggtgtgcaccaccacacctcgctaatttttgtatttttagtagagattgggtttccccatgttggccaagctggaatcgaactcctggcctca

SEQ ID NO: 42198 - DNA, 201 bp, Homo sapiens
gggcttactgctcatttttactgataagaagataataaaaataataaagcattgacttaggtacaaggctccatttagaactaggttctttacaagcctcrcctctaattcatgcagcaatccttactcaaggtaggtgtttcttgcattatacagaagaggaaactgggtcttagagaggtttaggtctcttcccagggc

SEQ ID NO: 42199 - DNA, 201 bp, Homo sapiens
ggattacaggcatgagccattgcacccagccttttctatttttcatttcaagagtttgctttttaagaattaaaattgtgtaattatgacagtttttattrcagtactccaagctagagaaaagcatatataaattaatagttttcccttcttctcccacagttctgtctctgttgttaacactttgctgagtattcttct

SEQ ID NO: 42200 - DNA, 201 bp, Homo sapiens
ttatacaacatctcagattcagcatgctgtgcaggaggtggggagaaaagggtacaaaagaggaaaatgttcagtgaaggtgttattacaatggaggggawtatgaaagtggaaattgataccttttcctcttgggatttaattaagtctataaaattgaggtgttgcaatacataatgtctatgatttttttttaccagc

SEQ ID NO: 42201 - DNA, 201 bp, Homo sapiens
agaggaaaatgttcagtgaaggtgttattacaatggaggggattatgaaagtggaaattgataccttttcctcttgggatttaattaagtctataaaattraggtgttgcaatacataatgtctatgatttttttttaccagctctaaatctctgagatggctgtgttttagagctgcatgttctgcttatttactgcctg

SEQ ID NO: 42202 - DNA, 201 bp, Homo sapiens
tattgagtggctactgtgtcgggcatggtgccacttgctggagatacagcgttgaacaagacagacccaatggggctgcctgggtggagcttatgtttcakactgggaagagagtcaacgaacatccacacatatttcagttgtgagaggtgccatgagggaagagacagactggctggggaaagcgtgatcaggcagtct

SEQ ID NO: 42203 - DNA, 201 bp, Homo sapiens
gactgggagactgagtggggagtgacagaccatgaccttaattactgaccttttgttatagattaacttccttcctattttattgttcctggcccagaccwgatagcacttgagataaaagatcccttgattattacatccttaatgtggaatgttaaatactcccttcccccaaggaatcactgcctaaaaccagtcaga

SEQ ID NO: 42204 - DNA, 201 bp, Homo sapiens
caggcgtggtggcacgtacctatagtcccagctactcgggaggccgaggcaggagaattgctgaacccaggaggcggatgttgcagtgagccaagatggcrccactgctctccagcctgagcgacaaagccagactccctctaaaaaaaaaaaaaaaattattattatttagttttatcttctctatctgttaatgagaga

SEQ ID NO: 42205 - DNA, 201 bp, Homo sapiens
tcaccatcagccaaagtgtgctggtcaccaacttgaaaccagcaaccatcaaggtctatgactactacctaccaggtgagagggctgagctgaaatgagakctgagatcttacctgcatctcccaacttacttctgcctcattcttcatggcttctctcttaattttacaaatactccttcccaagccaagtagcacataa

SEQ ID NO: 42206 - DNA, 201 bp, Homo sapiens
agacctcctcctcctccttacaactgtagatatggaagccagcctttgcaaagtactcagcatattactaaacacttgtctatggaagttcctcagagtcragaaatgctgtcatctgaaataaggaccagctttcaacagcagtggcaaaaccctaatgaaaatgtcagcacaattggaaatttcactaacttgaaagta

SEQ ID NO: 42207 - DNA, 201 bp, Homo sapiens
ttaaaaatagtcagcttccaaattctgtattaactttaccatcaaggcagacctcagctgtaccatcacagcagtatgccacgcaaactgacaaaagaccwcctcctcctccttacaactgtagatatggaagccagcctttgcaaagtactcagcatattactaaacacttgtctatggaagttcctcagagtcgagaaa

SEQ ID NO: 42208 - DNA, 201 bp, Homo sapiens
gatcccttctaattctacacgacttcctgtagcttaccaaggaaatcagggacttaaccagtctttttcagagcaacaggttgattggacacaacagtgtrtatctaagggactgacttacccagattacagaccacctccaaagctataccgttactcaccacaaagctttttaccagattctaccattcaaaaacaaaa

SEQ ID NO: 42209 - DNA, 201 bp, Homo sapiens
caatcaagtacttattaaatatttataaggcatcaaatcctatgttacatgctgcatggaaagaaacagactaaagaaaatttgggtttttttttttttttaattatttttatcttttggttttccttgagaccggatctcactctgtcacccaggctgaagtgcagtggcatgaccacagctcactgcagtctcaacctc

SEQ ID NO: 42210 - DNA, 201 bp, Homo sapiens
tgtagtcaaacctttggattttttttcctatcccacttaaaacaattatttaactctctacatttaggcaagattaaattgtatataaattccctcttatkaatccacccccatgactcacacagaccatctacaacatgcccaagccctctgacttgtccttagccagtcgagtagggaaggaaagaattcagcataagg

SEQ ID NO: 42211 - DNA, 201 bp, Homo sapiens
ggcaccggctcagcaaggaaaaaaggttaaccgtggctccaccaggtaaacattttttccttgggtgcatgtgatgcaaatgattagttgaatagactctycccttccttccggtcactcaggctcacccagctgcagagtatacctttgatgatgtgtaaattcctataagtcaagtaaaaacttccttacacttagctt

SEQ ID NO: 42212 - DNA, 201 bp, Homo sapiens
taatatctcgggtcccacacatatgatcattcacaattatcatatcgggctgagcagggtggctcacgcttgtaatcccagcactttggaaggccgaggtrgacagatcacatgagtttgggcccagcctggccaacgtagcaaaaccccatctctactaacaataaaaaaattagccaggcgtggtggcacgtacctata

SEQ ID NO: 42213 - DNA, 201 bp, Homo sapiens
gctaaaatcaaaaagataggtaaatatttaaggaatcattgtagtattcccaacagttttatagatgaaattttaagttctctgggttataacttgctttstgatgccattataaacctgacggctgagacactggtcgatcacccattaggaatatatgctaaaattgttgctttcagtttttaaaatatggcttaattt

SEQ ID NO: 42214 - DNA, 201 bp, Homo sapiens
tctgagtcttctacttcctgctttccctattcagtctcccatttccttctccagccccatccctggtactagcaagtccctccctgatgtcttcaccatcygttcctttcagacacctgccacccttcacattagcaaaatgacaaaaaataagaataaataaggtgagtatagtagattgcatagtggcccccaaaagat

SEQ ID NO: 42215 - DNA, 201 bp, Homo sapiens
ggcattaccgcttgaccagggagccctcaagtggcccttatgtgggcgtaagagagggctcacctcttgccttcttggtcacttctcacaatgtcccttcrgcacctgaccctatacccgccgttattccttggttatattagtaacacaacaaagagtaatattaaaagttaatgattaataatgtccacgatcatctct

SEQ ID NO: 42216 - DNA, 201 bp, Homo sapiens
aaattctgtttagacgttgagttaaactttctcaactgtattcagtacaggattaagtggttgagatgggccattctgcagttacactgtttccgttccartctgggtctcctcatgtattagctgtgtggaccttgggcaggtaactcctttgtgcctcaaagaaatggagatgacgataatacctacctcagtggggtt

SEQ ID NO: 42217 - DNA, 201 bp, Homo sapiens
ttgggctggctctccatggtttacgaaggagtacctcagtgtcagtgtaattccatcaagaactcatcttcagaggaagagaaacaaaaagagcagtgttstcctttggataccaacagttgtaaacaaggagagagaacttctgatagagatgtcactgttgttcaatttaagagccttgtaaataatccaaagactcct

SEQ ID NO: 42218 - DNA, 201 bp, Homo sapiens
atgcaatgactgttcaaaggttggtttcacccatagccatgagtgtcatagtcccaggaagatgggttgaattcagggccactctaggaattttgcttgcrgtttcataagcatagactattccagactccacatcctttttacctacaatgagtcccaaggcaaacagaacactgtgaagtgggagaccagaattaatct

SEQ ID NO: 42219 - DNA, 201 bp, Homo sapiens
gagtttatttgggacaagaactcaggtgtgtcaactagttttgattatagaaagggggagccagtatagacaaattcagaatccagtgtctacaatatcaygagtccaagaaattctctaaattatgttctggtaattggccaggtaaaatcataaagagcttcctttctctgaaggaaaagagattttcccttttgcatg

SEQ ID NO: 42220 - DNA, 201 bp, Homo sapiens
tctgccataggatccaatatttaattctatttaccgcacaacattgagctcatattcaaataaaaagaacaaagaagaaataaatacacaggccccaaaawtctcttggaactatgagcccaggtcatctgtgagaaccttgagtagtaaaaacaaatcatatccagaggcttataccaaagacaataaaggtaacgaagg

SEQ ID NO: 42221 - DNA, 201 bp, Homo sapiens
aatagcaacaggattgcacagtggctggaagtggtacctgagcaaggcattgtagacctgtccttccaactggcaccagaggcaatgctgggcacctacaytgtggcagtggctgagggcaagacctttggtactttcagtgtggaggaatatggtaggtggggaaatggacaggccaaagtattgggcataatctcatct

SEQ ID NO: 42222 - DNA, 201 bp, Homo sapiens
ggagtgacatgatttgtttcatgtgtgtaagtaattctagatgtagtacagaggacggataaaaaaataagactgcaggcaagcagattccttaaaattgyattcctatagttttgtcaaaatactattgagggccataactagataaggataaagaggacagatctaggaaaccaaggcagatttttaaggagggaaaag

SEQ ID NO: 42223 - DNA, 201 bp, Homo sapiens
accatgcatgcctttttaaattttatttttattttagtatcttcatttcctcaacctcccaggctcaggtgatcctctcacttcagcctccgacgtagctwggactacaggcatgtaccgccacgtctggtgagttttttgtttgtattttttgtagagatgggtttccccatgttgcccaggctggtttcaagctcctgg

SEQ ID NO: 42224 - DNA, 201 bp, Homo sapiens
gctggagtgcaatggtgcgatcttggctcactgcaacctctgccttctgggttcaagctattcttctgcctcagcctcccgagtagctggaactacaggckcctgccatcatgtctggctaatttttatatttttagtagagatggggtttcaccatgttggccaggctggtctcgaactcctgaccttgtgccgcccacc

SEQ ID NO: 42225 - DNA, 201 bp, Homo sapiens
taaaatgctctgggttcgggagtgtcttcctggagatcactaagggcttcaggactccttgagatggagttttcttttctctctctctcttttttttttttagtattttaaaatgtatttcgttaattagcagcagtatgccaaagttgttccattattatattttgttcattcttttgtacaagtgtcttccaatgtgat

SEQ ID NO: 42226 - DNA, 201 bp, Homo sapiens
taattataccactatactgtcattaataatggataaatgtacttcaaagtaatttattagtttgtctgtgaatatgtctttccttgtctcttttccccctyacctagaatgtaaacaagagagaagagaactccagatctgattttcatggaggaaggtgatacagatcattatggctgtaaggggaggattcttgtgttt

SEQ ID NO: 42227 - DNA, 201 bp, Homo sapiens
tcccttactgtctgcctaaagcaagctggctaacttcttacacctgtgtattatacagcaccagtctttagggaaaggaacttcaggtgggtagggtagastatagcaatagctggcaagaaaaaaaagatttgaagaaacaaactctgtggtgccctagggagcagatgtgggatggaaaagtgaggctgggccttaaat

SEQ ID NO: 42228 - DNA, 201 bp, Homo sapiens
ggcaggagagtttccctgaggtgataggaaccaaggtctgatgagagtaggctgaagagcaaatgtggagaaacagagatggcaagaatcaacagttcatrtcaggattttgctgtgaaaggcagcagagggatggggtaccattattttcattttgttttgttgttggtttctgctgcagtggtagtttatgttgagatg

SEQ ID NO: 42229 - DNA, 201 bp, Homo sapiens
ctcctagagcagtcacctagaatcctagagaaaaatgtctttccaaaaggaagaaatgcagaactgtgtgagtaaaatgaagctaagaattaattactggrtttggcaagatggaggttgctgatgacttggcaggagagtttccctgaggtgataggaaccaaggtctgatgagagtaggctgaagagcaaatgtggaga

SEQ ID NO: 42230 - DNA, 201 bp, Homo sapiens
tgtgagatggacataaacatagtactgtgctgtcatgttgtaaaatgggacctctcattgagaagctgggttggtttgggggtggggagtatgacatcaakagttctgttttgatcatgtttagttcaagatgcctgttatggtcaggcaccgtggctcacacctgtaatctagaactttgggagactgaggtgggtggat

SEQ ID NO: 42231 - DNA, 201 bp, Homo sapiens
gggggttgaggctgcagtgagctgtgatggtgtcgatgaactctatcctgcagtacagagtgagaccttgtctcaaaaaaaatcatctttacagttatttkattatttgcagattttcagtgtttattgtttttactttccttgccccactattctgcattcatcaaatattcattgaacactgtctttttgccagagact

SEQ ID NO: 42232 - DNA, 201 bp, Homo sapiens
catggtgccgtgtgcctatagtctcaactactttggaggctaaggcaggaggaatgcttgagcctggggggttgaggctgcagtgagctgtgatggtgtcratgaactctatcctgcagtacagagtgagaccttgtctcaaaaaaaatcatctttacagttattttattatttgcagattttcagtgtttattgttttta

SEQ ID NO: 42233 - DNA, 201 bp, Homo sapiens
gcttgggaggctgaggcgggaggatcacttgtgactgggagtttgagaacagcctggggaacatagtgagaacccatcaggaaaaaaaaaaaaaaaaaaargttgattaaaaaaagaaaaacaaaagaggccaggcacggtggctcacacttgtaatcccagcattttgggtggccaaggtgggaggatcgcttgaggcca

SEQ ID NO: 42234 - DNA, 201 bp, Homo sapiens
aagaatcaggaagatctcaaactaaatgaaaaggccaacactaagatgacaaagacattagaattatctgaccaagattttaaagcagccacgacaaaaatgcttcagtgagcaattatgaacatgtttgaaataaatgaaaacataggcttggcaaagaaataggaagcctcagtaaaaataagatagaaaactataagg

SEQ ID NO: 42235 - DNA, 201 bp, Homo sapiens
cgcttacaggataattctatctacattgtgctaccataatgggcggggagggtgttaattttttttttttatcaagatagggtttcactgcattgcccacrctggtctcaaactcctagcctcaagcagtcttcccaccttggcctcccaagtgctaggattgagtgtgagccactgcacctgacctataattctggtttt

SEQ ID NO: 42236 - DNA, 201 bp, Homo sapiens
ttgcaaataaaaaaacctaaatataactaaaaagtatccagatgaataggcagaggttagatctagccctgactcacatactgagcttttgtgtgatcctyacaagagactttaacctttttattggcttcatttttctctgctgaaaaatggagaggcaaggctacataattactaagattatgaatagatacagagttt

SEQ ID NO: 42237 - DNA, 201 bp, Homo sapiens
acatctagctgcaagagagacttgggggaatataatctctacttacattccaagtgactacatacaaactgactttgtacccagctaaccattactaacawgaaggggaaagaaacaaaaaagaaggggaggcctggcgtggtggctcatgcctgtaatcccagaactttgggaggctgaggcaagcagatcacttgaggt

SEQ ID NO: 42238 - DNA, 201 bp, Homo sapiens
tgatccctcattccctgaaaagagaggagtctttgtcaaaggtggaaattctatgtatcctagacatagcataatttgatgtgaatggaagctggaaaaaygagatcacttggagacagttttatgggttttgtggcgaaggaccaattttgaaattgagacagtattgcttcattcttagagaaactgagcaggaattgt

SEQ ID NO: 42239 - DNA, 201 bp, Homo sapiens
ctatgaggggaatctttcccaagcctgaccagttgacaaggctttctggcacactaggttgtaaatctcttagagagaagacagtgtaaagcttggctctygagtaaacaaactttcaggtccatgagattgcattctccctttgcaagtttcttactggtgaccatttaagactactctattgatgaatatcacttgtac

SEQ ID NO: 42240 - DNA, 201 bp, Homo sapiens
tgatactctgtctcaaaaaaaaaaaaaaaaaaaaaaaaaaggaaaaaggatgaaatcacaacttggagcaaaaaaacccaaaggcatatttaaagatttgygtattgggttaaaacaagttttaacatctggaaagaaaaagcatccatcaacttttcttatcaagaaatatgaattatagccaggtccagtggtgtgtgc

SEQ ID NO: 42241 - DNA, 201 bp, Homo sapiens
tacaaaaaagctccgttcagtgggaagtgggaataggggtgggctcaggtggtggtacttacacaacagcagtaataacagaaaaggggaccatattgttrgaggctggtcaacagaatctctttgtaggaatctaatttaaccaaataatctgaaatgcagataaaactttatgcattaagatattcattataataatat

SEQ ID NO: 42242 - DNA, 201 bp, Homo sapiens
ttaattggagttacctccaattgcctacttcttattctattcctatcaaaaacccagctgacaggtacacaaggggcatagcccaaattacatgtaatccrtaaatctctccattttttcttaagtcttagttttctcttgatataggattttttttttttttttttgagatggagtctcactctgtcgccaggctggagt

SEQ ID NO: 42243 - DNA, 201 bp, Homo sapiens
ttgggggagaaagagaaatatatgatgatgatactggtcaatgttccctattcttcagtttttaaaatattttttaaaattcaagttcaaactaatatatrtgctaaaataaatatgaaactaagcacatagtttgtattagcatctaatatcatgatgactttattttactttttctactttattttttcattctccata

SEQ ID NO: 42244 - DNA, 201 bp, Homo sapiens
tgggcaacgtgaggaccgtgtgcacacgcatgcaggtggtttatggagaagaatgtgaccaatgagtcgagtattcttgatggccagttggatggatcctytgaaagctgcaatccccattgtgtgtagcagctgcagctgagccaagaacagccaaggttgaggatggggcagggaatccacagatgcttttctgtgtga

SEQ ID NO: 42245 - DNA, 201 bp, Homo sapiens
actgtatgccattctgcatttctttgtttattagtaatacattcagttcaggctaggtagtaatcatatctgggttggatgttgccccaataaaaaaaaaattaaatttttttcttcctgaaaaggaaagtaatttgtgatcagataacacagaaaacaacaaaacaaaaatcatacataaactcaccaggagggtgtgta

SEQ ID NO: 42246 - DNA, 201 bp, Homo sapiens
ctcgttatctttggatatgcccaaatatagcaatatgacttgtgaagacagagaaaggatctaatgaagtggaagttagtgttgagtactaagaagaagaygagacagttttcaggataccaggacctcctcatttccctccaacgtgaacaactgttaaaaacagagctactctctggttccttctttctgagacagggt

SEQ ID NO: 42247 - DNA, 201 bp, Homo sapiens
ctggcagagtcatcctttagtggaggggtgatgttggaaacagagatagccaaaagtagcttcatccatcaaacccctgtaagaacatttttggaagctayattcaatcattcactccgtattttgatatgaaagctatagaagagacgcagacgtcctctaactcctacaccaatgcagtgatcattgacaggtccacaa

SEQ ID NO: 42248 - DNA, 201 bp, Homo sapiens
aatgtggatatataattagttactataatttttttctcaaaatatctcagatttggccattggaagccccttcagacaggctcctgtctccttttgacatrtcctcatcatcttttaaatgcatgttgtaactctggcatcacaagatgtgtctggcttattttgctccagccctagaatcagtaacttctccaaagaccc

SEQ ID NO: 42249 - DNA, 201 bp, Homo sapiens
agtgcctgacatagtacagtgctttgtaaatacttgccgagtgaatgaacaacaaatgaatgaatgaattttagtattattttgcagtttcaaatcaaaastattttgtctaatgtccctgggtgacctagtacacgttctgccacagtttttgagatgaaagaacgaaaattctgtgatcaaagagaacattttaaagat

SEQ ID NO: 42250 - DNA, 201 bp, Homo sapiens
attaatgagcctatgcaattgcgcattttacttaggtctatcctaaagaggaagaggttaagataattattcagaacttttcaggaagattgtcttagaawtgaaaatgttggaggaaccacattccctcccctccagcaaatggaggaaagtaaagttacttacttcactgccaccaactcccagatccaagtctcagga

SEQ ID NO: 42251 - DNA, 201 bp, Homo sapiens
aagtccagcatcttcagacaggcagaaggcccctgccttccactcggtgatggtgtcagggactgttactcctacctcagccacacctgatgagctggggrggagggcaagtgaagaacagaaataatgaatgtaagccaccttttctcaagtgagaattaatatgcataaagctaacgtcaagaactgaatccacttaag

SEQ ID NO: 42252 - DNA, 201 bp, Homo sapiens
cccattgagtaggggaaaagaggaagtgcccttttagcagtaagggtaaaagggagttgtggcagtctacaaatcatttctgtaaggtagctctgcttttyctcttttccattctttttttttttttttttttgagacgcagttttgcgcttgtcccgcaggctggagtgcagtggcgcaatctcggctcactgcaacctc

SEQ ID NO: 42253 - DNA, 201 bp, Homo sapiens
ctaaattacaaacccattgagtaggggaaaagaggaagtgcccttttagcagtaagggtaaaagggagttgtggcagtctacaaatcatttctgtaaggtrgctctgctttttctcttttccattctttttttttttttttttttgagacgcagttttgcgcttgtcccgcaggctggagtgcagtggcgcaatctcggct

SEQ ID NO: 42254 - DNA, 201 bp, Homo sapiens
tcatggaagaattcccattctgccactgagcctctctgttagggacttgaaaatggaaggtagtgcagttctttctgaccatctgccaggcaaggagcccmgggcttctaggggtaagttcgtcccttttcccaagtctttcactttgcactcttcattcagagttaaatggcataaaactcggattttcaaagccagttg

SEQ ID NO: 42255 - DNA, 201 bp, Homo sapiens
gattcctccagtacaatctatcttatttgttcaaatgacaccatcagctatgaaactatctgtgaattttgcctctattctcataggcatcatatcactcrgcactatgttttaaaggaagaaaggtaatactatctgctttctaattgattaatagttacagctgagaacagaccccatacaatctcatccttaaccatg

SEQ ID NO: 42256 - DNA, 201 bp, Homo sapiens
tcagtactttggtcataccagccacatttcaaaagctcagtagccatgtgtggcaactgggcatattggcaacacagatacgtcatcgcagaaagttccaytgggcactgctagcctatgctcttgccttaactttttcaacactatgccatgccatgcacctattgatttgtttatgttccactagaatacatgctctgg

SEQ ID NO: 42257 - DNA, 201 bp, Homo sapiens
aacatagtagtcactagccatatatgacaattaaaattaattaaatgacaaaataaaaaattcagtactttggtcataccagccacatttcaaaagctcartagccatgtgtggcaactgggcatattggcaacacagatacgtcatcgcagaaagttccactgggcactgctagcctatgctcttgccttaactttttca

SEQ ID NO: 42258 - DNA, 201 bp, Homo sapiens
ctgtgagctcttcttttctaattgaatctactctctaagactctttgctgctggaatatgcagcagtagtttgagagacacttctcagtcagttctaacaygtttagctaggttcttcctattttttgtgcttcatcagatcatttgggctcagtgttttctttctttttatttttttctttttttttgagacagtatctc

SEQ ID NO: 42259 - DNA, 201 bp, Homo sapiens
ttaggaatttgttctaggggtgcctagaaccctgaaaaaattgagccacttagtagtgtcccttcaactgagaatatttgggaatctctttcccaaattarttaactcagaatggagatggaatctctatgtctttgtttttaaaaagctccccaagtgattctaatgggttcgtaaggttgagaaccactgcttgagaga

SEQ ID NO: 42260 - DNA, 201 bp, Homo sapiens
tagtcagaaaatgtgtgcctttaagttttgcttctgaatagacatattctgctaagcaagcaatctcctcttagactgcttgctgagcacatatactttcygtatgctgatttttaaagtgtctgtatttggttggtggctttagtaataagagactagcttttaacacagccagaagaagctgatgtgaaccagcagaaa

SEQ ID NO: 42261 - DNA, 201 bp, Homo sapiens
ttaatactaaaagcctcttgatctgtttcctatatcctagtcacaactgaattttaagaaagtcgaggtcatgttggtaactccatgtcaatactgctttktgtactaactgcaagatcaggaatcgtccctcattacttccatcttggctttcaaaagagcctactgtaattttttcttctgaaatagtatgaaataact

SEQ ID NO: 42262 - DNA, 201 bp, Homo sapiens
gtggtgctacttagaagctgagaggttatgaaccttatatgcaaccatagggaatagtgttgttactataaataatgattgtactgaaccttatatgcaayagtgaataatgttattataaataatgattgtactgaaccttatatgcaacatagggaataatgttattataaataatgattttcagactgaggcagtttt

SEQ ID NO: 42263 - DNA, 201 bp, Homo sapiens
tgcctcagtacccctttcaacagtgggtagattatccagacagaaaatcaatgaggaaacagtggcctgaataacattatagaccaagtggacctaacagrcatacacagaccatctcatccaatagcagcagaatacacgtttttctcaaggacgcttggaacattcacaagggctagattatatgttgggccacaaaac

SEQ ID NO: 42264 - DNA, 201 bp, Homo sapiens
tatttggcaggggaagcagagactctgccatcttcaagccactggtagagcccctttcacatgacctgggaggtaatttcacaagcaaagaagtctaaagraaaggttgtacctaatttaaattattgcttttgtcatattctctaccactcacaggaatgttttattattaatcacaaatcataagcaatttatactctt

SEQ ID NO: 42265 - DNA, 201 bp, Homo sapiens
aaatttttgttctctatttgtcttttaatttgaggattctttaaatgtaaaaatctatagtttgtaaaatctccttaccatctttttttttttttttttgrgtcattttcactcttgttgcccaggctgcagtgcaatggcacaattttggctcaccgcaacttccacctcctgggttcaagcaattctcttaccttagcc

SEQ ID NO: 42266 - DNA, 201 bp, Homo sapiens
gggtttccccatgttggtcaggctggtctcgaactcccgacctcaggtgatctgcccgcctcagcctcccgaagtgctgggatcacaggcatgagccacckcgcctagcctgttttttgtttttttgagacagggtcttgctctgtcacccaggctggagtgcagttttgcagtggcatgatcccggctcactgcagcctt

SEQ ID NO: 42267 - DNA, 201 bp, Homo sapiens
aaaggcacatagagaaaaagcatacagatttattaacgtgcacacgtgagaatcacagaatgattgcccagtatcccaatggggcccaaatacttacatawtcttatttcagaggggaagaggagatagggaatattggtattctgctgagtaataattgattactgtggagaatgaatggatgagggaacagagactgat

SEQ ID NO: 42268 - DNA, 201 bp, Homo sapiens
agtacaatggcatgatctcagctcactgcaacctctgcaaaacacaaaaattagctgggtatggtggcatgcacctgtagtcccagctactcgggaggctraggcaggagaatcgcttgaacctgggaggcagaagttgcaatgagccaagatcacaccactgcactccagcctggcgacagagcgagactccatcttaaa

SEQ ID NO: 42269 - DNA, 201 bp, Homo sapiens
cccaggaggtggaggttgcagtgaaccgagattgcgccactgaactccagactgggcgacagagcgagactccatctcaaaagaaaaaaaaaggcacatakagaaaaagcatacagatttattaacgtgcacacgtgagaatcacagaatgattgcccagtatcccaatggggcccaaatacttacataatcttatttcag

SEQ ID NO: 42270 - DNA, 201 bp, Homo sapiens
aggctttcagctgcacactgacctatcaccccatgtgaggcagagacagaaatgatcagaatatggaacgacatgaacacatagaattggggccaagtgtragatgctgcagtaaattgggatttgtaagaaaaatgtatgtcacatagattcatccatgctttaagaagcatggcaatggcaatgatacaaatcaagatt

SEQ ID NO: 42271 - DNA, 201 bp, Homo sapiens
caccccatgtgaggcagagacagaaatgatcagaatatggaacgacatgaacacatagaattggggccaagtgtgagatgctgcagtaaattgggatttgkaagaaaaatgtatgtcacatagattcatccatgctttaagaagcatggcaatggcaatgatacaaatcaagattggttgtgtattaggaggatttggcat

SEQ ID NO: 42272 - DNA, 201 bp, Homo sapiens
gcaggaaattccattagtcttacaggatgtattgtgtgagcatgatattaatggttctttgttgtctcaagagtgaccgcccggtgttgcattcttacagktgttagggactcccaaaaatatgttacctccaccaacagggttttgatgactgtgtcttttcttttaatctcagggacctcaacaacctcatttccacag

SEQ ID NO: 42273 - DNA, 201 bp, Homo sapiens
atctcctgacctcgtgatccgcccgccttggcctcccaaagtgctgggattacaggcgtgagccaccgcgcccggcccctgttgcatatgttaacaccccwttcccaacaaatcgaacagtgggcacagactaggagggtactggaagaccacatgctcaaggatgctgatcttggagggggcagggtgcgtgtgaggaat

SEQ ID NO: 42274 - DNA, 201 bp, Homo sapiens
gatgattctgatacgtgctcttggttaagaatcactgctctggttttcttcccagtgcctcttacccaccactgttagatcagttctttaaacaccacttmaactcccacttttgtcagcaacctcctcttgacagtcaagctccttagtctggcatgtagcactcaccattacttggtgtgagtcctgaattctgagcag

SEQ ID NO: 42275 - DNA, 201 bp, Homo sapiens
gggacagacgtttctctggaggtaagcatggacggaggaccagcttcctagaaaggaaggcttccctgaaggaaaacttcagaattttcctgtttcctatyctcccctctgcttggaattacatctttctcactcacaagtcctgctctcccgttgacaaaaagttttccttagatgctttctgtttttaatatcaatcaa

SEQ ID NO: 42276 - DNA, 201 bp, Homo sapiens
gcaatttggtgatttctcaaagatcttaaaatggaattaccatctgacccagaaatcccattattgggtatatacccaaaggaatataaatcattctaccrtaaaggcacatacatgcagttcattgcagcattattcacaatagctaagccatggaatcaatctaaatgcccaccaatggtagactggataaagaaaaca

SEQ ID NO: 42277 - DNA, 201 bp, Homo sapiens
cagagttctctcactctcattatgatgaagaaaaaatgttttcttaatgacgattatatattatcaggaaaaaagggctatttccattaataaataaatayacccaaatcagccaagttaacacttgtgttccttcctatttctctctgcagtcactgactgccacctcaaagagaaacagcagtctcatctcagccgctg

SEQ ID NO: 42278 - DNA, 201 bp, Homo sapiens
ccttgatcaagtttgccgaagaaggaatcatatgcctcccctttgtttagtttactatcagattgatgggaattctagatgcccttactcttattactgtsattccctaacagcctgttcaggaatgcctccaagctgtatcttggatcgagttaaattcagcaactccttactacaaagcaacactcggaaatagaccta

SEQ ID NO: 42279 - DNA, 201 bp, Homo sapiens
tggccaacatggtgaaaccccatctctactagaaatacaaaaattagccaggcgtggtggtgcgcacctgtaatccgagctacttgggaggctgaggcatragaatctcttgaacccgggaggtggagattgcagtgagctgagatcacaccatggcactccagtctgggcaacacagctagactcagtctcaaaaaaaaa

SEQ ID NO: 42280 - DNA, 201 bp, Homo sapiens
tggacatgtaggttgtttctactttttggttattatgagtaatgctccagtgaacttcacatgtaagtctctgtgtggacatatgttttcatttcttttcrgtaggtacctaggagcggaattggtggttcattttatgttttttgagaaattgtcaaactattttccaaagtggccacaccattttatatttctagcagt

SEQ ID NO: 42281 - DNA, 201 bp, Homo sapiens
cccgtgcctgacactgccctaattagctgacactgctctgctttgctgaagcacagggaggtctctcgagaaagatccagaagggaccatgataaatcggrcaaaatattccttgagagcctgaggttcacatgagagctcagaggaattacaataaagatggattaggaaaatggaatattaggaggggaaagactagag

SEQ ID NO: 42282 - DNA, 201 bp, Homo sapiens
agtgatgctgtctgaagtcaaatcctcttccacctctatgggaatccatttccatatctataaaatgggtatcatctttcttcaaaatatggctttgaggrataaataagaaaaacagtacgatatgcctagcagagtgcctggctaatggtaattcatcaatagaggttagctattatacttccaatccttattcttcaa

SEQ ID NO: 42283 - DNA, 201 bp, Homo sapiens
cagtgtgctgatggttggaggtggtaatacagtttcttggttaaggtgtggtctttggaatttgactgcctgtttaggtcctggctccccactattagctktgagaccctgggcaaattacttaacttttctgtggctcaggttccagatgtaaaatgaaatttttaaaaaagcaacacctttaagttttcttaagaatta

SEQ ID NO: 42284 - DNA, 201 bp, Homo sapiens
ggcgggcggatcatgaggtcaggatatcgagaccatcctggtgaacacggtgaaaccccgtctctactaaaaatacaaaaaaattagccgggcgtggtggygggcgcctgtagtcccagctactcgggaggctgaggcaggagaatggcgtgaacccgggaggcggagcttgcagtgagccgagatcacgtcactgtactc

SEQ ID NO: 42285 - DNA, 201 bp, Homo sapiens
gcggatcatgaggtcaggatatcgagaccatcctggtgaacacggtgaaaccccgtctctactaaaaatacaaaaaaattagccgggcgtggtggcgggcrcctgtagtcccagctactcgggaggctgaggcaggagaatggcgtgaacccgggaggcggagcttgcagtgagccgagatcacgtcactgtactccagcc

SEQ ID NO: 42286 - DNA, 201 bp, Homo sapiens
ccgtctctactaaaaatacaaaaaaattagccgggcgtggtggcgggcgcctgtagtcccagctactcgggaggctgaggcaggagaatggcgtgaacccrggaggcggagcttgcagtgagccgagatcacgtcactgtactccagcctgggcgacagagcgagactccatctcaaaaaaaaaaaaaagaatagcagcta

SEQ ID NO: 42287 - DNA, 201 bp, Homo sapiens
cctcccaaagtgctgggattacaggcgtgagccactgtgcctggcctacattatgttatttaatattctctctctctctctttccactgcccaccaccccmctgcccgcccccaagggattggtcattgccattttacaaatcgggaattaagaccctgagagcttaagtagccaacataaagaacatagccaaaaggagt

SEQ ID NO: 42288 - DNA, 201 bp, Homo sapiens
tataattaagtccagagtcttattttcagagataagtacttgatccctacttttgtgtgtcaatttgaatttaattttttaatgcatgtcttttaatactrccctttattatagatgcagacgttaatgaagaatccagtcccatttgtacaaatgccaaggagtttaccctctattgaagggatgaaatgttggtagagc

SEQ ID NO: 42289 - DNA, 201 bp, Homo sapiens
ccaggctgcctggcagggcaccacggagggctggggaaatgggaatatagatgccatgatgatcatattaatgagggtaaaaattaggaccaacaggggaygtcccctctgcacatgtgtacaagtgtgtgcctttcacagacaatagaggctgaagtcagggaggcagcatgcacaggcaggcctggctcagacaggggc

SEQ ID NO: 42290 - DNA, 201 bp, Homo sapiens
tgatcccagcccacctggacatatctagcaattctgcagaccagcacatacttctggaaagatgttgcatggtgatttatagatctgtgtggacacataamacctttacaatggagtgaggtcttgaaatagccctgctgttgctgcccattgagagataagtattctcctgaggtattccccaacagctggaaatgaagt

SEQ ID NO: 42291 - DNA, 201 bp, Homo sapiens
tgaggcaggagaatggcgtgaacctgggaggcagaggttgcagtgagccaagatcatgccactgcgctccagcctgggtgaaacagcaagactccgtctcaaaaaaaaaaaaaaaaaaaaaaaaatctgcctttctttacctacaactgtcttggtaaattcttttaccaccatcccaccagcctggatagatgccgctca

SEQ ID NO: 42292 - DNA, 201 bp, Homo sapiens
cctcctgctttatcctgtatccaattaaaatgatccctcgtcagtttttcctctgattcaaacattttaccccacattgtttctgcaattagacagaaaartaagcatctgtgaagtcaacctttttgctttttttactctgaagtgctgctttttttttcagtaagttgtggttttaaaaaaatccagttatttgaatga

SEQ ID NO: 42293 - DNA, 201 bp, Homo sapiens
ctctttgtactctttctctttatttctcagaccagccgacacttaggaaaaatagaaagaacctacattgaaatattgggggcaggttcctctgataattrcatatggacattttggttatctggagggaaaaaaacaaacccttatactttataatattctaaaatgtgggccaggcatggtggctcacacctgtaatcc

SEQ ID NO: 42294 - DNA, 201 bp, Homo sapiens
cttttggtttcctacacagtttcctctcttgtccttccccctccattagctctctacaccaatgtagcatatattctttcttatttttctctgttcttgtmcacacacacacacacacacacacacacacacacacatttaaaggcttgtgtgggggaggggtcattgtttcctaaaacggcaccacagtacacttacttt

SEQ ID NO: 42295 - DNA, 201 bp, Homo sapiens
tgttcagaagtcactgctgctgctacttctacaaggcaaacaaaggagagcccccatccctcagaacctgtttgctgggatccacctcaggcagcagaacrgggacatggaccaggctgcctggcagggcaccacggagggctggggaaatgggaatatagatgccatgatgatcatattaatgagggtaaaaattaggac

SEQ ID NO: 42296 - DNA, 201 bp, Homo sapiens
tcacctctaggcatccctagtgcctagtattgccatctttatgtccataagtacctgatgtgtagctctcatttgtaagtgagaacatacggtatttgttwttcttttcctgcatttctttgcttagaataatggcctccagctgcatctatgttgctgcaaaggacatgattttgattttttatggctgcatagaattcc

SEQ ID NO: 42297 - DNA, 201 bp, Homo sapiens
cttgtcaatctttaggaaaggtccttagacctttaatcaaattgatttccaaattataaataatttagcaacattaataatttaatttcccagaatggaayaaattaaaagcaacagattaaaatgtgatgaaaggtaggcctccgcattacctatgagagtagttagtaaaaaaaaaaaaaaattagggctgggtgcggt

SEQ ID NO: 42298 - DNA, 201 bp, Homo sapiens
gccaactttttatttttatttttaatagagatagggtatccttacattgcccaggtgtgcaatgtaagtctcgaactcctaaactcaaatgatcctcctgycttggcctcccaaagtgggcatgagccaccacgcccagtcatgaaaatcagtccaagaggtctagcacttcttgcgtagcacttcagaatacaataggtc

SEQ ID NO: 42299 - DNA, 201 bp, Homo sapiens
ctcacctctaggcatccctagtgcctagtattgccatctttatgtccataagtacctgatgtgtagctctcatttgtaagtgagaacatacggtatttgtytttcttttcctgcatttctttgcttagaataatggcctccagctgcatctatgttgctgcaaaggacatgattttgattttttatggctgcatagaattc

SEQ ID NO: 42300 - DNA, 201 bp, Homo sapiens
cctcccaaagtgttgggaatacaggcatgagccaccgtacccagcagatttcattattttttaatggctgaataatattccatcatatatatgtattataycacattttctttattcattcatccattgatgggcacttaggttgattccatattttggttatttttatttttttgagacagagtcttgctctgttgccag

SEQ ID NO: 42301 - DNA, 201 bp, Homo sapiens
tttattttctttttaagaaatcaagtctacttaatatgataataatatagtcaaagaagtacacagccacgtatggctggatttgatttcttatccaatasctggatctgagaaaaggttgttcagttacattccagaagcttcagtagcaaaactgctcttttttcccccaacttttactttatattcagagggtacatg

SEQ ID NO: 42302 - DNA, 201 bp, Homo sapiens
aaatcatttcacaggagttgctacagcagcatggaaagcttttttaatattattatattctcaaagctgtactatgagtcgggggtaaagaaaaaagcccmaaaaattttccaattctcaaattatagcttttacggcaggaaagcattagaatacacctccacctgtaacataaagcaagcaaaccaccagatatctcca

SEQ ID NO: 42303 - DNA, 201 bp, Homo sapiens
gatttgatattgggtgatgaccaaacacagttggtcaaatcctccctctgggagttggagagacatagaaggaaaggaacagaaatgccagtggtgataayagggacagcagaaggaagaggagcagggactgaaagccactgagtcagagtacactgaggcatatgagcaatacctgagtggaatctgtggttgcagggc

SEQ ID NO: 42304 - DNA, 201 bp, Homo sapiens
aactcttcaaagctttaatgattcagtgattcatgattcaatatctgcagggttaggccatttatagagtaaatttgcaagtaaaaactattattttcttrtattattttactacccttactttccattgccaacataaactcttactttttaaattgttttctggacaggcaatttgacacaagaaacccaatattgttg

SEQ ID NO: 42305 - DNA, 201 bp, Homo sapiens
gcaaatacttgaaaaaaatgtaggatccactggcttatatcttctgtgtaggcatcaaaacagatggtggtggggttgttgggaagatggtagcagacagrgttgcttaaaaatataagacttccttgatgtccaagaatactgagatttatatgattagaaatttctatacaaagctggaaacagtggagcatgttccca

SEQ ID NO: 42306 - DNA, 201 bp, Homo sapiens
ttaagaacttactaggccttcagcaacaaatatacatgtaaagtgccatttactaaaaatggattaacatgtcttaagtgcttatagcatcctagtgaagwtcaatcctttgctatgcaattttacaggttgagaaataaacacttatgtaactataagtaaatatgttcagatgtaatcattaagatgggtcatagaatt

SEQ ID NO: 42307 - DNA, 201 bp, Homo sapiens
agatttggcctgagggatggcgggatctgagcaaatctcagtgggttgtgacagcgtgtgtggcttgatagtttccttgtttgattctcacatagtgcccmcccacagacagcttttttttttttaaagatggagtttcgctcttgtcaccctgctgggttcaagcgattctcctgcctcagcctctgagtagctgggatt

SEQ ID NO: 42308 - DNA, 201 bp, Homo sapiens
ctgctccttcctggttcagcagcctattttccatggaagatgcgtgtctgacacagagagaaactgagctcctagttttctaatgtccatcccaacgtatygtgtcccctctggatattctccccaacctcaggtcagtcctttcagtctcctccctcggcttatacaacacagggtgcctcaccgctagggtgtgtcgat

SEQ ID NO: 42309 - DNA, 201 bp, Homo sapiens
tttctttttagtcaaactaggttctgatttccaagataaggcgaaatccagagcagtttgggaaatgaaggaatctgactgaacaataagagtcagaaccrttgccctaccataagcaacaccttaacagaaacaaattcctttgtccgttcattctatccacagactattttcagagaagagaatgtcccagctagaaat

SEQ ID NO: 42310 - DNA, 201 bp, Homo sapiens
tggtgaaatcgcaaactgggcgtctgttccggcgccggacccctgtttgcaaaggtgggtggcccgtccggagcggaaaaacattccggaagtggagggcygggccagcgtgattgacaagcgggaacccctgtgtggggacggggcaggcctaggaaggttgtgcctgcggtggaacggcgcggtgcgcaggagtgggca

SEQ ID NO: 42311 - DNA, 201 bp, Homo sapiens
aaaaaaaaaaaaagcaaaaagattgatttacatatttaaaaaattaaatgccagtataaataatgttgtcactggtgaggcgttaaaaggtaattaaagtraaacttttttgtttcctatatgtatttttcttggatctcctgcaagacaattttcaccttccctttgtgatcagagccgtcccaggacttcaggggcttc

SEQ ID NO: 42312 - DNA, 201 bp, Homo sapiens
acatcctattagagtgtgggaagattgttgttttcataaaaattatcatcatgggttaatatttgatgatataactgaagcttaattgggaaaagtttcaytagagtaacaaagtaaatttttctctgtctcacttaccagtgatgagatagccaacggccttggccttgatctcctgcgtcagctgctgggtttcattca

SEQ ID NO: 42313 - DNA, 201 bp, Homo sapiens
aggaaaaatgcagtgctgaggctcttttcattgagcactttactgctctgttttgtacacacaggctcccccatcacagtgtgcacccaagaaagtcaatyagctgttactgagagtttggagactttttctttttagcttagacatctctttttcttttttcttttcttttctttttttttttttttttgctgccacatg

SEQ ID NO: 42314 - DNA, 201 bp, Homo sapiens
ttgcaatttccttgtgcctccttcctcccttcacccctgggggatgttatgttgatgtgtgtcaggctcagaagtttgtggaacagttcacctttatggcrttgttgagcagtgacccagagctcctgaaacagccattgtccttctgcatctgggagagccacgtgagagattgggtaatgtgtgcttcatcaatgaaga

SEQ ID NO: 42315 - DNA, 201 bp, Homo sapiens
ccctgtctctactaaaaatacaaaaattagctgggcgtggtggtgtgcacctgtagtcccagctacttgggaagctgaggcagaagaatcgcttgaacccrggaggtggaggttgcagtgagccgagatcactgcataccagcctgagtgacaaagtgagactctgtctcaaaaaaaaaaacaaacgaaaaaaaacatatt

SEQ ID NO: 42316 - DNA, 201 bp, Homo sapiens
tctgttgctggtgaggagctgtgatcttttggaggagaaggggcgctctggtttttagaattttcagcttttctgctctggtttctccccatctttgtggktttatctacctttggtctttgatgatggtgacctacagatggagtttttgtgtggatgtcctttttgttgatgttgatgctattccattctgtttgttag

SEQ ID NO: 42317 - DNA, 201 bp, Homo sapiens
gccaggagtgggggcacatacctgtagccccagctatttaggaagctgaggtgggaggattgcttgagccagggcagtcaaggctgctgtaagccatgatygtgccactgtactccaccctgggtgacagaacaagaccctgtctcaaaaaacaaaatttaagtttgtccttcagtttgagtcagaggatgctataaacca

SEQ ID NO: 42318 - DNA, 201 bp, Homo sapiens
atcgcttgaacccgggaggtggaggttgcagtgagccgagatcactgcataccagcctgagtgacaaagtgagactctgtctcaaaaaaaaaaaacaaacaaaaaaaaacatattaaattaaggcattaaaaaaaagaaaatatttctggcagattagggtcttactgaaattgcatactcatagcataacttttatggaa

SEQ ID NO: 42319 - DNA, 201 bp, Homo sapiens
tcacaggaacaagaacagagaattctgaattctaaaatccacaacgctcatttcactgaaaggtcgttcaggtggcggtggtggatttttttcccttagcygtcattttggatatttgattaattatcgaccattatatttccttcttcttgttagttacgatttactaagaagaatttttatgctattttaaagttaaat

SEQ ID NO: 42320 - DNA, 201 bp, Homo sapiens
tcgcttgaacccgggaggtggaggttgcagtgagccgagatcactgcataccagcctgagtgacaaagtgagactctgtctcaaaaaaaaaaaacaaacgaaaaaaaacatattaaattaaggcattaaaaaaaagaaaatatttctggcagattagggtcttactgaaattgcatactcatagcataacttttatggaaa

SEQ ID NO: 42321 - DNA, 201 bp, Homo sapiens
ttctgatacccccactggagagtgactgatcagtgcattatctgtcacctcagagctcagagtgcccctcttttctattcaaatacaaagccattcatttmctttgatggacaaatagccgtggcattagtatgggtaggggcaagtgctgttgtctcttatctaggaaggagttggttcttttctgatggttgaataata

SEQ ID NO: 42322 - DNA, 201 bp, Homo sapiens
agagagccccctttggggcggagccactgagggctgcgcggaagaggctgggtgtgataaactataaagaggccctaaactcggatgcaacgtgacgggarttgtagttctttcacctggcgggcgtctgctccggttcagctgcaggaggtttcttgggagttcagcccagcgcgcagccccgccgcgacgccgcgagcc

SEQ ID NO: 42323 - DNA, 201 bp, Homo sapiens
tcgcttgaacttgggacatggaagttgcagtgagctgagatcacaccactgcactccagcctgggcgacagagcaagactccgtctcaaaataaataaatwaattaattaattaaaattaaaataaaaaagtatttatttatttatttatttaagatataagttctcactatgttgccaggctggactccaactcttgggt

SEQ ID NO: 42324 - DNA, 201 bp, Homo sapiens
aagtgcacaaacatgaatatacagtttaacaaataatataaacctgctattcatgtagccaccacccagatgaaggaaatagaatatcataagcaccgcasaatctccatttgtgcccttctccatcgtagctttctctgtcccagacaaccattgtccacaacttgttgtaataatttacttaattttcttttatagttt

SEQ ID NO: 42325 - DNA, 201 bp, Homo sapiens
agccagtttatccatctgggtggtgccagctgatccggcaattgcagggtctggaaaatatctcaagcactgagatatttgaagaaaatcttgaagcctcyagttgcatgactcttaaaccataatttctaatcttgtagctaatgttagtcctacaaagggaatctagtccccaggcaagaaggaggtgtgctttgggaa

SEQ ID NO: 42326 - DNA, 201 bp, Homo sapiens
ctatataacctttctgaaaaacatcctgtgggaaatataccatatatacagaaaaagtgcacaaacatgaatatacagtttaacaaataatataaacctgytattcatgtagccaccacccagatgaaggaaatagaatatcataagcaccgcacaatctccatttgtgcccttctccatcgtagctttctctgtcccaga

SEQ ID NO: 42327 - DNA, 201 bp, Homo sapiens
tttttttggtaaagggattaaatatcaaaaacattttgaaaattaataagaatagcttcatctgagccaaaataataattattatagtttcctttttttcttttttttttgagacagtctcacactctcgcccaggctagagtgcagtggtgtgatcttggctcactgcaatctccgcctcctgggttcatgtgattctcc

SEQ ID NO: 42328 - DNA, 201 bp, Homo sapiens
cttgagtcacatcaactcaaagacctgaccaagcataaacaggatgttttccatttaaattttttgtgtcattttataattttaaatgactacctttttgktaatgaatcatcagttatccacagcccaagtttacttaaaattttccttatttgattcataaagattcaaattttaggtgaaaatctgtttataggaata

SEQ ID NO: 42329 - DNA, 201 bp, Homo sapiens
cctgcttttcttttcttcatagcacttattacctcctgattatattttttgtttgccttttgtctatcacctgtcattcttttaccagaccatctagtctyatatgtctatataacctttctgaaaaacatcctgtgggaaatataccatatatacagaaaaagtgcacaaacatgaatatacagtttaacaaataatata

SEQ ID NO: 42330 - DNA, 201 bp, Homo sapiens
ttgggaggctgaggtaggcagatcacttgaggtcaggagttcgagaccagcctgaccaacatggtgaaaccctgtctctactaaaaatacaaaaattagcygggtgtggtggcgtgcacatgaagtcccagctacttgggaggctgaggcaggggaattgcttgaacccgggaggtggaggttacagtgagccaagattgt

SEQ ID NO: 42331 - DNA, 201 bp, Homo sapiens
acttgagtcacatcaactcaaagacctgaccaagcataaacaggatgttttccatttaaattttttgtgtcattttataattttaaatgactacctttttrgtaatgaatcatcagttatccacagcccaagtttacttaaaattttccttatttgattcataaagattcaaattttaggtgaaaatctgtttataggaat

SEQ ID NO: 42332 - DNA, 201 bp, Homo sapiens
gcattcaatttgcattgcctttgctgtgttcacagtggcactccatgaggcttaactatggagatcctggtgctacaagccgttaaatagttctctcttcycaacctattcccctatcctgcttttcttttcttcatagcacttattacctcctgattatattttttgtttgccttttgtctatcacctgtcattctttta

SEQ ID NO: 42333 - DNA, 201 bp, Homo sapiens
ccgtgcaacacaggtgagccccaaaattggggcttagcctggggaagtccttggctttacccaggaaataattcaagggtgagctgatagtagaaaacaggtttgtttgtttgtttgtttgtttttgagacatggtctcgctctgtcacacaggctggagtacagtggcatgatctcagctcactgcagcctccacctcct

SEQ ID NO: 42334 - DNA, 201 bp, Homo sapiens
ggttcaggtctggttttgctgatgaatgagttacaaaaagaatgtttggttttcagaattttttggatttgtagaattgaggataatggattgtgggcttrtaataatcctttcacagaacccactgtgaacaaacacagtaaaatctttgggaggaagaatttaggggagtctttttaaaaaggttaagaaaatgatcag

SEQ ID NO: 42335 - DNA, 201 bp, Homo sapiens
aagtctagctcctaaaactaaagtttgctagagtcacactgataatgtcaattacaagctgatcttcccaggagcagaacaaatcattcctccacctaccstgagatgtttgcataattgattcttcctctactccctttttctctgaattctttataatataatcaccttatctgtataaaatgtagatttactgagctc

SEQ ID NO: 42336 - DNA, 201 bp, Homo sapiens
gagagatgaaatgaattgatcaaaatctcaaaattcattttggttgagtaaaaataaaaccgtctctatttcccacaaaaaaaaatgcctacttttaaaaraaagtaggaaatgtggacagcagaggcacataatgaaagaataaaagcctctcacagccccctcacctaaaataatccccataaatacttgattcatttc

SEQ ID NO: 42337 - DNA, 201 bp, Homo sapiens
ccttatcaagtgagttcagtatttctctattctgattttgctttcccagtagggaaaaagcataggccagcaatgccttggtgtagacatggctcccatgrgtcccctcctttgctacattccaggctgactccaggcagaacagggcattgcgaacaatagggttctgtaaaggcaaaatgtggttgtgtcaaactaggg

SEQ ID NO: 42338 - DNA, 201 bp, Homo sapiens
cattgaccgtaacttcaaacttgggcagcactggaaacgaagagaaatatacgttagcctgcacaatcacaggcaagcaaaccttattgcagtcatatagyttactatgattccttgtaccctccatctgtatgagctatgtatcatttgccccaaattgtgtggcaccattctacatggtggtgtctcactaatgattaa

SEQ ID NO: 42339 - DNA, 201 bp, Homo sapiens
atttcctgggttacctaggagacctggtaatgaatggtgactatcttctattctcattcacttccagagaagtgtccttacccgaatgcaggtggacaagyagttaaacacagtggctttgagtgtgaaggcttctcctcgcaccacagaataaggaagggtgagttctaggaagaaaggctggaaggcttgaagagacac

SEQ ID NO: 42340 - DNA, 201 bp, Homo sapiens
gctggtgtctcctgccccctccggaagcttggatgcccctccacaccctcttgatcttccctgtgatgtcacctggacccctgctgctggcattggccacraagcctcctggtctggctccaaagcctggcagggtcttttccccgggggagctgcaggcagggaacagtcctgatgggtcatccccttcactcccagccc

SEQ ID NO: 42341 - DNA, 201 bp, Homo sapiens
cgtgcaacacaggtgagccccaaaattggggcttagcctggggaagtccttggctttacccaggaaataattcaagggtgagctgatagtagaaaacaggtttgtttgtttgtttgtttgtttttgagacatggtctcgctctgtcacacaggctggagtacagtggcatgatctcagctcactgcagcctccacctcctg

SEQ ID NO: 42342 - DNA, 201 bp, Homo sapiens
ctattacaggagccgccttgccatccctgcagcccaggtgagggccctgcagggccagaaagccgctcttggctctcactgtggtctaggccatgaggggsgtcctcatcacactgtagtttgggggatgccccccaccgtggtcaggttgatggcaccttaacccattctctcctgaggcgtgagttggaggaggcgcgt

SEQ ID NO: 42343 - DNA, 201 bp, Homo sapiens
gtgcaacacaggtgagccccaaaattggggcttagcctggggaagtccttggctttacccaggaaataattcaagggtgagctgatagtagaaaacaggtttgtttgtttgtttgtttgtttttgagacatggtctcgctctgtcacacaggctggagtacagtggcatgatctcagctcactgcagcctccacctcctgg

SEQ ID NO: 42344 - DNA, 201 bp, Homo sapiens
tgagaaagttatccacattctattttctctaggactgtgtgtgtccctatttccatacagtcacaacaatactgagtagtattaattttttttttttttttgagacagagtctcgttgtgtcacccacgctggagtaaagtggcatgatctcggctcactgcaacctccacctcccgggttcaagcgattctcctgcctca

SEQ ID NO: 42345 - DNA, 201 bp, Homo sapiens
tgcaacacaggtgagccccaaaattggggcttagcctggggaagtccttggctttacccaggaaataattcaagggtgagctgatagtagaaaacaggtttgtttgtttgtttgtttgtttttgagacatggtctcgctctgtcacacaggctggagtacagtggcatgatctcagctcactgcagcctccacctcctggg

SEQ ID NO: 42346 - DNA, 201 bp, Homo sapiens
taggcgtattaaatgtatttttgacttatgatatttttcaaactatgatgggtttactaggacataatctcatcatcagttgaggagcatctgtatatgtrtgtgtttagatagatataattagatatctatatataatagattctatgctatgggcattgtaagttctaaattgcttcagtggcattattgtacattctt

SEQ ID NO: 42347 - DNA, 201 bp, Homo sapiens
cctgggaggtggaggttgcagtgagccaagatcgcgccactgcactccagcctgggcaatagagcgagactccatctcaaaaaaaagaaaagaaaaaaaamatcaaaatgaaagcatcattaacttcatgtcaaaacttgacagacttacttaaaagataaacatggtgtaaaaaaaagagtagctggattgctcattttc

SEQ ID NO: 42348 - DNA, 201 bp, Homo sapiens
gcttatggctccagaagtggccattaatacctggagctaaaacactgttttggtttagcatgactctagttttcactgaatatttagtatttttaagttargtttttttgttgttgttgtttttgtttttgttttgtttgagacagtgtctcgctctgttgcccagactggattgcagtggtgtgatttcggctcactgca

SEQ ID NO: 42349 - DNA, 201 bp, Homo sapiens
tcatcactatgttttggtttagtgaaatactttcaaagtcctcgataacatttttttctataaattttttattttttaattatccgggcatggtggcttcrcctgtggtcctagctacttggtaggcagaggcgggaggatcacttgagcccatgaggtcgaggctacagtgagccatgatcacgccactgcattccaacc

SEQ ID NO: 42350 - DNA, 201 bp, Homo sapiens
  misc_feature (1)...(201): n = A,T,C or G, or insertion/deletion polymorphism (see Tables 1-2)
gaccagaactaaggctctggtctagagctccaaaccagaagcaaaaaggaatggtgctgggctggggcactttcctctaacatcacccaaacccagaaaangaggatcgtaagccccttcatgggccaaatgcagggctggggcccttgggctaaccctttagtgcctctggctgcatcactgtcagagtaaggtaaccag

SEQ ID NO: 42351 - DNA, 201 bp, Homo sapiens
tctccgttgcaactaatcaacactttgttgtagtaagaaagcagctatagggagtatgtaaactaacggatgcagctatgttccaataaaactttatttawaaaaacaagctatagcgccaggcgcagtggctcacgccagtaatcctagcactttgggaggccaaggcaggcagatcacgaggtcaggagatcgagacca

SEQ ID NO: 42352 - DNA, 201 bp, Homo sapiens
agtgcgatgtggatgacttacaaacaattattattcctaaaatataggtacgatgagtttattgaaaacaacataatgcaataggaaaaaaggacaaagascaactagtcagagaggatttgcaagtaaatcagtaaatgggaagagatgttcaatctgagtagtcagtgaatgtaaattaaggaagtttactttttttcc

SEQ ID NO: 42353 - DNA, 201 bp, Homo sapiens
gactgacttatttggttttagaaatgaaaaagaacagtttggaagaaatagtgcgatgtggatgacttacaaacaattattattcctaaaatataggtacratgagtttattgaaaacaacataatgcaataggaaaaaaggacaaagaccaactagtcagagaggatttgcaagtaaatcagtaaatgggaagagatgtt

SEQ ID NO: 42354 - DNA, 201 bp, Homo sapiens
accaaagttgagcaaaattcaccagcagtttgtgaaacaatttctgttcccaagtccatgtccactgaggaatataaatcaaaaattcaaaatgaaaataygctacttctcgctttgctttcacaggcacgtaagactcagaagacagtattaaaagatgctaatcaaactattcaggattctaaaccagacagttgtgaa

SEQ ID NO: 42355 - DNA, 201 bp, Homo sapiens
tagggaaccaggagcctaggagggccagagtagcaccattttaagttcagctccatcttgagaaatagtaaagcccattctctgctggtcacgacccacaktcatgggctgtttacagtggaagaaacagcctaaagatacctacaaggacacactcctactacagccaagagtccagatgtccaatacccataacaatct

SEQ ID NO: 42356 - DNA, 201 bp, Homo sapiens
ttctgacccatccctgccctgctcaggacccaatcacagttccctcaccctcctgaatcaaacctgaagtcctgtcctgagtaccccatgggccttaactyactcatcccaacttcactcattgccttgccccacaccctgccagggagcctcccatggcaccgtggaggacgcagaggaaccaaggcaaagctcctgtgg

SEQ ID NO: 42357 - DNA, 201 bp, Homo sapiens
tatcatataagtgacattagttgagggtaacctgatttaggtacactcacctttctgtccaggcttgtaggtgggtttatcagtctgtacaaagaccacaytctctctggatctgattgccacagatctcctctcttccaggttgagagtggctcctttagcagaaaatgtaataaatgccagtgggtcagatctggcctg

SEQ ID NO: 42358 - DNA, 201 bp, Homo sapiens
ctttttttgcacagtttttaaaaaaacttttattatttatctatttatttatttattttttaaattttattttattttaagttctggggtacatgtgcagratgtgcaggtttgttacataggtgtgccatggtggtttgctgcatgtatcagcccatcacctggttattaggtcccccatgcattagctatctatcctga

SEQ ID NO: 42359 - DNA, 201 bp, Homo sapiens
ccgggtggggaacatcccacactggggcctgtcgtggggtgggggcagtggggagggatagcattaggagatatacctaatgtaaatgacaagttaatggrtgcagcacagcaacgtggcacatgtatacatttgtaacaaacctgcatgttgtgcacatgtaccctagaacttaaagtataatttaaaaaattttaaata

SEQ ID NO: 42360 - DNA, 201 bp, Homo sapiens
agtgtggagcagggaggggaccagcaccatatactgcctgggaaaggaagaagtctaaattagagaaaaactgatgatagtaagcgttttcatccataaakgtgttttcataacaatatgtattaattggtgcaatcagttttattctaaaagtcaatggactaagtcaatggaggttctgtcacagatcagcacaaaaat

SEQ ID NO: 42361 - DNA, 201 bp, Homo sapiens
taaagccataaaaaccctagaagaaaacctaggcaataccattcaggacataggcataggcaaggacttcatgtctaaaacaccaaaagcaatggcaacamaagccaaaattgacaaatgggatctaattaaactaaagagcttctgcacagcaaaagaaactaccatcagagtgaacaggcaactgacagaatgggagaa

SEQ ID NO: 42362 - DNA, 201 bp, Homo sapiens
gctagccatatgtagaaagctgaaactggatcccttccttacaccttatacaaaaattaattcaagacagattattaaagacttaaatgttagacctaaarccataaaaaccctagaagaaaacctaggcaataccattcaggacataggcataggcaaggacttcatgtctaaaacaccaaaagcaatggcaacacaagc

SEQ ID NO: 42363 - DNA, 201 bp, Homo sapiens
gcaaaggacatgaactcattcttttttatggctgcatagtattccatggtgtgtatgtgccccattttctttacccagtctaacattgatgggcatttggrttggttccaagtctttgttattgtgaatagtgctgcaataaacgtacgtgtgcaggtgtctttatagtagaatgatttataatcctttgggtatataccc

SEQ ID NO: 42364 - DNA, 201 bp, Homo sapiens
ctggaattgtctaggagattagaaagtttcatttaagccaagagatgaatgctgaggaggaatcagctcggaaaatgaggtgcaggcaggttgggaactgyggtagcaaatgggaacgaagattgttatgggcagaagggaaaacctgtgggaggcttcggagccagaaaagcacatggcttgtccaagaaaatgaaagcc

SEQ ID NO: 42365 - DNA, 201 bp, Homo sapiens
ataaagcaatttaatgttccacattccaaaacagttttctaagaccaataaacaactttttattcatatttgcaaatgctgaattacatctaaatttattwagttcagtgaaacaaagttacacaaaggcattaagagtctcccagtgcttgtctggttttctgaaaggtgtgtttgatatgcaaggtataagcaaggcct

SEQ ID NO: 42366 - DNA, 201 bp, Homo sapiens
aaggtggctttaactgagagagcagatccaactgagcttataacaatatttttgaagtatgcaagcattgagaaaaatggtgaatttttcatgtctcccartgactttatcactccatacttgaacatttctggagaaagccagcctaacccaaagactgtggaacttttaagtggggtggtgggtcagaccaaagatggg

SEQ ID NO: 42367 - DNA, 201 bp, Homo sapiens
gcatcactgtggagaataaggtcagcccctcaagggcaacagaggggtctaggtctggacctgtggctggcggcacaggagccatggtggtgcagaccagragctgtgtctagcaaggcttatgccctgccaagcactgccaatggagatgtgaagctgctggtggtatccagcatgcctctggtggacttcctgatgtag

SEQ ID NO: 42368 - DNA, 201 bp, Homo sapiens
cagctcaaagaggtgagttgcctgtcacctctccctttcctggccctcactccccccacccgcaaggcccactcatcatgatcaagaagtcataaaggagktgattgaaaggactgttttttcttctagggccctttgttggtaagagaagattgaaagagtccattgtttcctcccccaagagaaaaattgcctaagaaa

SEQ ID NO: 42369 - DNA, 201 bp, Homo sapiens
gccaagacagttcaatggaggaaagaataatctttcaacaaatggttctgaacaactagatatctacatacaaaataatgaatttggcacctgagtaccayacactatatacaaaaattaactcaaaatggatcaggacctaaacataagagctaaaattataaactcttagaagaaaacatagatgtaaatccctgtgac

SEQ ID NO: 42370 - DNA, 201 bp, Homo sapiens
agcaatttcactccttggtacgtaccttagggaattgaaaacatatgttcatataagatagcaaaaaaaggaaacaactgaaatgttaatcaactgatgartggataaacaaaatgtggtatatccataaaatcgagtattatttagtcataaaaaggaatgaagtatgaaagatgctaaaacatagatgaacctcaaaaa

SEQ ID NO: 42371 - DNA, 201 bp, Homo sapiens
atgaaatattacctaagtaggaattaattgctttttatcactttacattatttcatttttagtattatgaaaaatataattgttccttttcttaaaaaaaaccagcgtaatttgtgcttagttttaaaccaaaatttttcctatatgtttatagtttatattttcaagccaaaatacttgagtttttttcctgtcataata

SEQ ID NO: 42372 - DNA, 201 bp, Homo sapiens
ttgggatcacaggcgtgagccaccgcacccggcctgagctaattcttaagaagtcactttggaaaaaaatattatttaagggcttttcataaagtattcaraaaggtacaagttctaatctaacagttctatttgtgatttttgaggaagcatatgcgtatttccacttaagcatctgaaatattgcctctagtgctgaac

SEQ ID NO: 42373 - DNA, 201 bp, Homo sapiens
gctccagcaagggaactcaattgtctaattagatgttaccagaaatcttattggggctgtgatctaattcttttttttttttttgagacagactcttgctstgtcatccaggctgcagtgcagtggcgcgatctcagttcactgcagcctctgcctccgaggctccagtgattctcctgcctcagcctcctaggtagcggg

SEQ ID NO: 42374 - DNA, 201 bp, Homo sapiens
ttttcccatgattccaccccaccccccaataaaattagccagtgatctcaataccacaggttactgaacagttgatctttcctgcactaatttccaatgtstgttttgtgataaatcaagtttttatatatgcatgggtctatttttggactattctgttacattggtttgttggtctattcttgtgcaaatgccacactg

SEQ ID NO: 42375 - DNA, 201 bp, Homo sapiens
cctggaattgatttttgtgtttggtgtgaggtagaaatctaatttaaattttttcccatgattccaccccaccccccaataaaattagccagtgatctcartaccacaggttactgaacagttgatctttcctgcactaatttccaatgtgtgttttgtgataaatcaagtttttatatatgcatgggtctatttttggac

SEQ ID NO: 42376 - DNA, 201 bp, Homo sapiens
atcctttccatgaagtcataaaaacatgcacctatattgtcttctgaatatcttctggtttgacttttatatttaaatctttaattctccctggaattgakttttgtgtttggtgtgaggtagaaatctaatttaaattttttcccatgattccaccccaccccccaataaaattagccagtgatctcaataccacaggtt

SEQ ID NO: 42377 - DNA, 201 bp, Homo sapiens
ggaaatatcttttcctagtccatgggttgtctttttactctttctgtggtatcctttgaagaagagaagtttataattttaatttagttgatttatcactsttttgtgtttctaggttgtatttttctattcttaagaaatcctttccatgaagtcataaaaacatgcacctatattgtcttctgaatatcttctggtttg

SEQ ID NO: 42378 - DNA, 201 bp, Homo sapiens
gggggaactggatgtggtgggaaaaattgtatacctcttctcagacttcataccccaccaatgggctgtcaccacggtttgcagactgttcacaccgagtktgtgtagaaaggatgaaatcttaagattagaatgagagtgaacgcaggttggtcatgcctgcagctctctttgaagacactcgctatcatggcgggctag

SEQ ID NO: 42379 - DNA, 201 bp, Homo sapiens
cagcctgggcgacagagcgagactccgtctcaaaaaaaaaaaaaaaaaaaaaaaaaggagaacataaagcaagtaacaatgtttttcaagttttctttaaygcattacatctttttttcacaagatattttaaaattttatttttccttattaagcgaattgaattatttcaagcatcagtgagagctgctagactgttat

SEQ ID NO: 42380 - DNA, 201 bp, Homo sapiens
tcttgtgctctctgtcctttattctccataatgcgagctatccagtagaccctagccaaaggggacataaagacagtctcaacattgtattactggttctktgctacagttgtcattcaagttcctgagaaaatggaatgaatgtctgttattcatttatttattaaatctttagagagcatcatctatatgccaggtatt

SEQ ID NO: 42381 - DNA, 201 bp, Homo sapiens
attttaggaaagtctttttataattgatactcaaagtgatgaatgtataaaagaagttattttaatatttaagacaggcctcagcaaggcacatgaggctyttcatgatttggcccttgtctgcctcattccttatcatcactccatatgcagtaagaccacttgcttgcagtccatgttttcacaggccttgtgcccctt

SEQ ID NO: 42382 - DNA, 201 bp, Homo sapiens
gcgagattctgagaaagaaaaggagaaagagagaaagagtgagagaaagagggaaggggaggggaggggagggaagggagagagggaggaagggaggaagkaaggaaggagggagggagggagggaggagagaagagagaagagagaagagtaatggggaaagacagtcccatatcaaaaatttttggaatctctggccaa

SEQ ID NO: 42383 - DNA, 201 bp, Homo sapiens
cactgcactccagcctgggtgacagagcaagactccgtctcaataaaaaaaaataaaaataaaaaataaaagaggaagtgtgataatggaagcttttggaktttttttttgccttctaaaaaaagcatggtatacaatataaaagaacatttattaggttctcaactctggaataaactcttgactgtatcatttaaaaag

SEQ ID NO: 42384 - DNA, 201 bp, Homo sapiens
agcatttaatgaagggaatatttaccaaaaaagtaggattaaagaaagccaataggtacggtaaaccaccttgggaagctgcaacacacccaaagggttaraggaggtagtagtcaccgaacgtgacaagttgacctgtagctgaacatttttccatgtctgtataatactactataaagcatgattttaaatagataacc

SEQ ID NO: 42385 - DNA, 201 bp, Homo sapiens
agagttacattctcagtgaaaatttccccatctcccactagggagagttagataaacacctctaaacgctgatttacagcatctatcacattgtgcagtaraaaaggctaagctgagagtcaataacctttggaaacttcttaggaaagcatggccatatcaggaactaaaatttgctgtactctgcagtcctaaattcat

SEQ ID NO: 42386 - DNA, 201 bp, Homo sapiens
atacaaaaaaattagctgggcatggtggtgggtgcttgtaatcccagctatgcgggaggctgaggcaggagaatcgcctgaacccgggaggtggaggaggytgcagtgagccaagatggcaccgctgcactccagcctgggtgacagagtgagactgtatctgaaagaaaggaaagggaaaaaaaagaaagaaaaaaaaaa

SEQ ID NO: 42387 - DNA, 201 bp, Homo sapiens
acggggttttgctatgttggccaggttggcctcaaactcctgatctcaagtgatctgcccacttcggcctcccaaagtgttgggaaagaatacatatgatkgcatttagggtccacgtagatgtgatccaggacaatctcctatttcaagatccctatcacatctgcaaaaatcctttttccaaataaggcaatatttaca

SEQ ID NO: 42388 - DNA, 201 bp, Homo sapiens
tttaatacaggctctcccagaattttctagtaaacgccctagccctttacaagttggtgttcaacttgtgaagagaagaccattgtaaaatagatttaagytagtatgacataatgggggaaaactataagcaagatttctaagttgcttgttgcctcaagtgaacagtggttagtgcaagctggcatgcagggtaaatgg

SEQ ID NO: 42389 - DNA, 201 bp, Homo sapiens
ggtgaaagtggctgctccatacctggacagggcatggagagccaccactgtgtcctggaagagacgagtggacaaccgccccaaagagtaaatttttggcrtctgggattttcccccaaagtctgtgttagcctaccatgagggaagctggctttttacccctaaggtagatcttcactaattacctttcctttttctctg

SEQ ID NO: 42390 - DNA, 201 bp, Homo sapiens
cccctcacttcctcattacttaacgtctccagaggtgccttttactttcccaggaaggaaggaacagagtttccatttcaattggcaagtttaaagttgaytctcacccatataagcttggagccctacctgaagatacacacatctttccccagttactgttatgacatattctccagggagctctggcaatgagatctg

SEQ ID NO: 42391 - DNA, 201 bp, Homo sapiens
ttcctttccctgaaaagcttctcccccacattttgtatatccgactcctttttgttcctcatagataataaaatgaatatcacttcttcagagagatctcyactgattatctttttttcttctttctacctaaattttatccttgtttttcttttaaaacttttaaaaagcacatataaaatgcttatgtgtgtgatacta

SEQ ID NO: 42392 - DNA, 201 bp, Homo sapiens
ctctggcctggaagtttctctgaatctgagtgaattagagtgtaatgagtgtcccctttgccttccctgcacttagtacatgtacctaccaagtattgagyactgaccattaaaattgtaattctcttcttttcttctcatttttattttttgtgatgctataacaataaagaagaaaatctaaggcttacataatcttac

SEQ ID NO: 42393 - DNA, 201 bp, Homo sapiens
aaactcccatctcctctggtttctgtccttcccatggccccctttcacacaaatacagtgatttacatagaataggagctaggagtggtccattctaaatrttttatcctctcttttcctaggctctgcaagcactgcagcggcagcccaatgcagctcagtatttccaccagttcatgctccagcagcagctcagtaatg

SEQ ID NO: 42394 - DNA, 201 bp, Homo sapiens
cacagcgagattctgagaaagaaaaggagaaagagagaaagagtgagagaaagagggaaggggaggggaggggagggaagggagagagggaggaagggagkaaggaaggaaggagggagggagggagggaggagagaagagagaagagagaagagtaatggggaaagacagtcccatatcaaaaatttttggaatctctgg

SEQ ID NO: 42395 - DNA, 201 bp, Homo sapiens
agcaaaattcaccagcagtttgtgaaacaatttctgttcccaagtccatgtccactgaggaatataaatcaaaaattcaaaatgaaaatatgctacttctygctttgctttcacaggcacgtaagactcagaagacagtattaaaagatgctaatcaaactattcaggattctaaaccagacagttgtgaaatgaatccaa

SEQ ID NO: 42396 - DNA, 201 bp, Homo sapiens
tgaggcggccataatcaggggctgatggctcttaaagacttccgtcctcttgccgaggcatcccttgggcacatttagcataacaataagcacaaaggagygtccaacactttctgtaactgttggtagcaagttgatgaatggccaccattcaatgggcagtcaacgagtagagattatcaacaggcaagagctagcatt

SEQ ID NO: 42397 - DNA, 201 bp, Homo sapiens
tctacaggtgcctagtaccaggatgggaaaggaaagccaccaaaatctaaggctgccctcagagaagggcaagcatgcagtcctcatcttgatgaggaaasagtttctgagggaatagttttcccctccattccaagcgttggacatgaggcggccataatcaggggctgatggctcttaaagacttccgtcctcttgccg

SEQ ID NO: 42398 - DNA, 201 bp, Homo sapiens
gcacacggtgggagatggatgtggtgacctggaactcaggtgtgagggagctgggacacaggcccaggattcctgagagacatcctcccctccctgggccrtgcgagccacttggagaacctgcacccactctcaacgaactcagcactcccttccccaggatatgccttcctgccttctcctcatcccatccctgggcag

SEQ ID NO: 42399 - DNA, 201 bp, Homo sapiens
tgctctcccattccggcctctaagctcctaaggacaccgtgttggccacatctttggtgtctctcagggtccagcacaatggggagcacacggtgggagayggatgtggtgacctggaactcaggtgtgagggagctgggacacaggcccaggattcctgagagacatcctcccctccctgggccatgcgagccacttgga

SEQ ID NO: 42400 - DNA, 201 bp, Homo sapiens
accaatttttagtgatttctctcccctctagacccctggaagcctgtgcgattcatgctatgcaatgaagaatcagcctcgccctgtgctctcccattccrgcctctaagctcctaaggacaccgtgttggccacatctttggtgtctctcagggtccagcacaatggggagcacacggtgggagatggatgtggtgacct

SEQ ID NO: 42401 - DNA, 201 bp, Homo sapiens
ttcctcatgttaccgactattctagtaaagagactcacttagaaagacgacccatatgtagtctcagccaggatgtcagagccctcacctgttccacataratgaggacatggttgttgctcacttctgtccggctcacagagctagatctttcaagctggagagaattagaaaacttcagttaaagttagagaacagatg

SEQ ID NO: 42402 - DNA, 201 bp, Homo sapiens
ggcatgcaccatcacatccggcttatttttttatttttgtagagacagggtttcatcatgttggccaggctcatctccaactcctggcctcaagtgatccrcccacctcagcctcccaaagttctgggattacaggcatgagccactgcgcccggctaaaggaccatttaaaaatgtaaaaggacaatcccctggatgaga

SEQ ID NO: 42403 - DNA, 201 bp, Homo sapiens
cttattgttctttgactctttttcaccagtgtctttaggtgaccagacatttgtggatgtcaagatgggttttagaatgcatccttgggaactctatttamagtcaacaaattttcacagattttcttctaaacaactgagccaaccctattcttttgtagtcccttgttatgagattaactctctgggcccatgtgaatg

SEQ ID NO: 42404 - DNA, 201 bp, Homo sapiens
ggtgtgaggacatgccatgtggattgtctcagatgtaggaaaagccttgtagagaatttaaattgcaggggcccttggagagtgggttaatgccatctagyactggtcataagtggtgaactcttacctgtgctgcagggggcgatatactcagcaaccacagactcatctgaaagataacgttgggtgaaggaagaaacg

SEQ ID NO: 42405 - DNA, 201 bp, Homo sapiens
actttggctgttcaggtggcccttctcagtgttgccccaaacagtggaatttccctacttacctgtctgtcctggtttatacatgggtttgtctgtctggmcaaagaccagactttgggtgttcagtaccagaactgtgttcctcttcctgaaatcttgcgtaggcccctttatctggatgctaaggaatgccacctctga

SEQ ID NO: 42406 - DNA, 201 bp, Homo sapiens
cagtcatacaatttacagtatccataagataaaagcaggccaattactcagaagaagccaacgattctaggtagtaagaccagacatagatttattctgcrgaacacaaaatgttcttgtaaaaagagacaccgtgtgagctaatggataatgagctcaacagcatccttgtttagacaaggtgaccactgatatggtttg

SEQ ID NO: 42407 - DNA, 201 bp, Homo sapiens
tggagagaacaaaggaaatctctttctttttaacagattttaaaatgtgataatgtcccttaggaaatttaaaagattatggtgtttatttaacatgtgcwtgcttacattatgaaaagcaacacagagaatcatggagtaatatcagaggtcatggatcctaattcttttgttgtgcaaaagaaagtaatatatagagag

SEQ ID NO: 42408 - DNA, 201 bp, Homo sapiens
ctacctggcctctcagatttctgccttcagttccataaatcctcttaaactaagagagtcacccggtcactttcggatgggacagatacctcagtttattyacatttttcctgacttttcttaattccttcttgtgaagtcagaaactgaaaagtctgagattttctgctacttgcaagctaacaagttaccgtgccacaa

SEQ ID NO: 42409 - DNA, 201 bp, Homo sapiens
aatattcaattgtgttactaaaatgacaatttatactttaaatcccaaggcaaatttgaatattatgaaataatatacttttaagagcaaaaaatgtaagmagttacctcttctacatttgaaaaaaacaccaatctctcgctcacacatataccagtgcttcaactgtccctcaaagactgatgttcagataaaagctgt

SEQ ID NO: 42410 - DNA, 201 bp, Homo sapiens
ggattatttctacgtaatacatttataaggatatgattataggttgtggccaggcacggtggctcacacctgtaatttcagcactttgggaggccgaggcrggtggatcacctgaggtcaggagttcgagaccagcctggccaacatagcaaaaccttgtctctactaaaaatacaaaaattagctgggggtggtggcgca

SEQ ID NO: 42411 - DNA, 201 bp, Homo sapiens
tacaggcatgatcctccatctttttatattgtgtaattataatgcagagtagtttgagcttggtgatgagaaagctttcttttcgccttcctgccactcaytgtttgtatactttattttcaaaggccattaacatgtcgacagccactgagctgctgtttttgttttattgttcccttgaccacacaccaaccaaccatg

SEQ ID NO: 42412 - DNA, 201 bp, Homo sapiens
ttagttactttttgctcaacctggtctggagagttccgactgacagggtgccaccaatttttagtgatttctctcccctctagacccctggaagcctgtgygattcatgctatgcaatgaagaatcagcctcgccctgtgctctcccattccggcctctaagctcctaaggacaccgtgttggccacatctttggtgtctc

SEQ ID NO: 42413 - DNA, 201 bp, Homo sapiens
cctatgaagtaggtacttcttgttctctcatttttcaattttattttgttttgtacttttagtagagatggggtgtcgccatgttgcccaggctggtctcraactcttgagctcaagcaatacacccacctcggcctcccaaagtgctgggattacaggtgtgagccaccgtgcccggccttgttctctcatcttatagac

SEQ ID NO: 42414 - DNA, 201 bp, Homo sapiens
aaagcgctgggattacaggcatgagccaccacacccggccatactgtactttttcatttaatagattgaaaaatttgcctccactaaatttctttgggtgmacatctaaagtccctcaaacagcattagtgtcaacatttccatattcagttatttcttctataactccatttaggtagttttggggatttttttagaggc

SEQ ID NO: 42415 - DNA, 201 bp, Homo sapiens
aatttttatattcctcttcatcctgttaaaatctcccctgtttttcttaaattaccacctttcaaggtaaataaaacgctgctggttctctttttatcagkgtgccatttaattttcggttattacaatagaatggtcttaaatttgtctttaaactgaaaacatgcaactctcaagtgataacacggcttagagaacctt

SEQ ID NO: 42416 - DNA, 201 bp, Homo sapiens
agtgagtgtggcttctggaggaagtggggacaaaggagagcattctttcctgccagacctaaccctgggtcatgagtccagccccactggttgtcacctcrccaccacgagagcaaggcctgtctgggaatgtagccagcccaaaagaagcaagctgacatggaaggaaagcaaaccaggcctggatgacgtcgtgtaagc

SEQ ID NO: 42417 - DNA, 201 bp, Homo sapiens
aagatctctagagaagaaaaacaaaaaacaaagtcgaggcgttcctcctcttgctttctgaggatgccctactctaacagtgtagtttctaataacgttgyttctttcactgcactctgtgactcgttttgaagtccctcctgctcgagatccaagaacgttctcttggggtctggatagagatcccttttccggtaacac

SEQ ID NO: 42418 - DNA, 201 bp, Homo sapiens
gagcctgccctgtgtggagtaggcacatggttttcctctccagcacccatttcctccttactcaagcaatggccctgtttcctctggggaatccatctcarttcatgagcatcagatcagactgcccccagagctcctcagtctaagccaatcagtgtgtcatagtccccagcctcagtgatggattctgggacagacacg

SEQ ID NO: 42419 - DNA, 201 bp, Homo sapiens
caccccgggacctgcacaccagcctcgctaccttagccccctcctccaggagcctgccctgtgtggagtaggcacatggttttcctctccagcacccattkcctccttactcaagcaatggccctgtttcctctggggaatccatctcaattcatgagcatcagatcagactgcccccagagctcctcagtctaagccaat

SEQ ID NO: 42420 - DNA, 201 bp, Homo sapiens
gtctggggcatgagatggggtggtggggaggagagagacagtctctcctctacccacctgtctcttctgtgcaggtggtttccgagcaggtgaagcacatktaaagggggaggttctaaactggtcacagtcccattgaaaaagcccatgggaaatgaaaagcccacacactcgcccattccattgccacaggcagggggc

SEQ ID NO: 42421 - DNA, 201 bp, Homo sapiens
agcagatgactggagacagaaaataagagtccatcatcttatttaaatagattaaaggaaacacaaagaccgcaatggaaaaattgcaaaagatggaaagrgaagaaatagaaataataaataaataaatgtagtggtttgagtcagaaggttcgatctcattagttaccaataaaatgtacattggaaggacaataagat

SEQ ID NO: 42422 - DNA, 201 bp, Homo sapiens
ctccagctttctccacctggaccggatcagttgttctcccttactcccctctaggatccagaattcctggtttgactatcaaaagtaacactacttataaktatttataggatacatcattgactctcacattcactttattataaaatttctttttctataacaactctaggtacttttattgttattaggccattgttc

SEQ ID NO: 42423 - DNA, 201 bp, Homo sapiens
agaattcctggtttgactatcaaaagtaacactacttataattatttataggatacatcattgactctcacattcactttattataaaatttctttttctmtaacaactctaggtacttttattgttattaggccattgttccttactctttgttttcttgtattatcacatcagtcagcgaccaaatcctgttcattcta

SEQ ID NO: 42424 - DNA, 201 bp, Homo sapiens
ggatacttgagcagagtcttggacgagtggatttgatttggagtgagaagaaaactagagagagaacagcaagcgtaagagtatagtcatatatttaaatrcgagtatgtgtggtaggcgttggagatgaggggataaataaaatagaatcaacaggcatgatgatagaagaggtcattgctggggtagagcatataaagg

SEQ ID NO: 42425 - DNA, 201 bp, Homo sapiens
tgttgactaagaacagaaattcgttttttggtgggggatattttgcgacaagcttgtcctgatgccctctttctagttagtaaaatggagtctcactggtygtaaacagtgatagcactgagggagaataccgcctactaacctgttgactgaattcctcacagacctcctgcttgtcacaattaagaacacgagataatt

SEQ ID NO: 42426 - DNA, 201 bp, Homo sapiens
gcctacctactttctatatataagtacttgttctaaaatcctaattttctctatttctttgacgtgtgactctttgacatcaatctgtagttttctatgcwttctaggttttcttctggatggttcattacatgtggagaatatgaggctcctgggttggtgtggaagaggcagggctcagctgtttaatatcttctgttt

SEQ ID NO: 42427 - DNA, 201 bp, Homo sapiens
gggggatattttgcgacaagcttgtcctgatgccctctttctagttagtaaaatggagtctcactggttgtaaacagtgatagcactgagggagaataccrcctactaacctgttgactgaattcctcacagacctcctgcttgtcacaattaagaacacgagataattttctacacaggctcacagttgcaagtcctggg

SEQ ID NO: 42428 - DNA, 201 bp, Homo sapiens
aaacagtgccaaaccatctaacttccctccaccagcaatgagagaaagcgttttaaactgaaatgatttagtagctatactgattggtttgacttggtttrataaaaatgatctgtgcaagctggttccatgcccatagcatcagctggggttccatggcaacaaaaataattactcatctgcaaacagtctttgtaacag

SEQ ID NO: 42429 - DNA, 201 bp, Homo sapiens
gtatacaaattctgtgttatcgctcagcctacctactttctatatataagtacttgttctaaaatcctaattttctctatttctttgacgtgtgactcttkgacatcaatctgtagttttctatgcattctaggttttcttctggatggttcattacatgtggagaatatgaggctcctgggttggtgtggaagaggcagg

SEQ ID NO: 42430 - DNA, 201 bp, Homo sapiens
actgaattcctcacagacctcctgcttgtcacaattaagaacacgagataattttctacacaggctcacagttgcaagtcctgggacaggcttcccataartgtatctggtacatgagaaataaatcaggaattgagaatggctgtttgcattttccactaccactcctccacagaactgtccctctttagagttgcctac

SEQ ID NO: 42431 - DNA, 201 bp, Homo sapiens
aaaatgtttcttattgcacttagaagggtgcctggctcttagctgattatctcctggatctggaaaggaaggaaggaaaacaaagcggggaaaggggattytctacagaatgtggatttttcccacaagagactttgcagggcaatttcaaggtatggcaaggaaatatattttggttttctttctttgccagtatcagat

SEQ ID NO: 42432 - DNA, 201 bp, Homo sapiens
ttaagagatgaacagcctaggaactaccaattcagtgtctctggaacaacctggaaatttgattccagttaactcaggttttccattccttatataaatgrtgaaatataaattgacttaatcatatagaaataaaatgctgcatagaattgaaaacacacgtacaagaaagatgcataccttgctatcactgacctatct

SEQ ID NO: 42433 - DNA, 201 bp, Homo sapiens
ttgccaaatatgccactaccgcctacgtgccatctgaggagatcaacctggttgtaaaatccactgagaatttccagcgcacattcaacatacagtcagtyaacagattggtatttcagcaggataccctgcccaatgtccctggaatgtacacgttggaggcctcaggccagggctgtgtctatgtgcaggtaagtagag

SEQ ID NO: 42434 - DNA, 201 bp, Homo sapiens
agaatcgcttgaacccgggaggcggaggttgcagtgagcgtaaatcacaccactgcacttcagcctggtgacagagctagactccatctcaaaaaaaaaamaaaaaaaaaaacttaggacactgagcaagaatcttttctatgctttggcaaattgtcatcctcatttctaagtttggatcaccttccaacattttatcct

SEQ ID NO: 42435 - DNA, 201 bp, Homo sapiens
acaatgctttataattttcagagtacagatggtccttgacttgtgatggttcgtctagacttttttatttaacaatggtgttaaagcaataccatttagtrgaaaccatactttgagtacctatacaactgttctgtttttcattttcagtacagtagtcaataaattacatgagatagtaaacattttattataaaatag

SEQ ID NO: 42436 - DNA, 201 bp, Homo sapiens
gactaatactctatccacacccactcccctatttaaccagtgtgtcccctctaagaatctttatcctcatggttcacatggtgtattagtctgttctcacrctgctaataaagacatacccgagaccgggtaatttataaaagaagtttaattgactcacagttctacatgactagggaggcctcacaatcatggcagaag

SEQ ID NO: 42437 - DNA, 201 bp, Homo sapiens
tgggtttacaggcgtgagccattgcacctggcctaggagttcttatatattctagatatgagcttctttgggttacatgacttacacaaattttttttttyctactttgtggcttgccacaaagcaaaactcaaaatgttttccacagccattcttccattttaaattcctaccagcagtatataacagtcctgattaatc

SEQ ID NO: 42438 - DNA, 201 bp, Homo sapiens
tgggaggccgaggcaggtggatcacctgaggtcaggagttcaagaccagcctgaccaatatggtgaaaccctgtctctactaaaaatacaaaaattagccrggcaatgtggcatggacttgtaatcccagctactctggaggctgaggcaagagaattgcttgaaaccgggaggcagaggttgcagtgagcccagatcatg

SEQ ID NO: 42439 - DNA, 201 bp, Homo sapiens
ccaaactcccaacctcaggtgatctgcccaccttggcatcccaaaatgctgggtttacaggcgtgagccattgcacctggcctaggagttcttatatattstagatatgagcttctttgggttacatgacttacacaaatttttttttttctactttgtggcttgccacaaagcaaaactcaaaatgttttccacagccat

SEQ ID NO: 42440 - DNA, 201 bp, Homo sapiens
agtggggaacagaagtctccccagagcaaaataggagtactctaagatgtggttgcaaatcagcacaccccacctatctctgtttgactactatttatgcrttctcagcagacataaatgtgttaagagtagtagatcggccgggtgcagtggctcacgcctgtaatcccagcactttgggaggccgaggcaggtggatca

SEQ ID NO: 42441 - DNA, 201 bp, Homo sapiens
tagccaaattcccaaacaggtcacttaatcttcaagagtcacgataatgagtttccctctgctttaatcctttcacacacagaaaaagtagccccaagaarcctgatgttaactaatcagttatttttctgttgttctatctccttgtctcatcttacaagaaaagtcactttgaaacaatggacataatctttgcttctt

SEQ ID NO: 42442 - DNA, 201 bp, Homo sapiens
gcagtggacaagaatcctcaacaaaaggaatgcctgctaaaagtgacagtagctgttccatggaagtgctagcaacctgtctttccctgtggaaaaagcarccttcagatactgcaaaagaaaaggagtgtgataaactcagaacaaacacaacagcagttggaatttcaaagcctgctaacatccacgttaagagtcctt

SEQ ID NO: 42443 - DNA, 201 bp, Homo sapiens
ggctcactgcaacctctgcctccctgttcaagcgtttctcctgtctcagcctcctgagtaactgggatcacaggcacctgccaataatattctttataatraactgataaatgtagatatgtatttccctgagctctgtgagcagctctagcaaataaatcccccaagaagggggtcatggaaccgtgatttatagttggt

SEQ ID NO: 42444 - DNA, 201 bp, Homo sapiens
cctcctgagtaactgggactacaggcacgtgccaccatgcccagctaatttttgtattttttgtagagatggggtttcaccatgttggccaggatggtctygatctcttgacctcatgatccgcccaccttggcctctcaaagttctgggtttacagacgtgagccaccgtgcccagcctttttactttactttattttat

SEQ ID NO: 42445 - DNA, 201 bp, Homo sapiens
gaggaagggagaaggaatgactataaacaacaagcaccatcctccacagattcaaggaagaattaaaaggggtagtaaggtggtctctctagagaggcaaygttttacttgagatttgccaagaaattgtcagacttgtgaaatctgcggactagcaatccgtggggtgggtaaggaagagcaaatatactgcttagaggt

SEQ ID NO: 42446 - DNA, 201 bp, Homo sapiens
gtcagagagacctgccccaggagttctaattctaatcaccataacagctattatttattgagcccttcctgtgtgctgaatcttgttccaagcctttacaratagtgtcttgttccatcccccagtgattctatggctatatactaaaagcccacagtcctttatctgcaatttggaagcccaaaaaactctgaagccaaa

SEQ ID NO: 42447 - DNA, 201 bp, Homo sapiens
agtcagcccatgcaggtgtgtaataaattccattgtaaaggatatgtccatcttcaagacacggcactttaaggccatcttctaagttaagtcctctgaartaatagccatgtagttcgctggaatgtagctgactatacacctagatggtagaagagagtcaactgtattttttcatagaaaacaattcatttttcccca

SEQ ID NO: 42448 - DNA, 201 bp, Homo sapiens
tagtcctggttcctttctgtaccacacagatcaatctggccaccacatcggccgcccagctcatcagccgatcccagagtgtgagctctcctagtgctacyaccttgacccaatctgtgctactggggaacaccacctccccacccctcaaccagtctcaggcccagatgtatctacgggtaagccacagatgcagtcacc

SEQ ID NO: 42449 - DNA, 201 bp, Homo sapiens
aagacagcaagggtcttttattccacattgcatacagtgtaattttcattttacttctaaggtactgtttcatctgtcttccccacagctcattaagaacrctcagacttacaccttcaccatcagccaaagtgtgctggtcaccaacttgaaaccagcaaccatcaaggtctatgactactacctaccaggtgagagggc

SEQ ID NO: 42450 - DNA, 201 bp, Homo sapiens
ttgaaacatttgcatttctgtctacctggtcccttcagaatttggaaaccatttgtgattaatcttcttttatggcaatatagtcatttgcataagttcartaacaatttgctgtctttgtaggaagagacattagacccaacaaaactccttagaatccctagcatgtgaaagattagataatagaagagtttcagatta

SEQ ID NO: 42451 - DNA, 201 bp, Homo sapiens
ccaaatccttagtcctggttcctttctgtaccacacagatcaatctggccaccacatcggccgcccagctcatcagccgatcccagagtgtgagctctccyagtgctaccaccttgacccaatctgtgctactggggaacaccacctccccacccctcaaccagtctcaggcccagatgtatctacgggtaagccacagat

SEQ ID NO: 42452 - DNA, 201 bp, Homo sapiens
gaaattcatgaaaaaaaaccataacaagcattcttgaatacagattttttataatttttgagatcataccattggactaggtaaaaacttccagaactctratgagtaaactaaagtgttcatgaagattcctaatccgacatcaagaaaaacaagaattaattacatgggactcaactgatgaagaattgaaatttttta

SEQ ID NO: 42453 - DNA, 201 bp, Homo sapiens
ctccggtttcttccctcacatacctgtctgactagttcctagaagcctggcagaaattgttctccgattttaatctggctgccacaaatgaaagaccttgragtccaaatactcctctctcaaagcaaaatctaaatggatataatttataagcaaagataacacttctgtttttttctctataaacaaaccatgcatggg

SEQ ID NO: 42454 - DNA, 201 bp, Homo sapiens
ggctggctaatttatttttatttttttgtagaaatgaggtctcactatgttgttcaggctgctctggaactcctgggctcaagtgatctgcccgctttgaycttgcaaagtactaggattacaggcataaaacacgacatgcagccccaaatttgctgcttcttcaaggaaattcatgaaaaaaaaccataacaagcattc

SEQ ID NO: 42455 - DNA, 201 bp, Homo sapiens
cctcagcctgtagctgggattacaggcatgcgccaccacacccggctaatttttgtgtttttagtagagatggggtttccctgtgttggccaggctggtcycaaactcccaacctcaggtgatctgcccaccttggcatcccaaaatgctgggtttacaggcgtgagccattgcacctggcctaggagttcttatatattc

SEQ ID NO: 42456 - DNA, 201 bp, Homo sapiens
aggtattgcagacggtggaccattataagactgagatagagaggctaaccaaggagctcacggagaccacccacgagaagatccaggctgccgagtacggrctggtggtgctggaggagaagctgaccctcaaacagcagtatgatgaactggaggctgagtacgacagcctcaaacaggagctggagcagctcaaagagg

SEQ ID NO: 42457 - DNA, 201 bp, Homo sapiens
ttaccatctgctatacctttgtttatttttaaatgatgtttaaaaattactttagaaattattttaagcagaaaaaattgtgtatatttaccatgtacaaygttttgaaatatatattcattgtagaatggttaagtcaagctaattaacatgtacattacttcatatagttgtcatatggttaaactctactccttagca

SEQ ID NO: 42458 - DNA, 201 bp, Homo sapiens
tgggtgaaggaagaaacgaaagatctatgaactagggaccatgctaaatctgtctagtcactttactactggagaaaagcacgccctatcagaattgtcaraacttcatgtaaatagacaagaattaaacaggatcattaacatatttatattctctttccctgagactggagatggggactgaagcctgttcagatggca

SEQ ID NO: 42459 - DNA, 201 bp, Homo sapiens
taaatgagaacaggaattggaatgagaccagaaaaaaagggaggagttcaaaatatgttctgagagctttaccattatgaatactcagctctggttttccyccaaaactggctgaaccagtatggatgttccaggcagaaacaactttaaagaagtgaatagtggccctaccctggtccaccacctaacctggtggttaca

SEQ ID NO: 42460 - DNA, 201 bp, Homo sapiens
aaagtcctaatgtttcattacagtgatctggcaaaaataaacatgtcatgtaggattagtaatgaatgaatgaataatgaggaaacagaataatacaggaytaagacaaatatgaaataaaaaaatgagttctcctttaagcaaggaaccagctttaattaaagggaaaccctgaagcaaaccacttgggtcttaaaatac

SEQ ID NO: 42461 - DNA, 201 bp, Homo sapiens
ttgataaatttgttcagtaagtttttgttttgttttgtgttgttttttcttttttttgagacggagtctcgcaccgtcacctgggctggagtgcaatggcrtgatctcagctcactgcaacctctgcctcccaggcttacacgattctcctgcctcagcctccatagtagctgggattacaggcacacaccaccacaccca

SEQ ID NO: 42462 - DNA, 201 bp, Homo sapiens
gttccagggcagctcccctcctggaatagaatctttctttccatcctgcatggctgagagccaggcttcctgcttggagtccgcaggaggctgtggcagcwgtggcatccactgtggcatctccgtcctgcccaccttaagaggtgagatggagcaggtccatctgcctctgccctttctagccaaggttatagctgccct

SEQ ID NO: 42463 - DNA, 201 bp, Homo sapiens
ggaagttgaatgataaatgtgaatccaatgacgccatacccctgcggataatggcaggctggatgtagcatgttagccgtcatattctgtgtgctccctgygatgtgggcacttcccttccatcgtggtgaggccaaagcaaaggcacagagacctgaacacaaacatgaaaaacaccttaccacctgggagtcaggggca

SEQ ID NO: 42464 - DNA, 201 bp, Homo sapiens
tttcttggctctggttaagattgtttcatttttctttcactcacctgtctcatagtaatcatagactttaacaattgctggcttcaagtctcctactgggwtgtcttgcagaaccatgaaggaaaaacttagcgtctgatttgtcacctgaaaggaaaagtgggagtaatcaagaacctagaaaacctccttctttctccc

SEQ ID NO: 42465 - DNA, 201 bp, Homo sapiens
tggaaactttcctaacaacaaacacctaaagacctgcagagttgcttttatttttgttaccccagctccacgccttaaccctcactttgaaataggatgtrtcaaccctattttgcagatgaggaaagcaagggtcagagaggttagacaactcttccagagtcacacagctgggaagtagcagctccaggagcagaagct

SEQ ID NO: 42466 - DNA, 201 bp, Homo sapiens
ttctcagtattacttttcttttttttttcagagtcagaggttccggttgagatcaagttgggagacacacccttgttcattctccttgagaagcagctatwatcaacagaacattgacagaacctgtgtttggggaaaggactgatggctttgagtctaggttggaaagcacacaggaaccactgtggtctcctcttgcag

SEQ ID NO: 42467 - DNA, 201 bp, Homo sapiens
agtaatcatagactttaacaattgctggcttcaagtctcctactgggatgtcttgcagaaccatgaaggaaaaacttagcgtctgatttgtcacctgaaasgaaaagtgggagtaatcaagaacctagaaaacctccttctttctcccatgagcaaaacatattcttattgttctttgactctttttcaccagtgtcttta

SEQ ID NO: 42468 - DNA, 201 bp, Homo sapiens
aattgcttgaaaccgggaggcagaggttgcagtgagcccagatcatgccattgcactccagcccagacgacagagcaaccctccgtctcaaaaaaaaaaaaggtagatcacaaccttctttgactaatactctatccacacccactcccctatttaaccagtgtgtcccctctaagaatctttatcctcatggttcacatg

SEQ ID NO: 42469 - DNA, 201 bp, Homo sapiens
cccagagttcgaggctgtagtgaactatgattacaccactgcactccagcctgggtgatagagtgagaccctctctctctcaaaaaaaaaaaaaaaaaaaagatttatatgtattatatatgtataaatacatagcctaaatatcaacttttacttaaattatacaggaggtatttcattgtcaaataagaaataacgttt

SEQ ID NO: 42470 - DNA, 201 bp, Homo sapiens
aataaaaaaaaatctttaggggtggaatgtaactatatgcagtagcggtaattctgctccatttgtaaggagggtgaaatgcgatatggtcatgtaccctyttggtacacaagttccataggctatagaaaaacaagtccataccctctgatatctgcattccttattcttgttatagcttacaaatcttctttagacact

SEQ ID NO: 42471 - DNA, 201 bp, Homo sapiens
cttccccactgcaccatacccacagagtgtgaaagtaggtattgtatgtaaattgtattttatgattttttggggtcattgttaacttttttcagttatcytggcagaaataagaaaattcttttttgctattccatatatctattgtgatatcagagtctgttgtttgtttgtgtgtttgtttgtttaagacagtcttgc

SEQ ID NO: 42472 - DNA, 201 bp, Homo sapiens
aagtattcatcgcttatcccctaacattatctagtagctataggagccggtgacctagtaaataataaaaaaaaatctttaggggtggaatgtaactatawgcagtagcggtaattctgctccatttgtaaggagggtgaaatgcgatatggtcatgtaccctcttggtacacaagttccataggctatagaaaaacaagt

SEQ ID NO: 42473 - DNA, 201 bp, Homo sapiens
tttcatttcactaccagagataaagtaaaaaatgcatgtttttgcttgaagtaacaacctagttgaaatgcagtcagtcagcaagtataaaggaaaggtgrctggatgctttagtgtgggaaaggttgtttgctcggtggaaaaggttggagagagtcagtcacagggcaggagcagtgaactcaaatgaccacaagcagc

SEQ ID NO: 42474 - DNA, 201 bp, Homo sapiens
accttaatgccataatccgggaccaaatcaagcatctgcagaaagctgtggaccggtccttgcaactgtctcgtcaaagagcagcggctcgggagctagcycccatgattgataaagacaaggaagccttaatggaagagatcctcaagctaaagtccctgctgagcaccaaacgggagcagatcgccacattgagggcgg

SEQ ID NO: 42475 - DNA, 201 bp, Homo sapiens
aggtatgcatgcagcgatcttcatagtacggtgcagtggccagattttagttaactgcaaaaataaatgtgctcttgttgtggaggatggaggaggggaavcaaaagaaaaaatgggagctggcatataaatggtcttgctaatgtgggtctttccagatcaaaacctttttgataattgtgtttatgtagtcctttctaa

SEQ ID NO: 42476 - DNA, 201 bp, Homo sapiens
ggtatgcatgcagcgatcttcatagtacggtgcagtggccagattttagttaactgcaaaaataaatgtgctcttgttgtggaggatggaggaggggaagsaaaagaaaaaatgggagctggcatataaatggtcttgctaatgtgggtctttccagatcaaaacctttttgataattgtgtttatgtagtcctttctaac

SEQ ID NO: 42477 - DNA, 201 bp, Homo sapiens
agccaacaagcaggtaatctcattctactggtgaaagcatgccagtcaaagctttcttaactaatttattccctaattttattgagtatcgagtatcgtcragatgagagttcagattcttggtaagtggataaataaaactgtcccagtgccagatcagaatgtcataataattattgtttttaaatgatgaaatacctg

SEQ ID NO: 42478 - DNA, 201 bp, Homo sapiens
gttttcacagtttcagttaccagctgatctgagaagtgcctatcagccttgatgaccttgactcaaaagggaccctgttgtcatcaaggagtttgtaattrgacagcagattgtatgtcttcacaaaattgttgcctattttttagccagcattttatcttgactccttaactacctaggcctatatccttctcctcctcc

SEQ ID NO: 42479 - DNA, 201 bp, Homo sapiens
tttcacagtttcagttaccagctgatctgagaagtgcctatcagccttgatgaccttgactcaaaagggaccctgttgtcatcaaggagtttgtaattggrcagcagattgtatgtcttcacaaaattgttgcctattttttagccagcattttatcttgactccttaactacctaggcctatatccttctcctcctcctc

SEQ ID NO: 42480 - DNA, 201 bp, Homo sapiens
cacctgaaaggaaaagtgggagtaatcaagaacctagaaaacctccttctttctcccatgagcaaaacatattcttattgttctttgactctttttcaccrgtgtctttaggtgaccagacatttgtggatgtcaagatgggttttagaatgcatccttgggaactctatttacagtcaacaaattttcacagattttctt

SEQ ID NO: 42481 - DNA, 201 bp, Homo sapiens
ctttgctacattccaggctgactccaggcagaacagggcattgcgaacaatagggttctgtaaaggcaaaatgtggttgtgtcaaactagggtgaatagarggcagagcaagccgagagctggatattgacagtcagatgttattaatagatttcagacagataggcagacagctagatattcatcatatttaaatagaaa

SEQ ID NO: 42482 - DNA, 201 bp, Homo sapiens
ctaaaaatacgaaaacttagccgggcgtggtggtgggcatctgtgggcccagctacttgggaggctgaggcaggagaatcacttgaacctgggaggcggargtttcagtgagccgagattgtgccactgcactccagcctgggcaacagagcgagactcttgtctcaaaaaaaaggaaaaactgtgactagttcttgttta

SEQ ID NO: 42483 - DNA, 201 bp, Homo sapiens
tccttctctgtagaaagtgtaatactctttccctgatgccatcccacatcatccaggacttcatctttgcaatttccttgtgcctccttcctcccttcacycctgggggatgttatgttgatgtgtgtcaggctcagaagtttgtggaacagttcacctttatggcattgttgagcagtgacccagagctcctgaaacagc

SEQ ID NO: 42484 - DNA, 201 bp, Homo sapiens
caattctcctcctcagcatctagagtagctgggattacaggcgtgtgccaccacgcccagctaattttttttgtatttttaatagagacggggtttcaccrtcttggccaggctcatcttgaactcctgacctcgtgatccacccgcctcggcctcccaaagtgctgggattacaggcgtgagccactgcgcccggcctta

SEQ ID NO: 42485 - DNA, 201 bp, Homo sapiens
cttcagtacaaaagctgtgagcctagggggaggaaaaatgcagtgctgaggctcttttcattgagcactttactgctctgttttgtacacacaggctcccscatcacagtgtgcacccaagaaagtcaattagctgttactgagagtttggagactttttctttttagcttagacatctctttttcttttttcttttcttt

SEQ ID NO: 42486 - DNA, 201 bp, Homo sapiens
ttcaagtgattctcatgcctcagcctcccgagtagcttggattacagctgtgcaccaccacgcctggctaattttttgtgttttttgtagaaaggggtttygccatgttggccaggctggtcttgaactcctgacctcaagtgatctgcctgcctgcctccgcctcccaaagtgctgagattacaggcatgagccactgtg

SEQ ID NO: 42487 - DNA, 201 bp, Homo sapiens
ctgtgagcctagggggaggaaaaatgcagtgctgaggctcttttcattgagcactttactgctctgttttgtacacacaggctcccccatcacagtgtgcmcccaagaaagtcaattagctgttactgagagtttggagactttttctttttagcttagacatctctttttcttttttcttttcttttctttttttttttt

SEQ ID NO: 42488 - DNA, 201 bp, Homo sapiens
cacactgaatatgttttctcctctgtaaaatgaagctaataactctcacttcccagggtagctataagaattaaataaggtaacattatggtttagaaatkgtttctccaccaaaactcatgttaaaacttaatccccaatgtggtagtattgagaggtggagcctttaagaggtgattggctcatgagggttctgctctc

SEQ ID NO: 42489 - DNA, 201 bp, Homo sapiens
tggcacagagaaacactgctggccaggtgtggtggttcacagctgtaatcacaacactttgggaggtcgaagcaggaggatcatttgaggccaggagttcragaccagcctgggcaatataatgagactggcccatcactacttaaaatgtaaacatttagctggggatggtggtgtgctcctctagtcccagctactggg

SEQ ID NO: 42490 - DNA, 201 bp, Homo sapiens
ggagaatggcgtgaacccgggaggcggagcttgcagtgagccgagatcacgtcactgtactccagcctgggcgacagagcgagactccatctcaaaaaaawaaaaaagaatagcagctatcaagaacttgataattcaaatacaaatacgtagataagatgtacagtggcaactcttttggcccaggtttactaaatggaa

SEQ ID NO: 42491 - DNA, 201 bp, Homo sapiens
ttttgtgctttaggaagaaggggtattaggtccaggagatacaagaaattagtcattagaaatattattggccgggcgaggtggctcacgactgtaatccmcgcactttgggaggccgaggcgggaggatcacctgaggttaggagtttgagactagcctggacaacatgatgaaaccccgtctctctactaaaaatgcaa

SEQ ID NO: 42492 - DNA, 201 bp, Homo sapiens
ttgcccaggctggagtgcagtggtgcgatcatggctcactgcagccccaacctcctgggctcaagtgatcctcccaccttagcctcctgagtagctgggaytacagctgcatgacacaacacccagctaattttgtattgtttgtagagacggggtctcactatgttgccaccgaggatggtctcaaactcctaggctcaa

SEQ ID NO: 42493 - DNA, 201 bp, Homo sapiens
ttccaggcagcctcagtgagagcaccctgaagtttttgctcctgaatccagctgtgcactttgcccaagtggtgaaggaatgccgggcagtggtcattgcsgggggtaccatgcagccggtaaggacacctttcccagcccctcgtgccccaggtgttgggatgagatggggacttgggagagatgcattatcagtcctgt

SEQ ID NO: 42494 - DNA, 201 bp, Homo sapiens
gtctgttgggcttgcactcacctcccaccgatctgtttttccaggcagcctcagtgagagcaccctgaagtttttgctcctgaatccagctgtgcactttscccaagtggtgaaggaatgccgggcagtggtcattgcggggggtaccatgcagccggtaaggacacctttcccagcccctcgtgccccaggtgttgggat

SEQ ID NO: 42495 - DNA, 201 bp, Homo sapiens
gccggtaaggacacctttcccagcccctcgtgccccaggtgttgggatgagatggggacttgggagagatgcattatcagtcctgttctctcctggggccscaagccagaaagggtcagctcgagcaggcccagtggtgtccactgggtgacactgctattctctcactgctgtgccttttaggctgcaggagcagtgcag

SEQ ID NO: 42496 - DNA, 201 bp, Homo sapiens
gtgatattttgctttttactgatctttaaagcaactcacagaagtgtattagccttagatacgtaatcaccccttgagatatatagtcaacagtacacacygacatgttcatagtaaaaactgcctttatgtttcactgcattcaagcaagtagatatttgtttgtttcacgtattgcaaagcctatgttcttaagcatgt

SEQ ID NO: 42497 - DNA, 201 bp, Homo sapiens
tcagcactacaacctggtgcaggacttcgaagtaatagaaagcgaggctgcaaaggtggacagggacctgaagacagagggccaggttagtgagagcagacttaccacgggcatagcttagcagttttaagaataggatcagattttcatttgataaaatcaccctgatgacaaggtggagagtggattagatgtgggtaa

SEQ ID NO: 42498 - DNA, 201 bp, Homo sapiens
atcatcgtaccaccttgagttaactctgtgccagctggccttgctcttgagaaggtcatttctaaacagaaggttattttttgaaagatttttaactggtrtaagaatctggcagcagaatgtacttttacctcttggtgccactgtatttaattaccctctccccatttatcctccatgtctttcctaccataagctatt

SEQ ID NO: 42499 - DNA, 201 bp, Homo sapiens
attacttgccatttttaaaggaatgccttataagttatagtcttcatcttcactttttaggacccaatggtgagtcagggtctatggtgtctcaagaattyggccacctccacgaccaacctctacacacaggccctgttggcttacattttctccctggctggggaaatggacatcagaaacattctccttaaacagtta

SEQ ID NO: 42500 - DNA, 201 bp, Homo sapiens
tgattaattgcccatttaaagaaactaggaattctagaagagctgcataccaaaagaaagatcacaaagcttagcaagctagaacagaaacactccaaaakagcttcctgtgatgatgaaaatgttctctatctacaaggtccaatttggtagccacaagtggctcctgagcacttgaaatgtggccagtgttattaagaa

SEQ ID NO: 42501 - DNA, 201 bp, Homo sapiens
gacattaatcaatatgtgtaagatgtgcattggttcgttctggtaacgcgggataacttgaggcaagggcttccaggtcccacataggtaagagacaaaargttgcattcttttaaatccttgatcatctttccactgaatacacaatttaggctggctcagtgaatctgcatttttacataaacaatagggcaggggaag

SEQ ID NO: 42502 - DNA, 201 bp, Homo sapiens
gcaaattgtgagggaggtatgtagcttttttttgagacggagtcttgcttattcgccaggctgaagtgcagtggcgccatctcggctcactgcaatctccrcataccaggttcaagcgattctcctgcctcagcctcctgaataactgggattacagtcacgcaccaccacgcccagctaatttttatatttttagtggag

SEQ ID NO: 42503 - DNA, 201 bp, Homo sapiens
tttgagatggagccttgctctgttgcccaggctggagtgcagtatgcgatctcagcactttggggcgggggcaagatgaacagatcgcttgagttcaagasttcaagaccagcctgggcaacatgtctaaaccccatctccacaaaaaaatataaaaattagctgggcgtagtggtacccgcctgtagtcccagctactca

SEQ ID NO: 42504 - DNA, 201 bp, Homo sapiens
taaacatttttacatataagaaatggtggtccgtacagggatacattttcctctggggtggtctctagtcctctcatgagggggtctcccactgcctcatygtggtggcctcaggggtagtaagaaattgagacccatctggtgtgatgaatagacccggactctcaacaaggcagaagaaactggccagcaatctggagt

SEQ ID NO: 42505 - DNA, 201 bp, Homo sapiens
cagtaccctgagggtcagccccccgagggccattcagcctccatcttccaagaccaattttacctcgtgtctccaacgataaaaggaaaatttagcgtacyttgaagacttaacatgatacagcgaggtcaggcacttccaaaagctaacccatcagtccacccttattcatccccaagcggatgcatagtaatactgtaa

SEQ ID NO: 42506 - DNA, 201 bp, Homo sapiens
caagttctatttctttttatatttatcatttatattaatatgtttgagattgtgtgtgtatatgtgtacatgcacacatacactcaatatgtgcaaatgtrtatgtagttttacatgttttttatcattattttataaagtttttgtaaaaccttataaaaacttatttttaattgctacattatttctcatataaatatg

SEQ ID NO: 42507 - DNA, 201 bp, Homo sapiens
tcttgttaactgaaatattccactctgtcaatgggattaatggttggagattatgatacaaccaaaaccaaagctgggcaatgggctcttggactggaatyacccattatgaactatccatctgaccaactctttaactttcttcctaaacgtcagatcaccagggcgtttcagtgcagcctgcacaattcagagagtagg

SEQ ID NO: 42508 - DNA, 201 bp, Homo sapiens
catcaacatgtgtgtgaaaattttggttgatatatgaaacattcagaatttgaatcagatgaacccaatgaaaagccctcagggaaaaaatgattgtattracattgtatagttggcaatcaggtaacaattcgaatgagacagtgatatccattggggtctggcttcttagagagcattacctgttccgttctctgtaac

SEQ ID NO: 42509 - DNA, 201 bp, Homo sapiens
tatattgtcttgttaactgaaatattccactctgtcaatgggattaatggttggagattatgatacaaccaaaaccaaagctgggcaatgggctcttggamtggaatcacccattatgaactatccatctgaccaactctttaactttcttcctaaacgtcagatcaccagggcgtttcagtgcagcctgcacaattcaga

SEQ ID NO: 42510 - DNA, 201 bp, Homo sapiens
agtactgcttgtcatttctatcatctgatacatctatacttccaaataatcctaactgatactcaaagtgatgccttgacaccctctgaggttctacaggmtcttccaaatcaaagagaggtcacatcatgcatagtattatttgggggttagcatacgttttgtaataattatgttaaaattggtaatccctttttgggt

SEQ ID NO: 42511 - DNA, 201 bp, Homo sapiens
tctaccagtttcgtgtcccagtttgccacctgtaaacatgtgaacactggcactggcatggatgcctggggcaactagcgcttcacctatgatgggggctrgcgctctaccagtgatgggggccttattacagccagccaggtgcagcaacaacatcctattttagagtcagttcctaggaccacatccagtaccagctgt

SEQ ID NO: 42512 - DNA, 201 bp, Homo sapiens
cacatgaagaatccaccaatggacaaatgttgtcaaaccagagatgactagaaagcactgggtagatagcataagcgctgctggtaaattggcttaaaackaaaataaatgtgggattgttgttattaaacagaacaaatataaacattaagaaacataatataattaacaaaaattgagaagttgtagagagaaaaagga

SEQ ID NO: 42513 - DNA, 201 bp, Homo sapiens
ttattgagccacctgcacaatcaaacatctcggcatggtaaaatctcagcttgcttctaggtatctgcctggtccttcaaatcatcacagggttttcttarctatacactacatgtcagatactctgaccgccttctcttcagtcactcacttctgctgagatgtaaattattgctgaattataattatgctacatgctaa

SEQ ID NO: 42514 - DNA, 201 bp, Homo sapiens
acaacttcaaagactgaaggaatatcagcctataaaaatgagaaagaaccagcatgagaactatgacaactcaaaaagccagaatgtcttctttcctccaratgactgcattagctttccagcaagagttcttaatcaggctgatatggctgaaatgacagaaatagaattcagaaatatggataggaatgaagatcactg

SEQ ID NO: 42515 - DNA, 201 bp, Homo sapiens
cttcactttcttcctttcctccccacccctcactgttcaacagataacctgagtgcattcagtttgtaaagcacagtgctggggccgtgaaagccagagaygaatcagacaacacacaaccactctcaaagagattcagggatcccaggagggaagaaaggaacatcagtaagcacaacgccccgcaagcctgggtttcac

SEQ ID NO: 42516 - DNA, 201 bp, Homo sapiens
tggcatgactgatgcatgatttctaagctgtgctgggctaagcagacgtgcaattgaacaggattccaggaacccactgactgagacttaccaaatagaakaactttacattggaatcatcctcatatgcttcactgtttagggagtaatgcacagtaacaaccttctggtgattacattcaagctgctttggttctggaa

SEQ ID NO: 42517 - DNA, 201 bp, Homo sapiens
tggggccgtgaaagccagagacgaatcagacaacacacaaccactctcaaagagattcagggatcccaggagggaagaaaggaacatcagtaagcacaacrccccgcaagcctgggtttcacatctgtttagcagcagcatgaccttaaggaggtcactaacaggtcaacgcctcagcttcttccactgaaaaacaggaat

SEQ ID NO: 42518 - DNA, 201 bp, Homo sapiens
ccaaggctcgcagaaccctgttctcttgttatgtaagtttcagtacgttcagtacgtaggcatgattgattaaatcatttgcctttggtgatcaacttaamcttcagcccttctttgctccctggaggttgaggggtggggctgaaagtcccaattcttattctgacgttggtttttgaggtaaccagaccccactgaagc

SEQ ID NO: 42519 - DNA, 201 bp, Homo sapiens
aaagaaaagacacttcagccttaattcacttgctttctttccatatctctgcctatatttacaacaaggcttattttttattttattttatttttttttttgagacaaagtctcactctgttgcccaggctggagtgcagtggcacaattttggctcactgcaacctccacctcctgggttcaagtgattctcctgcctca

SEQ ID NO: 42520 - DNA, 201 bp, Homo sapiens
cagtggtcattgcggggggtaccatgcagccggtaaggacacctttcccagcccctcgtgccccaggtgttgggatgagatggggacttgggagagatgcrttatcagtcctgttctctcctggggccccaagccagaaagggtcagctcgagcaggcccagtggtgtccactgggtgacactgctattctctcactgctg

SEQ ID NO: 42521 - DNA, 201 bp, Homo sapiens
gacaagagggaggcctcctccccattctgctctgtgcagctcttgcagcccctgcagacgagagtcaggccagcgtcccgcaaccagcttccccactgatkcacatcgaaggcttcctggcagctctcactacggccaaccaggacggcagggtcatcctgagccgccaaggtaatcaggtggttcttggccaggttcagt

SEQ ID NO: 42522 - DNA, 201 bp, Homo sapiens
gggaggcctcctccccattctgctctgtgcagctcttgcagcccctgcagacgagagtcaggccagcgtcccgcaaccagcttccccactgatgcacatcsaaggcttcctggcagctctcactacggccaaccaggacggcagggtcatcctgagccgccaaggtaatcaggtggttcttggccaggttcagttcccagg

SEQ ID NO: 42523 - DNA, 201 bp, Homo sapiens
ccagagttacccacaggatgagtgagggagctggttatgaactgctgggggagtgttacagttcaggctgccagagcaaaccttgtcatggaaatcagccrggcatacactacagagtcagaagtagggatggaggcactgaagatggcaggcacaaacacagtgcaaaattttcatcatcaactctatgttttatatact

SEQ ID NO: 42524 - DNA, 201 bp, Homo sapiens
tagaagatgctcagtaaatgtttgtgaaatgaagttgaataaaatccttactctcaaaactcatttttgctatattctatacaaccaaaggtaaatgggargattggtagaagttttccttggaccggcaaacctttcccttgtcccattttaaaaaaacataaaccgaggcgggcagatcacgaggtcaggagattgaga

SEQ ID NO: 42525 - DNA, 201 bp, Homo sapiens
ccttctctactaaaaatacaaaaaaattggccgggcatggtggcgggtgcctgcagtctcagctactcgggaggctgaggcaggagaatggcatgaacccrggggacggaccttgcagtaagcagagatgcgccactgcactccagcctcggtgacagagacagactctgtctcaaaaaaaaaaaaaaaacaaaaaccata

SEQ ID NO: 42526 - DNA, 201 bp, Homo sapiens
cccaatccttgccagacctcatttaactaatagcttccttttcaaggactgcaggcagaggcagagtgcttgctgttacatgaagtgtgctccagtgctgstggcttgggacaatgaattcatgcagatctcaggcgatggcaggagaagtattggatgctcctgatcagttggtacatctgtatatgaaatacaggagga

SEQ ID NO: 42527 - DNA, 201 bp, Homo sapiens
gccgggcagtcctgcccgctgtacagagaaagtggtcgacacagcaggggaatttaaagatcacctctaaccatctcagttcttaagtggcatctttagtkgggcctaggaattaaattgacataaggcagattaacagaagaaaagcacacaagttttattaatttttacctgtacaaagggacacttacaagagagtga

SEQ ID NO: 42528 - DNA, 201 bp, Homo sapiens
aaaactatactgtgggtggtaaacaaagatggttttaatcactcacagtttgtgctggcagctgaccataattccttagtagcaataccctctggtctacmgcccaaagagcataaagagagtttgaagcagccgagacttgaagatcgacattggatcctggtaaacttttttctttagaaaaatttaagttgacctgaa

SEQ ID NO: 42529 - DNA, 201 bp, Homo sapiens
cagagaaagtggtcgacacagcaggggaatttaaagatcacctctaaccatctcagttcttaagtggcatctttagttgggcctaggaattaaattgacataaggcagattaacagaagaaaagcacacaagttttattaatttttacctgtacaaagggacacttacaagagagtgaacacctgaggaaatggccaaagc

SEQ ID NO: 42530 - DNA, 201 bp, Homo sapiens
gacttgctacatgtaggaaaggacaggtcagagagccctttctgcaattacagtctctcaagtactttcagcttgaaataatcagtacatcacatcagccrattttggggtggctcatccttaactcctgcaacacttttgcttagtggttttatcattatatattgtataaatatatatatatagtatacatctataacc

SEQ ID NO: 42531 - DNA, 201 bp, Homo sapiens
aggtgagctgagctaccggagtccttggaaagacccagtgcccttcttcttagggtcaagaaggaaggcacaaagagggagagaggctcagcagaagaggyccctaagctcccaaggcaggctgctggatgctgagagatgaggccaggtcaactgccctaggaggggaaggggaggggagagccctggcaaggaagcccc

SEQ ID NO: 42532 - DNA, 201 bp, Homo sapiens
ccttgtctcatcttacaagaaaagtcactttgaaacaatggacataatctttgcttcttcttttttttttttttttcctgagacagagtctcgctctgtcrtccaggcaggagtacagtggtgccatctcagttcactgcaacctccacctcatgggctggtccaccatgatcctcccacctcagcttcccgggtagctgg

SEQ ID NO: 42533 - DNA, 201 bp, Homo sapiens
ccctggcaaggaagcccccaaggctactgactccacaggaatcatctcctgagcctggctggggtggtgtgagcctagtgaaccacacgcgctcctttctytgctactccagcaggaactggccgctgtgaaccctcttcccacattagccggctctcacactgtgactaaagagaccagccaccacatggtcccggttac

SEQ ID NO: 42534 - DNA, 201 bp, Homo sapiens
cacgcccggcccatagtaggtacttattaaatgatagctaatacgtgtttgttcagtgaatgatgataactcttagagggtcccttcttctctgtaccccyaccttctctctctccttttggatcccaggagacattatgggcacagccctgcagaacctggatggtctggtgcagatgcccagtggctgtggcgagcaga

SEQ ID NO: 42535 - DNA, 201 bp, Homo sapiens
tttctctgctactccagcaggaactggccgctgtgaaccctcttcccacattagccggctctcacactgtgactaaagagaccagccaccacatggtcccrgttacaggggcggctggggccttgccatctggcaggacctgctgccactggcgctcgctgtctgtgagcacagggtctggtgggcaggaggtgactggag

SEQ ID NO: 42536 - DNA, 201 bp, Homo sapiens
ctgaaacctactgggaaatccagttgaaataacattcaagttttcccttactcaagtaatcactcaccagtgttgagatagccaatggccttggacttgayctctggagtaagctgctgtgtttcatttagataatccagtacatagatgttaggagcaaagaggaccatattctgctctccacagccatagggcatctgg

SEQ ID NO: 42537 - DNA, 201 bp, Homo sapiens
cctggttccctagcaaacctgagctttatttatatatctgatatgcaccccatctccacagctggcattcaattgcaactctaaattctaaagtgctcagrgtcaatataatgcactgacgattcagacctgactgggcattttcactgcataaatctaaaaagtaaacaatctcattatgtttgagaggatggatgggga

SEQ ID NO: 42538 - DNA, 201 bp, Homo sapiens
ctttctgcaattacagtctctcaagtactttcagcttgaaataatcagtacatcacatcagccaattttggggtggctcatccttaactcctgcaacactkttgcttagtggttttatcattatatattgtataaatatatatatatagtatacatctataaccatttatttattatacttacattaatttttttcctata

SEQ ID NO: 42539 - DNA, 201 bp, Homo sapiens
aggatactcactgtctcctgactccacaggcagagtgtgggttccagatctgacgatgactcccttagccatgatctgaaatgaaaaaacagtgaaggaartttcttgagctggacacagttctcagccttctattccccacatgacccactttcagttgtcaagtctgtgctggagagaatcaacctcaagaaaactcat

SEQ ID NO: 42540 - DNA, 201 bp, Homo sapiens
attttgcaattctatgaaaaattgggagtttaaacccaacactctcttaagttctccttagttttcccccaaattaaaaaagaatcatttttggcacctamctgattttcgaagcatttctcaattggaattgggtgctatcagtgaccatttctcctccaggatgcaagctatagacaagcatatgtactgagggcgcta

SEQ ID NO: 42541 - DNA, 201 bp, Homo sapiens
tctcctaaagtgatgggattacagccgtgaaccgccgtgcctggcccattttaccattttaaagatgacatctcattgcttttctccttttttgtttctgwtgagaatttagctatcattcatgtgttgtttcccattattaatgtgttatttattttcctctggctgttttcagtattttctttttatctttggttttta

SEQ ID NO: 42542 - DNA, 201 bp, Homo sapiens
tcatcatgttagccaggatggtctggatctcttgaccttgtgatccgcccaccttggcctcccaaagtgctgggattacaagcgcttgtaatcccaccackcctggcctatttttttaaacatttgaaagtacaacacacagaaagtataactttaaggtggcataaaaactaggtgttagaatttttatctcaaccacca

SEQ ID NO: 42543 - DNA, 201 bp, Homo sapiens
ctgaatgaaaacatatccacacgtaagtgccactcacacactctgtgtccggggcgtggaataggccaggagaaccttggtctgaaaatacgaagagctcrtttcttcctcttaatctatcactagtaccacaatactgagttgagatcattattgctatattacctcaagccaatcattaatgtcaatggtattaacttt

SEQ ID NO: 42544 - DNA, 201 bp, Homo sapiens
tgacaagccttgagaagaccaccaaggagagtggtgagaagatggcccacatggagaaggagttgcaaaagatgaccagcatagccaacgaaaatcacagyacccttaatacggcccaggatgagttagtgacattcagtgaggagttagctcagctttaccaccatgtgtgtctatgtaataatgaaactcccaacaggg

SEQ ID NO: 42545 - DNA, 201 bp, Homo sapiens
ccacaatactgagttgagatcattattgctatattacctcaagccaatcattaatgtcaatggtattaactttttctcatttgtaaaaatgataaaacttsgtttaagatgttccgtatagtcccttgaaattacttttgtttgtttgttcatatctatctataaaaacaagctgatgtagcattttttgttttgttttgt

SEQ ID NO: 42546 - DNA, 201 bp, Homo sapiens
atgacaaaatgaacggtcatatccatgggcctcttgtgaaactgaatggagactatcggactcccaccttaaggaaaggagagtctctgaaccctgtctcygacttattcagtgagctgaacatttcagaaatacagaagttgaagcagcagcttatgcaggtaagaactttgtttagggccgctagagtgaatttcttgt

SEQ ID NO: 42547 - DNA, 201 bp, Homo sapiens
aaaggagagtctctgaaccctgtctctgacttattcagtgagctgaacatttcagaaatacagaagttgaagcagcagcttatgcaggtaagaactttgtktagggccgctagagtgaatttcttgtagattgcaggtagcatgttgtgggacttctgattctcgcatttcacttctagatttcttttcttttttcttttc

SEQ ID NO: 42548 - DNA, 201 bp, Homo sapiens
ttttaaaggaatgccttataagttatagtcttcatcttcactttttaggacccaatggtgagtcagggtctatggtgtctcaagaattcggccacctccaygaccaacctctacacacaggccctgttggcttacattttctccctggctggggaaatggacatcagaaacattctccttaaacagttagatcaacaggct

SEQ ID NO: 42549 - DNA, 201 bp, Homo sapiens
gatccgcccacctcggcctcccaaagtgctgggattacaggcgtgagccactgcacccggcctaatttttcatagttttttgtagagatagggtttcgccrtgttgcccaggctggtctcaaacccctgagctcaagtgattggcttgtcctcccaaagtgctgattataggcgtgagccactgcacccggccatgttttt

SEQ ID NO: 42550 - DNA, 201 bp, Homo sapiens
ttttttctttatgcatacttaccctctttatttcttactggcttacctaaaatatgtgaagaggctgcttgccaggaggtgagagaaactggaggagagtrgtaatgcaatgagttttggatttcttttttttttttttttttgaggcagagtctcaatctgtcacccaggctggaatgcagtgagtggtgcaatcttggg

SEQ ID NO: 42551 - DNA, 201 bp, Homo sapiens
aaaatatgtgaagaggctgcttgccaggaggtgagagaaactggaggagagtagtaatgcaatgagttttggatttcttttttttttttttttttgaggcmgagtctcaatctgtcacccaggctggaatgcagtgagtggtgcaatcttgggtcactgcaacttctgcctcccaggttcaagcgaatcttctgtctcagc

SEQ ID NO: 42552 - DNA, 201 bp, Homo sapiens
gaatccaatgacagctttggacgtccccttcccccataatctctgtgcagaccctcaacctcaccccagatgcctttggagttttcattctttattataarcaattgatagtttctcagacttttatatacagcgtaaagaaaatccgtacccagccgggcggtggctcacgcctgtaatcccagcactttgggaggccga

SEQ ID NO: 42553 - DNA, 201 bp, Homo sapiens
tagattaatatctgtggttcaagagcctgagtttgcaggaacactcagtaatacagagaaaatgtatttcccacagactatagtgcaaaacttcagaatarataaaagttgacttcagtaacacatgggtatcccttctgccctccttccctcccatttactgcatcttttttttgatctttggtgctctcaccggactct

SEQ ID NO: 42554 - DNA, 201 bp, Homo sapiens
ggggcaggtccacgtgtgttggtaggatgtcatttagctggcaccatctctttgcctctttctttctcctttgttgcagaacctttgtgtaaatgaagacrtgagaagcctaggttctgtgcagcttatcaacgaccgctgcgtggacatgcagagaagcaggcacggtagccaccaggaccatggtgtagccgcaggtgg

SEQ ID NO: 42555 - DNA, 201 bp, Homo sapiens
ggcaggaggggtctcagggaggggacgatcatggagggctgtcctgcatgcccatgctaaggagtctggaccagggcctggaaggatccgataagcccccraagggtttcattaggagaacaaccagagcagacctgcactttaaaatgacagctccctgttctgcctgtggaggacagacgtggcaggatggagaagggc

SEQ ID NO: 42556 - DNA, 201 bp, Homo sapiens
cttcttttatgtacaatccatgcatttgttccacagacatctgatgtttactgaatgccctgtgcaacagagattgaggattcaaaggtgaacaacagatkatctttctctgcagggggctgtctctatgcacatcactcacaaatatccatctacggtccctcacaaatatccatctacagtcccaagctccttccccta

SEQ ID NO: 42557 - DNA, 201 bp, Homo sapiens
gttgccttaccttcacaaggtcatagccatcttttccaaagtcagcccatgcaggtgtgtaataaattccattgtaaaggatatgtccatcttcaagacayggcactttaaggccatcttctaagttaagtcctctgaaataatagccatgtagttcgctggaatgtagctgactatacacctagatggtagaagagagtc

SEQ ID NO: 42558 - DNA, 201 bp, Homo sapiens
ccaagatcccgccattgcactccagcctgggcaacaagagcgaaactccatctcaaaagaaaagaaaaaaaaaagtaaaaacaacacctaggaggtgttaytattcttactttatagatcagaaatatgctttcaataattcttgtttatttatttatttttgagacggaatctcgctctgtcaccctggagtgcagtggc

SEQ ID NO: 42559 - DNA, 201 bp, Homo sapiens
cacctgccttggcctctcaaagtgctgggattacaggtgtgagccactgcgcctggcccatcttttttttttttcttttctttttgtagagagagagagasagacagagttttgccgtgttgctcaggctgatctcaaactcctggcctcaagtgatcctcccaccttggcctcccaaaggatataatcccatgcctggaa

SEQ ID NO: 42560 - DNA, 201 bp, Homo sapiens
ttataaagcttcctaggaaagggtaagacaagcacaagacagtagtatcaaagaaaaaaaaaaaaaaccaagacagtagtatcatgtacttttcattatgkcttttttttttttttttttttttaaacagagtttctctcttgttgcccaggctggagtgcaatggtgcaatctcagctcactgcaaactctgcctcctgg

SEQ ID NO: 42561 - DNA, 201 bp, Homo sapiens
aaagaggaaggtgtggctttcttttcctccgggacacagaaggtcgtccttcctacctactggctgccctcgggggcaaccccttgcccagcaccaaggaygtcaagaagatcctgtacaatataagcaataaggccaatggcaaccagtgcagcaagatcatcagtgagctgaatggaaaaaacattaaaggtgtcattg

SEQ ID NO: 42562 - DNA, 201 bp, Homo sapiens
agattaagcgatttgaggaggagacggtactgctgaacagccagctggaagatgccatccgattgaaagagattgctgagcaccaactggaagaagccctygagactttaaaaaatgaaagagagcaaaagaacaacctgcggaaggagctctcccagtatatcagcctcaatgataaccatatcagcatctcagtagatg

SEQ ID NO: 42563 - DNA, 201 bp, Homo sapiens
acaagatattttaaaattttatttttccttattaagcgaattgaattatttcaagcatcagtgagagctgctagactgttatatttcgggggtcttgcggrgtagcttttcttacacatataagcagaagaaaacattttcccaagtcttaaaagagggttatgatgcatttcattgtgtactctttttcttcccatatac

SEQ ID NO: 42564 - DNA, 201 bp, Homo sapiens
gccttgacatattgctacactccccaaataagacttacttcaagtgaatatacattagatatctgcaggaaaaatgaagaagagcaagacagcaaccatcmcttccctttaagaattcccttcaagaacaaggatttttctccatataacaagaatgtgattgcaaattgcttcacaaaaaagtaatctggcagagctgta

SEQ ID NO: 42565 - DNA, 201 bp, Homo sapiens
caagtctttgtgtggacatgttttcatttcttttggggaagtacgtaacagttggattgctgggtcatgtggtaactctgtctttcacataatcagaaacyaccaaactcttttcaaagtattcataccactgtggtttgtgtccctccaaaactgatgttggaatttaattaccatggcgactctattaagaggtgggac

SEQ ID NO: 42566 - DNA, 201 bp, Homo sapiens
tttagtagagataaggtttcgccatgttggccaggttggtctcgaactcctgacctcaagtgatccgcctgcctcagcctcccaacatgcgtgagccaccrtgcccggccagcattacataagctttcaaaacatgatttttactatcctatcctaaaagtttttttttttttttttttttttgagactgagtctcactct

SEQ ID NO: 42567 - DNA, 201 bp, Homo sapiens
tgttttggagaaggggtctccatctgttgccctgcctggagtgcagtggcacaatctcagctcactgcaacctccgtctctcgggttcaagtgattctcckgcctcagcctcccgtgtagctgggaccacaggcacacaccaccacgcctggctaatttttgtatttttagtacagacagggttttgccatgttggccagg

SEQ ID NO: 42568 - DNA, 201 bp, Homo sapiens
catcctatacttttagagtagctcatctcagctagttgttataaggaaagtaaactaagtcaaaattagtcatcaatgaattattagcttttagtactgcrggagattttttttttcaagagtaccaatgtgtccggaattggtgggttcttggtctcacttcaacaatgaagctgcggaccctcgcggtgttacagctct

SEQ ID NO: 42569 - DNA, 201 bp, Homo sapiens
gcaagaacgcttaaccaaccttgggttagaggcccaaattagaagagttatcccttctaagatttagggagttagaggcctctctcagtaaagtccttctyggctaagaatgggtttgacactattaactgctattctctttcaaataatctgccttgcactctttgctgacagctatgggtgacaggattaggcatgaac

SEQ ID NO: 42570 - DNA, 201 bp, Homo sapiens
tggggagacagcactggcctgcccacctcactgggctctgacaggaggcatgccaggcgtgctgttcattattatttcagaacagtgctgcttaactccasggaccaagctgcttctgtgaatgaggggtagggaatcccagaggccaaggccgcctcatctctcagggaccttctggctcattagatggcctcgtccctc

SEQ ID NO: 42571 - DNA, 201 bp, Homo sapiens
gggaggtgaggtccattgggtggatccactaagctttggaagcagagagtttgggctggagatggtgagaaaccacatagtggttggagcattttagggtytgtcagaagggtcagggctgctggctggggtaggagcaggtgctggggagacagcactggcctgcccacctcactgggctctgacaggaggcatgccagg

SEQ ID NO: 42572 - DNA, 201 bp, Homo sapiens
actgcgggaggtgaggtccattgggtggatccactaagctttggaagcagagagtttgggctggagatggtgagaaaccacatagtggttggagcattttrgggtctgtcagaagggtcagggctgctggctggggtaggagcaggtgctggggagacagcactggcctgcccacctcactgggctctgacaggaggcatg

SEQ ID NO: 42573 - DNA, 201 bp, Homo sapiens
ctactcgggagcctgaggcagcagaatggcttgaacccgggaggcggaggttgctgtgagccgagatcgcgccattgcactccagcctgggcaacaagagygaaactccatctcaaaaaaaaaaagagagagaaataccattacatgtcccttgcttctaggagctaccttgatcaagtttgccgaagaaggaatcatatg

SEQ ID NO: 42574 - DNA, 201 bp, Homo sapiens
ctcgaacttctgagctcaagtgatctgcctgccttggcctcccaaagttctgggattacaggtgtgagccactgtgcccagcctaggtctattttcttatrcttctttctattcatgtgtatgtgtgcttgtgcatgtgtgtttaacatggatagtaatatggttatttcctataggtataattttagattattttttgct

SEQ ID NO: 42575 - DNA, 201 bp, Homo sapiens
cgagcgtggtggcgcatgcctgtaatcccagctactcgggagcctgaggcagcagaatggcttgaacccgggaggcggaggttgctgtgagccgagatcgygccattgcactccagcctgggcaacaagagtgaaactccatctcaaaaaaaaaaagagagagaaataccattacatgtcccttgcttctaggagctacct

SEQ ID NO: 42576 - DNA, 201 bp, Homo sapiens
gaaaggcaggcactagaataccaggtactgggtgagtgaaagcacagtgtgacctggcaagggaaggggaggcgagagcaaagcagttgctgtctctccartttctccttcactaaccacctcagcccagggcctggaaagaaaaagaacttaaggacttccacaggctgagactggatgctgaaggtggacagtggctca

SEQ ID NO: 42577 - DNA, 201 bp, Homo sapiens
gcagatcacctgaggtccggagttcgagaccagactgaccaacatggagaaaccccatctctactaaaaatacaaaattagccgagcgtggtggcgcatgyctgtaatcccagctactcgggagcctgaggcagcagaatggcttgaacccgggaggcggaggttgctgtgagccgagatcgcgccattgcactccagcct

SEQ ID NO: 42578 - DNA, 201 bp, Homo sapiens
tcaagtgattctcctgcctcagcctccccagtagctaggattacaggcgcccactaccaagcctggctaatttttgtatttttagtagagataaggtttcrccatgttggccaggttggtctcgaactcctgacctcaagtgatccgcctgcctcagcctcccaacatgcgtgagccaccgtgcccggccagcattacata

SEQ ID NO: 42579 - DNA, 201 bp, Homo sapiens
tctatttttcctcacttgaaattacatggacacacctgcaactgtatgtgttttttaaaactccaagaactgtacaccaaaaagagcaaacttaaagctgrgagttgtggctcacgcctataatcccagcactttgggaggctgaggtgggtgagtcgcttaagcccaggagtctgagacaagtctggacaacatggcgaa

SEQ ID NO: 42580 - DNA, 201 bp, Homo sapiens
tcccagcgcttttttctttttttttaagatggtgtctcactttattgcccaggctggagtgtagtggctcgatctctgctcactgcagcctctgcctcccrggttcaagtgattctcctgcctcagcctccccagtagctaggattacaggcgcccactaccaagcctggctaatttttgtatttttagtagagataaggt

SEQ ID NO: 42581 - DNA, 201 bp, Homo sapiens
ggccatgccccaccgcctctccagccccactgggcacactggtaaggctggggcctctgcccacagtcagggcctatcgtggcctggagcccacacctacyaccctgactacagcgggactgagggcactcatggtatctcatggaaaacaaactgaggcccaggaggaaaatgtttgtttaaaattttgcacgccatttc

SEQ ID NO: 42582 - DNA, 201 bp, Homo sapiens
cctgggccccaactctgaagcagctgcctggcagagacagtgaggagggtgcagggagaggactttgccctccactgctctccagccaggacacggccccrgctggcagcctttcattctatactgagccaagagacacacaccagagccccaggctggccatgccccaccgcctctccagccccactgggcacactggta

SEQ ID NO: 42583 - DNA, 201 bp, Homo sapiens
tttctttttttttttttgagacagagtctcactctgtcacccagtctggagtgcagtggcacaatctcggctcactgcaagctccgccgcctgggttcacrccattctcccgcctcagcctcccgagtagctgggactacaggtgcccgccaccacatccggctaattttttgtatttttagtagagatgggatttcactg

SEQ ID NO: 42584 - DNA, 201 bp, Homo sapiens
gtgcagtggcacaatctcggctcaccacaacctccgcctcccaggttcaagcgattatcctgcctcagcctcccaagtagctgggattacaggatgcccggctaattttgtatttttagtagatatggggtttctccatgttggtcaggctggtctcgaactcccgacctcaggttatccacccgcctcagcctcccaaag

SEQ ID NO: 42585 - DNA, 201 bp, Homo sapiens
gagtgcagtggcacaatctcggctcaccacaacctccgcctcccaggttcaagcgattatcctgcctcagcctcccaagtagctgggattacaggatgcchggctaattttgtatttttagtagatatggggtttctccatgttggtcaggctggtctcgaactcccgacctcaggttatccacccgcctcagcctcccaa

SEQ ID NO: 42586 - DNA, 201 bp, Homo sapiens
aggagaactcagataaactcgtgggagaaccacaatgtgctgtggaggggagcaggcatgcgggtacactcctgacctccacagacggcccctaccaccargcctgatggagctgcctacctagcatgggtaggcctcattccttcagagaaatggaagaaattttaatttctttaaaataaaatcctttaattttaagag

SEQ ID NO: 42587 - DNA, 201 bp, Homo sapiens
attacaggcatgcgccatcatgtccagctaattttgtatttttagtagatgcagggtttcaccatgttggtcagcctggtctcgaactcctgacctcaggwgatccactcgcctcagcctcccaaagtgctgggattataggcatgagccactgtgccaggcctatgtgaagccatcttttaaaactttacactgctataa

SEQ ID NO: 42588 - DNA, 201 bp, Homo sapiens
catgccaggaagaatattaagggaccaggcccctataattaggcctaatcgtagcctgttgtttgaaaagggtatgaaggacattcatcaggcttggcackgtgccctagacctgctctcctgggtagtggggccctccattgcaacagaggtgtgggtgggcctgggagagtgtggcaagaaatgcttaggaggctctac

SEQ ID NO: 42589 - DNA, 201 bp, Homo sapiens
ggttctgatcctaatttctgggctagtactcccatagctatggccctcttctctgctacatacaaggagaagggcttagttagctctgggatgccaagagygagagcctgggtaagggcctgttttagcttggcaaaggcttctctcatttctggggcccattccattagctcattttcaggcccccttgttgcttcatat

SEQ ID NO: 42590 - DNA, 201 bp, Homo sapiens
tttatatcctaacaatttttatttactctggcaataaagagatagaacacccaccaacaaagtccctaaaatacgtaattgataaagcattggttatctgstaggttttaaacataatttctaagaatataaaaatttaatcaccaccatctttataattgttttaaaattacctctaatttcttcgcacaaggtccacta

SEQ ID NO: 42591 - DNA, 201 bp, Homo sapiens
cccaaaatttggtacccatattctgcaaaacccagccattccccaaaaagaatgaagctgctgcttggtgttggaggcagggctcaaaccacatatggtcygtgctcattctggggatatttgccaggctccgggtgttaagacatatccaaaatattggaaccattggagggtaatctgagccatctttgtatcccgtat

SEQ ID NO: 42592 - DNA, 201 bp, Homo sapiens
tttaaaggtgctttatcaactaaatttatggaatattctaaatccttcattatcatttcaacaatatccacagcatcttcaccaggaatatattccctctyaagaaaccactttctttgctcatccataaaaagcaactcttcatccattaaagctttttttagcatgtgattgaagcaattcagtcacatctttaggccc

SEQ ID NO: 42593 - DNA, 201 bp, Homo sapiens
actactgaaagcaacatacagattcaatgcgatgcctatcaaaattttaatggcatttttcacagatatcagaaaaacaatcctaatatttgtatggaatygcaaaagaccccaagtaaccaaagcaatcttgagaaagaaggacaaagctggaggaaccacttcctggtttcaaactacttcctggtttcaaactacatt

SEQ ID NO: 42594 - DNA, 201 bp, Homo sapiens
tataatcagctataggactctaacaggtgctcttaaattcaggtttctaatacctttgaacactgtaatattaaaatacaggaaaaaactttcggactcayggaaagctgaaatgttcataaatatcaaacaggaattaactgcatggactaaactaatagaagctatttacagcttttaacaattaagtatactcctgta

SEQ ID NO: 42595 - DNA, 201 bp, Homo sapiens
gtctttgtcttaggtaaacaagggggtcgtcatccattggtcttatctaaatcatatagggaagggtggatttttgcagtaagccattttcaggaccgcaraagagtggagggatttttaaactattgctattttccaggagtatgatgctcaggtaaagttcaacattgccaacctttttgtttgtttgtttgtttgttt

SEQ ID NO: 42596 - DNA, 201 bp, Homo sapiens
aaaggcaggcactagaataccaggtactgggtgagtgaaagcacagtgtgacctggcaagggaaggggaggcgagagcaaagcagttgctgtctctccagwttctccttcactaaccacctcagcccagggcctggaaagaaaaagaacttaaggacttccacaggctgagactggatgctgaaggtggacagtggctcac

SEQ ID NO: 42597 - DNA, 201 bp, Homo sapiens
acattttctttccattgatccccggccttcagataaactcaaccaactgtcaaccagaaagtatttaaatttacctatagcgtggaagccccggctttgcrttgtcctgcctttctgaaccaaaccaatgtatttcttaaatgtatttgattgatgactcatgtctccctaaaatgaataaaaccaagctggccgggcgca

SEQ ID NO: 42598 - DNA, 201 bp, Homo sapiens
cagttgctgtctctccagtttctccttcactaaccacctcagcccagggcctggaaagaaaaagaacttaaggacttccacaggctgagactggatgctgraggtggacagtggctcacacaccttcttgaagtcaagtggctcctcccctgcccaccagatgccaagagggtctgttggacccagacctgtggtgacagc

SEQ ID NO: 42599 - DNA, 201 bp, Homo sapiens
attagctggatgtagtagcgtgcacctgtagtctcagctactcaggaggctgaggtgggaggattgcctgagaggttgaggctgcagtgagctaggattgyaccactgcacttcagcctgggtgacagagcaagaccctgtttcaaagaacaaaatgcatcttattcttggtacttgtaatttgtaaacacattcatttac

SEQ ID NO: 42600 - DNA, 201 bp, Homo sapiens
aaggacttccacaggctgagactggatgctgaaggtggacagtggctcacacaccttcttgaagtcaagtggctcctcccctgcccaccagatgccaagasggtctgttggacccagacctgtggtgacagctacaagagaaggaggagacaccaaagttgagtttgctttataagtgacattgcaggctgggctgcagtg

SEQ ID NO: 42601 - DNA, 201 bp, Homo sapiens
atgaagattcaggctgtacttttcaagggaccaagggcttgggatccacataggcctcccacaccgtcagatgtcagctccatcaatactgaaagacaatrggagatgaggtagggagggggtgagaacgtggggagagggaagggaggtggtgggaaagagaggaaggaagaggtgaggaaaggcaaggaggaaagggaa

SEQ ID NO: 42602 - DNA, 201 bp, Homo sapiens
ccccaaatggacactttgctcataggtgatgctactgaattaatatacaggtacagctccacctacttattagtaggtaagactcttggcttaaaggacaagaatgtgcagatttatcaaatgggcttgagaaaatacaattcagaatattggtgaaagtattctttacctgtgggtggagaaaataagagatgctcggcc

SEQ ID NO: 42603 - DNA, 201 bp, Homo sapiens
cctgcctcagcctcccaagtagctgggactacaggcgcccgtcaccacgcctggctaatttttttttttttttttgtatttttagtagagacagggtttcwccatgttagccaggatggtcttgatctcctgacctcgtgatccgcccgcctcagcctcccaaagtgctgggattacaggcgtgagccactgtgcccagcc

SEQ ID NO: 42604 - DNA, 201 bp, Homo sapiens
gcgcagtggctcatgcctgtaatcccagcactttgggaggccgaggtggacggatcacgaggtcaggagatagagaccatcctggataagatggtgaaacyccatctctactaaaaatacaaaaaattagccaggcgtggtggcacgcacttgtaatcccagctactcaggaggctgaggcaggagaatcgcttgaacccg

SEQ ID NO: 42605 - DNA, 201 bp, Homo sapiens
caggcctggatgacgtcgtgtaagccctggaactccgaagcctgctctactgattagttactttttgctcaacctggtctggagagttccgactgacaggrtgccaccaatttttagtgatttctctcccctctagacccctggaagcctgtgcgattcatgctatgcaatgaagaatcagcctcgccctgtgctctccca

SEQ ID NO: 42606 - DNA, 201 bp, Homo sapiens
catgaaataacatgatatagtcatgaccaaacatgtctttcatatcaaaaattttaaacaattgtaataattgtaaatgagtttaattcatctagtaaaargggaaaaagtcagatagaaccacaaataaaaaataattcaataccataaaaacaaagacaaacctaaaactaatagattcagaaggacagaaaatgaaga

SEQ ID NO: 42607 - DNA, 201 bp, Homo sapiens
ttatttatttatttatttatttatttatttttgagacggagactcgctctgtcccccaggctggagtgcagtggcaccatcttggctcacagcaagctccrcttcccaagttcacaccattctcctgcctcagcctcccaagtagctgggactacaggcgcccgtcaccacgcctggctaatttttttttttttttttgta

SEQ ID NO: 42608 - DNA, 201 bp, Homo sapiens
cattatgcaggccacttgggggccaccagatgccaatgagtagaaggagagagaaggacagatggaggaagtaaggacaaggggaaaggggaagggagaaagggagaagaaaggaaggggagtggggaaagaaggagaaagagagggaggaaaggaccaagagccttgcagagaaaattccccctttttctaaggaaaggt

SEQ ID NO: 42609 - DNA, 201 bp, Homo sapiens
tcattatgcaggccacttgggggccaccagatgccaatgagtagaaggagagagaaggacagatggaggaagtaaggacaaggggaaaggggaagggagaaagggagaagaaaggaaggggagtggggaaagaaggagaaagagagggaggaaaggaccaagagccttgcagagaaaattccccctttttctaaggaaagg

SEQ ID NO: 42610 - DNA, 201 bp, Homo sapiens
tgcaggtgtctttttcatataatgacttcttttcctttgggtagatacccagtagtgggattgctagatggaatggtagttctatttttagttctttaagkaatctctacactgttttctgtagtggtaaatgcgtttgcatttactttacactcccatcagcagtgtagaagtgttcccttttcaccacatccatgccaa

SEQ ID NO: 42611 - DNA, 201 bp, Homo sapiens
cattatttactataaaaatctggacacggaaaatgacttcagtactctgttcaaaaagaaactggggaaaggttttattgaaaagggcaagggccgggcayggtgactcacgcctgtaatcccagcactttgggaggccgaggcgggcggatcacaaggtcaggagatcgagaccatcctggctaatgtggtgaaaccccg

SEQ ID NO: 42612 - DNA, 201 bp, Homo sapiens
tgcttttgcatcctcatagcttagctcccatttataagtgagaacatacaatatttcgttttccattcctaaattacttcacttagaataatggcctcccrctccatccaagttgctgcaaatgccattatttcgttcccttttatggttgagtagtattccatggtgcatatataccacattttctttatccagtcattg

SEQ ID NO: 42613 - DNA, 201 bp, Homo sapiens
caattgtcaattatcaacactgagagaaaatgagatgagagagagaaggaggtaaatttgacccttaggtgatgggtgatgatattgtcacacaccgaagmggggatctaagttggagaaactggtttggagtagattatggatcctattgaagtgcctgtgggacattcagttaaagaagcaccttaggcagtgggatat

SEQ ID NO: 42614 - DNA, 201 bp, Homo sapiens
tttgcttacatggatactttctttagtggtgatttctgagattttggtgcaactgtcacttgagcattgtacacggtgcccgatctatagtcttttatccytcactcccctcccaccttttcctgagtctccaaagtccaaagtctattgtatcattcttatgcttttgcatcctcatagcttagctcccatttataagtg

SEQ ID NO: 42615 - DNA, 201 bp, Homo sapiens
atcaacaattgtcaattatcaacactgagagaaaatgagatgagagagagaaggaggtaaatttgacccttaggtgatgggtgatgatattgtcacacacygaagcggggatctaagttggagaaactggtttggagtagattatggatcctattgaagtgcctgtgggacattcagttaaagaagcaccttaggcagtgg

SEQ ID NO: 42616 - DNA, 201 bp, Homo sapiens
ttgcctcaacatggatgacttctgactgatctgagtggtggttgctgaaggctggagtggatgtggcaacttcttcaaatcagacaacaaaaaagtttgcygcattgatggactcatttttaaaatattttattttatttcaatagttcttggggaacaggtggttttgcttacatggatactttctttagtggtgatttc

SEQ ID NO: 42617 - DNA, 201 bp, Homo sapiens
acaagcgattctcctgcctcagcctcctgaacagctgggactacaggtgcccgccaccacgcccagctaatttttgtatttttagtagagatggggtttcmccatattggtcaggctggtcttgaactcctgaccttgtgatctgcccgcctcggccacccaaagtgctgggattacaggggtgagccaccatgcccagcc

SEQ ID NO: 42618 - DNA, 201 bp, Homo sapiens
tcatttgaggtcagaagttcgagaccagcctgaccaacatggtgaaaccctgtctctactaaaaatacaaaaaaaattagcctggtgtggtggcacatgcytgtagtcccagctacttcggatgctgaggcaggagaatctcttgaacccgggaggtggaggttgcagtaagtggagatcgtgccactgcattccaacctg

SEQ ID NO: 42619 - DNA, 201 bp, Homo sapiens
aaaaaagcaagtaacatctttgtccaggcgcggtggctcacgcctgtaaccccagcactttgggaggccgaggtgggcagatcatttgaggtcagaagttygagaccagcctgaccaacatggtgaaaccctgtctctactaaaaatacaaaaaaaattagcctggtgtggtggcacatgcctgtagtcccagctacttcg

SEQ ID NO: 42620 - DNA, 201 bp, Homo sapiens
atgagcatattttgggttatattgtaaaatgataaaattatttaaaatcaaatcactgcaataaaaatgtaatgtttaattattattattattattatttatttttttttttctagacagagtctccctctgtcgcccaggctggagtgcccagtggcacgatcttgcctcactgcaacctccgcctcccaggtttaagcg

SEQ ID NO: 42621 - DNA, 201 bp, Homo sapiens
gaagctgaggcaggagaatcgcttgaacccgggaagcggaggttgcagtgagccgagatcacaccattgcactctagcctgggcaacaagagcaaaactcygtctcaaaaaaaaagcaagtaacatctttgtccaggcgcggtggctcacgcctgtaaccccagcactttgggaggccgaggtgggcagatcatttgaggt

SEQ ID NO: 42622 - DNA, 201 bp, Homo sapiens
aattagttgggcgtggtggcaggtgcctgtaatcccagctactggggaagctgaggcaggagaatcgcttgaacccgggaagcggaggttgcagtgagccragatcacaccattgcactctagcctgggcaacaagagcaaaactccgtctcaaaaaaaaagcaagtaacatctttgtccaggcgcggtggctcacgcctg

SEQ ID NO: 42623 - DNA, 201 bp, Homo sapiens
aagtggtgtcattggccgttggtcatgatgttatgtagtgcttttatagactgaagtgctggcagcaaagattgtgcgttatgcattgctcacaatcaatrtatttggtcattgaaatttggaccatggtttgaggagtagctggtgttttaactaaagcatagtaactgaaacttacccatattagaacctcgccaagag

SEQ ID NO: 42624 - DNA, 201 bp, Homo sapiens
gattttatgattagcagatgtgtgtcatctgctactgtacctgctccctactgtgagcttaggcaagctacaaagagaggtattcctctcctaattaaaayacttccaacttcagtaactgttatttacaatacctcccctcagatagagtacagaaatagaaatgagatgaaaaaaatgcaactcacaaggcacaggttg

SEQ ID NO: 42625 - DNA, 201 bp, Homo sapiens
ggagatcaacctggttgtaaaatccactgagaatttccagcgcacattcaacatacagtcagttaacagattggtatttcagcaggataccctgcccaatrtccctggaatgtacacgttggaggcctcaggccagggctgtgtctatgtgcaggtaagtagagatccatgagaatgagcggacattgggaaggagagtcg

SEQ ID NO: 42626 - DNA, 201 bp, Homo sapiens
gaaaagttgctgtcaaataactccaacatttgaagggaaagaaataaaagggagggccgtcaggtgataggtatctgcttatctggcaaagaacaggttarggaccaggcataattgtataaaataagtgtggactagtacattttacatagttctttcttgaatgaacagctaacatgatgttaaggcttcctgtgccag

SEQ ID NO: 42627 - DNA, 201 bp, Homo sapiens
taccagtttacttattttattcaaaggatgcaggacaggtagttcagcatccaagcaagcactgctttgagcaaaaggccttgcaatatcccaggcacagyttccaagcttatcatttcatgggtcatgctcagttacaagggatgaaggtaaagcaagatggaccaccttggcactgcgaagctcttctactatctgctc

SEQ ID NO: 42628 - DNA, 201 bp, Homo sapiens
tcaccctcaggtacccttgcctccttcttcctgccctctacttagacaatacacacacataaacatcctcatctttcttctaatctcaaagtataaaatayattagccaaggctcaaaactgtgtcttccacttgcatccttgaccaattctcccgtcttttcaacccgctccattagtcacctcctttgctgtatcgcca

SEQ ID NO: 42629 - DNA, 201 bp, Homo sapiens
tcttggccctattcattatcaaaacaatttcagaataagttgttaatttccacaaacatcctgctgggattctgaatgcactgaatatgtgtaatatctgkgtgtatatgtgtaattaaatgtttttttgtttgtttgtttgttttttctgagacggagtttcgctcttgttgcccaggctggagtgcaatggcacgatct

SEQ ID NO: 42630 - DNA, 201 bp, Homo sapiens
gaatttcccagaactggtgagaagcatatacccacagatcttgaaagcaaagaaaaaaaaaaataaggaaacagggaaacaaatttaaaatataatttttwaaaaattgcagagaaaaaggaaacgagtctaaaaatgtaaaatggcatattactaaaaaagattccaagtagtcaagagcaatctatgtcctgataaaat

SEQ ID NO: 42631 - DNA, 201 bp, Homo sapiens
cttcttgactcttaaagacttccagcctaaagtagacacaggaaggaggacaggcaaagctttcaccttaaagtttggcatggaattttagattactgtartgaagctctcctaataactagaaatttccaggtcacttttttatttttaattatgcaaaattaaaaggaaaagtagtacacatgagtcagggaaaagtag

SEQ ID NO: 42632 - DNA, 201 bp, Homo sapiens
cttccttatctcaccatttaaatggattcttttgcctttcttaaaacttcccttttctgcacaagagtcattctttctatatgtcttattcccttcaacarttttctatcataaaatcaaatgttttggctcttgcccttgttaccatttatgactgtacttaacatcatctcatactgaggactatattattcttttaaa

SEQ ID NO: 42633 - DNA, 201 bp, Homo sapiens
atatgtgattagaatgttattagaataatacggatattattagaatattattagaataatatggatattattagaatagaataaggtgctctttaaaaatrcactttctgaggctccccaccccagactcatggaaatgaaatctctaacatttaggctatgtaatctatatttttattttgtatttttaagcaggttctc

SEQ ID NO: 42634 - DNA, 201 bp, Homo sapiens
tatatcacattttattttatttttaattattatactttaagttctagggtacttgtgcacaacgtgcaggtttgttacatatgtatacatgtgccatgttkctgtgctgcacccattaactcgtcatttacattaggtatttctcctagtgctatccctccccctctccccactgcacgacaggccttgttgtgtgatgtt

SEQ ID NO: 42635 - DNA, 201 bp, Homo sapiens
ttccaggcttgagggtgaagtttagcctggagcccagcagttctgcatcaagaagatttaacatacacttagtttcaattagaaagatagtgagaaaagaktagaggcaatgtgtaaagagataatggctgtgaatttcccagaactggtgagaagcatatacccacagatcttgaaagcaaagaaaaaaaaaaataagga

SEQ ID NO: 42636 - DNA, 201 bp, Homo sapiens
tacatagtgtagtataataataacagatgtttttgtcagcctaaaaataatgagttgaaggttctaacggttgcctttatagaaaataacatctttggccrggcgcggtggctcacgcctgtaatcccagcactttgggaggccgaggcaggcggatagcctaaagtcaggagtttgagaccagcctggccaacatggtga

SEQ ID NO: 42637 - DNA, 201 bp, Homo sapiens
tgcattataaatatgaagcaacaataaactgtgcaatgaggttttagcaatcatagttaatatcacaccatatttttattcaaaaagaagcatgatgctgrgtagattatgaatatttgtagcattataatctcagattgtaatgatcaattttttgaaaactgaatatctctcaattgtgtaagactcctggctcaattt

SEQ ID NO: 42638 - DNA, 201 bp, Homo sapiens
tttctaggtaaaattaacaactagcaaggggttctagcagagtgtaatttcaaaatactctattatgcttgtaaaataaactattcacaatacatagtgtrgtataataataacagatgtttttgtcagcctaaaaataatgagttgaaggttctaacggttgcctttatagaaaataacatctttggccgggcgcggtgg

SEQ ID NO: 42639 - DNA, 201 bp, Homo sapiens
tagactaccatcaccatattagtctggtctcactttctattttatctgtttactatgctttttcatattttgttcatgccactatatagtagttaatataytgcattataaatatgaagcaacaataaactgtgcaatgaggttttagcaatcatagttaatatcacaccatatttttattcaaaaagaagcatgatgctg

SEQ ID NO: 42640 - DNA, 201 bp, Homo sapiens
tcttttgacagttttcactgttgatcgccttggttctcagattgtcgctagctagattgtagtcttctgctgaaatactgtcttagactaccatcaccatrttagtctggtctcactttctattttatctgtttactatgctttttcatattttgttcatgccactatatagtagttaatatattgcattataaatatgaa

SEQ ID NO: 42641 - DNA, 201 bp, Homo sapiens
aggataaagattaacttaaatataactagctcttactatacactctgtggaacaaaatggcctacttaattttattttcaaaacagggaaatgagcactgygcttaagcaaattgctatgaagtccacacattcctggtcttgttaagtaattaatttattctttgcattattaaactttatttactaagcataattttac

SEQ ID NO: 42642 - DNA, 201 bp, Homo sapiens
ctgagagaccacaaaagaatgcttagttctaacaggtttctaaactacatgaaatgaaatttgtcaggtatcctgttgtaaagactgaagtccaggtcatrattcgttgtcttttgacagttttcactgttgatcgccttggttctcagattgtcgctagctagattgtagtcttctgctgaaatactgtcttagactacc

SEQ ID NO: 42643 - DNA, 201 bp, Homo sapiens
aacttaaatataactagctcttactatacactctgtggaacaaaatggcctacttaattttattttcaaaacagggaaatgagcactgcgcttaagcaaaytgctatgaagtccacacattcctggtcttgttaagtaattaatttattctttgcattattaaactttatttactaagcataattttaccaatgataatca

SEQ ID NO: 42644 - DNA, 201 bp, Homo sapiens
taattctgattggtagctttacttgataatttgttgccctgatagtaatgttgtaattgacatttctgcatgtgtaaataggataaattcttgaaagattrctctgcaaatctgatcatttgtttctcatctcttttttttatattttattttattttatttatttattttttttttgagacagatcttgctctgtcaccc

SEQ ID NO: 42645 - DNA, 201 bp, Homo sapiens
catcatttttggaaatgctacatcaatttccatctctatacataagcacatgcagtttgttgtgccatggaaactccttgccataaacatttggtacaaaygatcttcttatctatgacccatatttgagggaacagtccattaatcctgttcttatgcaaatgtagttattactaaagcagggagttgggtaatcatatt

SEQ ID NO: 42646 - DNA, 201 bp, Homo sapiens
ccctccatgctggtcacagtaaggtgcttttggcacgactacaaattatacgaacatatatgagatgtctctgcccacgtaagtccacttaggtctgaggwcccggagttcttacaggagtctggttgcacaaggcacattcctcccacgtgacaatctatggtgcagatctttacccaggaggcaggtgctcatggcaca

SEQ ID NO: 42647 - DNA, 201 bp, Homo sapiens
ctagatccacttcacagattttgtccagggcttcggcttgtcctaatgtcctaggaaaaccatcaaggagccagtgctggccacgcctattctccaactcrgacatcattaggcgtgtgatcacatggtctggaaccaaaagacttttctctatatactgctttgccatctcaccaacttcggtgctggccttgatgttct

SEQ ID NO: 42648 - DNA, 201 bp, Homo sapiens
agaagaaactaggtatatgctctatatcttggctcatttgataatgagcccagttgcatcattactatatttttattatgtagtcaaatttattatgaatrcccaaatctcataggccagccatgcattgaatctatttatctaaatggaatactgaaccagataatgtccagcaattagaaacactggcttgcaaagata

SEQ ID NO: 42649 - DNA, 201 bp, Homo sapiens
tgattttgtaaagtgtcaaatggtcgatattgacaaaaatatcaatcttttttctcttttgtgcaatatggagagtggtgtgaatcttcggtttcttattrtaagtcattttctttgaaaaaagagttttataaaactaagacttagaaacttacttgccctggccttgaaaattacctttggaaaaatgcttgtgcttta

SEQ ID NO: 42650 - DNA, 201 bp, Homo sapiens
tgacttaaaggaaaagaaaggcaccatcagcaatgaaattgcagaaaatgaaagaaaagaccgatgtaagatttgggcagaagaaactaggtatatgctcyatatcttggctcatttgataatgagcccagttgcatcattactatatttttattatgtagtcaaatttattatgaatgcccaaatctcataggccagcca

SEQ ID NO: 42651 - DNA, 201 bp, Homo sapiens
taaaggatatgctcctctcccctatagcacagagaggaggatgtctttctgagatataacacatattcaaaatatctgattttgtaaagtgtcaaatggtygatattgacaaaaatatcaatcttttttctcttttgtgcaatatggagagtggtgtgaatcttcggtttcttattgtaagtcattttctttgaaaaaaga

SEQ ID NO: 42652 - DNA, 201 bp, Homo sapiens
aaaattgtctgttacagaaatatatatgtgagcatgcaactgcataaaaataaggcagcttttagtgtattttgtgcatattgccataaatttgtacagastgacattctaatgatatttcttttattttcagatttataaatatgtgattacatattgtggaaaaataatgctataggctctgtatttcagttattatta

SEQ ID NO: 42653 - DNA, 201 bp, Homo sapiens
ttacattagctcttccatgccttgactctcacttaagacccctggtgctttctcgtctttctgttatgaacataaattctgcggaaagccacctaaactaytcccattctagcactctctcctctgtaataatcctctacttccctccttacctgcccaccagagccccaaaccgcggatgaagactatcccctcacttcc

SEQ ID NO: 42654 - DNA, 201 bp, Homo sapiens
aagcttccaaccttttaaggaaagatttctatccaacttgactagttgcaatggcttacacctgtaatcctagcactttggccggatcacttgaggccagkagttcgagaccagcctaggcaacatagtgagactctgtctctacaaaaaatttaaaaaattagcctccttagctacttgggaggctgaagtgggaagata

SEQ ID NO: 42655 - DNA, 201 bp, Homo sapiens
gtttgtcctgggagcaacagcaggcgctggtttggcttgattgtgaaaagaggggtcctgtgatgctcttatatctttctgagaacacagagtatgtgatygctcccacacccggctgtagccactgggtttctgttttaaatatgagtacctcagtgagtcatagggagtccatttggtctgtgggctgtgaacatactt

SEQ ID NO: 42656 - DNA, 201 bp, Homo sapiens
tggataagatggtgaaaccccatctctactaaaaatacaaaaaattagccaggcgtggtggcacgcacttgtaatcccagctactcaggaggctgaggcargagaatcgcttgaacccgggaggcagaagttgcagtgagcagagatcgagccgctgcactccagcctgggcaacagagggagaaaaaaaaaaaaaaaaca

SEQ ID NO: 42657 - DNA, 201 bp, Homo sapiens
tccatcacaaggtgatgggtgcaagggctttgggtgctatctactggatacaaatgcaggggcttaggatactatcacccgagcgaattcctgggaactgyggacataacttgccacaggaccttatcagttaattgcactctgatgtgctgggagtcagcttgcacaagttaagtccttgaggaattgggtgggcaagga

SEQ ID NO: 42658 - DNA, 201 bp, Homo sapiens
ccgaggcgggaggatcacctgaggttaggagtttgagactagcctggacaacatgatgaaaccccgtctctctactaaaaatgcaaaaacctagtcgggcstgatggcgggcgcctgtaatcccagctactcgggaggctgaggcggaagaatcgcttgaacctggcgggcggaggtcgcagtgagctaagattacgccac

SEQ ID NO: 42659 - DNA, 201 bp, Homo sapiens
acaagaaattagtcattagaaatattattggccgggcgaggtggctcacgactgtaatccccgcactttgggaggccgaggcgggaggatcacctgaggtyaggagtttgagactagcctggacaacatgatgaaaccccgtctctctactaaaaatgcaaaaacctagtcgggcctgatggcgggcgcctgtaatcccag

SEQ ID NO: 42660 - DNA, 201 bp, Homo sapiens
ggactgcaggtgcataccaccacgcccagctaatttttgtatttttagtagaggcagggtttcaccgtgttggccaggccggtcccaaactcctgacatcrggtaatccacctgcctcggcctcccaaagtgctgggattacagacatgagacaccgtgcctggcctctaattaaactttatctaccaaaataggcagcag

SEQ ID NO: 42661 - DNA, 201 bp, Homo sapiens
ctctaaaactttgaagactgatataagtacattagtaatttaatatttcaggaacagaaattttgctgaaatatcagttacatatgcgtaagtttaaaagyactacagtaacacaaagtggtcagcacagaaaaaagcatttcaaggattaagacttaccattttgtgctttaggaagaaggggtattaggtccaggagat

SEQ ID NO: 42662 - DNA, 201 bp, Homo sapiens
gaaaaagtatgtttgaatattctacaaaacactgacttaaaggaaaagaaaggcaccatcagcaatgaaattgcagaaaatgaaagaaaagaccgatgtargatttgggcagaagaaactaggtatatgctctatatcttggctcatttgataatgagcccagttgcatcattactatatttttattatgtagtcaaattt

SEQ ID NO: 42663 - DNA, 201 bp, Homo sapiens
ggtaagcatttcaaatagaaatcatttttccagtcctttttttagagttgtgttacatgtggttatatctagggcctttcaaaatctattttcagcttacrtgattttcctttgttatagtactaaaggagatgattagcaatatctagagttctgaaaatgaatatttaaatagtttcaggaataaaaagtacaaaagaa

SEQ ID NO: 42664 - DNA, 201 bp, Homo sapiens
atgtgacagatacctctaaaactttgaagactgatataagtacattagtaatttaatatttcaggaacagaaattttgctgaaatatcagttacatatgcrtaagtttaaaagtactacagtaacacaaagtggtcagcacagaaaaaagcatttcaaggattaagacttaccattttgtgctttaggaagaaggggtatt

SEQ ID NO: 42665 - DNA, 201 bp, Homo sapiens
aaaaactagtgaacaagaacctagtaaaatcacattttcattgttctaagctgcttgatttttctctaaaaacaattattaaaatgaggctgattctgctstagtcactaatgactgtctgcactaaatcttgtataaaccagccaagaaccaatacaacaactccttcatgtccccttctggttcatactatctctccct

SEQ ID NO: 42666 - DNA, 201 bp, Homo sapiens
ggtcaatatttgggctagcacctctcatgctgtctgggctgctgggaaagactttaatgtgttatgccactacctagtatttgttttgcctggtaaaccartgtttcattgggcaatatttgttttgtgttcattgccaccttattgtaaattgtagaaaattggtcgtcatgacgagctatatgtaaaacttgccagata

SEQ ID NO: 42667 - DNA, 201 bp, Homo sapiens
acctagagtactatccctttttgtttgctatttgtaatacttccaatgcagatggcttcaactgtgttcaacaaatttagtttttattacttaatttgtcytttttttttagatttttttttaaactcagcttggtctatttcaaaaaactagtgaacaagaacctagtaaaatcacattttcattgttctaagctgcttg

SEQ ID NO: 42668 - DNA, 201 bp, Homo sapiens
acacccaaatttattatctttaacttcaagatcgattatctcctgtcacatcaaagtaaaattgtctgttacagaaatatatatgtgagcatgcaactgcrtaaaaataaggcagcttttagtgtattttgtgcatattgccataaatttgtacagagtgacattctaatgatatttcttttattttcagatttataaata

SEQ ID NO: 42669 - DNA, 201 bp, Homo sapiens
aatattgagatggtattgaagaaagctactgctgcaacattaactcaagcattaagagaggtagagcttctcatgagatttcctcataggaagaaaatgawtatattacccaaaggtgccatgggaagacgttaaccatttggatgagattctaataatgagaaatgaacctagagtactatccctttttgtttgctattt

SEQ ID NO: 42670 - DNA, 201 bp, Homo sapiens
ggccttttgtgaaaagtaaatgatttacatatcagagataattaagataaccctatgcctctgatgagcaacctcacattttaaccatcttgctataaatmtatatagatcaactgaaatttatacaccttagtcacacccaaatttattatctttaacttcaagatcgattatctcctgtcacatcaaagtaaaattgtc

SEQ ID NO: 42671 - DNA, 201 bp, Homo sapiens
gagtacatagggtcctttgcccactccccaagttgctaagtgctccttcccactaattgcagcattcattcactaataaaacgtaatgtgtctggagatargaacaggattcataaaccttgtccagaattcttggaactgagaaatataacagttgaattaagggcctacttgttattctaaattcatggaattgaatct

SEQ ID NO: 42672 - DNA, 201 bp, Homo sapiens
tacttattttaatttatggttgtttgtgtttacacaagaaagagggccttttgtgaaaagtaaatgatttacatatcagagataattaagataaccctatrcctctgatgagcaacctcacattttaaccatcttgctataaatctatatagatcaactgaaatttatacaccttagtcacacccaaatttattatcttta

SEQ ID NO: 42673 - DNA, 201 bp, Homo sapiens
attcgtggtcagtcttcactctgacagttgcaatgttttacactgctggttgcctctttttgaaatgcttcaattttgatttctgtatctagcactaattktttttgtcttagattattggccattcctatactccaccatttccttatcagacaagtaaataaatgtagacatttgcccaagtttcccttgcagagtttc

SEQ ID NO: 42674 - DNA, 201 bp, Homo sapiens
atttacttctctctctttcacaacatacaccctgcagtctcagtaagcaatcctgcccttgggtctctccaacataataaaaatgccctcttagatgaatmataacttccttatcaacaaattcgtggtcagtcttcactctgacagttgcaatgttttacactgctggttgcctctttttgaaatgcttcaattttgatt

SEQ ID NO: 42675 - DNA, 201 bp, Homo sapiens
ccaggcttgtcttaaactcctgggctcaagggatccttttgcctcaacctcccaaagtgctgggattacaggtgtgagccaccacacctggctgcaaataractttcaataaaaaaaactttcattccaggatcatcagtgcaggagtaagctagttgacctggtaacaaaacacatgacctcaataataaacaggaactc

SEQ ID NO: 42676 - DNA, 201 bp, Homo sapiens
gagccaccgcgcctgtccagagaccccttttctagaaatttttttttttttttttttttttttaattagccagccatggtggtgcatgcctgtggtcccarctactcaggggactgaagtgggaggattgcttgagtttgggaaatcaaggctgcagtggagccataattgcgccactgcactccagcctgggtgacagag

SEQ ID NO: 42677 - DNA, 201 bp, Homo sapiens
catgcataattttttgcttagtagtcaaatttatcattctaaaacaatctcttctgtgttttgcattatacttggaaggtcaaggaccttagagacatacytctggctattggatgtagactttctttcttttttttttttttttttttttgagtcagtgttttgctctgtcctcaagcctcgagcgcagtggtacaatca

SEQ ID NO: 42678 - DNA, 201 bp, Homo sapiens
gaaaagatgctgcaagctacctcagctagcttctaatttggacacagcaccaatactacacacactattgaatgaatgaccacatcttcctggttcttccwttgggcagggtcaatatgcttctttggactgaataggtgtgatcttgtttgagaaaagtgtgtaaacgtagggccagattttgttcgtctccgttccgga

SEQ ID NO: 42679 - DNA, 201 bp, Homo sapiens
atatctattgattatattgaaactcatctgcctagttttcaagaattttcatttacttctctctctttcacaacatacaccctgcagtctcagtaagcaaycctgcccttgggtctctccaacataataaaaatgccctcttagatgaataataacttccttatcaacaaattcgtggtcagtcttcactctgacagttgc

SEQ ID NO: 42680 - DNA, 201 bp, Homo sapiens
gtgatcactggatactgaaataaaaataaaaataatgttaatatatgaactcaaggttttttttctagatgagtgaagaggttaattataaatctattatkaagcaaagaaacataaacacatttaggacaacccaaacaaatactgatttctgactgaaagtttgaatatctattgattatattgaaactcatctgccta

SEQ ID NO: 42681 - DNA, 201 bp, Homo sapiens
ctatttctgtcctcttgaggctgtctacatgaaattaataattctgcgacaatttaaatagacaatcttccctgtgagctgccttttgattttgaggtttrgagagatgttcaaaaaatgagaaaacaattcttcaactattagttatcttacctgaagggtgatcactggatactgaaataaaaataaaaataatgttaa

SEQ ID NO: 42682 - DNA, 201 bp, Homo sapiens
tcagcatgtctcattaatggcctagggatatctggagtccacactctcttagcctcttgatttgacaatctttgcataagatttattgtattaattggagrctgtcttatttttttaagtgaggttttgtaattatagctacatgatttattttcagcagaaaattttaaaatcaacaaaattaatatctcctttttataa

SEQ ID NO: 42683 - DNA, 201 bp, Homo sapiens
ggacaaagatgatctcttcctacacactactaaaatttaaagaatttccgtaaaaactagtgaaataaaataaatggtaatcgctctgctaagtactttayatgtattacccacatcaattttatgataaaaatattattatctacaatctacacatgaggaaactgaggctcagagccatctggtgagttgccctaaggt

SEQ ID NO: 42684 - DNA, 201 bp, Homo sapiens
cacacacacccggcacactcagtaaattaaagaactggaacctgataaagtctgtctgattcaataccccttttcttacacacttgtgatgttaattataragattatttcatggaaggctcagcatgtctcattaatggcctagggatatctggagtccacactctcttagcctcttgatttgacaatctttgcataaga

SEQ ID NO: 42685 - DNA, 201 bp, Homo sapiens
cagagagaagggatgactaaattatgttaaactatgtgactatccgagggttcttttagtactctcttaatctagccatagcccttagatctatcctcacmgtaagaaacacatgtttttctccaattactttaggggcgactactgtatgtcaaagatcatgtcacttgattttatttatcttttcgttgcaacactatt

SEQ ID NO: 42686 - DNA, 201 bp, Homo sapiens
ccagcctgggcaataaagagcaaaactccgtctcaaaaaacaaacaaacaaacaaacaaacaaataataaaaaaaagaaaagaactatgagttgaaggaayggtgtgacagttcttgcttcaagagacaataatttccgatatgttcctgcgattatttatttatgtatgtatttatttattcttttttgagatggagtct

SEQ ID NO: 42687 - DNA, 201 bp, Homo sapiens
gtttgtgctggcagctgaccataattccttagtagcaataccctctggtctaccgcccaaagagcataaagagagtttgaagcagccgagacttgaagatsgacattggatcctggtaaacttttttctttagaaaaatttaagttgacctgaaaatgaaaataaaagggcaaaaggatggcaagccatatgagaagaatc

SEQ ID NO: 42688 - DNA, 201 bp, Homo sapiens
ttatttcaagacaaaaagtttacaggacatgccccagttagctgctggtccaaagaactgaggaaacatgttgagcagtcctgaacccaagtagaagcctrgagccacactcaggcaccctatagcctaaagcaaggttgctccagcccatgcaaagatccatgaacttgttgttgtaagtctgagacataggaggtgtgt

SEQ ID NO: 42689 - DNA, 201 bp, Homo sapiens
aaattaattcaagacagattattaaagacttaaatgttagacctaaagccataaaaaccctagaagaaaacctaggcaataccattcaggacataggcatrggcaaggacttcatgtctaaaacaccaaaagcaatggcaacacaagccaaaattgacaaatgggatctaattaaactaaagagcttctgcacagcaaaag

SEQ ID NO: 42690 - DNA, 201 bp, Homo sapiens
gcaagcccctctgcaaggtccagtatgattttcttggtggtgtctacaacattgtaaagagtcgtaggtcaatatttgggctagcacctctcatgctgtctgggctgctgggaaagactttaatgtgttatgccactacctagtatttgttttgcctggtaaaccagtgtttcattgggcaatatttgttttgtgttcatt

SEQ ID NO: 42691 - DNA, 201 bp, Homo sapiens
tacaaactctgtggaagaacggaaggatgtaaagcctcatcctaggaaggagcaagcccctctgcaaggtccagtatgattttcttggtggtgtctacaayattgtaaagagtcgtaggtcaatatttgggctagcacctctcatgctgtctgggctgctgggaaagactttaatgtgttatgccactacctagtatttgt

SEQ ID NO: 42692 - DNA, 201 bp, Homo sapiens
gtgattctgaacatatgagaccaagtaaacttgccgtgcaggttgaaagttgtgggaaatcaaatgagaaacacagcagcggcgtgcagacctctaaagartcattaaatggcttgacaagccatggtaaaaacctcaaaatccaccattctcaggagtctaaaacatacaacattctaaggaatgttaaagaaaaagttg

SEQ ID NO: 42693 - DNA, 201 bp, Homo sapiens
caattaaatgtttgtttaatacttgaatttcctctggatgtgacagatacctctaaaactttgaagactgatataagtacattagtaatttaatatttcasgaacagaaattttgctgaaatatcagttacatatgcgtaagtttaaaagtactacagtaacacaaagtggtcagcacagaaaaaagcatttcaaggatta

SEQ ID NO: 42694 - DNA, 201 bp, Homo sapiens
cagctggacaaagtcgtgattctgtgatactggactctgagaaagatgatatccactgctgtgcattgggctggctctccatggtttacgaaggagtaccycagtgtcagtgtaattccatcaagaactcatcttcagaggaagagaaacaaaaagagcagtgttgtcctttggataccaacagttgtaaacaaggagaga

SEQ ID NO: 42695 - DNA, 201 bp, Homo sapiens
cttttgtatttcttttttagtgttcttgtgtcaacctaaatattacttcctcagggaaactttccatgatcatttagtccagattttagcaaacttctttygtaaaacaccatggtctctctctcatatatttttttattttttaaataatcttttaaaaatgttaaaaccactcatagttcactggctgtatcaaggcag

SEQ ID NO: 42696 - DNA, 201 bp, Homo sapiens
aagctgtatttcaatctaaatttgttcattaaatgacttttactgaaatttgtttcagtaagtcctttaggtgatgctgatgccagtttgagaaactgctytgtaagatgtaagccaggctacccacttttgtatttcttttttagtgttcttgtgtcaacctaaatattacttcctcagggaaactttccatgatcattt

SEQ ID NO: 42697 - DNA, 201 bp, Homo sapiens
ctgtattaatgggtgcatgctaatatgaatcacatggtggtgggggtggaaacctatttctgtcctcttgaggctgtctacatgaaattaataattctgcracaatttaaatagacaatcttccctgtgagctgccttttgattttgaggtttagagagatgttcaaaaaatgagaaaacaattcttcaactattagttat

SEQ ID NO: 42698 - DNA, 201 bp, Homo sapiens
acctccacctcccaggctcaagtaatcctcccacctcagccttccaagtagctgggacaacaggtgtgcacacctggctaattttttttttgtatttttgrtagagacaggatttcaccatgttgttcaggctggtcttgaacttctgacctcaagcagtcgcccagctcagcctcccaaagtgctgggattacaggcaag

SEQ ID NO: 42699 - DNA, 201 bp, Homo sapiens
gatacaatgcctgcatcagtatctatgccagtttgaagcctttaaaggcaccttcttaacaacatctaaggccacaacaaccagaagaagactgtctgagmcatcctttttttagctcagtcagtttctgcaaaacaacttctgctttgagcctttcatcttatttctgccacttatcattttcctgctggtccaggcaaa

SEQ ID NO: 42700 - DNA, 201 bp, Homo sapiens
cgttgtctatattattattgtctgtattaatgggtgcatgctaatatgaatcacatggtggtgggggtggaaacctatttctgtcctcttgaggctgtctrcatgaaattaataattctgcgacaatttaaatagacaatcttccctgtgagctgccttttgattttgaggtttagagagatgttcaaaaaatgagaaaac

SEQ ID NO: 42701 - DNA, 201 bp, Homo sapiens
ctgataggccatggttatttgctagaaatctctttctcattctcttactagtacaggcaatgattgctttaaaaagtcccttctgaaattgtatgatttgyagtagatacaatgcctgcatcagtatctatgccagtttgaagcctttaaaggcaccttcttaacaacatctaaggccacaacaaccagaagaagactgtc

SEQ ID NO: 42702 - DNA, 201 bp, Homo sapiens
atacttgcccgttgtctatattattattgtctgtattaatgggtgcatgctaatatgaatcacatggtggtgggggtggaaacctatttctgtcctcttgrggctgtctacatgaaattaataattctgcgacaatttaaatagacaatcttccctgtgagctgccttttgattttgaggtttagagagatgttcaaaaaa

SEQ ID NO: 42703 - DNA, 201 bp, Homo sapiens
tactaaaatttaaagaatttccgtaaaaactagtgaaataaaataaatggtaatcgctctgctaagtactttacatgtattacccacatcaattttatgakaaaaatattattatctacaatctacacatgaggaaactgaggctcagagccatctggtgagttgccctaaggtcacacagctgataagtagcaaactgat

SEQ ID NO: 42704 - DNA, 201 bp, Homo sapiens
tttccaacttacttaggattcaaaacatgagtgcgtcctcacatcacccaaggagaattggttactctcctatctgaggtcacatagatgcatattacagyacttagtatattttagagctagctgtgatttttttacatttattttctgtgtcaatctctgatttcttaaaggcgagccatattttatccccagtgcata

SEQ ID NO: 42705 - DNA, 201 bp, Homo sapiens
actagtgaaataaaataaatggtaatcgctctgctaagtactttacatgtattacccacatcaattttatgataaaaatattattatctacaatctacacrtgaggaaactgaggctcagagccatctggtgagttgccctaaggtcacacagctgataagtagcaaactgatgtttgaatctaagtttaaaacaatgttt

SEQ ID NO: 42706 - DNA, 201 bp, Homo sapiens
ggtgatttcataccatccgaggatgggctctgagattaactggaaggagagttgtagaatccctcccacagactcctcattcacccactgttgtattcgaytgccttctggatcctgagaataagaaagcgtatttttgcatgctggatgtttttattcattataaagtttcagcaaggtgtttcctacttaggtttccaa

SEQ ID NO: 42707 - DNA, 201 bp, Homo sapiens
tatcattaccctaattaacatcaaacacacacacacacacacacacacacacacacacccggcacactcagtaaattaaagaactggaacctgataaagtytgtctgattcaataccccttttcttacacacttgtgatgttaattatagagattatttcatggaaggctcagcatgtctcattaatggcctagggatatc

SEQ ID NO: 42708 - DNA, 201 bp, Homo sapiens
tataatttttttattgataggtaatattttcattgctattatttaccatattcttccacagagaaggagtgatatgttttcttctcattgagcatctccayggtgatttcataccatccgaggatgggctctgagattaactggaaggagagttgtagaatccctcccacagactcctcattcacccactgttgtattcga

SEQ ID NO: 42709 - DNA, 201 bp, Homo sapiens
atcaagagtgttcctctgacaagtgctgattcttgttgaggatgacgggaactgcacgggagtgtaggacaagtagatttgtctcttgaatttgagaatcrgaaaaagagaaggaagagaaataggtgtacaggaaacatcttgactcagaaacaaacaaaaaattgtcaagtctatttcaaatgttaagttttactatcc

SEQ ID NO: 42710 - DNA, 201 bp, Homo sapiens
ttgtggagcagggattgccaagaggcaaatcaagagtgttcctctgacaagtgctgattcttgttgaggatgacgggaactgcacgggagtgtaggacaartagatttgtctcttgaatttgagaatcggaaaaagagaaggaagagaaataggtgtacaggaaacatcttgactcagaaacaaacaaaaaattgtcaagt

SEQ ID NO: 42711 - DNA, 201 bp, Homo sapiens
gaggacaaggaaagaggaaaggaagagatactcacttgaaaattcattatttaataatcttgcccttgcaaaattggaaagattttataatttttttattrataggtaatattttcattgctattatttaccatattcttccacagagaaggagtgatatgttttcttctcattgagcatctccatggtgatttcatacca

SEQ ID NO: 42712 - DNA, 201 bp, Homo sapiens
gataaaaatcacagtagatggagaaccctaaaatagtaacagaggacaaggaaagaggaaaggaagagatactcacttgaaaattcattatttaataatcytgcccttgcaaaattggaaagattttataatttttttattgataggtaatattttcattgctattatttaccatattcttccacagagaaggagtgatat

SEQ ID NO: 42713 - DNA, 201 bp, Homo sapiens
tgccattaataaacagtgtgaggaggacgttgaagtgcctaagactggattttggaattggatagaaaaatgcatattttgaattccaaattcatcacttytcaggtgttgaacttgggaaagtgtttctcaatatcttcatctttaaaatagtaataaagatactacaatagaaattttatgaagattttaggagaaaat

SEQ ID NO: 42714 - DNA, 201 bp, Homo sapiens
catattaacataaatacattcatacaaaacaattgtttctcctttacaaaccatcaacctttgcttatgtttgccattaataaacagtgtgaggaggacgytgaagtgcctaagactggattttggaattggatagaaaaatgcatattttgaattccaaattcatcacttctcaggtgttgaacttgggaaagtgtttct

SEQ ID NO: 42715 - DNA, 201 bp, Homo sapiens
cccgggtgttatctgcgggccgggtccgcggcttctctggtggcactaggaccgcggcggcgcggccctcgcagccaccgcctcgggcgtgaggcggagcstagctgttcctggatcctgggcctggctcctcgacccgcccctggaggcggaccccacttgacttaaactctggggcccgggaggccgccggttttctcc

SEQ ID NO: 42716 - DNA, 201 bp, Homo sapiens
ttaagaggtcgtgcttcgtgatctggtctccaaagtcaactttcctcagggactttcagaatccccaaatagactatccactttctttcacacttatttgyctctaacttgttgatttcttttttttttttctgttttttaagggttaacaatctcttgggtgcactctgacttccatgcgctttatagaaaaaattggtc

SEQ ID NO: 42717 - DNA, 201 bp, Homo sapiens
aagcattattgtggtaataactgactgttttagtccattctcacactgctgtaaagaactgcctgagacttggtagtttaaaggaaaggggtttaattgaytcacagttccgcagggctggggaaacctcaggaaacttataatcatggtggaaggggaagcaaaaccttcgttcttcacatggcagcagcgaggagaagt

SEQ ID NO: 42718 - DNA, 201 bp, Homo sapiens
tgctacagttacttagtaggtttacgcattacatttttaaaagcattccccaaaatatgcaaaatacaaccaggaagtccactatcatctctaatattcawattggagatctttgccaatcgaataaaacaaactaataacaaaaacctcagaagattaagttcagaaaggaagctaaaatataacattttcacacaaaat

SEQ ID NO: 42719 - DNA, 201 bp, Homo sapiens
agccaagtttaataacaagtagtatagacaataaccatcaaatgaacaccagtgtacccaccacctagtttaagaaatacccagttttgtttgtttgctgrgatgtcaaggcaagaaatatctagttttaagaaatacgctgtagactcttccctgatcctgcctgcaaatttctccaaccatagttttcctcattctgta

SEQ ID NO: 42720 - DNA, 201 bp, Homo sapiens
ggagagcttatgacatggtgcagtttggactaacactgagagaccagagttcagtgtaaaatgaatgtgcgttcagagaacagagaggagtcgggctttayagcaaaatttgctgcccaggttccccatcaggttcatttgcatatgaacccagattcatttgcatttgctttcctctgatgcagctgagccctgattaac

SEQ ID NO: 42721 - DNA, 201 bp, Homo sapiens
tcaccaaaaaaccaataaaagactgaatgtggccctttatcagctagacctcaaaatcttctttgctttctatgcgtatttccaataaaaaagtacaaggrttgttaaaagtccttatttatttatttatttatttatttatttatttatttatttttagaaccagggtctcactctgttgcccaggctggagttcagtgg

SEQ ID NO: 42722 - DNA, 201 bp, Homo sapiens
cttctcattaaaagcctgagtcttagccgggcatggtggtgtgttcctgtaatcccagctacttgggaggctgaggcaggagaatcacttgaacccaagasgtcaaggtagcagtgagcccagattgtgccactgcactccagccttggtgacagagtgagactccgtcttaaaaaaaaaaaaaaaaaaaaaaaaagcctg

SEQ ID NO: 42723 - DNA, 201 bp, Homo sapiens
gtgctgggatttacaggcgtgggccaccatgcctggcctgtttctggaaactttaaaacgataatctacctgggattgatttgtttgtatatgtctcttgstgtgtaattggataaggcttattttcattcgtggcatatagataaccaattgacctagcttcatgtattgaaaagaacttttttcctaactttgtcataa

SEQ ID NO: 42724 - DNA, 201 bp, Homo sapiens
cacagctgggaagtagcagctccaggagcagaagctggggccgcttcctggtgcaccgatggtcttcaggtgttttgtggaaactcgggggcctccggggygaccttgaggacatggacaaggctaagcaggggttcccttcacccagccctgcccttggtttactcaggagtcagaccagccctagtttcctgtgtttca

SEQ ID NO: 42725 - DNA, 201 bp, Homo sapiens
ctcttacagcagttttctctgtgatacatcttgagcttcagctttcttttataatcatgtaatacataaagattgaattgagaaatcatcataaacagaaratattgtccaatggaaatttctgggagatggaatgttctatgttttatgtctatgctctccaattcagtggccactagtcacatgtgacagcttgaaatg

SEQ ID NO: 42726 - DNA, 201 bp, Homo sapiens
gagccacttgtaactcttacagcagttttctctgtgatacatcttgagcttcagctttcttttataatcatgtaatacataaagattgaattgagaaatcrtcataaacagaagatattgtccaatggaaatttctgggagatggaatgttctatgttttatgtctatgctctccaattcagtggccactagtcacatgtg

SEQ ID NO: 42727 - DNA, 201 bp, Homo sapiens
ctgtctgcccttagtatcctccacactgtgccccgccattaccctagagccacttgtaactcttacagcagttttctctgtgatacatcttgagcttcagytttcttttataatcatgtaatacataaagattgaattgagaaatcatcataaacagaagatattgtccaatggaaatttctgggagatggaatgttctat

SEQ ID NO: 42728 - DNA, 201 bp, Homo sapiens
attaagaggtcgtgcttcgtgatctggtctccaaagtcaactttcctcagggactttcagaatccccaaatagactatccactttctttcacacttatttscctctaacttgttgatttcttttttttttttctgttttttaagggttaacaatctcttgggtgcactctgacttccatgcgctttatagaaaaaattggt

SEQ ID NO: 42729 - DNA, 201 bp, Homo sapiens
tcagggaaaagtagtacacatcaggtctgaggagacaaagttttaatgtttgcaccctggctctctttgctggttatataaactctgtgaatgttgcttamcttagtgacaagaggggaaaacaacctgacctgcttcactgctactcctgccacacgttaatcctcactatttgcccctaagtccctgtctgcccttagt

SEQ ID NO: 42730 - DNA, 201 bp, Homo sapiens
atcaggagctcagtgtcaggcaggcaagcctcctgcaggggagccccgccctgctcaggtggcctcatctcccctcccagctggtggtgctgccctatcaratgctgctgcatgcggccactcggcaggctgcgggcatccggctgcaggaccaggtggtgatcatcgacgaggcgcacaacctgatcgacaccatcacgg

SEQ ID NO: 42731 - DNA, 201 bp, Homo sapiens
agtagtacacatgagtcagggaaaagtagtacacatcaggtctgaggagacaaagttttaatgtttgcaccctggctctctttgctggttatataaactcygtgaatgttgcttaacttagtgacaagaggggaaaacaacctgacctgcttcactgctactcctgccacacgttaatcctcactatttgcccctaagtcc

SEQ ID NO: 42732 - DNA, 201 bp, Homo sapiens
agccaccgcgcccggccaaaaacattttttttttttgtagaactggaatctcaccatgttgcccatgctggtttcaaactccgatcctcaaatgatcccaytgcctcagcctcccaaagtgctgggattataagtgtgggccaccgtctccagcctgagcctcaatttctttattgtgaaatgggaggattgacattatgg

SEQ ID NO: 42733 - DNA, 201 bp, Homo sapiens
agctgacctgtggccccacagtgatccttactgggcaatctactggccaggaggccaagccctgtctaggtactaccctaatgaaacctttaaggcgctayagatctttgctgttttcagttccctccaacctctacaaaaaaccagagcaatgctaggcgtggtggctcatgcctgtagtctcagtactttgggaggctg

SEQ ID NO: 42734 - DNA, 201 bp, Homo sapiens
accgcgcccggccaaaaacattttttttttttgtagaactggaatctcaccatgttgcccatgctggtttcaaactccgatcctcaaatgatcccattgcytcagcctcccaaagtgctgggattataagtgtgggccaccgtctccagcctgagcctcaatttctttattgtgaaatgggaggattgacattatggggtg

SEQ ID NO: 42735 - DNA, 201 bp, Homo sapiens
ttttatttttaattatgcaaaattaaaaggaaaagtagtacacatgagtcagggaaaagtagtacacatcaggtctgaggagacaaagttttaatgtttgyaccctggctctctttgctggttatataaactctgtgaatgttgcttaacttagtgacaagaggggaaaacaacctgacctgcttcactgctactcctgcc

SEQ ID NO: 42736 - DNA, 201 bp, Homo sapiens
taaagtagacacaggaaggaggacaggcaaagctttcaccttaaagtttggcatggaattttagattactgtagtgaagctctcctaataactagaaattwccaggtcacttttttatttttaattatgcaaaattaaaaggaaaagtagtacacatgagtcagggaaaagtagtacacatcaggtctgaggagacaaagt

SEQ ID NO: 42737 - DNA, 201 bp, Homo sapiens
aactctggaggtgaagcacaaggtagtgacatcaaaaagttagccatgcttcttcttgactcttaaagacttccagcctaaagtagacacaggaaggaggrcaggcaaagctttcaccttaaagtttggcatggaattttagattactgtagtgaagctctcctaataactagaaatttccaggtcacttttttattttta

SEQ ID NO: 42738 - DNA, 201 bp, Homo sapiens
ctgttactcaggggattttccagcaatgctggcaattccctgcctttatgacccaactacaatgagacttttcagtctctgccttttctgtattcttccamctctggaggtgaagcacaaggtagtgacatcaaaaagttagccatgcttcttcttgactcttaaagacttccagcctaaagtagacacaggaaggaggac

SEQ ID NO: 42739 - DNA, 201 bp, Homo sapiens
caacacacagccactgtgatagggaagtacctagacatttgggctttggggatttctgttactcaggggattttccagcaatgctggcaattccctgcctytatgacccaactacaatgagacttttcagtctctgccttttctgtattcttccaactctggaggtgaagcacaaggtagtgacatcaaaaagttagccat

SEQ ID NO: 42740 - DNA, 201 bp, Homo sapiens
tgtaaagaaggggttttgccatgttgcccaggctggtctcgaactcatgaactaaaagcaatccactcacctcagactcctaatagtgctaggattgcctrcatgagccactgctcccggccgcaccccccacctttgtacagggcaaagactttgttatgtattcttccagacttttacattttagggagaaatttgtgc

SEQ ID NO: 42741 - DNA, 201 bp, Homo sapiens
gactctcactattcacaccaggtgattaaagctggggtgctggtggccggcagagcacctggtcataggagctgagctgggacacttgtgtgtgtgtgtgkctgtgtatgtgtgtgtgtacgtgtgtgtgtgtgtgtgtgtgttggggatgcagagtgcactgaagtaataggctcacatgtgttttcttcttcctgctct

SEQ ID NO: 42742 - DNA, 201 bp, Homo sapiens
ttttttttttttctgagacagggtctcactctgtagcccaggctggagtgtagtggcatgatcatggctcactgcaggcttgacctttggggctcaagcartcctcccacttcagccccctgactagctgggactaaaagtgtgcaccaccatacctggctaattttggcatgttctttttttgtacaaaataatcttctg

SEQ ID NO: 42743 - DNA, 201 bp, Homo sapiens
tcccactcaaaagtcataatctattttctactttaatgcatctgtaattggtgtttgtctatggtgtgaggtagggaacccaagcccaatttttccacatgaataaccatgttgttcttaatatcctagcaacacttattgaacagaccattttcgcccaccaatcacccccacatcatgtatcacataacaagtgctata

SEQ ID NO: 42744 - DNA, 201 bp, Homo sapiens
caaacatggcgaaaccctgtctctaccaaaaaatacaaaaattagccaggcatggtggcacatgcctgtaatcccagctactcgggaggctgaggtgggamaatcccttgaacccaggaggcagaggttgcagtgagctgagattgagccactgctctctagcctgggctacacagtgagactctgtctcaaaaaaaaaaa

SEQ ID NO: 42745 - DNA, 201 bp, Homo sapiens
tgcttcaacagtaccctatctttatttccatcccaggaattattcatctcactgaaacattacaattctatcataattctctcttcatggtctctcttccycaataccccatcatctcctagagagcaatatatgtatttttctttttatttatttatttttggagacagggtctcactctctcgtccaggctggagtgca

SEQ ID NO: 42746 - DNA, 201 bp, Homo sapiens
tctcaaagaggtagaaacaatcttggactttgccacgctcctcagacacagggttaaaattgtcctgatgatgagatggcataacacattcaggtggttargtgttttgactcctgtccaacaaaataaaaaacccaaaaaacatctgctccttcctggttcagcagcctattttccatggaagatgcgtgtctgacacag

SEQ ID NO: 42747 - DNA, 201 bp, Homo sapiens
ggccgggctggtctcgaactcctgacctcaggtgatccacacgcctttgcctcccaaagtgctaagattacaggcgtgagccactgtgcccagcccacacrctttttaataatgcaattactcagcagaaataagacaattctttttaactgaatcaagaaataaaaggcagagttttcttctttaagcattttttttaaa

SEQ ID NO: 42748 - DNA, 201 bp, Homo sapiens
ccactatacctggctaattttttgtatttggtggagacggggtttcaccaggttggtcaggctggtatcgaattcctgatctcaggtaatccacccacctyggcctcccaaagttctgggattataggtgtgagccactgtgcctggcctgcattccagctttcttgtagctatttgtgtgatattttttcatcattttac

SEQ ID NO: 42749 - DNA, 201 bp, Homo sapiens
agcaaatactgaaacctgctagacattatctacatgcatgtgtcttttgggttggcctgaaagacttttatgcctgtcgtattggctgttaatagtacttwgattcactctgatgatgttccacttacctttaataaattgtcaacccacttttctttcccttttttgagacagatcttgctgtgtcatccaggctggagt

SEQ ID NO: 42750 - DNA, 201 bp, Homo sapiens
ttttgggattcccagctggcttgtcctagagtgctttattttgcttatgcaatacttctccagtaaaaatgacacaggagccaacacacagccactgtgayagggaagtacctagacatttgggctttggggatttctgttactcaggggattttccagcaatgctggcaattccctgcctttatgacccaactacaatga

SEQ ID NO: 42751 - DNA, 201 bp, Homo sapiens
aaattagctgggcatggtggcacacgcctgtaatcccagctactcaggagaccgacgcaggagaatggcttgaacctgggaggtggaggttgcagtgagcygagatcgtgccattgcactccagcctgggtgagagactctgtctcaaaaaaaaaattaactgcattatgacagacttttttccttttagcaattgaaact

SEQ ID NO: 42752 - DNA, 201 bp, Homo sapiens
ctcatatctgagtatacacattttacttatttctaaatttttttctgattgatgttcaacagttttctcaggtatatattgctcttttttttgtttatatwataccttgatttcaagtcattagaatcttcaaccatttagtgattcatgcttatgttttgggattcccagctggcttgtcctagagtgctttattttgct

SEQ ID NO: 42753 - DNA, 201 bp, Homo sapiens
ttcgagaccaccctgaccaacatggtgcaaccccgtcaaatacaaaaattagctgggcatggtggcacacgcctgtaatcccagctactcaggagaccgasgcaggagaatggcttgaacctgggaggtggaggttgcagtgagccgagatcgtgccattgcactccagcctgggtgagagactctgtctcaaaaaaaaaa

SEQ ID NO: 42754 - DNA, 201 bp, Homo sapiens
ttttaaattaataatatgcctacttccaaggtctttaattatttttaaagttacactattgactcatatctgagtatacacattttacttatttctaaatytttttctgattgatgttcaacagttttctcaggtatatattgctcttttttttgtttatataataccttgatttcaagtcattagaatcttcaaccattt

SEQ ID NO: 42755 - DNA, 201 bp, Homo sapiens
tggcaatacgcgataaaggaagctgcatggccaggatggaaaagttgctggtcacagtagcagcaaagggcttagctagttcttcctggcagcctcctcartaattcatagtttactgggaatcatatatcaaatagttttagctcttcagaagaaaatgaaatttataattaactgcattgcccgggtgcagtggctcac

SEQ ID NO: 42756 - DNA, 201 bp, Homo sapiens
tctcaatttcatcttccaaattactaattctctcttaagcatcatcgatccttctagtcagcctttctacacatatatttttaaattaataatatgcctamttccaaggtctttaattatttttaaagttacactattgactcatatctgagtatacacattttacttatttctaaatttttttctgattgatgttcaaca

SEQ ID NO: 42757 - DNA, 201 bp, Homo sapiens
agaacaaaattgcttgtaaggaataacagtagattcctctgggctacgttttatgacaatttctcaatttcatcttccaaattactaattctctcttaagyatcatcgatccttctagtcagcctttctacacatatatttttaaattaataatatgcctacttccaaggtctttaattatttttaaagttacactattga

SEQ ID NO: 42758 - DNA, 201 bp, Homo sapiens
gaacttaaagtataatttaaaaaattttaaataggtagaaagagcaaagaacaaaattgcttgtaaggaataacagtagattcctctgggctacgttttakgacaatttctcaatttcatcttccaaattactaattctctcttaagcatcatcgatccttctagtcagcctttctacacatatatttttaaattaataat

SEQ ID NO: 42759 - DNA, 201 bp, Homo sapiens
ttgttttggaaagaagtaaaactgttcattattttttattattatattttaagttctgggatatatgtgcagaaggtgcaggtttgttacataggtatacrtgtgttatggtggtttgctgcacccatcaacccatcatctacattaagtatttctcttaatgctatccctccccttgcccccaacccccgacaggccccg

SEQ ID NO: 42760 - DNA, 201 bp, Homo sapiens
gtttgttttggaaagaagtaaaactgttcattattttttattattatattttaagttctgggatatatgtgcagaaggtgcaggtttgttacataggtatrcatgtgttatggtggtttgctgcacccatcaacccatcatctacattaagtatttctcttaatgctatccctccccttgcccccaacccccgacaggccc

SEQ ID NO: 42761 - DNA, 201 bp, Homo sapiens
tttttgtttttaaactgctattatgagcatattttatggtttttacttttaaaatgtaaattatatttatttatttattttttataaatgtcattttaagycatcagattttggggtaatttctttttgtttgttttggaaagaagtaaaactgttcattattttttattattatattttaagttctgggatatatgtgca

SEQ ID NO: 42762 - DNA, 201 bp, Homo sapiens
caatgtaaacaaaaaaacaaaaaaatacatcagtcattatttcattaaaaataatattttttgcatactgatagcaatggagtattgaaaaacaaaaaatraaataaaataacattttgcttcttttagtttttttgtttttaaactgctattatgagcatattttatggtttttacttttaaaatgtaaattatatttat

SEQ ID NO: 42763 - DNA, 201 bp, Homo sapiens
tgaacatagtataatattcataaaattcactcctttatagtattttgtttcatccttactataggaagaaagttgggacagaaggggtagaaggaaatttkaatctcttagaataagagacactggggcgggcgtggtggctcatgcctctaatcccagcactttcagaagctaaggcgggtggatctcaaggtcaagaga

SEQ ID NO: 42764 - DNA, 201 bp, Homo sapiens
ctgtgttagtttgctgaggataatggctcccaggtcccagtctatcattgatgggcatttgggttgattccacgtctttgctactgcagatagtgcttcartgaacatacgcatgcatgcatctttgtaacaggatgatttatattcctttgggtatatacccagtaatgggattgttgggtcaaatggtatttctggttc

SEQ ID NO: 42765 - DNA, 201 bp, Homo sapiens
gtaaaataattcttatctatatatatgacaatggtctgttagggggaggccaacccacctgccccaccccaagccagtttgcacaatcatttctacatttstttactccacataaatttcttcttctttgacgcctttgaacaggttataacatctgcctacttttctcatttaattaatacgttaagtaaaatctttagc

SEQ ID NO: 42766 - DNA, 201 bp, Homo sapiens
ttatgggtttcttacatcactgcccattagtcccctccagccaccagaccagactgattatttatggttttgcttgctttgcttttgttttctaggtggckatctcttaggaaccccagtagtttggacacacacacacacacacacacacacacacacaggcaaggtcacagtcagatccctggcacgttaatttggcca

SEQ ID NO: 42767 - DNA, 201 bp, Homo sapiens
ccattcagatgccaattgcaagctccaggttgttttacctgtgcttctgactgaccaagctatacatcgggtttcccaaaaacccctccttgggtttgatkgatttgctacagcagctcacagaactcagaaaaacacttaactaacctttactggtttattataaaggatattacgaagaataatgatgaacaccagatg

SEQ ID NO: 42768 - DNA, 201 bp, Homo sapiens
cccaatgaattacttctttcactggcttcctttgctctggcaaaggtggattttttttccatggcagagaaattttataaaaaatgtaatattttagaaawtgcctaaatgtcaagaatacaacatcttgtttgttgttgttgttgttgttttgtttgttttttgatacggagtctcgctctgtcgcccaggctggagtgc

SEQ ID NO: 42769 - DNA, 201 bp, Homo sapiens
acagtatttacagcctattagaatttgagagattcaggactatttgttttttttaagtccatcactcttatcagtgattttgaccaaatttagttaatacygaagtcaggatctgaacccggggacgtcttgctcagagtctgggcatttgaccactccactccactccactccactccactccactgcctctccacgagt

SEQ ID NO: 42770 - DNA, 201 bp, Homo sapiens
ggaggggcttggtacagacctggatggctcaacctttagaggttgagcagagacgaggggactgcaaagaagcagccaggcaggtaagagttcagatgtcygggaagccacacgagaaagtgtttccaaaagcaacacatgctgttgaagaagcccagaaagaggaagatacagaggtggccaccgatccaatgacaacgt

SEQ ID NO: 42771 - DNA, 201 bp, Homo sapiens
ctcctgcctcactcagcctcctgagtagctgggattacaggcacacgccaccacacctggctaatttttttggatttttagtagagatggggtttcaccaygttggccgggctggtctcgaactcctgacctcaggtgatccacacgcctttgcctcccaaagtgctaagattacaggcgtgagccactgtgcccagccca

SEQ ID NO: 42772 - DNA, 201 bp, Homo sapiens
tataattttgctagatatctataacttaaaaagacatgcttagattttattccatccatgtgttgtgagtgttctatgtctattcttctttccagttctgyattctcttcaagactggttgaagtaccacacacattattaattttttttttgagatcgagttttcactcttgctgcccaggctggagcgcaatggctcaa

SEQ ID NO: 42773 - DNA, 201 bp, Homo sapiens
aaatacaaaaaaaggccgggcaggcacagtggcttatgcctgtgatcccagtactttgggagaccgaggtgggtggattacctgaggtcagaagttagagrccagtctggccaacatggtgaaaccccatttctactaaaaatacaaaaattagcagggcatggtggcaggcacctgtaatcccagttacttgggaggcta

SEQ ID NO: 42774 - DNA, 201 bp, Homo sapiens
ccaggggcgggggcggggtgaggatgaaaagctgacctgaaacccctgaggtcggctggatggcccctagaagtagaaactgtgccctaatcagaactaaytgaagttctgcactatcacaggactccattatggcacttggcccccgtactgtctctcctctctgtgggtttcctaaggacagagtggcatccactttct

SEQ ID NO: 42775 - DNA, 201 bp, Homo sapiens
aaacaaaatttataacgtgaataaagaaaaaaaatatgttactagaataaagcaatgagatcatgctaccactgctccatcttcagaaatttatagttgtraaaatcagccactgtcttgttttaaaccaggtttaatgactatgtagtagtcatcatcaagagtctgcattctatagctcaggctctcccctagccatac

SEQ ID NO: 42776 - DNA, 201 bp, Homo sapiens
ttcaatttaaaataccagagcgaatttatatattttaggtataagaatagtattttaatgtatattatttatttcttaagtcctacgtcttttaggtactkaaatgcttacagatgaaatcatgctatgtctgtggttggcatagatagaaaaggaaacagaagtggtcaggactttttcccatctataagtttacattag

SEQ ID NO: 42777 - DNA, 201 bp, Homo sapiens
tatttttttaaacatttgaaagtacaacacacagaaagtataactttaaggtggcataaaaactaggtgttagaatttttatctcaaccaccaagccaagytgacatttagaacaaataactggccttgtatctgaaaacagagaatactgaagtgtttgatatttccattatccctagtttgctgcaacatgttactttt

SEQ ID NO: 42778 - DNA, 201 bp, Homo sapiens
caccagcctgcctccgcaggggggatttttgttttttttgtgtgtgtgtgtgtttttcattgattgttaatgctcatgatcacgtggctgactgggtgctmtggcttgctgccaccacccagcgtggaagaatatcatactgcctatcacaggcccgggaaaagatcaaaattcaaagtacaatttctgctgaatgcctgt

SEQ ID NO: 42779 - DNA, 201 bp, Homo sapiens
tttttccttatggggacaaaaaccatgtacaggcacaaataaggttgtacacaggtgcatacacagacacaaaagtgttgcctttcacataagatgacaayattcctgacgcaaattatgagtggcttaagacatccgttcatgttggtgaggaggagagcaatgtctgaaaaggtgagaaaaatggtagaaggctctcat

SEQ ID NO: 42780 - DNA, 201 bp, Homo sapiens
atgaagcattccacatagttctttacatacagattttcaaatgttagttgtttatagtagtacagatgtacctcagcttacgatggagttacatttcgatwacctgtattaagtagaaaatgtaagtcaaaaatggggttttatagacatgatgggatgggaaaacacaacatccaaaaaacttagctaacacagtacacc

SEQ ID NO: 42781 - DNA, 201 bp, Homo sapiens
agacagaggacactcatatgccaccccataacaactgttaactcctgtgagaagtaaagtgacagaaaccccatcacgttaaaactcattcaaagtgagakgacatttcatttcatttagtctttttattgggaatacaaaaggttgtgaagtcaggactgtggttgggacaaaaaaatttaggtgtttagatcacaaatc

SEQ ID NO: 42782 - DNA, 201 bp, Homo sapiens
taatatatgaatccatttggccttttgctgactgcagttacagaagcatagagaactgttctgccccttctaaccactgtgctgcaagagggaggattgckagtctttgttaatttgttgtgatacttaaatgagataaaagtatatgaagcattccacatagttctttacatacagattttcaaatgttagttgtttata

SEQ ID NO: 42783 - DNA, 201 bp, Homo sapiens
ttagctggcaccatctctttgcctctttctttctcctttgttgcagaacctttgtgtaaatgaagacgtgagaagcctaggttctgtgcagcttatcaacraccgctgcgtggacatgcagagaagcaggcacggtagccaccaggaccatggtgtagccgcaggtggtctggagagagtgaggcaggggtggcagtgact

SEQ ID NO: 42784 - DNA, 201 bp, Homo sapiens
tttgaacccaggaggcgaaggttgcagtgagctgagatcgaatcactgcactccagcctgggcgaccgagaaagactgtgtctcaaaaaaaaaaaaaaaaagtccttgatgaagcattaaacattaattttatcaatctcaagtacagttatttttagtacataaagaatttcagcagtcttctcctactgccctgtcttc

SEQ ID NO: 42785 - DNA, 201 bp, Homo sapiens
ctctcacacacacagagtggatgaggatgaggatgacctggaggaagaacacataactaaggtaacacgagtgtcctcagctggtgctgtgctgggggctrtgggctgggctgtgcacccttggggaagaggctggagtcactcggctacttctcaccctcctctccacaaaggaggagcttccagcacttggactctgtt

SEQ ID NO: 42786 - DNA, 201 bp, Homo sapiens
tctaatagaagaatataacaataacacaattacagaggtcaaggtcgtttttaatctgtatagggttttgaaacctttatttagtagctgaaaccagcacygtaacaacatttaaatagctagttaccataaattttattttctggaggaaatctaaaacaatggtatggactaaaattgagttgaatgctttaggcaaaa

SEQ ID NO: 42787 - DNA, 201 bp, Homo sapiens
ccctgtggagtgtgctgtcctttaaaataagtctctgctttggctgccttgcttgtgtggtttgttcagttctttgttcaagacgccaagaacctggacarctaccctcaactgcatggtttagaggaactcttctgttccactgaaggcattttgtctatctccagtggcagaaaattgactcactcataataggagcga

SEQ ID NO: 42788 - DNA, 201 bp, Homo sapiens
gctttgtctctggcacgtggggaggtgggtactggtgctgagacttcttcctccctccccacctccactgcccctgtccagaggcaggaagaagaagaaasagagaatctcctccgcctcagcagggagatgctagagacaggcccggaggctgagcggctggagcagctggagtctggggaggaggagctggtcctcgcc

SEQ ID NO: 42789 - DNA, 201 bp, Homo sapiens
gagcacatgaatgataagccgtagattctctgcacacactaagttggaccttcccgtccacaggttcaccataggtatatctaatagaagaatataacaayaacacaattacagaggtcaaggtcgtttttaatctgtatagggttttgaaacctttatttagtagctgaaaccagcactgtaacaacatttaaatagcta

SEQ ID NO: 42790 - DNA, 201 bp, Homo sapiens
tttggattgtcaggttgtaagtttttaagatatcctggattctgatccttccttactagggaccataaatgtgagggtttactcctgggttctaggttctrttccattgatcaatgcctgtcctgtgtcagtactatatggtcttgtttattgtagttttgtcgttttgtttttttgttttttgtttttaagactgaatct

SEQ ID NO: 42791 - DNA, 201 bp, Homo sapiens
cccccagtgaggaggcgccgagctgagtggcccagactccttaggagaggcctggttttgggcttcctggtgattttccttcatgtctgcctcctgtaggyggagcaggccaggaggaagcagcgagaagaacgcctgcagcagctgcagcacagggtgcagctcaagtatgcagccaagcgcctggtgagcctcatttct

SEQ ID NO: 42792 - DNA, 201 bp, Homo sapiens
aataggaatagaaatatagaataaaagtatatattttaactgtaaagaggaaaacaagaagaaaggaaggtaaatggaaggtgaggataaaaagttaacgsaaacctatttataattttgctgatatacctcttacctgaatggtaaaatttttacagagtgaactgataagatgagcacatgaatgataagccgtagatt

SEQ ID NO: 42793 - DNA, 201 bp, Homo sapiens
ctggaggtcagcagggccttctccacacaaggaactgttggtgcccatttattactcacctgggaaaggacctgatcgttgccattggcagcatggttcartggctgcaaatggatctgatggagagcgtgtggctttgggaggagcgtgccgccttccacagtgagcagcgaggctgggacctgcagggatgaggtcccg

SEQ ID NO: 42794 - DNA, 201 bp, Homo sapiens
ccgctcacttgttatttgccaggtaatcctctaatccagaggatttggccttttgtgtgtgttaatgtcctgcttgcaccagctctatgaggaaggtgctrctgttgtcatttccatttctgcactcgtggaaacaagcgtagtgaggccagcctgagccacagagctgcaggtaggggaggcagctggaaccctggcgcc

SEQ ID NO: 42795 - DNA, 201 bp, Homo sapiens
caaataggaatagaaatatagaataaaagtatatattttaactgtaaagaggaaaacaagaagaaaggaaggtaaatggaaggtgaggataaaaagttaaygcaaacctatttataattttgctgatatacctcttacctgaatggtaaaatttttacagagtgaactgataagatgagcacatgaatgataagccgtaga

SEQ ID NO: 42796 - DNA, 201 bp, Homo sapiens
agcaatcctccctccttggcctcccatagtgctgagatgacaggcgtgagccactgtacctgaccccttttaccttgtttagcctgacaacccatcttctscctctcaggtctttccatctcagtcttctgcactccaggcttctgcatcttcctcctatgctcagcctttaattgtcgatgtttctggttctatagcttc

SEQ ID NO: 42797 - DNA, 201 bp, Homo sapiens
gaaaatgaaacttagcatgacaaaagaggaatataaaatttacaaataggaatagaaatatagaataaaagtatatattttaactgtaaagaggaaaacargaagaaaggaaggtaaatggaaggtgaggataaaaagttaacgcaaacctatttataattttgctgatatacctcttacctgaatggtaaaatttttaca

SEQ ID NO: 42798 - DNA, 201 bp, Homo sapiens
ttggcacaatagtcttatagcctcagtgtgtcaccttctgttgatcttaccatggtatgtacaaaagtataatatggccgggcgtgatggctcacacctgkaatcccagcactttgggaggccgaggcgggcgggtcacctgaggtcaggagttcgagatcagcctggccaacatggtgaaaaccccatctctactaaaaa

SEQ ID NO: 42799 - DNA, 201 bp, Homo sapiens
tttcagcctgaccctcctctccctccctcttgcctcctcaatctgccagttgcctccagggctctcctagctcagcttccacttagagcccacttcctgtsttctgcaaggagcaggagcagggattgcaacctgggaatctaattgttcttaaacagaatttcaacccgtccctttgttttcagtggcctgctgtgttcc

SEQ ID NO: 42800 - DNA, 201 bp, Homo sapiens
atagggttcccatctggagctcctatatacacttatttccagtgagaataggttgagaggaaaataattatacatctaatactcttgaatatgcagaaacrtcacatctccctgactaaattcacaaagtataaaataaagaacaggacatatgttcccagtaaattgatagggtgtagattttgatatgaaaccaaatgt

SEQ ID NO: 42801 - DNA, 201 bp, Homo sapiens
accttccaagtagatcttttaggaaattcctcctttgtcagtttggaaaagttgattcttctctttagtggttaagaacctgactgatagggttcccatcyggagctcctatatacacttatttccagtgagaataggttgagaggaaaataattatacatctaatactcttgaatatgcagaaacatcacatctccctga

SEQ ID NO: 42802 - DNA, 201 bp, Homo sapiens
ttcgggaggtggaagttgcattgagcggggatcacgtcactgcactccagcctgggcgccagagcaagactcctctgtcacaaaaaaaaaaaaaaaaaaaagacagggtcttgctgtgttgcccaagctggacttgaacgcctgggctcaaggagtcctcctgcctcagcctcccaagtagctaagactgcaggtgtgcac

SEQ ID NO: 42803 - DNA, 201 bp, Homo sapiens
acctaaagtattctctaaacaggacaggaatatgtgacactgtgtgtgtgcacctgtgtgtgtgtgtgcacacatgtgtgtggataaatggtatcacactrtagtatggggattgcagctggcagttgtatattagacagtcagatctggcatgattatagctgaaagccttgctacatcctagaccagcctgtttgtgtc

SEQ ID NO: 42804 - DNA, 201 bp, Homo sapiens
tattataattgttactattgttagcgtttattgtccacattttttaaatttaagaattagaaggttcttaattatttccaacctaaagtattctctaaacrggacaggaatatgtgacactgtgtgtgtgcacctgtgtgtgtgtgtgcacacatgtgtgtggataaatggtatcacactgtagtatggggattgcagctg

SEQ ID NO: 42805 - DNA, 201 bp, Homo sapiens
taagcatccattaaatgttagcaattattattattataattgttactattgttagcgtttattgtccacattttttaaatttaagaattagaaggttcttmattatttccaacctaaagtattctctaaacaggacaggaatatgtgacactgtgtgtgtgcacctgtgtgtgtgtgtgcacacatgtgtgtggataaatg

SEQ ID NO: 42806 - DNA, 201 bp, Homo sapiens
cgggtatagtggcagtgctgagatcactccattgcactccagcctgggcaacaaaagcgaaactccatctcaaaaaaaaaaaaaaaaaaaaaaaaaaaaargtaagttactacttaagatcatgctgatattctaaagataacaataacagagtttcctacctgcccgagctatgttcccgtggagatccttcttcaaaaa

SEQ ID NO: 42807 - DNA, 201 bp, Homo sapiens
gtttagtttgaaatcaagtaatgtgatgcctccatagttttttgtttgtttgtttgtttgtttttatttgtttgtttttttaagtctttctttggctatgygggatccttttatgttccatatgaattttaggatttttttctagttctgtgaagaatgatgatgatattttgataacaacacaattcgcaattgcaaaat

SEQ ID NO: 42808 - DNA, 201 bp, Homo sapiens
accaccctccaagaatctccatgtgttcagtcatccgaaaaacctctgaacactgatttttggggtttttatggagtctttgttacataagcatgattgaytaaaccattggctactggtgatcaacttaaccttcagcccctgtcccctcccaggaggttgaggagtagggctaaaagttcgaaccagcaaatcctacct

SEQ ID NO: 42809 - DNA, 201 bp, Homo sapiens
agcaaagtggatgagtgggagaaggatacttcctgagctctttcaaggaggtcagggcaagtcgcatagggttttgttaaccctgacgtggatttgagaawcatcagcacgcaaggaggtatctaaagctggaggcctggatgaggttgcctttgggaagtgaggaaacagcaaaaggaggggcttggtacagacctggat

SEQ ID NO: 42810 - DNA, 201 bp, Homo sapiens
tcctagtgaaaagagtgtgaacaaggagaaagaaatccaggcagaggagacagctgctgcaaaaactctaaagcaagacccagcttcaggtcttcttcttyttttttttttttttttttttgacacagggtctcactctgttgcccaggttggagtgcagtgacatggtctcggcccactatagcctccacctcctggact

SEQ ID NO: 42811 - DNA, 201 bp, Homo sapiens
acctcgatccttgactctcactattcacaccaggtgattaaagctggggtgctggtggccggcagagcacctggtcataggagctgagctgggacacttgygtgtgtgtgtgtctgtgtatgtgtgtgtgtacgtgtgtgtgtgtgtgtgtgtgttggggatgcagagtgcactgaagtaataggctcacatgtgttttct

SEQ ID NO: 42812 - DNA, 201 bp, Homo sapiens
ggaagcatatgcgtatttccacttaagcatctgaaatattgcctctagtgctgaacaaattcttcccttggttattttcctcttatctcagtccctggaaraataaatgcctgtactaattctctatatacataaatggtctctttaggtataaataacctcataatcacataaaagttaaagttttaatggaaaaggctg

SEQ ID NO: 42813 - DNA, 201 bp, Homo sapiens
aggaagcatatgcgtatttccacttaagcatctgaaatattgcctctagtgctgaacaaattcttcccttggttattttcctcttatctcagtccctggaraaataaatgcctgtactaattctctatatacataaatggtctctttaggtataaataacctcataatcacataaaagttaaagttttaatggaaaaggct

SEQ ID NO: 42814 - DNA, 201 bp, Homo sapiens
tctgctcgcctcggcctcccaaagtgctgggattacaggcgtgagccatcgcaccggcccgcttagtccaatattttattttattttattttattttatttattttttttgagatggagtctcactctgtcgcccaggctggagtgcagtggcgcgaactcggctcactgcaagctccgcttccctgggttcatgccattc

SEQ ID NO: 42815 - DNA, 201 bp, Homo sapiens
caacctccacctcccagtttcaagcaattctcctgcctcaggctcccgagtagctgggattacaggcatgcaccaccatgcccagctaattttgtattttyagtagagacagggtttctccatgttggtcaggctggtcgcgaactcctgacctcaggtgatctgctcgcctcggcctcccaaagtgctgggattacaggc

SEQ ID NO: 42816 - DNA, 201 bp, Homo sapiens
agtgctagttctataataatcttctctgctactaaactgctggtatcgaaactgcctttcagatgagatcaggtgcgttcaaggtggtatggccgaagatrtaagttgccttccagctcaaatacctttgtttttggttaataatgattcaactcatgtgccctagacccagacctgccctggatgatatgaggggcttaa

SEQ ID NO: 42817 - DNA, 201 bp, Homo sapiens
agtcatatatatatatatatacacaaatatatatacacacacacacacacacacacatatatatatatatatatatatttttttttttaagaccatatttygctctcgttgtccaggctggagtgcaatggcatgatctcagctcaccgcaacctccacctcccagtttcaagcaattctcctgcctcaggctcccgagta

SEQ ID NO: 42818 - DNA, 201 bp, Homo sapiens
aattctgcggaaagccacctaaactactcccattctagcactctctcctctgtaataatcctctacttccctccttacctgcccaccagagccccaaaccscggatgaagactatcccctcacttccctattcccgtacccacacagactagttcccaatttctctcacgactacccatgaatcacttcacctgcctttta

SEQ ID NO: 42819 - DNA, 201 bp, Homo sapiens
ctacagtgactgtgagaggaatctccagaagggcgatggtgatataggcggagagggtcacttcatcttctactcctccctgtgaatacgagagagagatytgaataattcaacttctgagaatgctattgattagttctttctattctgctgtgtcatggaattcatccttacccatatccatccctatagggcaaagta

SEQ ID NO: 42820 - DNA, 201 bp, Homo sapiens
cacatgtgcatgtgcatgactttatattttgtcatttacgcttagtcatatatatatatatatacacaaatatatatacacacacacacacacacacacayatatatatatatatatatatttttttttttaagaccatatttcgctctcgttgtccaggctggagtgcaatggcatgatctcagctcaccgcaacctcca

SEQ ID NO: 42821 - DNA, 201 bp, Homo sapiens
ttttcaacccgctccattagtcacctcctttgctgtatcgccaatctttttctcagtggaatctcttcagctgacaagcatgttggtctccctcgtggccytctgtagtcatgttaacatctgtttcttcacacctctgatgtaaaaattcttaaaatatttagatgtaagacttctacttatttacgtttggatcttcag

SEQ ID NO: 42822 - DNA, 201 bp, Homo sapiens
gcacatgtgcatgtgcatgactttatattttgtcatttacgcttagtcatatatatatatatatacacaaatatatatacacacacacacacacacacacmtatatatatatatatatatatttttttttttaagaccatatttcgctctcgttgtccaggctggagtgcaatggcatgatctcagctcaccgcaacctcc

SEQ ID NO: 42823 - DNA, 201 bp, Homo sapiens
ccacacccggctaatttttgtatttttagtagagatggggtttcaccatgttggccaggctggtctcgaactcctgaccttcatgtgatccgcccacctcrgcctcccaagtaggtgggattacaggtgcaagccaccaatgctcagctaatttttgtattttttgtagagacagggttttaccatgttgcctagatcagt

SEQ ID NO: 42824 - DNA, 201 bp, Homo sapiens
aatcttctttttcacacacacgggcacatgtgcatgtgcatgactttatattttgtcatttacgcttagtcatatatatatatatatacacaaatatatayacacacacacacacacacacacatatatatatatatatatatatttttttttttaagaccatatttcgctctcgttgtccaggctggagtgcaatggcat

SEQ ID NO: 42825 - DNA, 201 bp, Homo sapiens
tttttgtatttttagtagagatggggtttcaccatgttggccaggctggtctcgaactcctgaccttcatgtgatccgcccacctcggcctcccaagtagstgggattacaggtgcaagccaccaatgctcagctaatttttgtattttttgtagagacagggttttaccatgttgcctagatcagtcttgaactcctgag

SEQ ID NO: 42826 - DNA, 201 bp, Homo sapiens
ttctcatcatttagctcccacttatgtgtgaaagcatgcaatatttggtttcctgtgttagtttgctaaggataatgtcctctagctccaagctcctgcawaggacatgatctcattctttttttatggctgcatagtattccctagtgtatgtgtactgttttctttatgcggtttaccgttgatgggcatttaggttga

SEQ ID NO: 42827 - DNA, 201 bp, Homo sapiens
ccagaaagtgttctatgactctttcaaatctaagttagctacccatcctgtacgcctcaattatagtatctatcacagagtattatagttacttatctccrttttctataaaatctcctctagaagggccagtatcttgtctgtcagccatcttactggcaaagtctactatagcacctgccccccccttttttttttttg

SEQ ID NO: 42828 - DNA, 201 bp, Homo sapiens
agttacttatctccattttctataaaatctcctctagaagggccagtatcttgtctgtcagccatcttactggcaaagtctactatagcacctgccccccscttttttttttttgagacggagtctcactctgtcgtccaggctggaatgcagtggcacaatcttggctcactgcaagctctgcctcccgggttcacgcca

SEQ ID NO: 42829 - DNA, 201 bp, Homo sapiens
attatccaaagtagatttaccactttattttttatttaacttttgttttatgtttgggggtacgtgtgtaggtttgggggtacgtgtataggtaaagttgygtcatgggggtttgtggaacagattatttaatcacccaggtattaagcctagtacccaattagttgtttttttttcaaatcctctccctcctcccacgct

SEQ ID NO: 42830 - DNA, 201 bp, Homo sapiens
tggcaaagaacaggttagggaccaggcataattgtataaaataagtgtggactagtacattttacatagttctttcttgaatgaacagctaacatgatgtkaaggcttcctgtgccagaaatcagacctggattcaaaccatggctcgaccaatcactagctatgcaaccaccaaccacaggcaagttacttaacctctca

SEQ ID NO: 42831 - DNA, 201 bp, Homo sapiens
tgaacccaggaggggaggttgcagtgagctgagatcacaccactgcactccagcctggacgacagagcgagactgtctcaaaaaaaaaaaaaaaagttcayggagcgcaacctttgggttttgatggatccaggatctaaatccaaaagagagttttaaagatttgggacactgtatctttgagctctgctgtcctctgct

SEQ ID NO: 42832 - DNA, 201 bp, Homo sapiens
aaagaaaaagaaaaagaaaaagaaacataagtagcaagacagaaattaacattttttccatttaggcaataaagagaataaaacaaaagtcaggctggacrtggtggctcacacctgtaatcccagcactttgggaggctgaggagggcagatcacctgaggtcagcagttcaagaccagcctggccaacatggtgaaatc

SEQ ID NO: 42833 - DNA, 201 bp, Homo sapiens
ggaaggggatccaggtggagagtccccctcagtgcctgctttcagcctgaccctcctctccctccctcttgcctcctcaatctgccagttgcctccagggytctcctagctcagcttccacttagagcccacttcctgtgttctgcaaggagcaggagcagggattgcaacctgggaatctaattgttcttaaacagaatt

SEQ ID NO: 42834 - DNA, 201 bp, Homo sapiens
gagactctgtcttagaaaataaagtccatgggctggtcgcagtggctcacgcctgtaatcccagcactttgggaggccaaggcaggtggatcatgaggtcmggaaatcgagaccaccctggctaacaggtgaaaccccaaaattagccaggtgtggtggcatgcgcctgtagtcccagctaactcaggaggctgagatagg

SEQ ID NO: 42835 - DNA, 201 bp, Homo sapiens
caaactcaagcgatcctcccctctcagcctcccaagtacctggtggctggcaagatccaagattactggtgcacaccaccatacacagcttcttttgtttkgtttttgttctttaaaaacttttttttaacatgcattttggtggggatacaattcagtccacagcagtgaccaattccatttttaccttggagccctcct

SEQ ID NO: 42836 - DNA, 201 bp, Homo sapiens
agtacagtcacatggcagggttaggatttcaacatatgtttgtttgttaagatgggcagtctcactatgtggcccaggctggtctcaaactcaagcgatcytcccctctcagcctcccaagtacctggtggctggcaagatccaagattactggtgcacaccaccatacacagcttcttttgttttgtttttgttctttaa

SEQ ID NO: 42837 - DNA, 201 bp, Homo sapiens
cttagctcagtgactgacacaaaataagcatccattaaatgttagcaattattattattataattgttactattgttagcgtttattgtccacattttttwaatttaagaattagaaggttcttaattatttccaacctaaagtattctctaaacaggacaggaatatgtgacactgtgtgtgtgcacctgtgtgtgtgtg

SEQ ID NO: 42838 - DNA, 201 bp, Homo sapiens
agagctgtaccgggttttggaggctggcaagattgggatatttgagagtccaactggcactgtgagtatgaacagtgagagatactgaaaaggacaacttwacggcagctgtgctagcttttcctgtttgcccatccagagattttcatagtatgaagttgggcagaatagttgctctcagtttatctttctgagtaatag

SEQ ID NO: 42839 - DNA, 201 bp, Homo sapiens
ccactcatcggtaagggggcgataatagtaccccctcatagggtactatttgttttgagaatcaaatgcacataaactacttagctcagtgactgacacamaataagcatccattaaatgttagcaattattattattataattgttactattgttagcgtttattgtccacattttttaaatttaagaattagaaggttc

SEQ ID NO: 42840 - DNA, 201 bp, Homo sapiens
cataggtcttgaggccagaaaagttagtaggtggcggctctggtcggtgctggaaatggaggccaggatgaactaagaagcaaactaaagatacttgtaakataaggacgtgtaggctgggtgcggtggctcacgcctgtaatcccagcacttcgggaggccaaggcgggcggatcacgaggtcaggagatcgagaccatc

SEQ ID NO: 42841 - DNA, 201 bp, Homo sapiens
aataggtagtttttttgatcctcaccccttcccaccctacatgtacattttaaatttccagagctctcaaatctcctgaagggcatcctataatatagccrccttcgataatgcattctgggatctacctaccctgtgcactcggcttatattggtttagtctcttctagagtgtgcatctttaaagattatgactgcttc

SEQ ID NO: 42842 - DNA, 201 bp, Homo sapiens
gagaagtgagttccaaagagagaggtgtgggaaccaggatggaagagtcaggcctccagatagcgtttacttctcctttcttccttgaatcactgtctcasagataattaggttcagaagaggaggaaaaaaaagatgacgtcaacatggagcagagtttttcttagaccttagcctagcaaggaaagagaaatgcctggt

SEQ ID NO: 42843 - DNA, 201 bp, Homo sapiens
taagcatagtatccaataggtagtttttttgatcctcaccccttcccaccctacatgtacattttaaatttccagagctctcaaatctcctgaagggcatyctataatatagccaccttcgataatgcattctgggatctacctaccctgtgcactcggcttatattggtttagtctcttctagagtgtgcatctttaaag

SEQ ID NO: 42844 - DNA, 201 bp, Homo sapiens
taaactgccaccaatctgtagtcattttaattgctcctaaaccgaagagcatcatggcaactacctttcccctcgtagagtgacactatcactagtcttaytgaggccaaagttataaagatgggctctcgatctactaatattagtaaaatgggtttgggacttactaacatttgtgcttagaagagacagacctggcaa

SEQ ID NO: 42845 - DNA, 201 bp, Homo sapiens
cagattatttcactatccaggtaataagcatagtatccaataggtagtttttttgatcctcaccccttcccaccctacatgtacattttaaatttccagakctctcaaatctcctgaagggcatcctataatatagccaccttcgataatgcattctgggatctacctaccctgtgcactcggcttatattggtttagtct

SEQ ID NO: 42846 - DNA, 201 bp, Homo sapiens
tttggtgtacagattatttcactatccaggtaataagcatagtatccaataggtagtttttttgatcctcaccccttcccaccctacatgtacattttaartttccagagctctcaaatctcctgaagggcatcctataatatagccaccttcgataatgcattctgggatctacctaccctgtgcactcggcttatattg

SEQ ID NO: 42847 - DNA, 201 bp, Homo sapiens
ttactctcagtttgtgaacctcccttcagtgaacctccctttacttatgctggatatctcttgcgactggatgagcttcactaaagcacagtcatttggayctggattcgaatccctggttttccactttttagctgtgagtttgagcaattatttaatttctgtaagcatcagtatccagtagctgtatccttatagtgt

SEQ ID NO: 42848 - DNA, 201 bp, Homo sapiens
ccactatactaaaggtgaataatgagataaattatttagtccacactcctgctttacatgtgcatttgattattttaacttttattttaggttcaagggtrcctgtgcaggtttgttatataggtaaattgtgtgtcatgggggtttggtgtacagattatttcactatccaggtaataagcatagtatccaataggtagt

SEQ ID NO: 42849 - DNA, 201 bp, Homo sapiens
gtgctacttcagggggtccttgaaactataagaaggtctagaaccatttccagaagcttaaagatctagaaaaatttccactatactaaaggtgaataatkagataaattatttagtccacactcctgctttacatgtgcatttgattattttaacttttattttaggttcaagggtgcctgtgcaggtttgttatatagg

SEQ ID NO: 42850 - DNA, 201 bp, Homo sapiens
aagagcttgtagaactgtattacattagacaataactggaaagtgtttatttagcacagggcctggcacttagtaaacattcagtaggtagtagatttttwaattagattcctttacatttctctcagtgtctagtcaagtgacaatgtctcactaagtgaaatttttaaagtgtcacaattagtaaccaaaattaaacag

SEQ ID NO: 42851 - DNA, 201 bp, Homo sapiens
ttacagtcaaacaccagaatttgaaccctggctttaccacttattacttcatacaaaatgaaatcttaataaagagcttgtagaactgtattacattagayaataactggaaagtgtttatttagcacagggcctggcacttagtaaacattcagtaggtagtagatttttaaattagattcctttacatttctctcagtg

SEQ ID NO: 42852 - DNA, 201 bp, Homo sapiens
tctgaatagaaatgagagagtaagccatatggatatgtgatgaaagtgtccctggccgggcgcggtggctcacgcctgtaatcccagcattttaagaggcmgaggcgggcggatcacgagaccatcctggctaacacggtgaaaccccgtctctactaaaaatacaaaaaattagccgggcgtgttggcgggcgcctgtag

SEQ ID NO: 42853 - DNA, 201 bp, Homo sapiens
atatacccaaatcagccaagttaacacttgtgttccttcctatttctctctgcagtcactgactgccacctcaaagagaaacagcagtctcatctcagccrctggtcccaccatacctgctccctttacacaaaacagaaaagactgtgatcattattcggttctaataatataccccatggaaacacagtagttgggagc

SEQ ID NO: 42854 - DNA, 201 bp, Homo sapiens
tatccacatgagccttcccatttctcagcctcctttgcattcagggcaggaacatgggcggaagtgatgtataccattcccactcctggctttaagagtcwagtgcaacctccttccccatgggtatgaccttgaaagccacgttggcgatggcagagtcaccagaggaaagcagactggttctctctgactcactgtttg

SEQ ID NO: 42855 - DNA, 201 bp, Homo sapiens
tgctctgcctcctgagctccaggcctgcgtttggactttaccttactctcagagcaggttttgtaaaaaagtaaaacctgttggggttttgctgactcagmgcatgtgtgaggaaggaggagggatagaggaaagattctgagcaggaggccgagcgcggtggctcacgcctataatcccagcactttgggaggccaaggc

SEQ ID NO: 42856 - DNA, 201 bp, Homo sapiens
ggaaagcagactggttctctctgactcactgtttggcacggggctgttctggagagtgtctgaactcacaagtagattttgtgtgagcaaaaaccaaaccrttaggtgcttacccgctgagatgtgggagtttgtttgttactgccattgaatctaattctgactaattcaggtattgactccatcatggacaaggaagat

SEQ ID NO: 42857 - DNA, 201 bp, Homo sapiens
cttcaccccatccagcaggaagtagctagagcggtcatcggccaaattcccaacagcagttggggtgtcctgtttagaggggggattgagaggtgacagcrtgctggcagtcctcagccctcactcactcttggcacctcctctgcccgggctcccactttggtggcacttgaggagcgcttcagcccaccgctgcactgt

SEQ ID NO: 42858 - DNA, 201 bp, Homo sapiens
ctacagcctccagaatcttctttttcacacacacgggcacatgtgcatgtgcatgactttatattttgtcatttacgcttagtcatatatatatatatatacacaaatatatatacacacacacacacacacacacatatatatatatatatatatatttttttttttaagaccatatttcgctctcgttgtccaggctgg

SEQ ID NO: 42859 - DNA, 201 bp, Homo sapiens
caggttctggcccccgttttctgtgggtaatacctcataccgtgaccaggcacaggggcggaggagaccccgggatgggagcctcacccttcgtgcgctcrcccaggctctcctgctttgctccctgctgcctgctgcccagtgtgactggcgatggtgggtgggtgagcgctgtcagtcgctgttcctgtgctggatgat

SEQ ID NO: 42860 - DNA, 201 bp, Homo sapiens
tctacagcctccagaatcttctttttcacacacacgggcacatgtgcatgtgcatgactttatattttgtcatttacgcttagtcatatatatatatatatacacaaatatatatacacacacacacacacacacacatatatatatatatatatatatttttttttttaagaccatatttcgctctcgttgtccaggctg

SEQ ID NO: 42861 - DNA, 201 bp, Homo sapiens
tgttaacactttgctgagtattcttctgtacttgttttaaatgtctttaaacatataggcagggtttttgtgtgtgtggtgtttttggtttttttttttttgctgtttttcttcctttgtttttataaaaacaggatcttgcagcctggtgttttaaatttagtagtatgtcctttcaaaaggcaggtatttacgagacaa

SEQ ID NO: 42862 - DNA, 201 bp, Homo sapiens
gttctgtctctgttgttaacactttgctgagtattcttctgtacttgttttaaatgtctttaaacatataggcagggtttttgtgtgtgtggtgtttttgktttttttttttttgctgtttttcttcctttgtttttataaaaacaggatcttgcagcctggtgttttaaatttagtagtatgtcctttcaaaaggcaggt

SEQ ID NO: 42863 - DNA, 201 bp, Homo sapiens
cgtgcccaccatagacacttacctcctgcatagtcagggcccacagacacccaacattcgggtcagcagtggcactcagaggaaaaggtatgcatgcagcratcttcatagtacggtgcagtggccagattttagttaactgcaaaaataaatgtgctcttgttgtggaggatggaggaggggaagcaaaagaaaaaatgg

SEQ ID NO: 42864 - DNA, 201 bp, Homo sapiens
tccgaggctccagtgattctcctgcctcagcctcctaggtagcggggattacaggtgcatgccaccacacccggctaatttttgtatttttagtagagacrgggtttcaccgtgttggccaggctggtctcaaactcctgacctcaggtgatctgcccgcctccgcctcccaaagtgttgggatcacaggcgtgagccacc

SEQ ID NO: 42865 - DNA, 201 bp, Homo sapiens
agtaggagtaggactcagaaagaaaaatttacaaagcatttcgtgatatagtaccaggattagccatgaagtctaaaactgaaaattaattttgttgtacrtaaggccagcaatttgtgggaaaaaagcgataatggattttaatttaatttaaaaggcatggcaaatgtacctgcttcttttaaagtgctgcatttctga

SEQ ID NO: 42866 - DNA, 201 bp, Homo sapiens
tttttttcctcttttcttttggtggggggtgtgggcggcgggggagtttcaatatgttgaccaggctggtcttgaactcctggcctcaagcgattctccckcctcagcctcccaaagtgctgggattacaggcatgagccattgcacccagccttttctatttttcatttcaagagtttgctttttaagaattaaaattgt

SEQ ID NO: 42867 - DNA, 201 bp, Homo sapiens
aattctgagcagccagtgtctccttatctgtcacattcgtactcatttttatgactttgcaggtcttgctgaaaattcttccttaacttgccttgagaacyaccttttccaccaagcattcccaatgaatgtagctcgtggtgttctttccttccaaattcctgttctcttatctctactgcttataacccaatacttgac

SEQ ID NO: 42868 - DNA, 201 bp, Homo sapiens
cccaagtagctgggactacaggtgcacaccgccatgcctgactaatttttgtattttttttgtagacacagggttttgccatgtaagccaggttggtctakaactcttgagctaaggacagtccgcctgttttggcctcccaaagtgctaggattacaggctaactttcaatttaataaaaaaaattaatttgtgcaattg

SEQ ID NO: 42869 - DNA, 201 bp, Homo sapiens
caaaattcactaaacctcctagagcaaaaccatttcagaagtcattatacctaatgcaggaggcagagagaggtggtagaggcaagtgcatatgtaactaygcacttgattaacctttgaataattaagagttcacacaagatatttttgagttgagtagaagaggtgacagaaatcagaagaaatgtttgagtttgttta

SEQ ID NO: 42870 - DNA, 201 bp, Homo sapiens
gattataggcatgagccaccgcgcccagcctaatttttgtacttttagtagagagaagatttcaaacatgttgcccaggctggtctgaaattcctgagctmgagcgatctgcctgccttgccctcgtaaagtgtggagattacaggcatgagccattgtgcccagccacataagtccttttaattcatgttttctttgctg

SEQ ID NO: 42871 - DNA, 201 bp, Homo sapiens
ttggggctgtgatctaattcttttttttttttttgagacagactcttgctctgtcatccaggctgcagtgcagtggcgcgatctcagttcactgcagcctytgcctccgaggctccagtgattctcctgcctcagcctcctaggtagcggggattacaggtgcatgccaccacacccggctaatttttgtatttttagtag

SEQ ID NO: 42872 - DNA, 201 bp, Homo sapiens
tggggggtggagtgccaaaagtgtagcccatcacataaaaataatattgattacatcaatggttgaacataagacatggggtggaagttaataaacaaaayaggaagcttcactatgtgtttctccctggctcccccacccccaggcaccaaggggaaaattcacactgctctctgatcctagacggcaaagtaaggggaa

SEQ ID NO: 42873 - DNA, 201 bp, Homo sapiens
gagagctgagaacataactaaccaatactttcgtgttcaaagaataaatactctgaaacagtgggacagaagcttgctccttagggactttctcaaagtayccttggtggacataaggttatcctcactcaacggaaggacatatctgctgtcgggggaggacacagaatgacgatttcatttacctaggatattttcctt

SEQ ID NO: 42874 - DNA, 201 bp, Homo sapiens
ttttttccaagacagaatctcgctctgtcgcctaggctggagtgcagtggcgcaatctcggcttactgcaacctctgcctcccgggttcaagtgattctcstgcgtcagccacctgtagatgggattataggcgcgcgccaccacgcctggctagtttttgtattttttttagtagagacagggtttcaccatgttggcca

SEQ ID NO: 42875 - DNA, 201 bp, Homo sapiens
ttagagtgtttcttcaaaactagttcaatctcgatctaattagtccccaaagagatgcaaaccaaacgagatgcgatttttgttctattaggagggcacamaaataaaaaataaaaattaagcctgataatagcctgtttgggccagcttgctgggaagcggactcatttttatactgctggaggggttcggaatcaagaa

SEQ ID NO: 42876 - DNA, 201 bp, Homo sapiens
gcccgccaccacgcccagctaatttttgtatttttagtagagatggggtttcaccatattggtcaggctggtcttgaactcctgaccttgtgatctgcccrcctcggccacccaaagtgctgggattacaggggtgagccaccatgcccagcctatagaaattatttttaaagtcgggatgagaaaaaaaaaaaaagaaaa

SEQ ID NO: 42877 - DNA, 201 bp, Homo sapiens
tacggaggccagggatgagtgcagttgaccagattgttgacggaagtgtcataaaagtggacttaaatgttgataagcagctggttgggttccacacaggktgcgagctcaggatgcacgttggaggggacacagggccagagcaaggtgggaatgcgggtattatgggccaggccatcctccagctggtggagcaccgca

SEQ ID NO: 42878 - DNA, 201 bp, Homo sapiens
gggccgggccagcgtgattgacaagcgggaacccctgtgtggggacggggcaggcctaggaaggttgtgcctgcggtggaacggcgcggtgcgcaggagtsggcattaacagcagccgcgtgtctgggtcttagatttggcctagctgtgttgagcttttcatggattatgttacgtagataagacactgcaacagtgagt

SEQ ID NO: 42879 - DNA, 201 bp, Homo sapiens
ttaggaacacaggctttacagtcaaacaccagaatttgaaccctggctttaccacttattacttcatacaaaatgaaatcttaataaagagcttgtagaaytgtattacattagacaataactggaaagtgtttatttagcacagggcctggcacttagtaaacattcagtaggtagtagatttttaaattagattccttt

SEQ ID NO: 42880 - DNA, 201 bp, Homo sapiens
tatttagttaccatgccttggacatttatgggactatttacacagcagttaggaacacaggctttacagtcaaacaccagaatttgaaccctggctttacyacttattacttcatacaaaatgaaatcttaataaagagcttgtagaactgtattacattagacaataactggaaagtgtttatttagcacagggcctggc

SEQ ID NO: 42881 - DNA, 201 bp, Homo sapiens
taataaacacatccatcactagtcacgtattcacacatgatatttgcaattttggtaatttcagccatattcttttacagttttgaaactgagttttataytatttagttaccatgccttggacatttatgggactatttacacagcagttaggaacacaggctttacagtcaaacaccagaatttgaaccctggctttac

SEQ ID NO: 42882 - DNA, 201 bp, Homo sapiens
agttcatgtatttacctataactatttattttttaataaatattaactcttacaatattgtgttttaaaaaactcttcatggtgacattattttgttattrtacaagataataaacacatccatcactagtcacgtattcacacatgatatttgcaattttggtaatttcagccatattcttttacagttttgaaactgag

SEQ ID NO: 42883 - DNA, 201 bp, Homo sapiens
cttagagagcattacctgttccgttctctgtaacaagagcatgcactttgaggaaactccagtatccttaccgatttaactcaaaagcacctgtgttaatraacttggagacacagccatctttccccaactgaaaagaacaataaaaaaaagttatattttaaaggaagactgtaagaaatacctatataatataatagg

SEQ ID NO: 42884 - DNA, 201 bp, Homo sapiens
gggtctggcttcttagagagcattacctgttccgttctctgtaacaagagcatgcactttgaggaaactccagtatccttaccgatttaactcaaaagcayctgtgttaatgaacttggagacacagccatctttccccaactgaaaagaacaataaaaaaaagttatattttaaaggaagactgtaagaaatacctatat

SEQ ID NO: 42885 - DNA, 201 bp, Homo sapiens
ttttctttggacatgaaaaagaaagcaactttgagagtagtcatttagcagtagatgtgcattattatgagaaaacagttctataaattcagggttaattmtattaattggaatgtcggtctctaatgtctagcttattatagggtagaaaagagctttctactcagctaatcattaatcattgatccaaaacttaaatac

SEQ ID NO: 42886 - DNA, 201 bp, Homo sapiens
gcatgggctagaaagtgtaaaattcttggaaaagattttcaacagtagctttccctggttatcgagcctcttattaagactgcttcagctaaacctgatgytgctctcttagacacacaggatgtggagaatatgaatgatgatgatggctggcaacatgtaaatcttggagaccaacagcgttttggaattaaaacttca

SEQ ID NO: 42887 - DNA, 201 bp, Homo sapiens
ttcagcatgggctagaaagtgtaaaattcttggaaaagattttcaacagtagctttccctggttatcgagcctcttattaagactgcttcagctaaacctsatgttgctctcttagacacacaggatgtggagaatatgaatgatgatgatggctggcaacatgtaaatcttggagaccaacagcgttttggaattaaaac

SEQ ID NO: 42888 - DNA, 201 bp, Homo sapiens
tttctctatactggcatcaaagcaaattttctaaaatgcaaaatttagcattatcctccctaaaacattgtagtgactgctctgataggccatggttattygctagaaatctctttctcattctcttactagtacaggcaatgattgctttaaaaagtcccttctgaaattgtatgatttgcagtagatacaatgcctgca

SEQ ID NO: 42889 - DNA, 201 bp, Homo sapiens
agattttgtcagtgtgctatatatgagtcagaggattgaataagatgaaaaaaatcaaatatagtggtgaatgatacaaatttcttttctgagaggagcascttcgcttcatttcttttctttccttcttttcttttttttttcttttcttttctttcttttttttgcccaggctggagtgcagtggcacagtcttggctc

SEQ ID NO: 42890 - DNA, 201 bp, Homo sapiens
taataaatattatatattatatatttataataaatattatatattatatattacatattatatatttataataaatattatataatatatactatatattwtatatatattatatatcttgtatatattatatatataacttctctttttacttcgtttcacttgagttataaatttgccatgtttggaggttttcgatgg

SEQ ID NO: 42891 - DNA, 201 bp, Homo sapiens
attatatattatatatttataatatatatttataaatattatatttataataaatattatatattatatatttataataaatattatatattatatattayatattatatatttataataaatattatataatatatactatatattttatatatattatatatcttgtatatattatatatataacttctctttttactt

SEQ ID NO: 42892 - DNA, 201 bp, Homo sapiens
tagctccttagaaatgttaggccttttcaaagaggaaagccttaattacactgtattcctcaggaaggttatttccttcatgtaaattatgacttttgtgmttccagtagctctgtgatttcttcatgaatgtcattaacttaattgccttctcattgctttatgctagaaaaatgggaatgtgctttaaacttttgtaga

SEQ ID NO: 42893 - DNA, 201 bp, Homo sapiens
tttgtatttttaatagagatggggtttcgccttgttggccagactagttttgaattcctagcttcaagtgatccacctgcctcgacctcaccatcctagaytttaaaccttgaaattttctagagctgcctcccagtgactttaacttactgtgtggacctgccttgctgccctcacttcttcatcttctcaccccgtcct

SEQ ID NO: 42894 - DNA, 201 bp, Homo sapiens
ccttgctttgtcgcccaggctggagtgcgatggtgccatcttggctcactgcaaatttcacctcccaggttcaaacgattcccctgcctcagcctcctcartagctgggattacaggccacaccatcatgtccagccaattttttttttttttttttttgagacagaatttcgctctcgttgcccaagctgtagtgcaatg

SEQ ID NO: 42895 - DNA, 201 bp, Homo sapiens
ggtgctgtgaaggcagaacaagaagggaactaagctatgtaaacaggcatattagcattcccaggcaaatacacggatcacagcacagaagtttttcaaaygcatttttccaacgattcctcattcttatcaatagatataatattatttttatctgttattctcacattcaaaagatacatctttaagattcttttttga

SEQ ID NO: 42896 - DNA, 201 bp, Homo sapiens
ctaacttaacattacatcttgactgtcttgccatacaagcaggtatactgctgtctcaattttttaaacagcaacataaaattttattatttgtttctacrataatttatttccttggcttagttaaatgaaataactcagtattcttccaataaattctcactcccccctcccccgccaccattttttgagacagggtct

SEQ ID NO: 42897 - DNA, 201 bp, Homo sapiens
cctcgtcggtcttctgcttctgggtatcgacatcgttatcctcatcatcttcagctgcccgcttgcccgtagctgactcagctccctcatcttcatctccrtcctcttcctcaccatcaccttcttcctccccaccttcttcctcttcttcatctacctcgttgtcagcctccggctccccattttcctcattagcattcc

SEQ ID NO: 42898 - DNA, 201 bp, Homo sapiens
atcctcctgcccttctcttcattttatattttccatagcacttatagcctcttaatttcctagactttgcttacccattatgttcattattatgtttgcgyatttcgtttgattgtattatacgtattgtttgtctcccccattagaatgcaagcaccacaagggcagctgtttttactattttcatgcattgatatttcc

SEQ ID NO: 42899 - DNA, 201 bp, Homo sapiens
gtgggaaaagatttcatcatttactagacaagaaggatctcattcataaagttaagggtgtggagagagtgggaaaaatgatggtgtgggttgtctgttargcaaactgggaatgccgtttccagcatatgaaaaaaatccctctttattcacatacattccaatgttcacttcctcatcctgtaaagcagagatgtgttt

SEQ ID NO: 42900 - DNA, 201 bp, Homo sapiens
gttgtttctaattctcagtctacgcatgggaaatccccttctactgtgggaaaagatttcatcatttactagacaagaaggatctcattcataaagttaarggtgtggagagagtgggaaaaatgatggtgtgggttgtctgttaggcaaactgggaatgccgtttccagcatatgaaaaaaatccctctttattcacata

SEQ ID NO: 42901 - DNA, 201 bp, Homo sapiens
tgatttattttcttattccatggaattataatacatatggagtaattctattaatattatttatacttgcctccaactctctaagttacatctgacttaargtatgattgttcatttttttagattttcccccagatctcaaaagtgaactttgtacataaacattatccaaattgagagatagatataaatatagacctc

SEQ ID NO: 42902 - DNA, 201 bp, Homo sapiens
tcatcttcattgatcccaagaacatccaggatgctctcaagtggatggcaggaaaccagctccccagtggctgctatgccaacgtgggaaatctccttcayacagctatgaaggtgcggatctgtccaggagcctgcagccaaccactgtctcgaaggaccccacacctctgaccgagtagaagcaaaagagcactggcct

SEQ ID NO: 42903 - DNA, 201 bp, Homo sapiens
attacaggcgtgagccactacgcctggccaagaagctgtatttttaacaagtgcccagacgatcctgatgtacaaccaggtttataagcttctgtgcattyccaaacatgggtaaaccccactttggtcctgaggacaggttgccgagatttgcaggaataagacaaggaatgctatagattgtccctcaatacataatct

SEQ ID NO: 42904 - DNA, 201 bp, Homo sapiens
agataattctgatgatctgcttggcttccaaatgccattctaccagctgtttcagaattacttgggattgctaattaaaaatctctagccacacccttgayatagtgactcagaatctgaggggtagggttagagaagctgtttttttttgtttgtttgctttttgtttttttgagacagagtcttgctctgtcacccagg

SEQ ID NO: 42905 - DNA, 201 bp, Homo sapiens
gccgctcgcggctggacgggagcgggaggagtcggggagcggcggtcgagcccggcaggatgagcgacgagggcggctccaacttcaggcgggtggcgatscggcggaagtccaacccctcctacctgccgcccggggtgccccggccctggagcaggcccgcgtcgcacctgggacgtgtagggaccgctgccttcaagg

SEQ ID NO: 42906 - DNA, 201 bp, Homo sapiens
aagaagagcccctttggcaaggatgttcggctggtctccctcggctcccagcaggtaaacagtagccagtatttccaccaggggccatcctgctcctttcsccacaactttgtcctgctcgtccaggcctgggagacgctgggtctgtgacaggctgaaccgtgtgaggagcagccccctccctggcctggccggcccatc

SEQ ID NO: 42907 - DNA, 201 bp, Homo sapiens
cctcaccaacctctggaagggcagcttccggatgagcagctcggtcgacttctgataacgacgaatctctcgaagcgccacggtcccaggcctgtagcgakgaggcttcaccccgcaggtagagggggtgcttttcctggcagctttcgtggccagctgtttgcggggggctttcccaccggtggatttacgagcagtctg

SEQ ID NO: 42908 - DNA, 201 bp, Homo sapiens
acggtcccaggcctgtagcgatgaggcttcaccccgcaggtagagggggtgcttttcctggcagctttcgtggccagctgtttgcggggggctttcccacyggtggatttacgagcagtctgcttggttcgggccattttctttcacccaacgccgaagttttaggccacttctccgacctccgcgctgcttccgctgccc

SEQ ID NO: 42909 - DNA, 201 bp, Homo sapiens
aacaatctacctgtaacattcccttgccttcatatcccaaagctctgcaagcaaagaagagttctggtgggcagctagggccatttgttgtagtccagagraagagagccatccgtatcttctgtgctgtactcatacctatttaatccaatctgctggcaccagtctattatattcaactgtttgcccccactgtaacta

SEQ ID NO: 42910 - DNA, 201 bp, Homo sapiens
ctctaactcctgggctcaagtgatccgccgcagcctcctgagtcactgggactacaggcatgggccatcacttctggctaatttaaaaagtgtttttttttgaagaaatggtgtcttactgtgtagcccagactggcctcaaactcctggccttcctcccacctcagtgtcccaaagcactgggattacaggtgtgagcca

SEQ ID NO: 42911 - DNA, 201 bp, Homo sapiens
tttttcttcaagttatccattatctgtcatcttggctgtcacagaggtttcttttggtctcattctattggactgccttctaagcatgtttcatatagttracctcattagcatttcttcatggtttctcagaattctttcatatactctgccatttttattctacttaaaatgttaaatctttttttttttttgagactg

SEQ ID NO: 42912 - DNA, 201 bp, Homo sapiens
ggatatgttaaatttgagaagcattttaaacatccaagtggagaagtcaaaatgtaattggagcctggtgtggtggaacatggatgtagtcccagttactraggctgaggtaggaggattgcttgagctcaggagtttgagaccagcctgggcaaaatagtgagacccccatctccacaaaaatttaaaaattagccagct

SEQ ID NO: 42913 - DNA, 201 bp, Homo sapiens
cggtccctagggagggagcttaatcttgggcagtgtctttctttggctaaaagcaacactgggaaagcagcacaggtgagaggtgccaggcagcggctccmccagcggctggagaatgagcagtgcctcagtcctggaggggaatccgggcagcacccacagcatccacaatgccctgcagcactgggagcagccctcacc

SEQ ID NO: 42914 - DNA, 201 bp, Homo sapiens
agccagccaggtgcagcaacaacatcctattttagagtcagttcctaggaccacatccagtaccagctgtcacaggtggagttcactgggaaacacactckgagacaccgagatttctatacagaagttattggagagtaatcgcagaaatagcacctgtaagtgttgaaagacaaagaatttggcagatagaaaagtcga

SEQ ID NO: 42915 - DNA, 201 bp, Homo sapiens
cggcatggtaaaatctcagcttgcttctaggtatctgcctggtccttcaaatcatcacagggttttcttagctatacactacatgtcagatactctgaccrccttctcttcagtcactcacttctgctgagatgtaaattattgctgaattataattatgctacatgctaatgaggcttcgatagtctgcatctgcctgtt

SEQ ID NO: 42916 - DNA, 201 bp, Homo sapiens
gcactccagcctgggcaacagagcaagactccatcacaaacaaaacaaaacaaaaaaactattaaacctacaaaagccccaccacaatttaacatagtackgcaacccacacctccactagtaattaatcccaagcctccataaataggagaaggctttgaagaaaatcccataaagcctataataagaataatacttaat

SEQ ID NO: 42917 - DNA, 201 bp, Homo sapiens
ggagttcgagaccagcctgaccaacatggtgaaaccctgtctctactaaaaatacaaaaattagccaggcatgatggcacgtgcctgtaatcccagttackcgggagactgaggcaggaaaattgcttgaacccagagggtggaggttgcagtgagctgagatcgtgccactgcactccagcctgggcaacagagcaagac

SEQ ID NO: 42918 - DNA, 201 bp, Homo sapiens
ccatgcctgtaatcccagcacttagggaggctgaggcgggcggatcatgaggtcaggagttcgagaccagcctgaccaacatggtgaaaccctgtctctaytaaaaatacaaaaattagccaggcatgatggcacgtgcctgtaatcccagttactcgggagactgaggcaggaaaattgcttgaacccagagggtggagg

SEQ ID NO: 42919 - DNA, 201 bp, Homo sapiens
gtctcaggatactcctcagtagccattgccattgtataaccaaaaaccaccatcattccccctaaataaaattttaaaactattaaaccaggccaggcacrtggcccatgcctgtaatcccagcacttagggaggctgaggcgggcggatcatgaggtcaggagttcgagaccagcctgaccaacatggtgaaaccctgtc

SEQ ID NO: 42920 - DNA, 201 bp, Homo sapiens
tgacggaagtgtcataaaagtggacttaaatgttgataagcagctggttgggttccacacagggtgcgagctcaggatgcacgttggaggggacacagggycagagcaaggtgggaatgcgggtattatgggccaggccatcctccagctggtggagcaccgcagcactgcagtgtgtggccctggcttaacagcagtgcg

SEQ ID NO: 42921 - DNA, 201 bp, Homo sapiens
caagattccattccttggaatccgtgaggccaagaaccccaggtcagagaacacgaggcttgccaccatcttggaagccgcccaccaccatcttggaagcsgcttgccaccattttgggagctctgtgagcaaggatccccggtaacattttggcgaccacgaagggacctccgaagcgtttgtctcttccagaattgaaa

SEQ ID NO: 42922 - DNA, 201 bp, Homo sapiens
atgaacccaggtccatgtccagaactgtttaccactcacctctttataaaacggtaactgtggccaggcacggtggctcactcctgtaatcccagcacttygggaggccgagggaggtggatcacttgaggccaggagttcaagaccagcctggccaatctgttgaaaccccatgtctactaaaaatagaaaaattagttg

SEQ ID NO: 42923 - DNA, 201 bp, Homo sapiens
gagtagctgggattacaagcgagtgccaccatgcctggctaatttttatatttttagtagaggccgggtttcaccgtgttggccaggctggtcttgaaccyctgaccttaggtgatccacccacctcggcctcccaaagttctgggattacaggcatgcaccaccgtgcccggcctgctaattggttttttaactaaagaa

SEQ ID NO: 42924 - DNA, 201 bp, Homo sapiens
taatgggacagttgtggcctcacacacttcagtagaaagaataacatatgcaaatgttaatggacccaaacaactaactcacaatttgcagatgtcttcargagttacccaaaatgtatggttgaactcaccaatgaggaatcctgtgcattctcatataggggcaactgtatctcatcaaactgattttggagctaacgt

SEQ ID NO: 42925 - DNA, 201 bp, Homo sapiens
aaacagggatgcagggtggctgctttccattagacgtgcctaccagtgtgccatgtcagtttaccattgccgtggcgacacccgaagttaatgcctctttycatggcaatggcctgacaacccagaagttaccactttttcctggaaatttctgcataatctgcctcttaatttccatgtaactaaaatgggtgtaaatat

SEQ ID NO: 42926 - DNA, 201 bp, Homo sapiens
tctaatacaaactttatttccagaaagacctgtcgtttccctgcgtgagctatccaaaggatagtgaacacctggtgcttttccattcaatgatgtgtacyctgtatcttgttcttatcaaaaacacagtgctatcaaattcttaaaagattccctacttgccctccatatcgaattctcatctcagacttcattgtacat

SEQ ID NO: 42927 - DNA, 201 bp, Homo sapiens
agaaataaaccagaaataaatatttagagattaaacagctggttaataaaccaagaagtattcttttcatccttctaccatctgatttgtgattccagaasgtccagaagagagagatttaaattgctttcagctaagctgtagacctctagcagatgaacgacatattttcctgaaggtatgatgaaagtttttagtgct

SEQ ID NO: 42928 - DNA, 201 bp, Homo sapiens
ccaagtctggtcatctaatcagcaggatataagagggtcattcttcactgcggccattccagtttcctggaaacttggctttctcctgaccgtttccccakgagcacggtggtgacaagcttgagctctgacatcagaaagtccccagtttgaaacctctagcttcttactcgctagctatgagactttgggcaaattaat

SEQ ID NO: 42929 - DNA, 201 bp, Homo sapiens
catccaagtgttctcattgttcaattcccacctatgagtgagaacatgcggtgtttggttttctgtccttgtgatagttttgctcagaatgatggtttccmgcttcatccatgttgctacaaaggacatgaactcatcattttttatggctgaatagtattccatggtgtatatgtgccacattttcttaatccagtctat

SEQ ID NO: 42930 - DNA, 201 bp, Homo sapiens
gtctcactcagaagaggaaggagctcctgtctgctgaggacacggttccatccaatgaggtcagcagggctatcagcagcttccgttaattccgttggggyaggcgtgtggcaagcggcagttatttgagctgaggatgctgggatggattttcacatgagcagttggcccttagatcatgagaccagcctaagtgcccaa

SEQ ID NO: 42931 - DNA, 201 bp, Homo sapiens
cctcggatctttgtccagcatgatatgatagagatgtgtctttggttaggcctttgtctgccttgtggtcaggtggttaggcaggacgtttctcacacccraacccctgtttcactttgactaaggtctgcaaaatagcagggagagcttatgacatggtgcagtttggactaacactgagagaccagagttcagtgtaaa

SEQ ID NO: 42932 - DNA, 201 bp, Homo sapiens
tatgttcattgcaaccctgttgcaatgaacagtagcaaagacatggaatcaacctaaatgcccatcagtggaagactgaataaagaaaatgtggtacatayacaccatggaactatgcagccataaaaaagaacgccatcatgtcctttgcaggagcatacatggagctagaagctatcattcttagcaaaataatgtagg

SEQ ID NO: 42933 - DNA, 201 bp, Homo sapiens
cctgagattggtggcactcaattaaaaattgttataactctacgtagaatatggaatttttccaacttcatgcaaatttgactttagcttaacattacttrttttatatcactatgtgtttatactgcaaagctcttaagtttgggaagaaaggaagcttaaaatatccttaaggcagtgttatgccattcatatttgtgt

SEQ ID NO: 42934 - DNA, 201 bp, Homo sapiens
acaggcgtgagccaccaggcccagccataattcttataaaaacggaaatctgatatttcatttagcctgtatagcctcagtgcaggtatatgtatcacttytgttaggctttttgaaatgttgaaactagtttgacaactcctattactggttgcatggagctctgggattttaaggactttgggtactgtatggtctttt

SEQ ID NO: 42935 - DNA, 201 bp, Homo sapiens
ttggactgcaaccaagtaatcactgcaaagtagttccaagcagcaagaaataccagattctcatggaggctactatagggtacagaataacaacatgaaarcaatcaaccctgtataaataatgtttcttggcattttttttttaattaaagaaatccagtgtctcaaaaacttgtgaaaatgtgtttaaaaaacaaacgg

SEQ ID NO: 42936 - DNA, 201 bp, Homo sapiens
tgtatgcctctttgtaagctgccttaaatgctttttggaatgaggcaggatatacattcaataaataaaatatgtctgagccacttatgaacaaaaccttyttgggccagagcctaaacattacttatataaaaagacctgattcctcaccttctacaacaatattatttagtcatttctctgcattgtactcaactcttt

SEQ ID NO: 42937 - DNA, 201 bp, Homo sapiens
ttcttacttcctttccattttattttgtatgcctctttgtaagctgccttaaatgctttttggaatgaggcaggatatacattcaataaataaaatatgtytgagccacttatgaacaaaaccttcttgggccagagcctaaacattacttatataaaaagacctgattcctcaccttctacaacaatattatttagtcat

SEQ ID NO: 42938 - DNA, 201 bp, Homo sapiens
tctatattaatattaatatttccaaatattcaggaaacaggcgtacatcaggggctgttcttttgctgcaaatgaagttgatggaattacactgtgatacractgactgtgagtaatagatctagactgatagcatatctgtttatcatctgtatctaatctgtcatctaccttatttatctattatctatctagctatct

SEQ ID NO: 42939 - DNA, 201 bp, Homo sapiens
aatcctaagaaaaaccttgtttcactagcaaataattcccttctctgagaaggcaaattaattattttatttccaactttctcttaggcatcctgaaattytgagctcagtttcatgctctgaaaaagaaaaaataactgctagagtcacagaaatggtattgactttttggattggaatatttgttttctctgttcctta

SEQ ID NO: 42940 - DNA, 201 bp, Homo sapiens
acacactgtggaaaagaggacattttgtttaaaggtctgattggcttaattgtaaactctcttgagggagtggctgctgttctggttgtgtgtcacagagrcttgagaacagctcgcaggagatcctggatgatctgacctgtggtgcacggccctggcagcctggtgtctgtgcctcctctcgttgagatgagatttttc

SEQ ID NO: 42941 - DNA, 201 bp, Homo sapiens
attaaatgagttttgtattttgaacttgtgctacttctggaatgtgtgtgtgtgtgtgtgtgtgtgtgtttgtgcacgtgtttatgtagtccttggaatayaccataaccaagtgggttcttcctgggaatgcaagactgcttcaatacttgaagatcagtcaatgtaatctgccatagtaataatctaacaagaaaatca

SEQ ID NO: 42942 - DNA, 201 bp, Homo sapiens
tatatagactcaatcatttcattttttcagagatagtacaaatgcaattattttaaaatgttgattttctgttagttattgttagtatatacaaattaaatgagttttgtattttgaacttgtgctacttctggaatgtgtgtgtgtgtgtgtgtgtgtgtgtttgtgcacgtgtttatgtagtccttggaatacaccata

SEQ ID NO: 42943 - DNA, 201 bp, Homo sapiens
attattttaaataactgcatttataaaatagccacattttataaaattattttaaataacctcactcgtgaatactggggtagctggggataaatttttargctcattgttattgtccctgaaaacgtggaagttattattccattgtctcatctactgctgctgatgatttaggctcattgttattttccctcaaaacgt

SEQ ID NO: 42944 - DNA, 201 bp, Homo sapiens
attacaggtgtgagccaccggtgcccagccgatactactgttttttgtgtctctttccatccatggtacatatatgatagtaacttccaaaaggtatgaamcttcgttttcttccctaatgcatcttaaacgcctagagtagaatctggcacaaaataagttctcaatagttggtgaattgccaggcgcggtggctcacgc

SEQ ID NO: 42945 - DNA, 201 bp, Homo sapiens
agtggctcaggcctgtagtcttagcactttgggaggctgaggtgggtgggttgcctgagctcaggagttcgagaccagcctgggcaacatggcaaaaaccygtctctactaaaaatacaaaaaattagctgggtgtggtggcacatgcctgtgaccccagctaggaggctgaggcatgagaatcgtttgaacctgggaggc

SEQ ID NO: 42946 - DNA, 201 bp, Homo sapiens
ctgccccttctacaaccacgagcagatgggccttctccgggatgaggccctggcagaggtgaaggacatggagcagctgctggcccttgggaaggaggccmgggcctgtccctattacaggagccgccttgccatccctgcagcccaggtgagggccctgcagggccagaaagccgctcttggctctcactgtggtctagg

SEQ ID NO: 42947 - DNA, 201 bp, Homo sapiens
tggcagaatgcctgctaacagcttagttactacattagctggagaaaattagctggaggattagaaggctgtcttacagaatgaatatatgacttaagccwgtagctaatatttggtgacgtctcccgcatagccaaataccgcatgaaccgaataaccaaggggtggaggtttggaatggcccctttcactttttccctt

SEQ ID NO: 42948 - DNA, 201 bp, Homo sapiens
tctgtctccaaaaaaaaaaaaaagagttctgtaattgtaaaaatgtgacataggcattctctaatgtgcaatgaatagtcatttttaagcatttcatacaktgttcctgtactgcactgggtctccttgtgctgaactgcatgggataggccatttccatacaatctcatcctctgaataaggaaccatgatgctcctaaa

SEQ ID NO: 42949 - DNA, 201 bp, Homo sapiens
gtacatagctggtgtatatatatttatggggtagatgagatatttttatacacacacacaatgtgtaatcattacatcagggtacatgtgtatccatcacytcaagcatttatcatttccttgtattacaaacaatccaattatactctcttagtaatttttaaatgtgcaataaattattgttgactgtagtcactcttt

SEQ ID NO: 42950 - DNA, 201 bp, Homo sapiens
gcactccccacttcccaagcccctacctgccaaattatctttaaaaactctgatccacgaaggctcaaggatttaagtaataataaaactccagtctcccrcacagccggctctgcgtgaattactcttttgccattgcagttcccctgtcttgataaatcggctctgtctaggcagcaagcaaggtgaatccattgggtg

SEQ ID NO: 42951 - DNA, 201 bp, Homo sapiens
ccaaaagtacaaaaattagccaggtttggtggtgtgcacctgtaatgccagctacttgggaggctgaggtgggaggattacttcagccctgtctccaccccgcccccccaaccaaaaaaaaaaaaaacagaaccaggaaaacattaaccttggcttccacgtagtcaggatcatcagtatcacttgtcttcctcctctaca

SEQ ID NO: 42952 - DNA, 201 bp, Homo sapiens
tcaacctagatgtcctactgcatacctaatcactatggtgtatcttattgcttataggctacaaatgtggacatcatgttactgtactgaatgctgtaggraattataacaatagttaagtatttgggtcttcaagcatagaaaagctactgtaaaaatgcagtataaaaaaaaatgatgccgggcacagtggctcacacc

SEQ ID NO: 42953 - DNA, 201 bp, Homo sapiens
tccctaaactagataagctgctttagaccttttccttatcccttacacgtcgctcagtaaatacttgctgattgactttcaaattcagattacttttacgmtagcatacggtgggcacaaagggtttttttgtttatttgtttgtttgagacggagtctcgctctgtcgccaggctggagcgcagtggtgcaatctcggct

SEQ ID NO: 42954 - DNA, 201 bp, Homo sapiens
ccagaaacaggggctgtttatccctttatttaggtcttctttcatttctttcaacaatgctttataattttcagagtacagatggtccttgacttgtgatkgttcgtctagacttttttatttaacaatggtgttaaagcaataccatttagtagaaaccatactttgagtacctatacaactgttctgtttttcattttc

SEQ ID NO: 42955 - DNA, 201 bp, Homo sapiens
aaaaaatgaggcgagaggatgacttgagtccaggaggttgaggctccaatgagccatgattgtgccactggactcctgcctgggtgacatagcaagagatygggtcttacaggaagtctaggccatcaattgaataaatactactgaattttaaactctgcagtgcaaactaaattaatgtcttcaagtcaagaccagagt

SEQ ID NO: 42956 - DNA, 201 bp, Homo sapiens
cctttatggctatttttttttcctagttgccacaaaattaaacacaggcatactgtgtcttactgtgctttgctttcttgctcttggaagatattgtgggktttttttttacaaattgaaggtttgtggcacccctacattgagcaagtctactgggaccattttcttttcaacagcatatgctccttttatgactgtgtc

SEQ ID NO: 42957 - DNA, 201 bp, Homo sapiens
agagcacttaggagctcagatttacactgtatatcatgagaaaagcattgaaagtttcaaagcaggagagtgacataattagctttatgttttaaagcggmtttttgactttagattctggcaatacagtggtcctgtggtctaagacatctgactaaccttcctgctagcaacaattaaaaatgctgagtgcaataaaaa

SEQ ID NO: 42958 - DNA, 201 bp, Homo sapiens
agaggtgagatggagcaggtccatctgcctctgccctttctagccaaggttatagctgccctggactgctcactctctggtctcaatttaaaatgatcccrtggccacagggctcctgcccaggggcttgtcaccttcccctcctccttcctgagtcactccttcagtagaaggccctgctctctatcctgccccacagcc

SEQ ID NO: 42959 - DNA, 201 bp, Homo sapiens
tcctgcctcagtagtacccactgttccttattactccaatccgaagatcaagagtcagctgaaatttgttatttcagcgtttctccatccctcttcgcttktttggtaactatttagctccagtccaaattccttggttgaattggactttgagttttaccagagaggtcattatactacatttcaagcagcaggaaaatc

SEQ ID NO: 42960 - DNA, 201 bp, Homo sapiens
ggaagacgtcataaagttctcaagggacaagtcttcgtgattttaggttttgaactttgcgttttagggattctcaactaggttgtgtaggtttttgggggtgaaccctgagaataattttagaatccagctctgagcctaatgattgcctgaggggcagcagaaacccatggtgactgtccagcaataccttgtttttta

SEQ ID NO: 42961 - DNA, 201 bp, Homo sapiens
tgagccaaggtcacaccactgcactccagtctaggcaacagaatgagaccctgtctcaaataaataaataaataaataaataaataaataaataaataagyaagcaaataaataaataggaattcaagaattgagatcatctgtgtgggtattgagaatgccaggaattaagaccagaaattctagagatgatggcaatgg

SEQ ID NO: 42962 - DNA, 201 bp, Homo sapiens
ccatcagcttgttattggctggcaccacagagatgtgtttctctggccctcattaattgtaaccaaccctaagagagttaagttgtatcaggcatgtgtayaccttacagtggataagtttgtcagatactttccttagtgcatattttttaaagagatagaataaagtataaatacacatggaatggatgtcaccaataa

SEQ ID NO: 42963 - DNA, 201 bp, Homo sapiens
aggcctggggaatttcttcagactgacaataaaacttgtttattccagtctggccaacatggtgaaaccctgtctctactaaaaataccaaaaagttagcygggcgtggtgacgtgcacctgtaatctcagctactagtgagacctggcctgccacaatgtggttaaggaaacatattaaaacatttttaaaaatcaagat

SEQ ID NO: 42964 - DNA, 201 bp, Homo sapiens
tggattactataggcagagcagagtcacccgcagtggcagcctgaaagggcccgatgatcccagaggacttttgtccccacgattagccaggcggggtgtstcatccccggtagaaacaaggacctcatctgaaccagttgcaaaagaaagcacagaggccagcaaagaaccaagtccaactaagacccccacaatctctc

SEQ ID NO: 42965 - DNA, 201 bp, Homo sapiens
gccttctacattttttttttaaccatttcatagttccctttttctttgaacacttggtccaaactcacttttcttctggattcatattttctgatctcacmtattatgttatagaactgatatgttacgtttgttttcattgatgcgtctgtacttggcttcagagagcagaacaaggccctgtgagtcactgggagccag

SEQ ID NO: 42966 - DNA, 201 bp, Homo sapiens
ttagctcccaccagcctaagggctgtggaaaccagtaccttttgtctgcacccagccccctctcctccctttggtggcttcctgtgtgtccagggctagcrtcttctaggtgaatctaagatgtcagtaccttagccctcggctgcttgctcagagcctggtttgtgttctttccccagctctgccaggcccattcccagc

SEQ ID NO: 42967 - DNA, 201 bp, Homo sapiens
aagacagattcgctgatgtctcttcatataaaggcactgattccatcaggccactgatcccatcatcccccagcctcatagcctcatccaatcccatttamttcccaaaggccctatctccaattaccatcacattgggaactggggcttcaacataggagtttgggggaactcaaacattcagttcataacagccaccat

SEQ ID NO: 42968 - DNA, 201 bp, Homo sapiens
attatatatcttgtatatattatatatataacttctctttttacttcgtttcacttgagttataaatttgccatgtttggaggttttcgatggtcctagcraaccagtttccctagaagcaacttcccttcagtccgattcacatcaaagatgtgacttcaataccatctgatgttcaagctatttattttagcagtggtc

SEQ ID NO: 42969 - DNA, 201 bp, Homo sapiens
caatgttaatggcagttggtcaaattaataataggtaatgtcttgtgtttttctctatatttttcaaattttctacagtgaggattcattgcttctctaayaacattaatgtaagcatataaataattaaagtttcatggttaatctcacttctcattctctctgagctttgtgttttcttgtgaaggtaaatctctgaat

SEQ ID NO: 42970 - DNA, 201 bp, Homo sapiens
tgttcttttgtctcaactccaccctctccctcttgaagtagacctgaatttgtgccgatacacaatttttatcagactggggtatctgaggtgagctcaamcgacctgtcacttcagacttggtttatagactcctttattgcagccctctcctttttactaatctggcagataaacccagtcctcagagacatttctcct

SEQ ID NO: 42971 - DNA, 201 bp, Homo sapiens
cctgcctcagccttccgagtagctgggattacaggcacctaccactatgcccagctaatttttgtacttttagtagagacggggtttcaccatgttggctrggctggtcttgaactcctgacctcaggtgatccacctgccttagcctcccaaagtgctgggattacaggcgtgagccactacgcctggccaagaagctgt

SEQ ID NO: 42972 - DNA, 201 bp, Homo sapiens
ctcttttctttattcttgccagtttcccacatttacaagctatttgaccagcaactggacattagcttcaccttcacatgaaacattattggtatccatcrtccctcattcctctggttttccacctatgttctttattttctcaactcctctgtgatcttgctccatctttgtttttccctctctcacatccctgctctc

SEQ ID NO: 42973 - DNA, 201 bp, Homo sapiens
tggcatgtgccaccacgcctggctaattttgtatttttagtaaagacaggttatctccttgttggtaggctggtctcgaactcccgacctcaggtgatcckcccgcctcagcctcccaaagtgttgggattacaggcgtgagccactgtgcccagcctacatgatgcatttaaatatatggatgtggggctgggcgcagtg

SEQ ID NO: 42974 - DNA, 201 bp, Homo sapiens
gctataaacagtgaaaagcaaaacaaagccgttcaaatacagatgctcttcttacttgatgtgcagtgtggagggagagaagatagggaagggttgggggkcctgagaaccaccattgtgacctatttccattctcttttttagggaacattaagcaaaatcccaatacacagagtctgtcacagacaggtaagagagttg

SEQ ID NO: 42975 - DNA, 201 bp, Homo sapiens
tttcccaccggccattcacagcagagcaccccagtgccccacagatacaccctctcattgtgtgttatccctgccatcatttctggggacatggagttgtmtgattaggctgtctccacatcttaaattttttgagatggagtctcgctctgttgcccaggctggagtgcagtgccacgatcttggctcactgcaaccacc

SEQ ID NO: 42976 - DNA, 201 bp, Homo sapiens
gcatctggaggtctcagtatgtgaagtgctcttgaagggaagatttcccaccggccattcacagcagagcaccccagtgccccacagatacaccctctcaktgtgtgttatccctgccatcatttctggggacatggagttgtctgattaggctgtctccacatcttaaattttttgagatggagtctcgctctgttgccc

SEQ ID NO: 42977 - DNA, 201 bp, Homo sapiens
tcctggaggaaaaggaagagaaatttacataagctgctatgtctctttctctctcaaactttcattgcttcccaaccaatcttgttacagacctttattgrtaccattatgaaactcccattatccatcctgatcagctccttactattctatgggacttacggcttcaaggaattttccaggactttactcctactcaaa

SEQ ID NO: 42978 - DNA, 201 bp, Homo sapiens
gtaaaagatcccagtcctctcctcaatcctcccctcacacttaaatggaatgggtcttaccagatcatctttactacacccacttaagcaggaaaaaaaaagtttcttgtactaggctaactcactttgaggctcagcgataggcagggctctggcagggctttgatagccctgtctgcagagccagggccctcaagggat

SEQ ID NO: 42979 - DNA, 201 bp, Homo sapiens
cagcctcccaagtagctgggattacaggatgcccggctaattttgtatttttagtagatatggggtttctccatgttggtcaggctggtctcgaactcccracctcaggttatccacccgcctcagcctcccaaagtgctgggattacaggtgtgagccaccatgcccggcctctgctttggtttttaagactcaacaatg

SEQ ID NO: 42980 - DNA, 201 bp, Homo sapiens
ctgctcctcacctccagaataaggagactccttcagctttgaagatgtgggaagagcaggggtgagggcaaggaagaggatgtctgagcattgaaaaggcyaagaaaagaggctggagccctgaaggcaatcagcacctgttcccaagaatgcaaggctgggccttctcccctctcagacacatccatcatctgtcaagat

SEQ ID NO: 42981 - DNA, 201 bp, Homo sapiens
gttctccctcactgctcctcacctccagaataaggagactccttcagctttgaagatgtgggaagagcaggggtgagggcaaggaagaggatgtctgagcrttgaaaaggccaagaaaagaggctggagccctgaaggcaatcagcacctgttcccaagaatgcaaggctgggccttctcccctctcagacacatccatca

SEQ ID NO: 42982 - DNA, 201 bp, Homo sapiens
ggagagacgcttctcacttcccagacagtgcggcagccaggtagaggcgctcctcacttcccagacagtgtagtccctgggcagaggggcacctcacttcmcagatggggcagcgaccgcagaggcactcctcacttcccagacggcgggggagccaggcagaggagctcttcacttcccagacggggtggcggccgggca

SEQ ID NO: 42983 - DNA, 201 bp, Homo sapiens
acttcccggatggtgcggcggccagggagagacgcttctcacttcccagacggtggggcggccaggtagaggcgctcctcactccctagactgtggggcgkccagggagagacgcttctcacttcccagacagtgcggcagccaggtagaggcgctcctcacttcccagacagtgtagtccctgggcagaggggcacctca

SEQ ID NO: 42984 - DNA, 201 bp, Homo sapiens
aagtcaattaatcatgcttttcagtttcttttttttaaacaaacatgccattaaaggaatcatgattttttttttttcattttatggtcacaatacctcartgagtttggtgttgtcattctgacttcagatttaaagaaattgagcctctaaaaggttaagtgagtctgcaaatttccaaagtcacatagtcatagcaga

SEQ ID NO: 42985 - DNA, 201 bp, Homo sapiens
tagtttcctcaaaaaactgaaaatagaactatcatatgatccagcaataccactgctaagtatatacacaaaagaaatgaaatcagtatattaaagagatmtctgcactcccatgtttattgcagcactattcacaatagccaagatttgtcagcaatctaagtgtcaatgaatagaagaatggataaagaaaaatgtggt

SEQ ID NO: 42986 - DNA, 201 bp, Homo sapiens
aactctgttttgtttatgttttaccagaagatatggcttttcctgaatatctatgcttaactcgttcctgtggtcctttcctcttttttctcagtttcttytagtcgtctcaaatgtctgcatctaaaacccacattcagatgcccacggttgtctacagtccacctgtttccagcttcccccttcttcaatgttagtcac

SEQ ID NO: 42987 - DNA, 201 bp, Homo sapiens
acttttgatctcgtgttagagcaaaatgcacactgccatcctctccactagtttgtaagctcttgaagcagggctgagtcagactcatccatagatccccygaagtgcctggcactctccaagtgaatagaggcacttaataaacttcagtagaatcagatttaatttaatggaagttgattaaaattcactttctccttc

SEQ ID NO: 42988 - DNA, 201 bp, Homo sapiens
cttcaccattacctactgagtgtcacatcagtatcacttgttttaggaagcccttccttgatctccctagtcttagttgatattccttctctgtactcctrtggtactgggtgcatatctatacatcttattatgtcataagtgataattttcttgtcttctgtagtagaaagtaatcattaagagcagagactgtgtctt

SEQ ID NO: 42989 - DNA, 201 bp, Homo sapiens
actttttaaaactttgcatagtagaaaattataaatgtggttcatattatatttatattggatacctctggactagacttttactgactcatgatatgacytgaccaaaagatctttttctagctgggcgtggtggcttacgcctgtaatgccagcactttgggaggctgaggcaggtggatcacttgaggtcaggagttc

SEQ ID NO: 42990 - DNA, 201 bp, Homo sapiens
ttgcatcttactttcttgaagattttcattgtgtgtatttctatgtttcataccccggagtcatttcttaaaatgatatattacattcagtatgaagcctyctttgcagtgaggaaacaggtataaggaaggaaagcaacatgcctgaggtgttattagtagcctgagctggaaccaggcagctatttgggctatgtgggc

SEQ ID NO: 42991 - DNA, 201 bp, Homo sapiens
cttctctgacaacctaggccggtaagtagtggttctgctcatctcctgggtcgtgatacatggccggccctcactcccagcagctgggcccctgcctgctstctgctgccattagagcccacagctgggctgcgactgctcagaccagccagctggagggaggggctcagcagctctgggtttggccctgagagagtagtt

SEQ ID NO: 42992 - DNA, 201 bp, Homo sapiens
gggtacctgagagtgagtggactgatagcctttgatagatgctgtgagaaatgagagactgagattgtgcttttcaacaaatatgtagaattcatcttttmtattttgtaagcccccccaccttttttttttgagacaggatgttgctctcaggctggagtgtggtgatgttatcttggctcactgtagcctccatcttgc

SEQ ID NO: 42993 - DNA, 201 bp, Homo sapiens
gagactcagtctcaaaaaaaaaaaaaaaaaaaaaaaaaagacaggttttgcctggagtgcaccctataatggtcgagagggaagcacattcactctttaaraaggaaggccctaaggagaaggcacttcactgggaaagctggaagatgggggtgcttacagcagaggagcaggaggaaggaagaaagaaagagcaaataa

SEQ ID NO: 42994 - DNA, 201 bp, Homo sapiens
ggcacttcactgggaaagctggaagatgggggtgcttacagcagaggagcaggaggaaggaagaaagaaagagcaaataacccgggccacagaaagccaaragttttggctgttgcagtccacagtattatcttgttcctagtattagcttgctcctagttccacaacatcaacaatggagcatgaaaatgtaaacaccta

SEQ ID NO: 42995 - DNA, 201 bp, Homo sapiens
gtgggccttgctggggtggtgggatgtgcgcttcaggtgtcttgagcctggcagagcctccgatccacccagcctctctctcatggctgttcctcgttccyctccactgctctctctcatcccacccagctctttggcttcactgaacggtacggagcagtgttctcatcccgggagcagcccaaactggctgggtttcag

SEQ ID NO: 42996 - DNA, 201 bp, Homo sapiens
cctgcagcccaggacgactgaaggtgaggcaggagggtgagcaggcagagccggctgcacgcatgggcaaggacttctgttcctcatgtgtggacctgacmagagggaggcctcctccccattctgctctgtgcagctcttgcagcccctgcagacgagagtcaggccagcgtcccgcaaccagcttccccactgatgcac

SEQ ID NO: 42997 - DNA, 201 bp, Homo sapiens
aaggtgaggcaggagggtgagcaggcagagccggctgcacgcatgggcaaggacttctgttcctcatgtgtggacctgacaagagggaggcctcctccccrttctgctctgtgcagctcttgcagcccctgcagacgagagtcaggccagcgtcccgcaaccagcttccccactgatgcacatcgaaggcttcctggcagc

SEQ ID NO: 42998 - DNA, 201 bp, Homo sapiens
ggaaaagcaactgaaaatttggaattctaaacccaattaaatttttttttttttgagctcaatctcagctcactgccacctctgcctcccaggttcaagtrattctcttgcctcagcctcccgagtagctgggattacaggcatgtgccatgatgcccaggtaatttttgtattttttatagagacggggtttcaccatgt

SEQ ID NO: 42999 - DNA, 201 bp, Homo sapiens
gggtgtttgaggctggcaggctctgagctgaggagaatctcaaatttacctgtaaagaggatatgattaaagcagccattttataattattacagtaaccrgcccttcttctactccaggctaagagtagccttttctatacttcctttctctttattcatcttacagcaggattaagagatgaacagcctaggaactacc

SEQ ID NO: 43000 - DNA, 201 bp, Homo sapiens
aacaatgacaaagaatgattataaaacagcaggagagaaaggagattatcttcttttttctttttgagacagagtcttgttctttcacccaggctggaatrcaatggctcgatctcggctcactgcaacctccgcctaccgggttccagcgattctccctgcctcagcctcccaagtagctgggattacaggcacccacca

SEQ ID NO: 43001 - DNA, 201 bp, Homo sapiens
caaaccttgagctaaacacagggtgctgattggtgtatttacaatccctgagctagatataaagactctccacgtcctcaccagagcagctagatacagastgtagactggtgcactcacaaaccttgagctaaacacagggtgctgattggtgcatttacaatccctgagctagatataaagactctccacgtcctcacc

SEQ ID NO: 43002 - DNA, 201 bp, Homo sapiens
gcaaacccagtatgtcatcctattacatcagcttcttcatctttggatgaagaggttggtgactgtttcttctaatgtgagaatagctccaaattgctaaattgttcagaatttgacaagatgaaagaggaaagaaaaaggaaatcttgaaaacatttactgtttccttgttcaatggataacacatggattcctgattgg

SEQ ID NO: 43003 - DNA, 201 bp, Homo sapiens
ggacctgacaagagggaggcctcctccccattctgctctgtgcagctcttgcagcccctgcagacgagagtcaggccagcgtcccgcaaccagcttccccrctgatgcacatcgaaggcttcctggcagctctcactacggccaaccaggacggcagggtcatcctgagccgccaaggtaatcaggtggttcttggccagg

SEQ ID NO: 43004 - DNA, 201 bp, Homo sapiens
tgagcaggcagagccggctgcacgcatgggcaaggacttctgttcctcatgtgtggacctgacaagagggaggcctcctccccattctgctctgtgcagcwcttgcagcccctgcagacgagagtcaggccagcgtcccgcaaccagcttccccactgatgcacatcgaaggcttcctggcagctctcactacggccaacc

SEQ ID NO: 43005 - DNA, 201 bp, Homo sapiens
ctccaggtgcctcagaaggtagcactgcgttgtgctgcctgggtggtagaagtggtgttttttgttttgtgtttaagattacagcttgctcagtttgcacwcatgcctacagctgggcttggtttttgcaggtgcagcgatactgtgagaagagcatgatcagcagaaaggtaactgctcccatcttgtggtcctgaacaa

SEQ ID NO: 43006 - DNA, 201 bp, Homo sapiens
caagatgagatttgggtgcagccacagccaaaccctataattctgcccctggcccctctcaaatctcctgtcttcacatttcttttttctttttttttttytttttttttttttttgagatagagtatcactctgtcaccaggctggattgcagtggcacaagcttggctcactgcaacctccacctcctgggttctagcc

SEQ ID NO: 43007 - DNA, 201 bp, Homo sapiens
acacatacgtgactgaattaatacttagccttacaccattgcactgttttattttctttccttttcctttttttttttttttgagacggagtcttgctctstgcccagcccaggctggagtgcagtggcgcaatcttggctcactgcaaactctgcctcccgggttcacgccattctcctgcctcagcctcccgagtagct

SEQ ID NO: 43008 - DNA, 201 bp, Homo sapiens
atttatttctcacagttctgaaggctgtgtgtctgagagcagggtcccagcacagccaagttctggtgaggaccctcttccagtggcagatgcccacttcyggtgctatctcccatggaggacagcagaggctataattcctttggagaaagcctactagcaaatacacaatggaattttatttagcctttcaaaaaaagg

SEQ ID NO: 43009 - DNA, 201 bp, Homo sapiens
ttctgaaggctgtgtgtctgagagcagggtcccagcacagccaagttctggtgaggaccctcttccagtggcagatgcccacttctggtgctatctcccawggaggacagcagaggctataattcctttggagaaagcctactagcaaatacacaatggaattttatttagcctttcaaaaaaaggaatttctgccatttg

SEQ ID NO: 43010 - DNA, 201 bp, Homo sapiens
ggtacaacatttcagttagacaggaggaatatttttttgagatctattgcacagtatgagaactatagttaataataatgtactgtatattccaaaaatgytaagtgaatacatttcaaatgctcttcctaccaaaaaaatgatgagtattggctgggcatggtggctcacacctgttatcccagagttttgggatgccaa

SEQ ID NO: 43011 - DNA, 201 bp, Homo sapiens
atgggtatgttaattagcttgatttaataatttcacattgtttacatatattacaacatcactccgtaccccataaagacatcaaattataaaaagccaayggcaaacacaaatggcctgtgacttcccttatgtccttcagtactaattcacccaatcctttaaaacctatcccttctgggccgggtgcggtggctcatg

SEQ ID NO: 43012 - DNA, 201 bp, Homo sapiens
ggggtttcaccatattggccaggctggtctcaaactcctaatctcaagtgatctgcctgccttggcctcccaaagtgcaggactacaggcgtgagctaccrcacctggccagaaaatgatatgctattcttgctgcaaatgttgaagttgactgataatttttctttaccataaagcagtggttcccaaagtgtagtctgc

SEQ ID NO: 43013 - DNA, 201 bp, Homo sapiens
caccattgtgacctatttccattctcttttttagggaacattaagcaaaatcccaatacacagagtctgtcacagacaggtaagagagttgccctcagagsgcccagagctgatctgagccacttccgagcttaaccctgggactgaaacctgaggcttagggtgaagctcccaaggcccttcatgtgtttgctctcaggg

SEQ ID NO: 43014 - DNA, 201 bp, Homo sapiens
aaaatttagttaataccatgactttcacattttttccactatagaacgctcaaacagctgggcgtggtagctcacgcttgtaatcccagaactttgggagkccaaggcgggcagatcacctgaggtcaggagttcgacaacagcctggccaacatggtgaaacaccatttctactaaaaatacaaaaattagccagacctg

SEQ ID NO: 43015 - DNA, 201 bp, Homo sapiens
agttgggtttaaatgcactgaacgtgaaagcatttctctcaccaaattagaaagttcacccaggaagcttcataaagataagagacaggaaaataaacatmagacctttttaccggtgaaaggtaacacagaaaaatcaaacatgctggagtttaaattatgtccagatatcttactaaagaatacaaactctgtggaaga

SEQ ID NO: 43016 - DNA, 201 bp, Homo sapiens
tgaggcaggagaatcacttgaacctgggaggcggaggttgcagtgagtcaagattgcaccactgcactccagcctgggcgacagagcaagactcattatcaaaaaaaaaaaaaaaaagaaagaaagaaagaaaaaaggaatgctcaaccgcatttgttattatttttttttttttggaaacggagtttcactcttgttgcc

SEQ ID NO: 43017 - DNA, 201 bp, Homo sapiens
cccttttcaaagtagtccacctgtgaggaaatactgattttccagtgatgctgtcattattcagaactcttttggaatgtttcaggaattctctacacagkctgtagtatctgcaattaatggcaaggctttattgtccacaggttgaattccttttaggaaataggcaaaagtcattcagaacccaattagatagtgaaa

SEQ ID NO: 43018 - DNA, 201 bp, Homo sapiens
aacttaaaagtgcaccattaagtaactcctgggaccaagcagatgtcatgagaaaaattaagaaatatttgccacttcatcagttataagacaaaaaaaawttttttttaaattttaagacatacttaaattgagtgataatgaatgatatggttgggtctgtgtccctgcccaaatctcatgacaaattgtaatccccaa

SEQ ID NO: 43019 - DNA, 201 bp, Homo sapiens
gttcatcaagcatgcaccaaaaaatggaaagaaaatggaaatcagtttcatgtaagttaatttgcatcagtcttagtagcttttataaaatgtaaaatgaragagaatctagctcttttaggcaagaactttaattcaccactatatactgatgctgaaaatagtagtacatttattgaatatgcagagaaggtactcaag

SEQ ID NO: 43020 - DNA, 201 bp, Homo sapiens
tgtaacatgaaaaccactgacattaagagacaggtaacagctttaataatttaccagccttgtatttcttcacattcttgtttcagagatagtttgaaaayagtccaaaaggaagataattccaaattcctgaggattttcaccaagtgttgagtgtactatataaagtgataacagaggattatgtggatgcataaccca

SEQ ID NO: 43021 - DNA, 201 bp, Homo sapiens
gcattaacaggaagcattaagaacaaggatgtggttaggtgtctattggtttgtcagaaagacatgtaacatgaaaaccactgacattaagagacaggtarcagctttaataatttaccagccttgtatttcttcacattcttgtttcagagatagtttgaaaatagtccaaaaggaagataattccaaattcctgaggat

SEQ ID NO: 43022 - DNA, 201 bp, Homo sapiens
gagcaagactccctctcgaaaaaaataaataaataagtaaaataaataaataataaagtgtactccatatgtattcaatctgttttattttatttttatttgtatgaacatatacaacacaaatttaaaatatataagtaattaattgtggaaaatgggatctatcgtgaggataaagcaaagttatgcaacaagatgaag

SEQ ID NO: 43023 - DNA, 201 bp, Homo sapiens
tcttagacttgggagagacatttggaaagagggtctcccccctgaggaggacactgcgttgtgggcaggggcagtagaggcgggggtggcctcggagaggrgatgacaaggttggtggcaaggaggctccaggtgcctcagaaggtagcactgcgttgtgctgcctgggtggtagaagtggtgttttttgttttgtgttta

SEQ ID NO: 43024 - DNA, 201 bp, Homo sapiens
ctcccatcttgtggtcctgaacaagacccagctgtgccccaaccccctgccgttgccatgctttcctcccctgccctcagggaactccagagtccccttcrtctccaccctccttggtgcagtgggccttgctggggtggtgggatgtgcgcttcaggtgtcttgagcctggcagagcctccgatccacccagcctctctc

SEQ ID NO: 43025 - DNA, 201 bp, Homo sapiens
tagctaacttagtgctgttccaagtactttatgtgtattcattttaatctttagaataatgcaatgaggcagacactgtattggccccattttatggatamtgagacaggcaacagaggctaagtgatttttccaaggtgatcacaaatagatgggaactatgaccaaatccaggaagcctgcctcccgggtatacactct

SEQ ID NO: 43026 - DNA, 201 bp, Homo sapiens
atcagcagaaaggtaactgctcccatcttgtggtcctgaacaagacccagctgtgccccaaccccctgccgttgccatgctttcctcccctgccctcaggraactccagagtccccttcgtctccaccctccttggtgcagtgggccttgctggggtggtgggatgtgcgcttcaggtgtcttgagcctggcagagcctcc

SEQ ID NO: 43027 - DNA, 201 bp, Homo sapiens
gcaacacgcctgtgagacaaaagtcatcatcttttagagtgaaggccacagggatgagggatgggtgagaaagggacctttcttggtgccccatagaacakatagagactccaggtccttgctgtctcaccccatcttctggcacagtctccctcaggcttatggacaggaataggatgttgatttgttctgtgcaacccc

SEQ ID NO: 43028 - DNA, 201 bp, Homo sapiens
acagagcaagactccctctcgaaaaaaataaataaataagtaaaataaataaataataaagtgtactccatatgtattcaatctgttttattttatttttrtttgtatgaacatatacaacacaaatttaaaatatataagtaattaattgtggaaaatgggatctatcgtgaggataaagcaaagttatgcaacaagatg

SEQ ID NO: 43029 - DNA, 201 bp, Homo sapiens
cagtggtgtgagcacagctcactgcaacctcaacctcccaggctcaagtaatcctcccacctcagcctcccaagtagctgggactacaaacatgcgccacyacccccagcttatttttgtggttttagtagagaaggggtctcactatgttgcccaggctggtctcctactcctgggttcaagcaatcaacctgccttggc

SEQ ID NO: 43030 - DNA, 201 bp, Homo sapiens
gaattgctttaacccaggaggtggaggttgcagtgagctgagattgcaccattgcactccagcttgggtgacagagcaagactccgtctcccaaaaaattwaaataaaataaaataaaataaagaattgtcagataatcatgactaagtctatgaggtaggtactctcattatgcctgttttacagatgaggaaactgaat

SEQ ID NO: 43031 - DNA, 201 bp, Homo sapiens
gcactaagcagaaggcctattcattgctgtgatattccatacaaatcactaagcaacctgtctacagtgaaggacacgatgagagagaattacactgatamaatttactagcactaccacaagccccaaggacccagaagcatctgacttgacaaaatggcagaatgcctgctaacagcttagttactacattagctggag

SEQ ID NO: 43032 - DNA, 201 bp, Homo sapiens
tgttcaattttctcatattgggaagctgccagttttagagttataccaacactgccataataaaaaaaagctgtcaagatcaggaaactgcagatactttygcaggttccagaaccagcaaaggaatgccccttaccatacccgtcagcacccatgaagtaagggaatggacactgcaacttctggtagcaccatcacaga

SEQ ID NO: 43033 - DNA, 201 bp, Homo sapiens
gttttaataggactgggatgtctcagataagacaagacagtgccactgtactcttcactgggcatatcttaccacacatgatttcctttcttatcacctcrtttttagaaggatgtgcacaaaccggaacaaggtcagagagcaaggagacgagtgagggaaattgacatcacgtcttaaaaggaagaaatggggttgggc

SEQ ID NO: 43034 - DNA, 201 bp, Homo sapiens
aagactctgtctcaaaaaaaaaaaaaaaaagttaaaatgataaattttatgtaatatatactttgtcacaataaaaaagtaaatgatcataaacagctctrttgttttaacttgtacatatcgtgtttctttcattttaaagtagaaacagtagctatttaaaatcaaaagataatttcaaacattgcttgttgtcattga

SEQ ID NO: 43035 - DNA, 201 bp, Homo sapiens
atagtctgaaagagtggtgtatatcaaatacgtgggtagtgttgcatttcaaatgaggctcttctggttgaaatgatatatttataagaccagaatatcamaaatgggtgatgtataatgtctctttagttttttggtatttggcctcttttaaagcctgtcggatgtatgggagaaaacaatgaacgtgctttgatttcc

SEQ ID NO: 43036 - DNA, 201 bp, Homo sapiens
ttgaacaaatatgatttatttaaaaataattgaaccagtttatgggaatgtcaacagaaaactactgtattaagtccaaattggacattagtaatttgcartatagcaacatggctcagtctttgcagatcattttgttttccagagtcagtacccaccaatgttgctaccttccttcccaggctaggtactgctgtgaca

SEQ ID NO: 43037 - DNA, 201 bp, Homo sapiens
tgcagtggctcatgctggtaatctcagcactttgggaggctgaggcaggaggattgcttgagtccatgaatttgtggttacagtgagtaaaatcacatcamtgcactccagcctgggtaacagagcaagaccctgtctctagataaatagatagatagacagacagatagaacagctgtataaaagtgtttctgtgtttct

SEQ ID NO: 43038 - DNA, 201 bp, Homo sapiens
ctggcgaagttatttctcagatataacttagcaagaatttatcatcttttatcacattccccatgtttatgtgaacatgtatgacagcgatggtttgaagrtttcttcagaactttctgcttgcaaatattttgccctatcatccccttaaatatagttgtactcatggatattgctttccaaatttgaaaatacggtaat

SEQ ID NO: 43039 - DNA, 201 bp, Homo sapiens
ccctgcacaaaatatcaagaactagaaaaaatcaactccatacaaagcttctgtaagagaaaataggaaatgcaaaccaaaacacttcagctaatgaaacytctccactaaagtcactaagtaaataaataagtaaacaaagaaaagccatgccaaaataatttaacatgagtgaaatattctcaagcatgtatttgaggt

SEQ ID NO: 43040 - DNA, 201 bp, Homo sapiens
tcccaaagtgctgggattacaggcatgagccaccacgcccgaccaatagttgtattttttttggagacggagtctcgctttgtcacctaggctggagtgcagtggcgtgcaattggctcatgccaacctctgcctcagcctcccaagtagctgggattacaggcgcccaccaccatgccgggctaatgttttgtattttag

SEQ ID NO: 43041 - DNA, 201 bp, Homo sapiens
ccactatcatggagactgagagcgagcagaactccaattccaccaatgggagttctagctcagggggcagctctcggccccagatagctcaaatgtcactwtatgaacgacaagcagtgcaggtgagactcagctctgaggggccatggtctgtgagtcttggcttgtggtaggcagtgatgctggaaaataattgtactc

SEQ ID NO: 43042 - DNA, 201 bp, Homo sapiens
gaagaccatcaacgactttctcttccagagccagatcgacaacatcaacctgttcaaggtagaggtttccaccttgccatgttccacatccaatttccttyctgtcaccacctgtgggtagagtactatgttaagactatagaaggaagaaaaagcaaaacagacgtgtaattacttaacccttaacgcaacacgcctgtg

SEQ ID NO: 43043 - DNA, 201 bp, Homo sapiens
tgagccacttccgagcttaaccctgggactgaaacctgaggcttagggtgaagctcccaaggcccttcatgtgtttgctctcagggacggagctgaagacyatcaacgactttctcttccagagccagatcgacaacatcaacctgttcaaggtagaggtttccaccttgccatgttccacatccaatttccttcctgtca

SEQ ID NO: 43044 - DNA, 201 bp, Homo sapiens
aaaacatgaacttacagggctttgggttccacgtgcaagcacgtgagtcagacgtgggaggctcctggacccacctgccctctaagtgggtccgttgcatrctataaacagtgaaaagcaaaacaaagccgttcaaatacagatgctcttcttacttgatgtgcagtgtggagggagagaagatagggaagggttgggggg

SEQ ID NO: 43045 - DNA, 201 bp, Homo sapiens
agtaaccaagaagcatgcatgtatcccggtaattcaaatccaatttcacagccactgctgaatatccaaaattatcctcaacaaatttctgtttctgataygcataatgggacagttgtggcctcacacacttcagtagaaagaataacatatgcaaatgttaatggacccaaacaactaactcacaatttgcagatgtct

SEQ ID NO: 43046 - DNA, 201 bp, Homo sapiens
ccctcaaaacgtggaagttattattccattgtctcatctactgttgctgatgagatgtctgctgttggcttggcaatcttttctttgcagcaaatctttcttttttcttttaaccttttggtgtttcctcattttttaaattttttcttttatcccaatgtgtctaggggtttatctactatctaataaataaatatgtat

SEQ ID NO: 43047 - DNA, 201 bp, Homo sapiens
cagacccaggggaatgataccaggggaaaagatggacagttttgtgggtaaattagcagtgattttgattccttgtcttgttagctgctgatggagatacrtgtatcagcataatacctggctagtttccatggccggcaagagccagtcctgcagtgtgaccacatcctgtccattctgggtcttggtggcaagccagga

SEQ ID NO: 43048 - DNA, 201 bp, Homo sapiens
gagatcatagcatcagtaatccctgtaccgtatgtagtcccagattggaatccttgaccgaaggcaagttctcaacctctctaagactcagttacaaaaamgagggcataatagtgtctcttgccttataggttttggtgaaaattgaataagaaaacatcagtaaggatgtggcatggtgcctgacaatctttagatgcc

SEQ ID NO: 43049 - DNA, 201 bp, Homo sapiens
agcctgctctctgggaaaggatttgtagcttgtgacccagtttgagaggcaccgggcagcaaggcttccactggggtgggcggggcgagtcgccatcaggrcaccaccacttaatgtccgttggcttcttctcaggaagcgtttgaaggccaagaacctgatgtacctgaagcagatcctgtatttgctggagaaattcgt

SEQ ID NO: 43050 - DNA, 201 bp, Homo sapiens
ccgggcagcaaggcttccactggggtgggcggggcgagtcgccatcagggcaccaccacttaatgtccgttggcttcttctcaggaagcgtttgaaggccragaacctgatgtacctgaagcagatcctgtatttgctggagaaattcgtggctgtgctagggggtgagagcctcgccccccggctaacccccggcctgca

SEQ ID NO: 43051 - DNA, 201 bp, Homo sapiens
accgagtgtgtgtagaaaggatgaaatcttaagattagaatgagagtgaacgcaggttggtcatgcctgcagctctctttgaagacactcgctatcatggygggctagaaatagtcaccatagatagtattcttaaaaaaaaaaaagttgctggccgggtatggtggctcacacctgtaatcttagcattttgggaggccg

SEQ ID NO: 43052 - DNA, 201 bp, Homo sapiens
ggtggagctgcatgccattcatgtcctaggcacatcatggtgtgtgctgcacacagacctggaaggctggggactgaccgctggctctgaggcctggggcygtggccagcctgctctctgggaaaggatttgtagcttgtgacccagtttgagaggcaccgggcagcaaggcttccactggggtgggcggggcgagtcgcc

SEQ ID NO: 43053 - DNA, 201 bp, Homo sapiens
atgttcgtatattgattttgtatcctgccaccttgctatacttgcttattagtcctaatagttgtttcttagtgaattccttaagaatttctattaatatwtacaagagcacgtcatctgcaaataaagatcattttacttttttctttccaatctcaataccttttatttgattttctcacctaagttccctggctagaa

SEQ ID NO: 43054 - DNA, 201 bp, Homo sapiens
caaattatccaggataccgtatgattaaaaatacagaacaggtataatctaagaccaaaggattcttattgcaacatgagttaaaccttaaatttttagcrtcttcaaaacaaatgtcttgtgaagatcccagccttgaaaaaatcgctttctagtttagagtcttgccttcctgccacatgtaatggaaatgttgtttaa

SEQ ID NO: 43055 - DNA, 201 bp, Homo sapiens
ctgcttgggctgccataacaaaatatcacagaccaggtggcccaaacaacagaaattgatttctcacagttctggagtctgagaggtctaagatcgaggtstctgctgatttggttcctgctgagggccctcttcctgcttgtgacagccaccttcttgctgcatcctcacgtgacttttcctctgtgcttgcatggagag

SEQ ID NO: 43056 - DNA, 201 bp, Homo sapiens
tttaagtcctcggtggtgatttcggagctggtgtctacggctgcgtctgacatggtggggcacgccggtgacgcgatgcaggggataaaaaagaaagcgasagttcagggactctggcgataaagctgccggagtccgcggcggcggaggcggctgcggcgagcaaggaggctgacgacgcacaatgcaaagacggctttt

SEQ ID NO: 43057 - DNA, 201 bp, Homo sapiens
gaaaaaaaaagccaagaaacaactgacattggtgaaagtctgtaattttcagatccattgatttacagaagaagatgccctgaacctctcagaatattttmtagtgtgattttttttaatgattaaaaaaaatgaagaaaatattaaacaagaagatcaaacacatttcattgagtggtgtctcatatgtttttcttgttt

SEQ ID NO: 43058 - DNA, 201 bp, Homo sapiens
aaggctggtttggtcatccgagatcattaaaaatggccgaccctaacaatatgtacaaaaatataaaatgtaaataaaaaatacaagtttcctttttaaastacttttaagaaaaaaaaaaagcagggccttggaagttttggttctttttccctcccctgttgcaaattctcatggtttgggttgggtggtggagagcgc

SEQ ID NO: 43059 - DNA, 201 bp, Homo sapiens
atcacagtgaagacatggaccatttccagcatccttcagagttcccgtgtgccctttagggctcctccccagcagcctccctcctggccttcagtatccayagacctgctttctcgcattgtcattttgccttttctagaatttcaggtaaaagaatcctacagtaggtatcttttgtgtctggctgctttcacttagtgt

SEQ ID NO: 43060 - DNA, 201 bp, Homo sapiens
tggtagcctcacccctgaaatccagttgcggcttttgacccccagatgcaaattctggtgggagagagctgacctgtggccccacagtgatccttactggkcaatctactggccaggaggccaagccctgtctaggtactaccctaatgaaacctttaaggcgctacagatctttgctgttttcagttccctccaacctct

SEQ ID NO: 43061 - DNA, 201 bp, Homo sapiens
ataattccccttatcatgaaaacattatttttaatggcagcagagtattgctttatattaacatgacagtttattcaaccgaactctttatggggcattgyaatagacttaatgttttatgtttgcagctctttacaccaacacttttcctactgtagtgatttctttgaacaatttcccctccccaactccctgtggttc

SEQ ID NO: 43062 - DNA, 201 bp, Homo sapiens
gacccaggcagtattgaatactcagctttcatcagaaaatgttaccaaagttgagcaaaattcaccagcagtttgtgaaacaatttctgttcccaagtccwtgtccactgaggaatataaatcaaaaattcaaaatgaaaatatgctacttctcgctttgctttcacaggcacgtaagactcagaagacagtattaaaaga

SEQ ID NO: 43063 - DNA, 201 bp, Homo sapiens
aattatatctgaatagagttgggtttaaatgcactgaacgtgaaagcatttctctcaccaaattagaaagttcacccaggaagcttcataaagataagagrcaggaaaataaacataagacctttttaccggtgaaaggtaacacagaaaaatcaaacatgctggagtttaaattatgtccagatatcttactaaagaata

SEQ ID NO: 43064 - DNA, 201 bp, Homo sapiens
agccaaaaataacaaaacaattattaagtactaatgttgtaatatcaaacttactatgacgtttaaattccttctgcagtttactgatctggttgcttttyatcctgttcccagatagagttttcactttctttggtttcaatgtagtctttagactgggtccagcccttgcatctaccacctggaagaaaatactgaata

SEQ ID NO: 43065 - DNA, 201 bp, Homo sapiens
gatgctgctgcatgcggccactcggcaggctgcgggcatccggctgcaggaccaggtggtgatcatcgacgaggcgcacaacctgatcgacaccatcacgrgcatgcacagcgtggaggtcagcggctcccaggtgcgtgggcctcccctccccgggccagggcctgccgtgaggtaaagggacttggatggttcctccag

SEQ ID NO: 43066 - DNA, 201 bp, Homo sapiens
gtttcattgaataagaaaaagaattttagtttttattttagctctgtgttcatttatttcataagtcaaatgtatcgtaacaaatttaacctgacaacttytcattaaaagcctgagtcttagccgggcatggtggtgtgttcctgtaatcccagctacttgggaggctgaggcaggagaatcacttgaacccaagaggtc

SEQ ID NO: 43067 - DNA, 201 bp, Homo sapiens
acttgcaaagggacctccacttccccactgcaccatacccacagagtgtgaaagtaggtattgtatgtaaattgtattttatgattttttggggtcattgytaacttttttcagttatcctggcagaaataagaaaattcttttttgctattccatatatctattgtgatatcagagtctgttgtttgtttgtgtgtttgt

SEQ ID NO: 43068 - DNA, 201 bp, Homo sapiens
tctttcactatttcttttatgactgagaaatttcttttcaatgtataaatcatatacatgttgctcctggacaaaactgagggtcaggctgctacttctcstggcccaataatgagatgcagacaaactggggaagagaggttttatttttgcatctggttacagggagaaggcctagaaattgtcaccacaccaactcaa

SEQ ID NO: 43069 - DNA, 201 bp, Homo sapiens
gtctcaagtttcccaaaagaataggccttcctttttccctcagccatcacccatcattacgagactcaccatttcatccaaagggtggaaattgacatccrtagagacaacacggaatttcactgaaacagaggtattttcctgtgaaatcaccccgtggagcctggggtagtaatagcatgcctgaattcccaggattgc

SEQ ID NO: 43070 - DNA, 201 bp, Homo sapiens
tttctttttcttttttttttttttttgagacggaatctcactctgtagcccaggctggagtgcagtggctcaatcttggctcgctgcaagctccgcctccygggttcgcgccattctcctgcctaagcctcccgagtagctgggactacaggcacccgccaccacgcctggctaattttttgtatttttagtagacggggt

SEQ ID NO: 43071 - DNA, 201 bp, Homo sapiens
gctttttcctgcttcttgggcccagtttccatttcttccttttttctgtttttcctggctattctagtgctaatttccttcctttcctttcctaggctggycttagagcatcctctcctatgtacagccagaccttctttcaagcttttattaaaatggggaaaggtcatttgggaggctttgttgttttcctgtttctaa

SEQ ID NO: 43072 - DNA, 201 bp, Homo sapiens
cttaatatttaactatttttcagtactctagattcacaccaaggtgtatcttttcatttctgttccataaatataatttcgcacagacctaaaccttagckagccagtgcagttttttgtttgcttgtttgtttttattttacttgcctttcgtttaacttactttcaaagtgatatttgggtatgtaaacgtatatgtgt

SEQ ID NO: 43073 - DNA, 201 bp, Homo sapiens
atgcggccactcggcaggctgcgggcatccggctgcaggaccaggtggtgatcatcgacgaggcgcacaacctgatcgacaccatcacgggcatgcacagmgtggaggtcagcggctcccaggtgcgtgggcctcccctccccgggccagggcctgccgtgaggtaaagggacttggatggttcctccagacacctgggcc

SEQ ID NO: 43074 - DNA, 201 bp, Homo sapiens
ttcatagggcctatattcttaatatttaactatttttcagtactctagattcacaccaaggtgtatcttttcatttctgttccataaatataatttcgcayagacctaaaccttagcgagccagtgcagttttttgtttgcttgtttgtttttattttacttgcctttcgtttaacttactttcaaagtgatatttgggta

SEQ ID NO: 43075 - DNA, 201 bp, Homo sapiens
aagctgttttttgaatgtctctacacagtccaggcaggaaatagaagcactcacatcaggagctcagtgtcaggcaggcaagcctcctgcaggggagcccygccctgctcaggtggcctcatctcccctcccagctggtggtgctgccctatcagatgctgctgcatgcggccactcggcaggctgcgggcatccggctgc

SEQ ID NO: 43076 - DNA, 201 bp, Homo sapiens
ttcccgggactcttaaaataatttttaacctacttttcatagggcctatattcttaatatttaactatttttcagtactctagattcacaccaaggtgtawcttttcatttctgttccataaatataatttcgcacagacctaaaccttagcgagccagtgcagttttttgtttgcttgtttgtttttattttacttgcct

SEQ ID NO: 43077 - DNA, 201 bp, Homo sapiens
gacagttgctgtcctctctgttttctctctttgtgcctgtgccaccctcagagaagaagaaaggagctgaggaggagaagccaaagaggaggaggcaggaraagcaggcagcctgccccttctacaaccacgagcagatgggccttctccgggatgaggccctggcagaggtgaaggacatggagcagctgctggcccttg

SEQ ID NO: 43078 - DNA, 201 bp, Homo sapiens
actatggtttttacaatttagtctattcaagtcctacttcaataatattacattcaatattttactgtattctttactataattattacttttgctagcawgtagattgctatatctccctcactataatacgaagaacccatgagtgcaaacgtttaccttgctactgataacataatatgaagttttgctgaaagatgg

SEQ ID NO: 43079 - DNA, 201 bp, Homo sapiens
cctgccatgagtcccgaggcttccaactcaagacttgggtttggggtgctgagctcatgtctcctttttacatttccctacccacagacctgagcggccaygggaggttggggttggcatttgcctgggggagtttctgagcaagcagcacctgctaccttggtggaacccattgctgggaatggccagggctcagcacca

SEQ ID NO: 43080 - DNA, 201 bp, Homo sapiens
aaatctaacccaattccccattttctagttatactctagagcgaccactatggtttttacaatttagtctattcaagtcctacttcaataatattacattmaatattttactgtattctttactataattattacttttgctagcaagtagattgctatatctccctcactataatacgaagaacccatgagtgcaaacgt

SEQ ID NO: 43081 - DNA, 201 bp, Homo sapiens
aaaaatcaaaattacgggtattttaggataaagagaaaggatgagtgaaagaatatttgataagatggtttatcatcatgctgctttatctctgcaagaarattttatagccattctacattaaatctaacccaattccccattttctagttatactctagagcgaccactatggtttttacaatttagtctattcaagtc

SEQ ID NO: 43082 - DNA, 201 bp, Homo sapiens
ttatgttaactttgagcttcctcgtggcatataggtacagggatttcattaggttcaaagaagttttaaagaaaagaagcaattttgattgtggaagaatrttttcagctcataccaaataattgaagtctgctgtgtaggttttgtcttcaaagtcttccatattgagaatgcagtgcactagcaccctcttctgctggt

SEQ ID NO: 43083 - DNA, 201 bp, Homo sapiens
tcccaattcctccctacccccattgcctggcaaccactaatctagtttccgtctctatggatttgcctattccggacatttcatataaatgggatcatatyacatttgttcttttgtgtctggcttgtttcacttagtatatagtatttccaagatgcatccatgttgtagcatatatcagtgcttcattcctttttggct

SEQ ID NO: 43084 - DNA, 201 bp, Homo sapiens
gggaggcggaggttgcagtgagttgagatcacaccattgcactacagcctgggcaacaagagcaaaactccatctcaaaaaaaaaaaaaaaaaaaaaaaamcaaagagtcaggagctctccatgtttaagataatcaaatccacattttatggttgtatacattttatttaaccacacaatgagcacacaaaaattaataa

SEQ ID NO: 43085 - DNA, 201 bp, Homo sapiens
ccagttatataagttttatcatttatgttaactttgagcttcctcgtggcatataggtacagggatttcattaggttcaaagaagttttaaagaaaagaarcaattttgattgtggaagaatattttcagctcataccaaataattgaagtctgctgtgtaggttttgtcttcaaagtcttccatattgagaatgcagtgc

SEQ ID NO: 43086 - DNA, 201 bp, Homo sapiens
acatatcagaactctggtttgatcccagcaatgtccaaatagaaatgggtaactctgaagaaagggtctgagaatgacagagtgcatatgggttgtggtgkcatggccttttccctcctttcttaaaaatagataccagttatataagttttatcatttatgttaactttgagcttcctcgtggcatataggtacagggat

SEQ ID NO: 43087 - DNA, 201 bp, Homo sapiens
catcttcctaaatctcaatgaagtatcatgcacccatttagacagtgtaaaataatccataatagcaatatattaaaatcaaactaatacttaatatcttytgtgtgccagaagttgggcaaagggctttatatgtattattaaataattatcttgatgattagacaatatattacaaaaaactaagattctctagaggtt

SEQ ID NO: 43088 - DNA, 201 bp, Homo sapiens
ggggtgctgagctcatgtctcctttttacatttccctacccacagacctgagcggccacgggaggttggggttggcatttgcctgggggagtttctgagcragcagcacctgctaccttggtggaacccattgctgggaatggccagggctcagcaccagcgctcagcagatgctcagtgcgttttgctgagtttgctgag

SEQ ID NO: 43089 - DNA, 201 bp, Homo sapiens
cagcttgaaattgcaggagctggtactcctagtccgtttaatatttcactgaatattaaaattgctttaaatctctgaagtgccaagtttgggttattagytcataaaaaaagaactgagcctcaactagctggaaaatattgttttgggaactagaacatttgcaaaaaggcataaagctcaaagtttaatgagcctgag

SEQ ID NO: 43090 - DNA, 201 bp, Homo sapiens
aggcaggtgttgctcggagccccagcctctgttcctatgcaggcagggccatcaggcaccagaaggattttgccagcatagtgctcctggaccagcgataygcccggccccctgtcctggccaagctgccggcctggatccgagcccgcgtggaggtcaaagctacctttggccccgccattgctgctgtgcagaaggtca

SEQ ID NO: 43091 - DNA, 201 bp, Homo sapiens
ggccatcaggcaccagaaggattttgccagcatagtgctcctggaccagcgatacgcccggccccctgtcctggccaagctgccggcctggatccgagccmgcgtggaggtcaaagctacctttggccccgccattgctgctgtgcagaaggtcagtcctacctttttctttctgagagcctcccaaccccgagatcacat

SEQ ID NO: 43092 - DNA, 201 bp, Homo sapiens
tgcctccaccaccaagtgcctgaacatctgggccctgattttgggcatcctcatgaccattctgctcatcatcatcccagtattaatcttccaagcccatmgatagatcaggagacatcactgaggccaggagatctacccatgacctgtatcctttgtactccaccttccattcctcgccctgctcccggagccaagtcc

SEQ ID NO: 43093 - DNA, 201 bp, Homo sapiens
ggagacttgaaatctagtacaaactccttgaatttttaaattacagttttagaatattattttaaaagatgctgagacttgcagaaaatttaaagcttccrtaagatcttgcagcttgaaattgcaggagctggtactcctagtccgtttaatatttcactgaatattaaaattgctttaaatctctgaagtgccaagttt

SEQ ID NO: 43094 - DNA, 201 bp, Homo sapiens
gagtcacagataaacttgctataaagcaatttaatgttccacattccaaaacagttttctaagaccaataaacaactttttattcatatttgcaaatgctraattacatctaaatttatttagttcagtgaaacaaagttacacaaaggcattaagagtctcccagtgcttgtctggttttctgaaaggtgtgtttgatat

SEQ ID NO: 43095 - DNA, 201 bp, Homo sapiens
tcctctcttgccccttttggaaatcagctgccacgtggggcagagatttttcttccacttcaataacccttgacttcaaccttccaggtaaaactattggkttaatttaagcttcttttttttttttttttttttttttttttttaagaaacagagtcttgctctgtcacccagttcagtggtgcaatcctggctcactgc

SEQ ID NO: 43096 - DNA, 201 bp, Homo sapiens
tataaacgaatgtgatttacctccttttcttgtctgagcaatactattgacatgtttactagtaaactcaggttaccagtaaacaagcatatgactctaayagctatattcaagagaatttaggagtcacagataaacttgctataaagcaatttaatgttccacattccaaaacagttttctaagaccaataaacaactt

SEQ ID NO: 43097 - DNA, 201 bp, Homo sapiens
ataatgggacattagcaaacgagatgcaagcagaggcctgaaaaacatttatgcaatggggcttgtcctctcttgccccttttggaaatcagctgccacgyggggcagagatttttcttccacttcaataacccttgacttcaaccttccaggtaaaactattggtttaatttaagcttcttttttttttttttttttttt

SEQ ID NO: 43098 - DNA, 201 bp, Homo sapiens
aaaattagaggcctcaccattttcgttgatctcaattttctgttgcccatgaagaatgattacaccttttgaaatcacctaggaaaatgaaaatataatcrtaaagtttagaggatagaaactaaatttcatttaattataaacgaatgtgatttacctccttttcttgtctgagcaatactattgacatgtttactagta

SEQ ID NO: 43099 - DNA, 201 bp, Homo sapiens
taaattataaaagaaagaaatagttgaacatttcttattacgtcaaacttcagtctacttttgtttctttttaaaaatcccttcttgtttgaatgtaaaartacttacctgtctttcttggaaaagaaagggaaggacaatgaccctttcccattatagtagtgtttggaatataattaatgcactattaattaagtaatt

SEQ ID NO: 43100 - DNA, 201 bp, Homo sapiens
caaaccgaaaaagtgctttggtgagatagctgactgtcatcttgcagaaaccctccactgagtttctagccatcctacccactgccaaagagactgccccracccaccaaatttaatttataaagcatttctaggaggagttcataacctattccataaattataaaagaaagaaatagttgaacatttcttattacgtca

SEQ ID NO: 43101 - DNA, 201 bp, Homo sapiens
agaaatggaaaatatgcccttcctccctgtgaaaagaaaatttcaaaccgaaaaagtgctttggtgagatagctgactgtcatcttgcagaaaccctccaytgagtttctagccatcctacccactgccaaagagactgccccgacccaccaaatttaatttataaagcatttctaggaggagttcataacctattccata

SEQ ID NO: 43102 - DNA, 201 bp, Homo sapiens
atttttggcacctacctgattttcgaagcatttctcaattggaattgggtgctatcagtgaccatttctcctccaggatgcaagctatagacaagcatatstactgagggcgctaattcagggttaatgtctatagaaatggaaaatatgcccttcctccctgtgaaaagaaaatttcaaaccgaaaaagtgctttggtga

SEQ ID NO: 43103 - DNA, 201 bp, Homo sapiens
agatttaggtgacagctcagcttcaggcttcattagcagcacactctggtctacagcacggagggcacaaagggagaggggggtggctctcaccttcaggygggtgtttgaggctggcaggctctgagctgaggagaatctcaaatttacctgtaaagaggatatgattaaagcagccattttataattattacagtaacc

SEQ ID NO: 43104 - DNA, 201 bp, Homo sapiens
aattcatgttggaagttattccccaatgcaacagtttaagaggtgagacctttagggggtgattcaggcatgcgggttctgccctcacggatgggattagygctttataaaagggacatggggaactagcctaggccttttttttttttttttttttttttcgcttctgctcttccaccatggaagacacagaaggaaggt

SEQ ID NO: 43105 - DNA, 201 bp, Homo sapiens
gagacatgggctcaaggtggacaaagctcttgcttggggagaacacaagataagcagtgtgatgtgcctcttcgtgttcttctgacacccactggtagccrtaacagggactacgatccttgtaattgacctaatgaattagaaaaattatattatttttagattatacgtcataaagattaatgttctcacaaaactacg

SEQ ID NO: 43106 - DNA, 201 bp, Homo sapiens
aagtacatacacaaaaaagttactggaatgctcggaataagatggtttttctgttgtcatttttgcattttttacaagttttttttttctcctttgagatyataatgaacatggccacaccacaagtaaagtgagaagtaggacagagaacgctccgaaggctggtttggtcatccgagatcattaaaaatggccgaccct

SEQ ID NO: 43107 - DNA, 201 bp, Homo sapiens
gatttttaaagcatgacatgttgtgttactaaaactaagtaattcttccagggggaggaagcagtagtgtctattatataccttccactttacttatttargaaaacataaaaagccattaccgggagaatagaatgcattgttctgaatctaaatgacaaagcaatctttgtttgtttgtttgtttgtttgtttgttttg

SEQ ID NO: 43108 - DNA, 201 bp, Homo sapiens
taatggtaagaagaaagaaaacaacagaaaaactcactgatcttgggagagtgttaccaaaattatttcatttttcagtccaacaaattgcaaagtcattktgaagaaggtgtaacctattaatctgtatgtattatgtacacgagttaaaaaacagaatgacagttgggcgcggtggctcatgcctgtaatcccagcgct

SEQ ID NO: 43109 - DNA, 201 bp, Homo sapiens
aagtgaaccagcacagagagatcaaggagaaagccacaatggctggccgcagaaatcacacttcatcatttttgcaatatcatactggtattacaaaaaasctccgttcagtgggaagtgggaataggggtgggctcaggtggtggtacttacacaacagcagtaataacagaaaaggggaccatattgttagaggctggt

SEQ ID NO: 43110 - DNA, 201 bp, Homo sapiens
cacaaacacattacaaatcatataattctatttacagaaacactggtgtgttcattctaagtcatccagactagtcttctttcttgctcttagtgaatcaycaatggaagttttgctcaggagaatgaaatgtcccatacttgtacatgcaaacactgggatccccagttaccacaaccccaacctgatgggtctcctacc

SEQ ID NO: 43111 - DNA, 201 bp, Homo sapiens
catcatccacagagcctctgtcccagcaatttttaccgctacataaatacccaggagagtgacagcaaatgtgcaaaaagtcacgtataagaacatttgcrgttgcattatttgtaatagctctaaattgaaaacaactcaaatgtcccacaacaggatatgtaaattgtggcatattcatacaattaaaactttatagtg

SEQ ID NO: 43112 - DNA, 201 bp, Homo sapiens
aaatctctacatatcctccaaaatggttaaagttaagattcataatgccaagttttagtgaggatgtggagcaaccgaatctctcatccaattgtgaaaakgaatcatcattatctactagaattcatcatccacagagcctctgtcccagcaatttttaccgctacataaatacccaggagagtgacagcaaatgtgcaa

SEQ ID NO: 43113 - DNA, 201 bp, Homo sapiens
tacaaaaattagccaggtttggtggtgtgcacctgtaatgccagctacttgggaggctgaggtgggaggattacttcagccctgtctccaccccgcccccmcaaccaaaaaaaaaaaaaacagaaccaggaaaacattaaccttggcttccacgtagtcaggatcatcagtatcacttgtcttcctcctctacatcttgcc

SEQ ID NO: 43114 - DNA, 201 bp, Homo sapiens
attttcaaagagaaatgtgtttacgaagcattgagcaactttgggtgggttgagaccgaaagtatccttgccacttgagtatacattgggggaggcagagytggaatcattggcatatgtggaatgaaattaatgcatgtattagcacataagggatgtgaatagcaatacttttcataaacaaaaaaagcaggattattg

SEQ ID NO: 43115 - DNA, 201 bp, Homo sapiens
gtttgaaaaccactattttatgagccaagtagaacaagaaatgacaactattaaaaaaaataagggatttctgaccagctaacaaccccacagaaaatctrccagggatccagaaatgagactgaggtggcctcagagagcggctccctcctgaaggggatgctgctgctgtcatcctgcccggcaccttggactgcagtg

SEQ ID NO: 43116 - DNA, 201 bp, Homo sapiens
agtttgaaaaccactattttatgagccaagtagaacaagaaatgacaactattaaaaaaaataagggatttctgaccagctaacaaccccacagaaaatcygccagggatccagaaatgagactgaggtggcctcagagagcggctccctcctgaaggggatgctgctgctgtcatcctgcccggcaccttggactgcagt

SEQ ID NO: 43117 - DNA, 201 bp, Homo sapiens
tattagaccctttttcctccttggtttaggaatgggggccccagggccacccttgtccaggctccctctaccgtagaggtgagaattccagggcgctacartttgaaaaccactattttatgagccaagtagaacaagaaatgacaactattaaaaaaaataagggatttctgaccagctaacaaccccacagaaaatctg

SEQ ID NO: 43118 - DNA, 201 bp, Homo sapiens
tgacaagaatagctttcagtgaaatagaatagagagcacagaaagtcacaagattttaaaacaactcaacatataataattaccaatcaacaggaaagaakgaaattgttctatttattgcataaatagcattgtagaaattggcttgctatttggtgataaaataaataataagtcaagtacggtggtgcacgcttgtat

SEQ ID NO: 43119 - DNA, 201 bp, Homo sapiens
gggattagcgctttataaaagggacatggggaactagcctaggccttttttttttttttttttttttttcgcttctgctcttccaccatggaagacacagmaggaaggtaccaccttggaagcagagagcagccctcgccagacaccaactctgctggcaccttgatcttgtacttcccagcctctagaactgagcagaaa

SEQ ID NO: 43120 - DNA, 201 bp, Homo sapiens
tcggcctcccaaagtgctgggattacaggtgtgagccaccaggcccgaccaatgctaggtctttgcagtgggtctcatatcattccacgtacactgaggcrcacttgttgccagagaccaaaaactttactgagcaccctttcacccccagcgcccacttggctgggtctatttccaattcttttagtctctggggctgat

SEQ ID NO: 43121 - DNA, 201 bp, Homo sapiens
gaattcgggatgagtccatagggtaaagtgaaagcaagtttattaagaaagtaggccaggcacagtggcttacgcctgtaacctcacaactttgggaggcygaggccagcggatacgaggtcaggagttcgaggctagcctggccaacatggtgaaaccctgtctctattaaaataacaaagattggcccagcctggtggt

SEQ ID NO: 43122 - DNA, 201 bp, Homo sapiens
aactgactttgtacccagctaaccattactaacaagaaggggaaagaaacaaaaaagaaggggaggcctggcgtggtggctcatgcctgtaatcccagaactttgggaggctgaggcaagcagatcacttgaggtcaggaattctagaccagcctggacaacatggtgaaaccccatctctactaaaaatacaaaattggc

SEQ ID NO: 43123 - DNA, 201 bp, Homo sapiens
ctttgtaatctcacatattttattttatgcattcaaaagattattctggccaggcatggtggctcatgcctgtaatcccagcactttaggagaccgagacrggtggatcacttgaggtcaggagtttctgaccagcctggccaacatggtgaaaccctgtctgtaattagccgggcttggtggcccatgcctataatccca

SEQ ID NO: 43124 - DNA, 201 bp, Homo sapiens
cttacaatcacgacagaagaaggggaagcaagctaccttcttcaaaaggtggcaggaagaagtgctgagcaaagggggaagagtcccttataaaaccatcrcatctcaagataactcactcaatatcacgagaacagcatgggggaaaccacccccataatccaattacctccacctggtctctctcttgacacatgggga

SEQ ID NO: 43125 - DNA, 201 bp, Homo sapiens
agtaaaacagaaataattaacactgtgtgtagataccttccctcctgaattcaacaaatgttaacactttgctatattcatttcacaactttttaaaacaraaatatgaatcttaaattcggctggggaaaaaaaaacagaaataaaaactttagataaatgaaaattccctcagctggagctcagaacatcagcctccat

SEQ ID NO: 43126 - DNA, 201 bp, Homo sapiens
gaccctatctcaaaaaaattaaaaagaagaaattagagcatatagagaagtaaaacagaaataattaacactgtgtgtagataccttccctcctgaattcmacaaatgttaacactttgctatattcatttcacaactttttaaaacagaaatatgaatcttaaattcggctggggaaaaaaaaacagaaataaaaacttt

SEQ ID NO: 43127 - DNA, 201 bp, Homo sapiens
gtaatggttcttccctcagcatttatagaagaaattcttgaaaaggcaaaaattcaactgttagagacaattatagcacaatggagaggctttagagcatrtcttaaaataatttaaatatatgcattaaaagctactctttccgaaaaaagtgattacacttatcttgcacgtagatgtatgggtatgaaaactaggttg

SEQ ID NO: 43128 - DNA, 201 bp, Homo sapiens
caataggaaagccacggagtggggtgtggggttcagtcacattggacccccggctccgtgttcctgtcccctgtagtgtttttgttattagaccctttttyctccttggtttaggaatgggggccccagggccacccttgtccaggctccctctaccgtagaggtgagaattccagggcgctacagtttgaaaaccactat

SEQ ID NO: 43129 - DNA, 201 bp, Homo sapiens
tttgaaaaacaattctatggagatgtagttcacatattatacaattcacccatgtaaagtggacaggctgactttgttttcttttctttttttttttttttgagacagggtctcactctgttgcccaagctggagtacagtggtgccatcatggctcactgcagtctcgacctcccaggctcacgcaatgctccacctcag

SEQ ID NO: 43130 - DNA, 201 bp, Homo sapiens
tcctaagtaagctgacctgacagcactatttgtaacaaatagttcattctaaattcacctggtaattaagggtgaccatctgtggtaattggtaaagttasctgaaaggggtcctgattcagaccccaagaaagggttcttagctctcgcacaagaaagaattcgggatgagtccatagggtaaagtgaaagcaagtttat

SEQ ID NO: 43131 - DNA, 201 bp, Homo sapiens
gctctccctgtgccctaccatggaacttggtaagcctttgttaactcactggcactgctagatcatgctatggtccccgagggccagggaggcaagtgtgytagtccaagtaaaaagctgatatgatctttgtatgaacagaaacactgtttgtaatgtgatgataacgttggtttcttgctcctgggatattgtgttcta

SEQ ID NO: 43132 - DNA, 201 bp, Homo sapiens
gtagcaaaacatgccactccaaacatgccactttggcatattgattattttgagataaagacagtgaaaggaagggaaatgggatacttccctgattcccyttgcaggacgtgcaacagaagtgtagctcacctgttcagttgcctcactgcttaatccccttgtgagacagagagcatgcagacaggcaggtgcagaggc

SEQ ID NO: 43133 - DNA, 201 bp, Homo sapiens
atgccactccaaacatgccactttggcatattgattattttgagataaagacagtgaaaggaagggaaatgggatacttccctgattccccttgcaggacrtgcaacagaagtgtagctcacctgttcagttgcctcactgcttaatccccttgtgagacagagagcatgcagacaggcaggtgcagaggctggggtgagc

SEQ ID NO: 43134 - DNA, 201 bp, Homo sapiens
tgtgatctcggctcactgcaagctccacctcccgggttcacgccattctcctgcctcagcctccggagtagctgagactacacgcattcaccaccacaccyggctaatttttcgtatttttagtagagatgggctttcaccttgttagccaggatggtctcgatgtttttaaagaaaaaatatttacatttattatcaaat

SEQ ID NO: 43135 - DNA, 201 bp, Homo sapiens
gggatggatagcattaggagatatacctaatgctaaatgacgagttaatgggtgcagcacaccagcatggcacatgtatacatatgtaactaatctgcacrttgtgcacatgtaccctaaaacttaaagtataataataaaaaaaaagagtttttttttaacttaaaaatggttgaaatttaaaatgttgtaaagttgaaa

SEQ ID NO: 43136 - DNA, 201 bp, Homo sapiens
atttaccagcattatttttactaaacgattcttgttcatatatttattttcagttgcatttagcataagtgaaattcgagattcctaaaaaactggtttayacagttatataaaaatgtattttaggtaataaaattattatagttgattatttgatagtgaggcctattatttttattctttaaacatagaatatacttt

SEQ ID NO: 43137 - DNA, 201 bp, Homo sapiens
aaacgttttgtaggaataatgtaactgtggtttcttaatacagaataatgcaaataccaactaaaattttttctataaatattttaatatatattttgttmtatatagcaggaggttaataaaaatttaccagcattatttttactaaacgattcttgttcatatatttattttcagttgcatttagcataagtgaaattc

SEQ ID NO: 43138 - DNA, 201 bp, Homo sapiens
aaaaagttgaactattttaataatggattttctgtgtgtatagaaactcctacaattgatttaaattttttttttttttgagacagattcttgctttgtcrcccaggctggagtgatctcggctcactgcaacctccacctcctggattcaagcaattctcctgcctcagcctcccaagtagctggaattacaggcacccg

SEQ ID NO: 43139 - DNA, 201 bp, Homo sapiens
accagcagtaatgagaaaaatgtgaaaaaaacgttttgtaggaataatgtaactgtggtttcttaatacagaataatgcaaataccaactaaaattttttmtataaatattttaatatatattttgttctatatagcaggaggttaataaaaatttaccagcattatttttactaaacgattcttgttcatatatttattt

SEQ ID NO: 43140 - DNA, 201 bp, Homo sapiens
tttctgtcattgcacttaccttgcatagcaaaccttaatgcaattgtgttttgcctttgctacaccatgagctttgcatcccaagtctttaacacaaaagmtagcacacagtgggcatgaaatattttatgaaagaatcagtttgtactagaagaaggcacacttttatcaagggttcactagtcaatattgattagtgtt

SEQ ID NO: 43141 - DNA, 201 bp, Homo sapiens
acctatcaacactgctttgccaagatagggaagtgcaaaccagaaagtggtaagccatcaccttcttgataaaggagatggacttaatttaatgaaatgtrcctcttactgactttgctgcttgatttaaacaatccttctagggatatttctgtcattgcacttaccttgcatagcaaaccttaatgcaattgtgttttg

SEQ ID NO: 43142 - DNA, 201 bp, Homo sapiens
acagggtcttgctgtgtcacccaggcacaatcacagctaactgcagccttgacctcccacctcagcctcccaagtagctaggactgtagatgtgtgccacyacgcctggctaatttttttattttttgtatagatgtggcctcactatgttgcccaggctggtcttgaactcctgggctctagcaatcctcttcccttggc

SEQ ID NO: 43143 - DNA, 201 bp, Homo sapiens
ttgattctcgacccttctccactctttcatttactccactcttactttgctttcacctccttttgtaaccgttcatcatcactcttcatatggattaatgkgattatcttaaaagcatgtaatatgtagttgctgggtttgtatgagtaatgagtgaacctgaagccaacataatgatcccgtttagtgctcccgagttaa

SEQ ID NO: 43144 - DNA, 201 bp, Homo sapiens
tctccaacattcatttcccctgcttcggcaccatagacttgaaggattggactcaggagttggggaggacacgggggaagttgctttcctggtgctgaggmccccggccaccgtggtagtgtacagcaagtacagggtaacagaagggccagcaggaggacacggtgcaatggtgtaccgagggacaggagagtgaatcag

SEQ ID NO: 43145 - DNA, 201 bp, Homo sapiens
agcctagacaatatagtaagactctgtctctaaagataaataaataaatcccagatgaattagagatccaaatataaaataaaaccaaaaactatatcatragcatttatcttctcttcaaatgaaagcacgttccaagcttaaacacaaaagaagataccataatccactgaactgcataaaaatttaaaacacctacat

SEQ ID NO: 43146 - DNA, 201 bp, Homo sapiens
tttgttttatttttagatcagacaatcacatgagaatattctgttgtgatcgctggcgtttagaaggaaacttgtctggtttgtgaagcaatggaaaacayatccagacagcctgctagtggaaactttggaagggcactgtcatatgctttttctcccacgccatcaacaagtgtcctttttttttttttttttttgaga

SEQ ID NO: 43147 - DNA, 201 bp, Homo sapiens
gctgtagtgcaccatgatcacacctgtgaatagtcgctgcagtccagcctagacaatatagtaagactctgtctctaaagataaataaataaatcccagaygaattagagatccaaatataaaataaaaccaaaaactatatcatgagcatttatcttctcttcaaatgaaagcacgttccaagcttaaacacaaaagaag

SEQ ID NO: 43148 - DNA, 201 bp, Homo sapiens
cctgtaatcccagctacttgggaggctgaggcaggagaattgcttgaacccgggaggtgaaggttgcagtgagccgagatcagatcacgccactgcactcyagcctgggcgacagagtgagactctgtttaaaaaaaaagaaaaagaccctgcagaaattaaaattgtaaaaatataaatatacaaggaacaggcaccagg

SEQ ID NO: 43149 - DNA, 201 bp, Homo sapiens
gtttttttgttttttttagacggagttttgctctgcctcccatacaggctggagtgccgtggcacaatcttagctcactgcaacctctgcctcccaggctyaagctattctcctgcctcagcctcccaagtagctgcgattaacaggtatgtgccaccacgcccagctaatttttgtattttaactaaagatagtttcacc

SEQ ID NO: 43150 - DNA, 201 bp, Homo sapiens
caagtacagggtaacagaagggccagcaggaggacacggtgcaatggtgtaccgagggacaggagagtgaatcagagccacaggacagagctccacctgtytccagggaagtgcatggggggctcccggaagccaaaggcagcgcccagaggcagtgtgaagaggccttcctcagacctcagggtttcggcagggatagtg

SEQ ID NO: 43151 - DNA, 201 bp, Homo sapiens
agagggcaaacatggacagaaacttaatatttgagaaatactgagtttgaggtgctttgtaggccatctgagaataaatgcctcgtaggcagttgacatgyggggatctggaaagcctcttaaagaaatggtgagagatggagacttgaaaatccaagcacctagacgcccgtgatgggagtagttaacatggccctggga

SEQ ID NO: 43152 - DNA, 201 bp, Homo sapiens
gccttgtctagaaagatagtctcctgcagttctgcagttgctaccgctggccgggaaggtgtagattccgctttccctctgcgcacgcgcggctcccggcrcaaaattctcttgaatcgaacttatttgcatacgggcgcgcgcacgttgcgggctgggagggggagaagtcccggcgaccgcgcgcgctcccgaggcctc

SEQ ID NO: 43153 - DNA, 201 bp, Homo sapiens
aaccccgtctctaccaaaaatgcaaaattagccgggcgtggtggcacatgcctataatcctagctacttgggaggctgaggcaggagaatcccttgaatcyaggagacagaggttgtggtgagccgagagatcaagccattgcactccagcctgggcaacaagagctaaactctgtctcaaaataataataataataataa

SEQ ID NO: 43154 - DNA, 201 bp, Homo sapiens
ttttgggaggtcgaggtgggtggatcacaaggtcaggagtttgagaccagcctggccaatatggtgaaacctcgtctctactaaaaatacaaaaaaattasccgggcatggtggcacgtgcctgtaatcccagctacttgggaggctgaggcaggagaattgcttgaatccgggaggcagaggttgcagtgagccgagatc

SEQ ID NO: 43155 - DNA, 201 bp, Homo sapiens
aatcactgtcctaaactccagctagagttaatcattcatttttctgtaacacctcagtggccatacatgtttcgtttgtaacacttatgtaattctaatayatgttttgtccccagttatactttttctatttcttctattgttacaattgctaatacagcacctggaatatgaaaaacattcaataagtgttggctgatt

SEQ ID NO: 43156 - DNA, 201 bp, Homo sapiens
ctgctactctaggaaatatactctgataatcactgtcctaaactccagctagagttaatcattcatttttctgtaacacctcagtggccatacatgtttcrtttgtaacacttatgtaattctaatatatgttttgtccccagttatactttttctatttcttctattgttacaattgctaatacagcacctggaatatga

SEQ ID NO: 43157 - DNA, 201 bp, Homo sapiens
tatataggcatatatctttttcctaaactagtggttgtcaaattttaatgtgcttcggaggacaagatttctaacttattcctatgttttttttttttttktttttttttttttttgagacagagtcttgctctgtcacccaggttggagtgcagtggcaccatcacggctcactgcaagctccgcctgctgggttcacac

SEQ ID NO: 43158 - DNA, 201 bp, Homo sapiens
aatgtaaatatataggcatatatctttttcctaaactagtggttgtcaaattttaatgtgcttcggaggacaagatttctaacttattcctatgttttttktttttttttttttttttttttttgagacagagtcttgctctgtcacccaggttggagtgcagtggcaccatcacggctcactgcaagctccgcctgctgg

SEQ ID NO: 43159 - DNA, 201 bp, Homo sapiens
cactccagcctgggcgactgagcgaggctctgtctcaaaaaaaaaaaaaaaaaaaagaggttcagcttctcattcaaggatgcttggtatttctcacaccscagtatggcaatattattgttgacatgttgaaggatttctgtaccggttggtaaagagccacttccctgagctccccagagtcccctccctgcttcccta

SEQ ID NO: 43160 - DNA, 201 bp, Homo sapiens
gaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccccagtatggcaatattattgttgacatgttgaaggatttctgtaccggttggtaaa

SEQ ID NO: 43161 - DNA, 201 bp, Homo sapiens
ctcaggtgatctgcctgcctcagcctcccaaagtgctgggattataggtgtgagccaccgcacttggcccctattttctttgtaaattacccagcctcaartatttctttacagcaacacaagaaatatacaaatgacaatatgcagccatttgtatattgtctgcatcccaaattcaatgtaaacttcacgaatataaag

SEQ ID NO: 43162 - DNA, 201 bp, Homo sapiens
cctattttcttccttttttttttttttgaaaaggagtttcactcttgttgcccaagctggagtgcaatggcacaatcttggctcactgcaacctctgcctyctgggttcaagtgattcttctgcctcagcctcccgagtagctgggattagaggcatgcaccaccacgcctggctaattttttgtatttttagtagaaaca

SEQ ID NO: 43163 - DNA, 201 bp, Homo sapiens
ccttaagattctttaccagttgtgtggtcttaatttcacaaattgaggaatctgatccatagatggttccacttgaacgtggtgggagggtaacattctcyttccatgaaatgtaaagactgcattgtgggacatggaggggctccatgagatccatttagttgcattcatcctcctgtccccaaagtatatcagtaaatg

SEQ ID NO: 43164 - DNA, 201 bp, Homo sapiens
gctactcggcaggctgaggcaggagaattgcttgaacctgggagacagaggtttcggtaagccgagatcctgccactgcactccagcctggcaacagagcragactctgtctcaaaaaataaaataaaataaaataaaatggattcaggtgataacactctttcctgcctacggaccctgtccctctatcctaagaggtgt

SEQ ID NO: 43165 - DNA, 201 bp, Homo sapiens
aaattctctagtagtctagtagtcatgttagaaaaagtaaaaagaagtcaggcaccatggctcacgcctataatcccagcactttgggaggccaaaatgaaggatcacttgagcccaggagttcaagaccagcctgggcaacatggcgaaaccatgtctctacaaaaaataaaaagattattcgggcatagtggcatgcgc

SEQ ID NO: 43166 - DNA, 201 bp, Homo sapiens
acgcgggaagggagggagccggccccgagactgcatcattccgcaccggctgctgcagggccagagggagcaggtggagcgagagagcgagccgcgagccrgagcgcgccagacccagggcgagactgcagtgacgcggcccgggagacatggcggacgggcgtctctgaataagcagaatccggagcccctcgctacccg

SEQ ID NO: 43167 - DNA, 201 bp, Homo sapiens
tctaagaaatgtgccccaagaagcattaacctttgttttgtgccatcctgaagacttgcacattttatttttcagatagcttaacatttttaatcgagtgygttctctaccatgcggtaatgctttggtactattcatacagggtcttgcctatcctaaagacttgccatttccccaagaggagctttgattctgctttag

SEQ ID NO: 43168 - DNA, 201 bp, Homo sapiens
agtctcgctctgttgcccaggctggagtgcagtgccacgatcttggctcactgcaaccaccacctcccaggttcaagcaattctcctgcctcagcctcccragtagctgggactacaggtgtgcgtcatcacacctggctaatttttgtatttttagtagagacagggtttcgccatgttggccaagctcatctcaaactc

SEQ ID NO: 43169 - DNA, 201 bp, Homo sapiens
cttgaagggaagatttcccaccggccattcacagcagagcaccccagtgccccacagatacaccctctcattgtgtgttatccctgccatcatttctgggsacatggagttgtctgattaggctgtctccacatcttaaattttttgagatggagtctcgctctgttgcccaggctggagtgcagtgccacgatcttggct

SEQ ID NO: 43170 - DNA, 201 bp, Homo sapiens
cagcttggagatgaagtcctggccccagaaggcactggtgtggaagccacacatctcccttgaaagtgcatctggaggtctcagtatgtgaagtgctcttraagggaagatttcccaccggccattcacagcagagcaccccagtgccccacagatacaccctctcattgtgtgttatccctgccatcatttctggggaca

SEQ ID NO: 43171 - DNA, 201 bp, Homo sapiens
ttcacgtgtttgtctgctgaccctctccccacaattgtcttgtgaccctgacacatccccctctttgagaaacacccacagatgatcaataaatactaagrgaactcagaggctggcgggatcctccatatgctgaacgctggttccccgggtccccttatttctttctctatactttgtctctgtgtctttttcttttcc

SEQ ID NO: 43172 - DNA, 201 bp, Homo sapiens
aaaattaaaaactttcattttttaaaggaccactttatttatttacttattattttgagacagaatctcaccctgtcacccaggctggagtgcagtggtgwgacctccgctccaggttcaagcgattctcctgcctcagcctcccaagtagctgggattacaggcatgcaccatcacatccggcttatttttttatttttg

SEQ ID NO: 43173 - DNA, 201 bp, Homo sapiens
tgatcagtaagcaccttcaggaggctggtgaggcttatcggtctcagcctgctgctgccacgaccccctggactaggcctcaggcaaccggaatttaagcytctgcaacatctagaagcataagttctcttcttcagtttcttcacctataaaaaaaacagagtttcactctacgatttttaaagtttgttgtatcatcta

SEQ ID NO: 43174 - DNA, 201 bp, Homo sapiens
ttctaggtatgaccgaccatcaaaccaaggggaaagaagaagaaaacagttttgatttgatttgattaggaagcaggcatgtatatgatgaggcataaagmccatgtgggggaaaaaactggggagaaacgtagcaatgtgaaggatttccagaggggcctttagaaacctaaaaagctaatctctgaagttgtccatgag

SEQ ID NO: 43175 - DNA, 201 bp, Homo sapiens
ggctgtagtgcaccatgatcacacctgtgaatagtcgctgcagtccagcctagacaatatagtaagactctgtctctaaagataaataaataaatcccagmtgaattagagatccaaatataaaataaaaccaaaaactatatcatgagcatttatcttctcttcaaatgaaagcacgttccaagcttaaacacaaaagaa

SEQ ID NO: 43176 - DNA, 201 bp, Homo sapiens
gatgggttggaatatcttagaaagaggcatcagttttcaggtactaattgcttgggttctaggtatgaccgaccatcaaaccaaggggaaagaagaagaamacagttttgatttgatttgattaggaagcaggcatgtatatgatgaggcataaagaccatgtgggggaaaaaactggggagaaacgtagcaatgtgaagg

SEQ ID NO: 43177 - DNA, 201 bp, Homo sapiens
ctgaatagaaagatgaaagacaatttctggatgggttggaatatcttagaaagaggcatcagttttcaggtactaattgcttgggttctaggtatgaccgmccatcaaaccaaggggaaagaagaagaaaacagttttgatttgatttgattaggaagcaggcatgtatatgatgaggcataaagaccatgtgggggaaaa

SEQ ID NO: 43178 - DNA, 201 bp, Homo sapiens
gatagctctctctccgtcacctactgcatctacaccatgtctagtgtcatcggttctatctccaacatgtctcaaatccatacttctctgccatcacctgktccaaactagcatcttctctgccctaacctatcgcctataacctcctaactggtctctcttctcttttgtccttcttccattaattctcttttttaaagg

SEQ ID NO: 43179 - DNA, 201 bp, Homo sapiens
tttactgaatagaaagatgaaagacaatttctggatgggttggaatatcttagaaagaggcatcagttttcaggtactaattgcttgggttctaggtatgmccgaccatcaaaccaaggggaaagaagaagaaaacagttttgatttgatttgattaggaagcaggcatgtatatgatgaggcataaagaccatgtggggg

SEQ ID NO: 43180 - DNA, 201 bp, Homo sapiens
tctcaaaaaaaatttatatatatggagcaaggtctgaatctttagtttttcttgctatagaaattttttttcttttatttactgaatagaaagatgaaagmcaatttctggatgggttggaatatcttagaaagaggcatcagttttcaggtactaattgcttgggttctaggtatgaccgaccatcaaaccaaggggaaa

SEQ ID NO: 43181 - DNA, 201 bp, Homo sapiens
catgagcatacaagacctggaatgcactttaaaatgtgtactgccaaagctgggcacagtggcacgtgtctgtagtcccatctgcttgaaaggctgaggtsggaggatcgcaggaacccaggagttctgggcagcagtgaacagtgactgcgattgtgagtagccttcactacggccgggcaacataacaggattctgcct

SEQ ID NO: 43182 - DNA, 201 bp, Homo sapiens
cttgaaaggctgaggtcggaggatcgcaggaacccaggagttctgggcagcagtgaacagtgactgcgattgtgagtagccttcactacggccgggcaacrtaacaggattctgcctctaaagaataataaacataaaattaacttcctacccactgtctttcagggcaagccataactgtgaagggaaacaagttaagga

SEQ ID NO: 43183 - DNA, 201 bp, Homo sapiens
ttgtagagacagggttgtgccatgttggccaggctggtctcgaactcctgacctcaagtgatctgcccaccttggcctcccaaagtgttgggattacaggygtgagccactgcacctgacctcgaagagggtttcttgatagagtaaacagaagaaattaaaagttaacaattaattgacatgtacttgactggtttcccg

SEQ ID NO: 43184 - DNA, 201 bp, Homo sapiens
aaaacagaaatctcagtaaactagatgattaacataaagatataatggccaaaattgactcaacaagttgaaaacctaaaacttatggtgaaagaagaaartatttaagttatcaaagaaatatttgttagacatttcccaggctcagatagttttactgtttaattattttaaactttccatagctagacaaaaatacac

SEQ ID NO: 43185 - DNA, 201 bp, Homo sapiens
tttcaccatgttggtgaggctggtctcgaactcctgacctcatgatccactcgcctcagtctctcaaagtgctgggattacaggcgtgagccaccacaccyggcctcacattttctttctattgcaatctcttagatctctcctagaagactgtggggattctagaaaaaatgtatattttctaggggaaaaagaaggcag

SEQ ID NO: 43186 - DNA, 201 bp, Homo sapiens
atgcacgaccacgctgggctaatttttgtatttttagtagagactgggtttcaccatgttggtgaggctggtctcgaactcctgacctcatgatccactcrcctcagtctctcaaagtgctgggattacaggcgtgagccaccacacctggcctcacattttctttctattgcaatctcttagatctctcctagaagactg

SEQ ID NO: 43187 - DNA, 201 bp, Homo sapiens
ctcccgagtagctgggattacaggcatgcacgaccacgctgggctaatttttgtatttttagtagagactgggtttcaccatgttggtgaggctggtctcsaactcctgacctcatgatccactcgcctcagtctctcaaagtgctgggattacaggcgtgagccaccacacctggcctcacattttctttctattgcaat

SEQ ID NO: 43188 - DNA, 201 bp, Homo sapiens
ttttgtttctttttgtttgtttgtttgagacggagtttcactctgttgcccaggctggagtgcagtggtgcaatcttggctcactgcaacctctgcctacrgggttcaagccattctcctgcctcagcctcccgagtagctgggattacaggcatgcacgaccacgctgggctaatttttgtatttttagtagagactggg

SEQ ID NO: 43189 - DNA, 201 bp, Homo sapiens
aagtcaaaagaagatttgaaatgctactgaaaaaaaaaaaagaaggctgaaaactggtttgcaagattctctggggcatcaaaggcatcttaagaaccacscttgcacgttcattagacagccctttaatcaatgtatctttaatagactgctggaaatactcaaaggcaagtaattttcatgtcataaattaaacaaagt

SEQ ID NO: 43190 - DNA, 201 bp, Homo sapiens
gactgtgtggttgttaaactttctaagtgaaacaccatagtgtcgggagcaatgccgacaagcctggccacctttggtctacagcagatattgcaagctgrtatcccgtggccacagtcaggcttggtgattgataaacattttgatttagggagctgcttttttcaagaaacagaatcacataaacaggatttcaggcca

SEQ ID NO: 43191 - DNA, 201 bp, Homo sapiens
agtaaataccacaaggttacaaaaggtacaaaaatgtgtgaaacatttaaatttcagagggaaatccacacttctgcaaggttgaagtttctcatatcaamttctcattcccagtggaaaacaaggtggggagggttgggaggtttttgtcctcagtagcctgctttttcccacgtaggactccactttatactacttcac

SEQ ID NO: 43192 - DNA, 201 bp, Homo sapiens
tgtcaggtttcatgattatataaaggccagacttagatctggccacacatattatacctgaacatttcttcttatttctacttaatgttttttatttatamaataaaagtcttattgtattatctgtaagctaacatatgcctataagacatgtagcttaaattttaaaaacaggacagaataatcccttcgtgatttgaa

SEQ ID NO: 43193 - DNA, 201 bp, Homo sapiens
aataaaatcatgtgtcaggtttcatgattatataaaggccagacttagatctggccacacatattatacctgaacatttcttcttatttctacttaatgtyttttatttataaaataaaagtcttattgtattatctgtaagctaacatatgcctataagacatgtagcttaaattttaaaaacaggacagaataatccct

SEQ ID NO: 43194 - DNA, 201 bp, Homo sapiens
gctccatgacttgcgctaagaggtactctgggcaccctcctccttgccctcagcactggtatctccatctaatgttacaccccttccccaggatcgtctcmtagctgatattttatgtctccctccttgcttttattcccttccccaaatcagctcataagcagaaattcacatttagagcagggtggtcttctgtggcac

SEQ ID NO: 43195 - DNA, 201 bp, Homo sapiens
agcccatggtcccagctactcaggaggctaaggagggaggatcacgcattcagaaggtcgagactgcagtgagccatgattttaccactacactgtagcckgggtaatagagtgagactctgtctcaaaaaaataataataataaaataaaacatatgttaactttgctgctaattagtttaagattctgaatttgcaaag

SEQ ID NO: 43196 - DNA, 201 bp, Homo sapiens
ttctttttctgaggcaggtcttgctctgttgcccagccttgagtacagtggtgcgaacacaattcactgcagccttgacctcctgggctccagtgattctyttgcctcagcctccctgtagctggaaccacagatgtgcaccactgtgcctggctaatttttgtagagaaggggctcactatgttgcccaggctggtttcg

SEQ ID NO: 43197 - DNA, 201 bp, Homo sapiens
ctgcagttcagaagaaatgtaaaacagtgaatgtgcttattactaaaagaaacagctaatatattttttaaaccccaacaaaatcaactacaaatattagraaaaagaattaataagatgaaagagaaaataaattatttaggaacacaaaataataaaagaaagaaaatagtaaaaataagaaccaataaaatagacgaa

SEQ ID NO: 43198 - DNA, 201 bp, Homo sapiens
cccccaccttttttttttgagacaggatgttgctctcaggctggagtgtggtgatgttatcttggctcactgtagcctccatcttgccaggcttaggtggkcctcctacctcagcctcctggatagctgagactacaggcatgttccatcacacctggctaattttgtattttttgtggagatggggttttgccatgttgc

SEQ ID NO: 43199 - DNA, 201 bp, Homo sapiens
tgaatcaagggggcagttacctccatgctgttctcgcgatagtgagttctcatgagatttgatagttttataagaggctttcggctttctcccttttgctstgcacttatccttgctgccaccatgtgaagaaggacatatattgtaagtttcctgaggcctccccagccatgctgaactgtgagtcagttaaaccccttt

SEQ ID NO: 43200 - DNA, 201 bp, Homo sapiens
cacccaaatctcatattgaattgtagtttccataatccccacgtgtcatgggagggacccggtgggaggtaactgaatcaagggggcagttacctccatgstgttctcgcgatagtgagttctcatgagatttgatagttttataagaggctttcggctttctcccttttgctctgcacttatccttgctgccaccatgtg

SEQ ID NO: 43201 - DNA, 201 bp, Homo sapiens
gctgagtgcaataaaaaactagcccttaaatggaatgaatgagttgactacttggtaaggatgctcagaggctaaaactgaatcaaagcaggaactcttaraagtaagcagtgtgttggctaggcgcagtggctcagcctgtaatcccaacactttgggaagccaaggcaggtggatcacttgagctcaggagtttgagac

SEQ ID NO: 43202 - DNA, 201 bp, Homo sapiens
accttcaggaggctggtgaggcttatcggtctcagcctgctgctgccacgaccccctggactaggcctcaggcaaccggaatttaagcttctgcaacatckagaagcataagttctcttcttcagtttcttcacctataaaaaaaacagagtttcactctacgatttttaaagtttgttgtatcatctaattccaaaggga

SEQ ID NO: 43203 - DNA, 201 bp, Homo sapiens
atctttgccagatacctaattgtatcttgataaataaaagttacttttaatggctaagtactttaaaatattatcttaagttacttttagaatttataaayatttctccctctttttaacccctttaaggtaaagagtcccaaagcagctttagggagggaaaaaggtcacagtgggaccttggcctggccttaactgtca

SEQ ID NO: 43204 - DNA, 201 bp, Homo sapiens
gtggtcctgtggtctaagacatctgactaaccttcctgctagcaacaattaaaaatgctgagtgcaataaaaaactagcccttaaatggaatgaatgagtygactacttggtaaggatgctcagaggctaaaactgaatcaaagcaggaactcttagaagtaagcagtgtgttggctaggcgcagtggctcagcctgtaat

SEQ ID NO: 43205 - DNA, 201 bp, Homo sapiens
cacacctcacgaagctcagccaccaactcaaaaaggactggacaatacttttaccactttcgcttctcagaattcaggcctgtcctcagaatgctacaagrtacagcccatttaagctcctgtatagacgctcctttttattaggccccagtctccttccagacaccagaccaacttagactgtgcccccaaaaacctgtc

SEQ ID NO: 43206 - DNA, 201 bp, Homo sapiens
ggctcttccaaatcaaagagaggtcacatcatgcatagtattatttgggggttagcatacgttttgtaataattatgttaaaattggtaatccctttttgrgttcaatgatagctctattaattatattgtcttgttaactgaaatattccactctgtcaatgggattaatggttggagattatgatacaaccaaaaccaa

SEQ ID NO: 43207 - DNA, 201 bp, Homo sapiens
agagtgacataattagctttatgttttaaagcggatttttgactttagattctggcaatacagtggtcctgtggtctaagacatctgactaaccttcctgmtagcaacaattaaaaatgctgagtgcaataaaaaactagcccttaaatggaatgaatgagttgactacttggtaaggatgctcagaggctaaaactgaat

SEQ ID NO: 43208 - DNA, 201 bp, Homo sapiens
ttgtcgctcaggctggagtgtagtggcacattcttggctcactgcaacctctgcctcctggattcaagtgattctccagcctcggcctcccaagtagctgrgattacaggcgtctgccacctcgcccagctaatttttgtacttttagtagagaaggggttttgacatattggccaggctggtctcgaactcctgaactca

SEQ ID NO: 43209 - DNA, 201 bp, Homo sapiens
aatattttattattacccttagtatcctggggcctggggtgttgtaaggggtaagtttatctatctatctatctatctatctatctatctatctatctathtatccaaatcatgtttgtgtgtgtgtgtgtgtttttttttgagacagggtcttgctctgtcatccaggctggagtgcagtcacacaatctcagctcactg

SEQ ID NO: 43210 - DNA, 201 bp, Homo sapiens
tagaaagatgagatctagtttgcaaaccagaagtctcaatactcgtagcagtggttttcacagcatgtatatcatcatgtatgtatgatgcatatatcaayattaaacgtatgaacaatctcaagcattagcacgagaatacctaaagatgtgaacactgactgtgtatattgtgttttcattgcttaaattttcttaaaa

SEQ ID NO: 43211 - DNA, 201 bp, Homo sapiens
tagcagaggtaatgaaaaatcataggagttgcttcaacttttcaccttacaaagatctttcacctccgtcatctcacttgatttctgtgactgccctgtgmagttagtattattattattctcatgtgacagatggtgaaaccgaagcccagtggggttaagtgactttaccatggccacatgggacatgaatctaagtct

SEQ ID NO: 43212 - DNA, 201 bp, Homo sapiens
ggtcaggctggcctcagactcccgacctcaggtgatccgcctgcctcggcctcccaaagtgctgggattacaggcgtgagccactggcccggccagagctrcgagttcttaaagcactttattctttgtatctcagtgagaaggcatcaccatgctctaacttagggatgatggcatcttgaattagttgtgcagcagaga

SEQ ID NO: 43213 - DNA, 201 bp, Homo sapiens
ggtatttcatgttttgtgtagcaattgcttcagttgtccattccaatttttcagttgtactaaatgcttcaggagtgatgtttagaaacatgaaaaaaaaatcaccaactctgttttttttttcacgtggctcatttgcatcgcgtatgccttaaaatgcattcattagcttgttgctttataagttggaggtccattttg

SEQ ID NO: 43214 - DNA, 201 bp, Homo sapiens
gcttgaatccaggaggtggaggttgtagtgcaccgagaccatgccattgcactccagcctgggcaagaagagtgagactccccctaaaaaaaaaaaaaaaagagagagagagattgtttgcatctacaatgttcattttcagcctccatccagaagagccaagtatggtttggacctaatattatgaagtaaatagcttta

SEQ ID NO: 43215 - DNA, 201 bp, Homo sapiens
cacagtgctagattagagatgtaaaaagtgctagaagaacgctggggaaggaacagttacttctacttggggaacccacaaacaacacagacagtgacttrtgccttgaagggtaagaataatttctaaaaacaggaaaaagatgctatttagattttgttacaaagaggtcaagaaaacaattatagattttaaaaatca

SEQ ID NO: 43216 - DNA, 201 bp, Homo sapiens
agttaatctatcatcagtaataataattagagaaatataaatttagttatattttataacacagtgtttattccagatttaaaatgttataaggatatatyagtttatttgatactcaaaactattacatgagctaggtactgttattatcttactatatagatgaagaaactaaactaggtccatcatgtaacctgtcca

SEQ ID NO: 43217 - DNA, 201 bp, Homo sapiens
actttttaaggtatattgcttatttaaaataacaaaaaatctatagttaatctatcatcagtaataataattagagaaatataaatttagttatattttayaacacagtgtttattccagatttaaaatgttataaggatatattagtttatttgatactcaaaactattacatgagctaggtactgttattatcttacta

SEQ ID NO: 43218 - DNA, 201 bp, Homo sapiens
tataaactggaggataaggtacagcgggagaaagcaagtaccagcagacacagagggggctgagactcctgcaagcagcgcctttcctcaggctcactggrtgtgctctgtgtttgggtgtgaaccaccaagatgcatgcatgatatctgttttcagggaagccaagatacaagtgtacagaaaagccattatacccccgt

SEQ ID NO: 43219 - DNA, 201 bp, Homo sapiens
ctcagcacatgtgtaacaacaaaacaaacactttttaaggtatattgcttatttaaaataacaaaaaatctatagttaatctatcatcagtaataataatyagagaaatataaatttagttatattttataacacagtgtttattccagatttaaaatgttataaggatatattagtttatttgatactcaaaactattac

SEQ ID NO: 43220 - DNA, 201 bp, Homo sapiens
caacagatatagaataatagcactttaaagatgtttaagagtaaagcacaaaccatgtatataccaagacttagctaattctctgagagttataacttaasacaataaaataattaaaaatagtgttaacattaagtagaatgcaaatctctatagatggtttcctgggaaagtagttttgataagctttcctagcattga

SEQ ID NO: 43221 - DNA, 201 bp, Homo sapiens
acttttagcttcccatcctcttgaacaagtattctcatgtattatttagtgaacaagcaaatttataaaataagttacattttaaattttctttaaaatakattctgtatacaagctatcttttgagatattcctaatgtttaacatttctgatatccaaatcctctgtgggatgtctaatggtcttcttctgttctttga

SEQ ID NO: 43222 - DNA, 201 bp, Homo sapiens
ccaggaggaggaggttgcagtaagctgagattgtgccattgcactccagcctggatgacagagcaagagtctgtctttaaaaaaaaaaaaaaaaaaagtargcttacacatattccctttactgtttttcaaggtcattacatttttatctgttattgttcaccatttaaaaataagcagtggaaagcagcctacttttta

SEQ ID NO: 43223 - DNA, 201 bp, Homo sapiens
gcagaaaataaacagaaagtataggatctcccctatctatgcatgaaatgatctgaggaagaaagtcaaatcatcctcatgagctacttcttgtttcctaraggaaaatattagttgttagcaaatttataacaatcgtgatagacttttagcttcccatcctcttgaacaagtattctcatgtattatttagtgaacaag

SEQ ID NO: 43224 - DNA, 201 bp, Homo sapiens
cactttaattgaagccacagaattgggtttcagttctgtttctttcagctacatgtgaacactgacaaattatttaactgcaaaattctgtttaagcagcrgaaaataaacagaaagtataggatctcccctatctatgcatgaaatgatctgaggaagaaagtcaaatcatcctcatgagctacttcttgtttcctaaag

SEQ ID NO: 43225 - DNA, 201 bp, Homo sapiens
ggaaatcagaacagaacaaagcattcctagctgaagttttattttcactgtgctttgtggtacaggttgagtatcccttttccgaaatgttttgggggacragaaatgtttcagattttggattttggacatttgcatatatacataatgagttatcttggggatgggatccaggtccaaacatgaaatttacttatgttt

SEQ ID NO: 43226 - DNA, 201 bp, Homo sapiens
ggaggaatctcagcttgtggctgacgttttaatgttaagttattggaatcaaaataataatagcacctgctctttgtatacaaaacgtgaccatgaaagaytgtgtaaatatttcattagactgatggtgaattgttatgttttttacactttaattgaagccacagaattgggtttcagttctgtttctttcagctacat

SEQ ID NO: 43227 - DNA, 201 bp, Homo sapiens
ccgtggctgaaacaaagttttgactgccactcatgacatgaggtcaggtgtagaattttgtggctcatgtcagcactcaaaaggtttcagattttgaagcrttttggattttggattaaggatgctcaacctgtaccatttgcattacattagagttacagtctatatgggctcagtaaattaaatgaaaacacatttcta

SEQ ID NO: 43228 - DNA, 201 bp, Homo sapiens
acaatcttcaggaagctgttggttcgggagtaaaagcgtgagactaagaagtgagcatccaagtactgaggcgtcaaccagctgggaagatagcagctctyaggtcgaacatatgtggcctgagatgacaaaagaaagtgaagggtcttagtatcatgacatccgaagacagttgttactgagaatggaggcttctcaact

SEQ ID NO: 43229 - DNA, 201 bp, Homo sapiens
cctcatatgcttcactgtttagggagtaatgcacagtaacaaccttctggtgattacattcaagctgctttggttctggaacaatcttcaggaagctgttsgttcgggagtaaaagcgtgagactaagaagtgagcatccaagtactgaggcgtcaaccagctgggaagatagcagctctcaggtcgaacatatgtggcct

SEQ ID NO: 43230 - DNA, 201 bp, Homo sapiens
cgttctatgtgtttgtttgttgttaatggatcgaacagtattcaccagcaaagtgagaaggctgcccttactctggtcaccgtggcatgactgatgcatgmtttctaagctgtgctgggctaagcagacgtgcaattgaacaggattccaggaacccactgactgagacttaccaaatagaagaactttacattggaatca

SEQ ID NO: 43231 - DNA, 201 bp, Homo sapiens
gttactttcaaatagattttatttctatgagatggtaaacagaaagcctcatctccttaaatgcacaatttctccattctggagaatcaactatagggtgrggcactgattttcaacattagtagaatattgtatagtaattgattaatgcattatactgatcggtttgctgcattagtacaaccttttaagggaaaattc

SEQ ID NO: 43232 - DNA, 201 bp, Homo sapiens
aaagataacatctcaataaggttaaaaattaataatcaatgttaacaacaataactgttttcatttttgtatgactggtttttgtttacatgaatatataytttatattgttatcattacattgtttaagccatgaacattatatcacaagcttttccatgttgctatctagtcttgtttttatttgttaaagttattgta

SEQ ID NO: 43233 - DNA, 201 bp, Homo sapiens
aacacacacacacagacacacacactcacttgcacacctgactttgaatcttattcaaaatgaaatgacagtattgaagttttaaagaaggggaatgatamccgtgcaacacaggtgagccccaaaattggggcttagcctggggaagtccttggctttacccaggaaataattcaagggtgagctgatagtagaaaacag

SEQ ID NO: 43234 - DNA, 201 bp, Homo sapiens
ttaacaattactgtcacatggtcactgttacatgttagccaatagtgcctcacattcactgtggcttccaaagcttgggcttggggaagcaggtggatggygatatcatgagctcagatagagatcatgggagaagagatttgagatgttttaaaaaagtgttttgagcagatgaagttaaagagttaaagggaactatgg

SEQ ID NO: 43235 - DNA, 201 bp, Homo sapiens
ctgtgctgttccaccgtccatctgctggtatcctcctctactcacctgctgctctgctgtggagcttggggtttgcggtttacgtgggggcaggatagagrgtgtggagggacaaaaggcaacctctttgtcttgaaaacaggaatgcctgtcctcatttagggccgcaggtcttcaggcttgaaggtgaggtctttgcca

SEQ ID NO: 43236 - DNA, 201 bp, Homo sapiens
ttgggaggcagaggtagggggattgcttgagcccaggagttctaaaccagcctgggcaacgtagtaggaccttgtctctataaataaataattaatttaawtttttttttaaaaagacaggcctgaggtccaaaccgaaatggcctcccgactccattttatgtgctttgactaacccgtcactgtttcccttcatcattt

SEQ ID NO: 43237 - DNA, 201 bp, Homo sapiens
ttaaaaagacaggcctgaggtccaaaccgaaatggcctcccgactccattttatgtgctttgactaacccgtcactgtttcccttcatcattttgttaagwtgctggacaagccccagttctagccaccctttttagttactcatcactgaatgctcccatgtgtatacaggcagcacatgttaaaaaactttttcggcca

SEQ ID NO: 43238 - DNA, 201 bp, Homo sapiens
tgcttgaatccaggaggtggaggttgtagtgcaccgagaccatgccattgcactccagcctgggcaagaagagtgagactccccctaaaaaaaaaaaaaaragagagagagagattgtttgcatctacaatgttcattttcagcctccatccagaagagccaagtatggtttggacctaatattatgaagtaaatagcttt

SEQ ID NO: 43239 - DNA, 201 bp, Homo sapiens
atgcttgaatccaggaggtggaggttgtagtgcaccgagaccatgccattgcactccagcctgggcaagaagagtgagactccccctaaaaaaaaaaaaaraagagagagagagattgtttgcatctacaatgttcattttcagcctccatccagaagagccaagtatggtttggacctaatattatgaagtaaatagctt

SEQ ID NO: 43240 - DNA, 201 bp, Homo sapiens
aatggttgatcagacccttgaatgttgagctctttccatactagacttgaatattctcctgcccatttgatttgttaattaggattcattggctgtttctstgctctcctcttttctctctgttcctgctggttcaagtttaacctccattttctttctcctctgggaagtttcccttatgcctcttgaacagggtcaaga

SEQ ID NO: 43241 - DNA, 201 bp, Homo sapiens
tcctgcgttcacgccattctgcctcagcctcccgagtagctgggactacaggcacctgtcaccatgtccggctaattttttgtatttttagtagagacggrgtttcaccgtgttagccaggatggtctcgatctcctgacctcgtgatctgcccacctcggcctcccaaagtgctgggattacaggtgtaagccaccgcgc

SEQ ID NO: 43242 - DNA, 201 bp, Homo sapiens
ataaaaaaataaaaaataaataaaataaaataaaaacgtttttatcttgttaatctgtcttttgtcaatctaatttacagggcccagcctgtaaatctaaratgagtagaaggaaaaagaatttttcccctcctgggcagaacactcttgggcacgtgagccttggcttcttaaccacatatctgagcagccagtgtggca

SEQ ID NO: 43243 - DNA, 201 bp, Homo sapiens
ccacaacctttacacaaaggaggaagagtgaaatgaatattgaacatagttgttaactgacataacatcatttgaacttacctaaatgttaggtttttttrttattattattttattttttatttttatttttttgagatggagtctcgctgtgtcacccaggctggagtgcagtggcgtcatctcagctcactggaagct

SEQ ID NO: 43244 - DNA, 201 bp, Homo sapiens
cccatgtattcccacgtgtgttagaacatcatggtgccccgcttttgcatattaaaaggctatggtgggagggccagctttttcgcagatatgtgaatgayatgcctagtcaaaccaatcccctgagccctatgcaattcagacaccgcctcctccagcctctgtgtacatatatctagctggtatctgtggcaggtcggg

SEQ ID NO: 43245 - DNA, 201 bp, Homo sapiens
accatgttggccaggctggtctcaaactcctgacctcaggtgatccgcccgccgcagcctcccaaattactgggattacaggtgtgagccactgcacccgkcctttcaaagctcatttcaatcccacctccgtcacaaagcattcttcagccaccttcgttttcatcctttttttctctgcactctttctacccttatcat

SEQ ID NO: 43246 - DNA, 201 bp, Homo sapiens
tttaaaaattttcagttctctgaataccattttacatataacatactgtgagaaaataccgttatccatttctgagtcttgggtcatttagacttttctgyttatagcatgagaaaagaaagtacgattaaaaaaaaatgggggataaaagcctctcagataatacccccatgaaattggactgactcagatgttataata

SEQ ID NO: 43247 - DNA, 201 bp, Homo sapiens
taaaaataccaaaaaaattagccgggcgtggtggcggcatgcgcctgtaatcccacctactcaggaggctcaggcaggagaatggcctgaacccgggaggyggagcttgcagtgagccaagatcgcgccattgcactccagcctgggtgacagagcaagactctgtctcaaaaaaaagagaaattcatcaaaattctaaca

SEQ ID NO: 43248 - DNA, 201 bp, Homo sapiens
tgttgttgttttgttttttgagacggagtctcgctttgttgcccaggctggagtgcagtggcgtgatttcggttcactacaacctccacctcccaggttcsagcgattctcctgcctcagcctccagagtagctgggattacaggcgcctgccaccacacctggttaatttttgtatttttagtagagacggagtttcacc

SEQ ID NO: 43249 - DNA, 201 bp, Homo sapiens
attcaaatcccagcattaccatctgcaatctataaccctagcctagtgtctaacttcctctgagctttcagtttcctcaactgaaaataggaaaaatacaygcctcactgggaaaactggtaagttataggagtaaataactagcatggcgcctgtcacaaaatgctagcaagcccccaaatatgagaagcaaggttgaga

SEQ ID NO: 43250 - DNA, 201 bp, Homo sapiens
cacgaggtcaggagatggagacgattctggctaacacggtgaaaccccatctctactaaaaataccaaaaaaattagccgggcgtggtggcggcatgcgcytgtaatcccacctactcaggaggctcaggcaggagaatggcctgaacccgggaggtggagcttgcagtgagccaagatcgcgccattgcactccagcctg

SEQ ID NO: 43251 - DNA, 201 bp, Homo sapiens
gaagggcagcttccggatgagcagctcggtcgacttctgataacgacgaatctctcgaagcgccacggtcccaggcctgtagcgatgaggcttcaccccgyaggtagagggggtgcttttcctggcagctttcgtggccagctgtttgcggggggctttcccaccggtggatttacgagcagtctgcttggttcgggccat

SEQ ID NO: 43252 - DNA, 201 bp, Homo sapiens
ttgttcacagcttctccaattccttcttgtatctgcccagcattgggttctgtaaaataataaacagtggctgcattctcatgggagagaaataaaccaargtactatgggacatcaactgtgtccacctaggcaggaaatacgtcatcagagcaggctggctttgccaggggctccatagaacttgcctctggcctgttt

SEQ ID NO: 43253 - DNA, 201 bp, Homo sapiens
  misc_feature (1)...(201): n = A,T,C or G, or insertion/deletion polymorphism (see Tables 1-2)
tggggggaaaaaaccctgggaatagggagatggcatgtgaagtggaagaaggttatgattttcaatagagtgatcagagaaagcctcattgagaagacacnctaaggaggccatgtggctggaggggactgagttagggggtgaatagtaggtgagaccagagggggccacatgatgtagcagcttctagattatcaggac

SEQ ID NO: 43254 - DNA, 201 bp, Homo sapiens
tattactgtagtcggacacactcccagctggcccagtttgtgcatgaggtgaagaagagcccctttggcaaggatgttcggctggtctccctcggctcccrgcaggtaaacagtagccagtatttccaccaggggccatcctgctcctttccccacaactttgtcctgctcgtccaggcctgggagacgctgggtctgtga

SEQ ID NO: 43255 - DNA, 201 bp, Homo sapiens
attacatttttagataatggtcacagtaagtcttttcagaaaaaagcaacgaagaaagctctagaccaatgagattttagtcatcattaatcaatgccaarcgaaaaaatcttaagatgtatttaaatttgtgatgccagtgtgattcagaaatttgaaaaatggatttcaaagtaatgctgtgagcagataggtcattgt

SEQ ID NO: 43256 - DNA, 201 bp, Homo sapiens
ctttctcatctttaaaatgaaaaaatcggttgctacctcatgtagtggtggtggtgaattaaagaaacccaagggaggaggcagaggttgcagtgagccamgattatgccacggtactccagcctaggcgatggagtgagactctgtttcaaaagaaaaagtaaaaggaaagaaacccaaaggagagctctggaaggggta

SEQ ID NO: 43257 - DNA, 201 bp, Homo sapiens
aatttagaagtagaaccctttcttaaggctgggcgcgctggctcacacctgtaatcccagcactttgggaggccgaggtgggtggatcacgaggtcaggaratcgagaccatcctaacacagatcgagaccatcctaacacagatcgagaccatcctgactaacatggtgaaacccccgtctctatgaaaaatacaaaaaa

SEQ ID NO: 43258 - DNA, 201 bp, Homo sapiens
ttttctactttctcatctttaaaatgaaaaaatcggttgctacctcatgtagtggtggtggtgaattaaagaaacccaagggaggaggcagaggttgcagwgagccaagattatgccacggtactccagcctaggcgatggagtgagactctgtttcaaaagaaaaagtaaaaggaaagaaacccaaaggagagctctgga

SEQ ID NO: 43259 - DNA, 201 bp, Homo sapiens
tcagtctcaagttggggctcttaaggttcaggaaaaaacaaatactacatgggtaacttaaaaaaagaaatctaaaggtctgtatgtttcatttcttacarttctgagatctgttttaaaagtaatggattgtatcgctcctatgtgccactttcaaaaaataaaggggtaggaaatagtcttaaagagaagatgatattt

SEQ ID NO: 43260 - DNA, 201 bp, Homo sapiens
tggggtaagtgtaagatttaatctctctattccttaagtgttcccatccacaaagtaagaaggctggatgaggtgtgtcaatcctagcacactaacctaaktcatcccccaggttgcctagacctgtcaggagcatggccttatgaagatacaaacatgaaatcctgggttggacccctctatagtttctgatcaccaaac

SEQ ID NO: 43261 - DNA, 201 bp, Homo sapiens
ctcccgaccagggcacagatctcacacatgcttccaacatcagtgtaatgccactgtgtcataaaggtcaagattaggggtttcatgacatatgaaaaacwttgggaaaataaatttttcaagaggtaatacttttggcaatttaattttaaaacaacttcttcaccagctattactatgcaaaaataatcattatggtcc

SEQ ID NO: 43262 - DNA, 201 bp, Homo sapiens
ccatgaagccagtccctggtgccacaaaggttgggggctcctccttagaaagacaaaatggacagaaccaagagaataaagtccttttactgcttatcaamataagctttccaccttactttctggcatctgcccaatattttactattacaaagtgtcataaatacttgatatgagttacatttgaatgcttaaacaagt

SEQ ID NO: 43263 - DNA, 201 bp, Homo sapiens
aatagaaataaagtgaacaataaatgtaatatgcttgaatcatcctgaagccatcccaccatccccaccccatctgtggaaaaattgtcttccatgaagcmagtccctggtgccacaaaggttgggggctcctccttagaaagacaaaatggacagaaccaagagaataaagtccttttactgcttatcaacataagcttt

SEQ ID NO: 43264 - DNA, 201 bp, Homo sapiens
aagtagagaaaaaaaagagatgagagtagagaccattttatgtaaagatgatctgaatacatttaatctctcctgaataaatccttatagatttctatackgtatttcctttgcccactctcaccctcagctttctttgcaggagacccccttcaccacgtgctgccgtctcaggattggcactgctgccaaggatcatgc

SEQ ID NO: 43265 - DNA, 201 bp, Homo sapiens
tgcccgccttggcctcccaaagtgctgggattacaggcgtgagcacagcacatggccatattccatatttatagataaatttatcctttatttgttgatgycccctcagattctgaaagcttctaactaaaagtatttttgctccctgtaatagaaaacttaaatgtatttatgttttgcattgagaaaaatgttttatat

SEQ ID NO: 43266 - DNA, 201 bp, Homo sapiens
tctgcccccgccagggctcaagtgatcctcccatgtcaatctcccaagtttctgagatcacaggtgcacaccactgtgccctgctcattttttatattttygggggagacagagtctcatcatgttgtgcaggctggtctcgacctcgtgagcacaaacgatctgcccgccttggcctcccaaagtgctgggattacaggc

SEQ ID NO: 43267 - DNA, 201 bp, Homo sapiens
tatgtaacctagtctcaaatgattcagaaaaaactgaaatggcataaactctgtgtgtgtgtgtgtgtgtgtgtgtgtatgtatgtgtgtgtgtgtagggktggagagagtgagaaagagaaaacaagtacggtgaaatgttcacaaactggtgaatcaggccaagggtctacgggagttctctgtgtaattcttgcactt

SEQ ID NO: 43268 - DNA, 201 bp, Homo sapiens
gcgatctcggctcactgcaagctctgcctcccaggttcatgccattctcctgcctcagtctcctgagtagctgggactacaggcacccgccaccacgcccrgctaattttttaatatttttagtagagacgcggtttcaccgtgttagcgaggatggtctcgatctcctgacctcatgatccacccgccttggcctcccaa

SEQ ID NO: 43269 - DNA, 201 bp, Homo sapiens
tattttactttttctactttattttttcattctccatagttctttattcagcaaatgcacattgaacagcagaattctgttttaaacaccatgaaggaacwctgaagcactatgaggagcaatgaggtggataaaaaagtacttactttctctaaggagattacagtgtacttgtggagataaaatgtttcttaaaaggtg

SEQ ID NO: 43270 - DNA, 201 bp, Homo sapiens
gagtgcagtggcgcgatctcggctcactgcaagctctgcctcccaggttcatgccattctcctgcctcagtctcctgagtagctgggactacaggcacccrccaccacgcccagctaattttttaatatttttagtagagacgcggtttcaccgtgttagcgaggatggtctcgatctcctgacctcatgatccacccgcc

SEQ ID NO: 43271 - DNA, 201 bp, Homo sapiens
atcatgatgactttattttactttttctactttattttttcattctccatagttctttattcagcaaatgcacattgaacagcagaattctgttttaaacmccatgaaggaacactgaagcactatgaggagcaatgaggtggataaaaaagtacttactttctctaaggagattacagtgtacttgtggagataaaatgt

SEQ ID NO: 43272 - DNA, 201 bp, Homo sapiens
tggtatgattaataaataactcctattgctgtttaattaaaaagataacatctcaataaggttaaaaattaataatcaatgttaacaacaataactgttttcatttttgtatgactggtttttgtttacatgaatatatactttatattgttatcattacattgtttaagccatgaacattatatcacaagcttttccatg

SEQ ID NO: 43273 - DNA, 201 bp, Homo sapiens
ggagtgcagtggcgcgatctcggctcactgcaagctctgcctcccaggttcatgccattctcctgcctcagtctcctgagtagctgggactacaggcaccygccaccacgcccagctaattttttaatatttttagtagagacgcggtttcaccgtgttagcgaggatggtctcgatctcctgacctcatgatccacccgc

SEQ ID NO: 43274 - DNA, 201 bp, Homo sapiens
aatatcatgatgactttattttactttttctactttattttttcattctccatagttctttattcagcaaatgcacattgaacagcagaattctgttttamacaccatgaaggaacactgaagcactatgaggagcaatgaggtggataaaaaagtacttactttctctaaggagattacagtgtacttgtggagataaaa

SEQ ID NO: 43275 - DNA, 201 bp, Homo sapiens
caggctggagtgcagtggcgcgatctcggctcactgcaagctctgcctcccaggttcatgccattctcctgcctcagtctcctgagtagctgggactacargcacccgccaccacgcccagctaattttttaatatttttagtagagacgcggtttcaccgtgttagcgaggatggtctcgatctcctgacctcatgatcc

SEQ ID NO: 43276 - DNA, 201 bp, Homo sapiens
gaagcagccatttccctatcctgggtgcttcctgtttctgtctaatgctacacatagtccatggtttcagtatgttgtatgtgtttgattgtcaatccctrtaattacatcctacctaaaatatgcatttttgttcccggaaccaagccgggtccggctgcattttcttgaggcccaataacgagaagcagacagactagg

SEQ ID NO: 43277 - DNA, 201 bp, Homo sapiens
tgtctaatgctacacatagtccatggtttcagtatgttgtatgtgtttgattgtcaatccctgtaattacatcctacctaaaatatgcatttttgttcccrgaaccaagccgggtccggctgcattttcttgaggcccaataacgagaagcagacagactaggaaagaagggaatttattgctgtaaccagatacaggcag

SEQ ID NO: 43278 - DNA, 201 bp, Homo sapiens
gttcacgccattctcctgcctcactcagcctcccgagtagctgggactacaggcacccgccaccacacccggctaattttttgtttttgtttttttttttkttttttttttagtagagacggggtttcaccgtgttagccaggatggtctcgatcttctgacctcgtgatctgcccgcctgggcctcccaaagtgctggga

SEQ ID NO: 43279 - DNA, 201 bp, Homo sapiens
atattacctaagtaggaattaattgctttttatcactttacattatttcatttttagtattatgaaaaatataattgttccttttcttaaaaaaaaccagygtaatttgtgcttagttttaaaccaaaatttttcctatatgtttatagtttatattttcaagccaaaatacttgagtttttttcctgtcataatatatca

SEQ ID NO: 43280 - DNA, 201 bp, Homo sapiens
gccaaaccctataattctgcccctggcccctctcaaatctcctgtcttcacatttcttttttctttttttttttctttttttttttttttgagatagagtmtcactctgtcaccaggctggattgcagtggcacaagcttggctcactgcaacctccacctcctgggttctagccattctcctgcctcagcctctgcagta

SEQ ID NO: 43281 - DNA, 201 bp, Homo sapiens
tctcgtgagaacttactatcacaacaatagcatgggagaaactgccaccatgattcaattacatcccaccgggtcccttacacaacatgtggggactatgrgaactaaaattcaagatgagatttgggtgcagccacagccaaaccctataattctgcccctggcccctctcaaatctcctgtcttcacatttcttttttc

SEQ ID NO: 43282 - DNA, 201 bp, Homo sapiens
tctcatactactataagaacacatccaagactgggtaatttagaaaggaaagaagtttaactgactcacagttcagcatggctgaggaggccttaggaaaytgatgatcatggtggaaagggaagcaaacatgttcttcttcacagggcagcaggaaggagaatgagggtcaagtgaagcagcaagctccttataaaacta

SEQ ID NO: 43283 - DNA, 201 bp, Homo sapiens
gaggttttttttttttcctctagcttgatgtgatatatctctgaagtcaatctttatcttgtccttgagagggtgaacagctccaatcagattttggagakgaggttctccttagattcttttgatcacactacatcagcaacctcttcaaaaagcttagaattcagttgattcaagggatttataaatttattttaatag

SEQ ID NO: 43284 - DNA, 201 bp, Homo sapiens
cagatgcctgccaccacatctggttaattttttgtatttttagtagagatggcatttcaccattttgcccaggctggtcttgaactcctgacctcaggtgrtccacctgcctccagcctcccaaagcactgagattacaggcatgagccaccgtgcctggccctgtctggcctttttactgctttttatggcttattgaaa

SEQ ID NO: 43285 - DNA, 201 bp, Homo sapiens
gagattcataaatgaatcatgtaattttaagcaattctcactagatggagctagttacaaataaatacttttttaatatttttcttctttatttttaattwtttatttttatttattttttattttttgaggaattaacagtctttattgggctcagatcaggaggccgtgggtcttgaggacctctgtgtatttgtcaat

SEQ ID NO: 43286 - DNA, 201 bp, Homo sapiens
agtccctctctgttgcccaggctggagtgcagtggtgcgatctcggctcactgcaacctccgcctcccggcttcaagcaattctcctccctcagcctccaragtagctggggttacaggcacgcgccaccacgcctggctactttttgtatttttagtagagatagggtttcaccatgttgttcaggctggtctcaaactc

SEQ ID NO: 43287 - DNA, 201 bp, Homo sapiens
aattctcctgcctcagcctcccaggtagctgggactacagatgcctgccaccacatctggttaattttttgtatttttagtagagatggcatttcaccatkttgcccaggctggtcttgaactcctgacctcaggtggtccacctgcctccagcctcccaaagcactgagattacaggcatgagccaccgtgcctggccct

SEQ ID NO: 43288 - DNA, 201 bp, Homo sapiens
gttcaaaggagattcataaatgaatcatgtaattttaagcaattctcactagatggagctagttacaaataaatacttttttaatatttttcttctttatytttaattttttatttttatttattttttattttttgaggaattaacagtctttattgggctcagatcaggaggccgtgggtcttgaggacctctgtgtat

SEQ ID NO: 43289 - DNA, 201 bp, Homo sapiens
gccagcagactgccttttggcttgaactgtctcttccctgagtctccaacctgatggcccacaataaagatttagactccccaggcctccacaattgtgtragccaattccttaaaatgtttctctatctataacatatcctattagttctgtttctctggagaaccctaatacattatacttttttttttttttttgaga

SEQ ID NO: 43290 - DNA, 201 bp, Homo sapiens
tgatttccattccatttcattgagacactcacactgttaaaggaatattgccttttttttcttttttcttttttgattatataaatagagatgcgtctcaytatgttgcccaggctggtcttaaatactgggactcaagtgatcctcccacctcagcctcacaaagtgttgggattacaggcatgagcctttgtgcctgac

SEQ ID NO: 43291 - DNA, 201 bp, Homo sapiens
tcaaaaaaaagacagttctaaaaaatgaacataaggtataaacaccaacattcaacatgtacacacacacacacacacacacacacacacacacacacacmtgcagttggccctctgtatttgtgggttccacatctggggattcaaccaaccacagataaaaaatatttggaaactaaaaattccaccctgcgcttctgg

SEQ ID NO: 43292 - DNA, 201 bp, Homo sapiens
gtggactagtcaaagtagtgagaggaacagagtcctaacgcctgagagttgtaaaatgagtgtcagcatgtggtggctgccttttttttttttttttaacrgatagactttattttctagaagagttttaggtttaaagaaaattgaggtcaggcatggtggttcacgcctgtaatcccagcactttgggaggccaaggca

SEQ ID NO: 43293 - DNA, 201 bp, Homo sapiens
ctgtctcaaaaaaaagacagttctaaaaaatgaacataaggtataaacaccaacattcaacatgtacacacacacacacacacacacacacacacacacayacacatgcagttggccctctgtatttgtgggttccacatctggggattcaaccaaccacagataaaaaatatttggaaactaaaaattccaccctgcgct

SEQ ID NO: 43294 - DNA, 201 bp, Homo sapiens
ctataccgttactcaccacaaagctttttaccagattctaccattcaaaaacaaaactttataccacatacatcattgcaagttaaaaatagtcagcttcyaaattctgtattaactttaccatcaaggcagacctcagctgtaccatcacagcagtatgccacgcaaactgacaaaagacctcctcctcctccttacaac

SEQ ID NO: 43295 - DNA, 201 bp, Homo sapiens
aatctcagcactttgggagcctgaggtgggaggatcacttgaggccaggagttcaagaccagcctgggcaatatagtgagacccaattgctacaaaaaaawttaaaattagctgggtgtggtggcaagcacttgtattctcagctacttgggaggttgaggcaggcaggaggagcacttgagcccatgaatttgagattgc

SEQ ID NO: 43296 - DNA, 201 bp, Homo sapiens
actttgaccatacccttaggaacttcctcagctcactttcaaatggagggcactggctttctaaccattgtgtctcccagcccagtgacagctgaagctgwctgcttccgatatcacaggcagcacagaagagccgccctccaggtgctgctgggaaatgctgcctggaactctttgccatttactttctatcaaaagctg

SEQ ID NO: 43297 - DNA, 201 bp, Homo sapiens
ctctcaaaaaatgttactagttcaaaggagattcataaatgaatcatgtaattttaagcaattctcactagatggagctagttacaaataaatactttttwaatatttttcttctttatttttaattttttatttttatttattttttattttttgaggaattaacagtctttattgggctcagatcaggaggccgtgggt

SEQ ID NO: 43298 - DNA, 201 bp, Homo sapiens
gactagattttttttttttaaatggagtctcgctctgtcgcccaggctggagtgcagtggcgcgatctcggctcactgcaagctctgcctcccaggttcaygccattctcctgcctcagtctcctgagtagctgggactacaggcacccgccaccacgcccagctaattttttaatatttttagtagagacgcggtttcac

SEQ ID NO: 43299 - DNA, 201 bp, Homo sapiens
atagcctgttctacatagtcagcattctcccctctgattccactagctaaaaaaaaaaaggaagaagtaccttattcagaccttggactctgcaaattatrgtctatatattatcagggtgtaaggtctccataaaacacctcactttcctgtatcacagtcacttactatgactgttttcctgtatcaccatacattgcc

SEQ ID NO: 43300 - DNA, 201 bp, Homo sapiens
gaaagcaattgtatttgtttgaggaatatggacctaagtcttatacctttatagtagcattttgcacttgaggataaagagaatatggaaatattaagaaatattttagctttgttagatttttgcctccagatcaaacagaacaactcacctctacacatgtattcaggtagctgaaggcattgacaatcaaatcaaatt

SEQ ID NO: 43301 - DNA, 201 bp, Homo sapiens
agaatttacaataagaattttaaaaatgtgagggagaaaatcacgtttgtatagacaatttaaggaaagtaaatggagacaataaatatgggctggtttttccatgagtgactggtgtagacagatagctgcttacccaatttcttaggtataatagtccagatgtttgttttcctccctccagcttgaataacctcactg

SEQ ID NO: 43302 - DNA, 201 bp, Homo sapiens
attgtgatggagcagcaattttcttgaaggtggcctgggttcatgatggtaggtgaaggacccagcgagaagtcaaataattaaggtggcattaatgatarcatggccttcatttgggatatggcatatgccaaacatatagtccatgataggtcatgccagttagcatttatattgtattttaattacattatgctcttg

SEQ ID NO: 43303 - DNA, 201 bp, Homo sapiens
gttgaattctgacattcaggaagtcaattgcagaaggtttaaccaagttgattctgttttaccaaatcctgtctattctgaaaagcggccaatgccagacycatctcatgatgtgaaagttctcacttcaaagacatcagctgttgagatgacccaggcagtattgaatactcagctttcatcagaaaatgttaccaaagt

SEQ ID NO: 43304 - DNA, 201 bp, Homo sapiens
atccaatcatttagtgattttggtatccccatggcacatctagtaaatttacaaacctgacaattccctcattggtcattgtgatggagcagcaattttcktgaaggtggcctgggttcatgatggtaggtgaaggacccagcgagaagtcaaataattaaggtggcattaatgatagcatggccttcatttgggatatgg

SEQ ID NO: 43305 - DNA, 201 bp, Homo sapiens
actttttccattccatgtattttcaatatttcaataggagacaagtttatttttccatcttgcagatagcataggcactaagacaatattctcagtttttkatctcaatccaatcatttagtgattttggtatccccatggcacatctagtaaatttacaaacctgacaattccctcattggtcattgtgatggagcagca

SEQ ID NO: 43306 - DNA, 201 bp, Homo sapiens
gtcataaaactatacaagttggtacagtattctgtctcaattgccaaggtaggattttgaagatcttgtgcagtagaaatattgagaaacttcaaatctartagaaaaatagtctgagaacagcatcacaactgagctaaaataatctcatagatatattatttgctgttaaaataatacaatgaatatagtacattaaag

SEQ ID NO: 43307 - DNA, 201 bp, Homo sapiens
agcacaggtgacaaaatttgagttctaacatattccaatttgattattcctattgaagctgtgcttctttactaaataattggtaaaaaaattttttttghataaagtttcattttggctccctccttgtcctaaaatcgcatactttcagcaatctgcattaaatatttattaaactactgtcattctcttagctcctga

SEQ ID NO: 43308 - DNA, 201 bp, Homo sapiens
ttgaaaacaatcattcttttaaggttattattatttacgtgactatataccaatatacataaccaatatattgttctttttgttgttgttgttgttgttgkgttttagtgtttctctgtctcaggaagcttgctatttcactcttaaaactgtgtcttcgacttaatgtcataaaactatacaagttggtacagtattctg

SEQ ID NO: 43309 - DNA, 201 bp, Homo sapiens
ttataaattacaatggtgtatgtcttttattctatgttttgggcccacagagcacaggtgacaaaatttgagttctaacatattccaatttgattattccwattgaagctgtgcttctttactaaataattggtaaaaaaattttttttgtataaagtttcattttggctccctccttgtcctaaaatcgcatactttcag

SEQ ID NO: 43310 - DNA, 201 bp, Homo sapiens
ttttaaacttcctgatttcacattatgtaattagaactgatctccagtttccttgcttgtgaaaattacaggattgaaaacaatcattcttttaaggttaktattatttacgtgactatataccaatatacataaccaatatattgttctttttgttgttgttgttgttgttgtgttttagtgtttctctgtctcaggaag

SEQ ID NO: 43311 - DNA, 201 bp, Homo sapiens
gtgatagtgagtggattatcaggagatctggttgtttaaaagtgtgtagcacctccccactctctctattcctcgtgctctggccctgtaagacgtgcctkcttctcttttgtctttcaccatgattgaaagtttcctgaggcctccccagcatgcttcctgtacagcctgtggaaccgtgagccaattaagcctctttta

SEQ ID NO: 43312 - DNA, 201 bp, Homo sapiens
tgttctcgtgatagtgagtggattatcaggagatctggttgtttaaaagtgtgtagcacctccccactctctctattcctcgtgctctggccctgtaagaygtgccttcttctcttttgtctttcaccatgattgaaagtttcctgaggcctccccagcatgcttcctgtacagcctgtggaaccgtgagccaattaagcc

SEQ ID NO: 43313 - DNA, 201 bp, Homo sapiens
aaacttaaaagtgcaccattaagtaactcctgggaccaagcagatgtcatgagaaaaattaagaaatatttgccacttcatcagttataagacaaaaaaawattttttttaaattttaagacatacttaaattgagtgataatgaatgatatggttgggtctgtgtccctgcccaaatctcatgacaaattgtaatcccca

SEQ ID NO: 43314 - DNA, 201 bp, Homo sapiens
aatcagaaggcggaggttgcagtgagccgagatcatgccactacactccagcctgggcaacaagagcaaaactctgtctcaaaaaaaaaaaaaaaaaaaargattacttaaaatttacttggaaacttaaaagtgcaccattaagtaactcctgggaccaagcagatgtcatgagaaaaattaagaaatatttgccacttc

SEQ ID NO: 43315 - DNA, 201 bp, Homo sapiens
agagttaaaatggagggaaaaaatatctactaatcagaatattctactggccacagtctctgaccttctggcaattaaaaatttaaagttaaagattactyaaaattggctgggtgtggtggctcacgcctgtaatcccagcactttgtgaggccgaggtgggtggatcacaaggtcaggagttcgagaccagcctgacca

SEQ ID NO: 43316 - DNA, 201 bp, Homo sapiens
agagcaagactccctctcgaaaaaaataaataaataagtaaaataaataaataataaagtgtactccatatgtattcaatctgttttattttatttttatttgtatgaacatatacaacacaaatttaaaatatataagtaattaattgtggaaaatgggatctatcgtgaggataaagcaaagttatgcaacaagatgaa

SEQ ID NO: 43317 - DNA, 201 bp, Homo sapiens
cagagcaagactccctctcgaaaaaaataaataaataagtaaaataaataaataataaagtgtactccatatgtattcaatctgttttattttatttttatttgtatgaacatatacaacacaaatttaaaatatataagtaattaattgtggaaaatgggatctatcgtgaggataaagcaaagttatgcaacaagatga

SEQ ID NO: 43318 - DNA, 201 bp, Homo sapiens
ggtgacagagcaagactccctctcgaaaaaaataaataaataagtaaaataaataaataataaagtgtactccatatgtattcaatctgttttattttatktttatttgtatgaacatatacaacacaaatttaaaatatataagtaattaattgtggaaaatgggatctatcgtgaggataaagcaaagttatgcaacaa

SEQ ID NO: 43319 - DNA, 201 bp, Homo sapiens
tgggtgacagagcaagactccctctcgaaaaaaataaataaataagtaaaataaataaataataaagtgtactccatatgtattcaatctgttttattttatttttatttgtatgaacatatacaacacaaatttaaaatatataagtaattaattgtggaaaatgggatctatcgtgaggataaagcaaagttatgcaac

SEQ ID NO: 43320 - DNA, 201 bp, Homo sapiens
tgaactccagcctgggtgacagagcaagactccctctcgaaaaaaataaataaataagtaaaataaataaataataaagtgtactccatatgtattcaatytgttttattttatttttatttgtatgaacatatacaacacaaatttaaaatatataagtaattaattgtggaaaatgggatctatcgtgaggataaagca

SEQ ID NO: 43321 - DNA, 201 bp, Homo sapiens
gaatccattgtttttaaacttcctgatttcacattatgtaattagaactgatctccagtttccttgcttgtgaaaattacaggattgaaaacaatcattcytttaaggttattattatttacgtgactatataccaatatacataaccaatatattgttctttttgttgttgttgttgttgttgtgttttagtgtttctct

SEQ ID NO: 43322 - DNA, 201 bp, Homo sapiens
aagattatattatgtgctattgggcctcaatcctaatatctcattgtccaatattgtgtgacaaccatatcataagaggagctaagaatacacatgatggraaaaaaaatagataggagcagaccagcctcagaaagtgaactaaaaaccacctcctgaatattctttttgatggataaacttataccataaagataaagc

SEQ ID NO: 43323 - DNA, 201 bp, Homo sapiens
caaaaggtaaagcttgaagactcagatgaaggagtataatcagatcaccatcaaccaggtaaaataatacccctcatggccataaaaccggagactgaggkgcaggggcagtgatgtatctatgggttattttctcctaagagtacaaaagccaagattatattatgtgctattgggcctcaatcctaatatctcattgtc

SEQ ID NO: 43324 - DNA, 201 bp, Homo sapiens
ttttttttttttttgagacggagttttgctcttgttgcccaggctagagtgaaatggcacgatctcggctcactgcaatctccgcctcctgggttcaagtrattctcctgcctcagcctcccaagtagctaggattacaggcgtgcaccaccacacccagctaattttttgtatttttttttttagtagtcacagggtttc

SEQ ID NO: 43325 - DNA, 201 bp, Homo sapiens
acatggcaaaaccctgtctctactaaaaatacaaaattagccgagcgtggtggcgcatgcctgtaatccaagctactcaggaggatgaagctcgagaatcrcttgaacccaggaggcagaggttgcagtgagccgagatcacgccattacactctagcctgggcaacaagagtgaaactccgtatcaaaaaaaaaaaaaga

SEQ ID NO: 43326 - DNA, 201 bp, Homo sapiens
ctggagtgcagtggcacaatcacggctcactgcaacctccacctcccaggctcatgagatcctctgaccttagcctcccaagtagctgggactataagcaycatgcaccaccatgttcagctaatttttaaattttttttgtacagacggggtcttgctatattgcccagactggtctcgaactcctgggctcaagcgatc

SEQ ID NO: 43327 - DNA, 201 bp, Homo sapiens
taagaaagaatttatttctatagatgttggcactttgcatatgaaggtttgaagctgcccatttcaagcaacaaaaagaaatgttaaaaaccaaggtagtsttcctgggaaatcccgttagtaatggatttctctgctagtaatggggttgttcattagtatggggtatttgtatacactttgaaaagttatagtttccag

SEQ ID NO: 43328 - DNA, 201 bp, Homo sapiens
tgaggatcaggtagtttaagcaatgtgggggtggctagtgggtgaactatgaggattaaaggtgccggctgggcactgtggctcacgcctgtaatcccagmactttgggagggtaaggcgggtggatcacctgaggtcaggagttcgagaccagcctggccaatgtggtgaaaccctgcctctactaaaaatacaaaaata

SEQ ID NO: 43329 - DNA, 201 bp, Homo sapiens
tcactatatttatttagacattgtgaaatgtttgtttttaaggttaaggtgagaattctggggtacaggggaaaaaaggaaatctccctgttttaaaatasgcattctactatacagccataagaaagaaaagaatgagatcatgtcatttacagggacatggttggagctggagaccattatccttagcaaactaacaca

SEQ ID NO: 43330 - DNA, 201 bp, Homo sapiens
cgaggcgggcggatcacgaggtcaggagatcaagaccatcctggctaacacagtgaaacccccgtctctacaacaaaatacaaaaaaaaattagctgggcrtggtggcgtgcacctgtagtcccaggtactcgagaggctgaggcaggagaattgcttgaacccgggaggcggaggttgcagtgagccgagatcgtgccac

SEQ ID NO: 43331 - DNA, 201 bp, Homo sapiens
tggggatgggatccaggtccaaacatgaaatttacttatgtttcatgtattcctatatacatagcctgaaggtaattttatacaatttttttaatgattcygtggctgaaacaaagttttgactgccactcatgacatgaggtcaggtgtagaattttgtggctcatgtcagcactcaaaaggtttcagattttgaagcat

SEQ ID NO: 43332 - DNA, 201 bp, Homo sapiens
gcaaatgccaggtggggcatggtggctcacgtctgtaatcccaacactttaggaggccaaggcaggtggatcccttgagctcaggagttccaaaccagccygggcaaaatggtgaaacctcgtctctacaaaaagtacaaaaattagctgggcatggtggtgcacacctgtggtcccagctacttggggggctgaggcgga

SEQ ID NO: 43333 - DNA, 201 bp, Homo sapiens
gagttttgctcttgttgcccaggctggagtgcaatggcatgatcttggctcactgtaagctctgcctcccaggtccaagcgattctcctgcctcagcctcycgagtagctgggactacaggcgcgcacccctaatttttgcgccctgctaatttttgtgtttttaatagagacagggtttcaccgtgttggccaggctggt

SEQ ID NO: 43334 - DNA, 201 bp, Homo sapiens
cctaagtctactggtaactaattttgtttcaactagaaggtcagaggcaaaaatgctttctaagtcggattaagctgtgagcggcccagtacctacaaggyctgtctactgtggtaccagagtgattatttctatcttatctgctttacagcttggtctggagggctgccttagactctccaatgaatctattcgaacagc

SEQ ID NO: 43335 - DNA, 201 bp, Homo sapiens
aacagtgacattgatgatactaataaataaatccaaggattttttttaagggaggtggtttgcaccacataaattccctagcaaagtgttgtggggaattraagaattataaggcagggtcctgcctgctctcaaggagctgcatagtgtggctagagagaatagatatactgcaagggaagcaggggtctagaattctgt

SEQ ID NO: 43336 - DNA, 201 bp, Homo sapiens
ctactggtaactaattttgtttcaactagaaggtcagaggcaaaaatgctttctaagtcggattaagctgtgagcggcccagtacctacaaggcctgtctrctgtggtaccagagtgattatttctatcttatctgctttacagcttggtctggagggctgccttagactctccaatgaatctattcgaacagctgcctct

SEQ ID NO: 43337 - DNA, 201 bp, Homo sapiens
tattttccctcagctgaactatatagggtaagacatatcaaacattttttatgatgcttttactatataaaatcttttcaataagccaagaaagagaaaakatgacatataataccagtcttatgttctatataagaaatatcataagcccatgggaaatagtagattttatgagtatttttaaattcaggagtttaacca

SEQ ID NO: 43338 - DNA, 201 bp, Homo sapiens
ggaaaattacttgaaaccgggaggcggagtttgcagtgagcagagattgtgacactgaactccagcctgggtgacagagcaagactccctctcgaaaaaaataaataaataagtaaaataaataaataataaagtgtactccatatgtattcaatctgttttattttatttttatttgtatgaacatatacaacacaaatt

SEQ ID NO: 43339 - DNA, 201 bp, Homo sapiens
ctgaggtgggaaaattacttgaaaccgggaggcggagtttgcagtgagcagagattgtgacactgaactccagcctgggtgacagagcaagactccctctygaaaaaaataaataaataagtaaaataaataaataataaagtgtactccatatgtattcaatctgttttattttatttttatttgtatgaacatatacaa

SEQ ID NO: 43340 - DNA, 201 bp, Homo sapiens
agaccaacccggccaacacagcaaaacctggtctctagtaaaaatacaaaaattagccgggcatggtggtgcacacctgtaatcccagctactcaggaggmtgaggtgggaaaattacttgaaaccgggaggcggagtttgcagtgagcagagattgtgacactgaactccagcctgggtgacagagcaagactccctctc

SEQ ID NO: 43341 - DNA, 201 bp, Homo sapiens
gaaacagtagctatttaaaatcaaaagataatttcaaacattgcttgttgtcattgaattcaagaagaaaactttaaaaaagaaaaaccacacaaaactctaaaaataataaggccaggcgttggtggttcacacctgtaatcctagcactttggaaggccaaggcaggtggatcacctgaggtcaggagttcaagaccaa

SEQ ID NO: 43342 - DNA, 201 bp, Homo sapiens
agaaacagtagctatttaaaatcaaaagataatttcaaacattgcttgttgtcattgaattcaagaagaaaactttaaaaaagaaaaaccacacaaaactctaaaaataataaggccaggcgttggtggttcacacctgtaatcctagcactttggaaggccaaggcaggtggatcacctgaggtcaggagttcaagacca

SEQ ID NO: 43343 - DNA, 201 bp, Homo sapiens
ggaggcagggcttgcagagagctgagatcgtgccactgcactccagcgtgggcaacaaagcaagactctgtctcaaaaaaaaaaaaaaaaagttaaaatgwtaaattttatgtaatatatactttgtcacaataaaaaagtaaatgatcataaacagctctattgttttaacttgtacatatcgtgtttctttcattttaa

SEQ ID NO: 43344 - DNA, 201 bp, Homo sapiens
gtgaacccaggaggcggagcttgcagtgactgagatcgcgccactgcactccagcctgggcgacagagggagactctgtctcaaaaaaaaaaaaattagcygggcgtggtggcgggcgcctgtagtcccagctactcgggaggctgaggcaggagaatggtgagaaccggggaggcagggcttgcagagagctgagatcgt

SEQ ID NO: 43345 - DNA, 201 bp, Homo sapiens
aatggcgtgaacccaggaggcggagcttgcagtgactgagatcgcgccactgcactccagcctgggcgacagagggagactctgtctcaaaaaaaaaaaaattagccgggcgtggtggcgggcgcctgtagtcccagctactcgggaggctgaggcaggagaatggtgagaaccggggaggcagggcttgcagagagctga

SEQ ID NO: 43346 - DNA, 201 bp, Homo sapiens
gaaaccccgtctctactaaaaatacaaaaacaaaagtagccgggcatggtggtgggcgcctgtagtcccagctactcaggaggctgaggcaggataatggygtgaacccaggaggcggagcttgcagtgactgagatcgcgccactgcactccagcctgggcgacagagggagactctgtctcaaaaaaaaaaaaattagc

SEQ ID NO: 43347 - DNA, 201 bp, Homo sapiens
tggtggaggggggggctaattgattttggctctgaactgatgctaatccatggagacacaaaataaagtaagatgaaatgaaacaaacgcaacaacaacamatccagcatagtccaccactcagagtagaagtttacagaacccaggtgatagatggaaccttgaccagagtcagtttcccagtgtgtccaatggcgtgat

SEQ ID NO: 43348 - DNA, 201 bp, Homo sapiens
ttccattgtctgtaataatgccctcggatgagttgtgtctaaaattaagttcatctttatttatatgcgaacttaactgccatagtccctaatgtattgcrtttgtaacctgatcgtattatgtttacagctgaaagatttcatctagacatgtctttcgtccttattattcaaagtgtaattgaaagagatatttagtat

SEQ ID NO: 43349 - DNA, 201 bp, Homo sapiens
aagcacagaccctgatgtgataaaacattttgtggtttctctgagtcacagataaacttctgccatcaaatggctacagttcatttaaatttaaaaaaaaraaaaaagaaacagaaaacgtgtctcagatggctggctttacctcgatagcataagagagacctaagacatgtaaaatacgtatattgcagtatcatcttt

SEQ ID NO: 43350 - DNA, 201 bp, Homo sapiens
gccatcagaggcggagtcggtttccttcccttgaattccgtctggttttgcgacttcccttgactaataaacagaatgaggtggaagttaaagggaatcayaacccaccctatggtacaatgattcttttaagacattcaagttatagatgcagaaagaagcctcttctgagcttcccttatctgactataggcagggcct

SEQ ID NO: 43351 - DNA, 201 bp, Homo sapiens
tttgtatttttagtagagatggggtttctccatagttggttaggctggtctcaaactcccgacctcaggtaattcacccaccttggcctcccaaagtgctrggattacaggcgtgagccaccacaccctgccctgagtattttttaatgactacaatgctatgttgaactcataagtagttttcaaacattttgaagttga

SEQ ID NO: 43352 - DNA, 201 bp, Homo sapiens
ctgggattacaggcatgagcctgcatgcccggctaattttgtatttttagtagagatggggtttctccatagttggttaggctggtctcaaactcccgacytcaggtaattcacccaccttggcctcccaaagtgctaggattacaggcgtgagccaccacaccctgccctgagtattttttaatgactacaatgctatgt

SEQ ID NO: 43353 - DNA, 201 bp, Homo sapiens
tcctgcctcagccttccgagtagctgggattacaggcatgagcctgcatgcccggctaattttgtatttttagtagagatggggtttctccatagttggtyaggctggtctcaaactcccgacctcaggtaattcacccaccttggcctcccaaagtgctaggattacaggcgtgagccaccacaccctgccctgagtatt

SEQ ID NO: 43354 - DNA, 201 bp, Homo sapiens
cacgatcttggctcaccacaacctccacctcccgggttcaagcgattctcctgcctcagccttccgagtagctgggattacaggcatgagcctgcatgccyggctaattttgtatttttagtagagatggggtttctccatagttggttaggctggtctcaaactcccgacctcaggtaattcacccaccttggcctccca

SEQ ID NO: 43355 - DNA, 201 bp, Homo sapiens
gcctgaacccgagaggcggaggttgcagtgagccaagatcacgccactgcactccagcctggacaatagagcaagactctgtctcaaaaaaaaaaaaaaaatatatatatatatatataataaatatataaattagctgggcattttcgcacagacctgtaattccagctacttgggaggctaaggcacaagaatcacttc

SEQ ID NO: 43356 - DNA, 201 bp, Homo sapiens
tgcctgaacccgagaggcggaggttgcagtgagccaagatcacgccactgcactccagcctggacaatagagcaagactctgtctcaaaaaaaaaaaaaawatatatatatatatatataataaatatataaattagctgggcattttcgcacagacctgtaattccagctacttgggaggctaaggcacaagaatcactt

SEQ ID NO: 43357 - DNA, 201 bp, Homo sapiens
ttgcctgaacccgagaggcggaggttgcagtgagccaagatcacgccactgcactccagcctggacaatagagcaagactctgtctcaaaaaaaaaaaaawaatatatatatatatatataataaatatataaattagctgggcattttcgcacagacctgtaattccagctacttgggaggctaaggcacaagaatcact

SEQ ID NO: 43358 - DNA, 201 bp, Homo sapiens
gggagaagctccgcggcgcgggaaacgcggcggccagagggaaacgggggcggggactgcttactacggcggacgtcacataaacaaacgcccccccccccggctgcaggccgcggcggagagggagaggcgaggtgggaaagggaaaggttagcaactgaggggagggctgcgctgcttggcgtgttttccgcccccgaa

SEQ ID NO: 43359 - DNA, 201 bp, Homo sapiens
ctatttaatacagaaatgtactaatataggttgccttttggtattgtaatttggtcaaccaaaacttgggaaaaataggtccaaagtttttcattttcctracatgctctttctatttactacagaaatgtactaatataggttgccttttggtattgtaatttggtcaaccaaaacttgggaaaaataggtttattaata

SEQ ID NO: 43360 - DNA, 201 bp, Homo sapiens
tggcataggttaaaaataaaattacaaattcaagtctctgggctttagatagtgtaaaacaccaggcccctccaattttggtagagcgaaaaaaaaaaaaagagaaacaaaactaggtctcccaattctagattaagaggaattccagtacatgaaaaaaaaaactgaaagtgtcagaaagaatatttatttgcttttaat

SEQ ID NO: 43361 - DNA, 201 bp, Homo sapiens
ttaattaaaaagataacatctcaataaggttaaaaattaataatcaatgttaacaacaataactgttttcatttttgtatgactggtttttgtttacatgratatatactttatattgttatcattacattgtttaagccatgaacattatatcacaagcttttccatgttgctatctagtcttgtttttatttgttaaag

SEQ ID NO: 43362 - DNA, 201 bp, Homo sapiens
gtatccagaacagtttccaaatagggttgtatcctgatgtggaaactaaaaaaaaaaaaagcaaaaagattgatttacatatttaaaaaattaaatgccartataaataatgttgtcactggtgaggcgttaaaaggtaattaaagtaaaacttttttgtttcctatatgtatttttcttggatctcctgcaagacaattt

SEQ ID NO: 43363 - DNA, 201 bp, Homo sapiens
taaaaataacaccggtcctatgcttatctcttaaagtcatgttgttttctgcaaggtgttaaaaatcaaaataagattgttctaataacattgaagtttcktcagtatatgtgtatgatacaagcgaaattgatgggtaactacttgcagtataattcttttagaattatgtacttttagattgacttaccagaactgctg

SEQ ID NO: 43364 - DNA, 201 bp, Homo sapiens
tgtgttttgtggatcttcagtaaaacattccccagaaataagtagggccatttcccagtgtgactataaactggagacaggtaaatattttttttggtggaggggggggctaattgattttggctctgaactgatgctaatccatggagacacaaaataaagtaagatgaaatgaaacaaacgcaacaacaacaaatccag

SEQ ID NO: 43365 - DNA, 201 bp, Homo sapiens
ctgggaggcggagcttgcagtaagccgagatcacgccactgcactccagtctgggtgacagagcgagactccgtctcacaaaaaaaaaacaaaaaaaaaamccaaaatacaaaattagccgagtgtggtggcacaggcctgtaatcccaactactcaggaggctgaggcaggagaatcgtttgaacccagtaggtggtggt

SEQ ID NO: 43366 - DNA, 201 bp, Homo sapiens
actaaaaacaatacacaaaaattagccgggcgtggtggcgggcgcctgtagtcccagctacttgggaggctgaggcaggagaatggtgtgaacctgggagkcggagcttgcagtaagccgagatcacgccactgcactccagtctgggtgacagagcgagactccgtctcacaaaaaaaaaacaaaaaaaaaaaccaaaat

SEQ ID NO: 43367 - DNA, 201 bp, Homo sapiens
ctcaccttggcctcccaaagtgctgggattagagatgtgagccactgcgcccggctgtgctgttttgttttgtttgttgttgttttttaatttgagatggmgtctcgctctgtcacccaggccgtagtacagtggcgcaatctcagctccctgcaacctctgcctcctgggttgaagcgattctcctgcctcggcctcccg

SEQ ID NO: 43368 - DNA, 201 bp, Homo sapiens
aacccaccagaaggaaccaattctggacatgctggcatcaagtcatctgctcaccttggcctcccaaagtgctgggattagagatgtgagccactgcgccyggctgtgctgttttgttttgtttgttgttgttttttaatttgagatggagtctcgctctgtcacccaggccgtagtacagtggcgcaatctcagctccct

SEQ ID NO: 43369 - DNA, 201 bp, Homo sapiens
ggtcaccttccatgctgtggaagcttttttcttttgctctttacaataaatcttgctgctgctgactctttgggtctgcaccacctttaagagctgtaacrccatgaaggtcggcagcttcattcttgaagtcagcaagaccatgaactcactggaaggtagaaactctggacatatctgaaggaacaaactcctgacaca

SEQ ID NO: 43370 - DNA, 201 bp, Homo sapiens
taaacgcaccaatcagcgctctgtgtctagctaaaggattgtaaatgcaccaatcagcactctgtaaaaacataccaatcagtactctgtgtctagctaamggattgtaaatgcaccaatcagcactctgtaaaaatgtaccaatcagcgctctgtgtctagctaaaggattgtaaacgcaccaatcagcactcggtaaaa

SEQ ID NO: 43371 - DNA, 201 bp, Homo sapiens
ttccacttacaaatgtgaacatgtggtatttgacagcatggttttaacagtgaaaaattataaatgacaaaagaatgttaagcaaattaaggcatacccaraatgtaatattatacagcctctaaaatgtatgtagtaatgaaaaggatatataataatgaaaagtacatatttcaaatgtttagtgaaaaatcaggataa

SEQ ID NO: 43372 - DNA, 201 bp, Homo sapiens
tttttaaattttgtagagccaggtcttgccatgttgcccaggctggtcttgaactcctggtgagagctgaagccagctggacttcctgggttgggtggggmcttggagaacttttctgtctagctaggggattgtaaacgcaccaatcagcgctctgtgtctagctaaaggattgtaaatgcaccaatcagcactctgtaa

SEQ ID NO: 43373 - DNA, 201 bp, Homo sapiens
caagcgatcctcctctctcagcctcctaagtagctaagaccacaaacatgcaccactatgccttgctaattttttaaattttgtagagccaggtcttgccmtgttgcccaggctggtcttgaactcctggtgagagctgaagccagctggacttcctgggttgggtggggacttggagaacttttctgtctagctagggga

SEQ ID NO: 43374 - DNA, 201 bp, Homo sapiens
ctcaagcgatcctcctctctcagcctcctaagtagctaagaccacaaacatgcaccactatgccttgctaattttttaaattttgtagagccaggtcttgmcatgttgcccaggctggtcttgaactcctggtgagagctgaagccagctggacttcctgggttgggtggggacttggagaacttttctgtctagctaggg

SEQ ID NO: 43375 - DNA, 201 bp, Homo sapiens
agcatcgctggattttaatctaatctacgatctttttttttttttttttcctgagagagtctcactctgtcgccaggctggagtgcagtggtacaatctcmgctcattgcaacctccgcctctgaggttcaagcaattctcctgcctcagcctcctgaggaactaagattacaggtgtgtgccaccacgactggctgattt

SEQ ID NO: 43376 - DNA, 201 bp, Homo sapiens
aggcaggcggatcacctgaggtcaggagttcgagaccagcttgaccaatatggagaaatcccttctctactaaaaatacaaaattagccaggtgtggtggygcatgcctgtaatcccagctactcgggaagctgaggcaggagaatcacttgaacccaggagatggaggttgcggtgagctgagattgtaccactgcattc

SEQ ID NO: 43377 - DNA, 201 bp, Homo sapiens
tccttggccgggtgcggtggctcacgcctgtaatcccagcactttgggagaccgaggcgggcggatcacctgaggtcaggagttcgagaccagcctgaccmacacggtgaaaccccatctctactaaaaatacaaaattagccggtcatggtggcacatgcctgtaatcccagctacttgggaggctgaggcaggaaaatt

SEQ ID NO: 43378 - DNA, 201 bp, Homo sapiens
tttgacatcactcatttaaacctctaagaaatacttttcagctgggcgcagtagctcacgcctgtaaccccagcactttgggaggccgaggcgggtggatsacctgaggtcaggagttcgaaaccagcctgaccaacatggagaaaccccatctctactaaaaatacaaaattagccaggcatggtggcacatgcctgtaa

SEQ ID NO: 43379 - DNA, 201 bp, Homo sapiens
aggtcaggagttcaagaccagcctggccaacatggcgaaactctgtctctactaaaaatacaaaaattagctgggtgtggtggcatgcacctgtaatcccrgctactcgggaggctgaggcaggagaatcgcttgaacccagtagggggaggttgcagtgagctgagatccgtgccactgcactgcactccagcctggttg

SEQ ID NO: 43380 - DNA, 201 bp, Homo sapiens
catggtggtgcgtgcctgtagacccagctatttgggcggctgaggtgggagaattgcctgagcccaggaggcggacattgcagtgagccaagataacaccmctgcactccagtctgggctacagagtgaaactctgtctcaaaaaaaaaaaaaaaaagattaaataaatgcaaacaaagtggtttaaagtactttaaagta

SEQ ID NO: 43381 - DNA, 201 bp, Homo sapiens
ttgtttgaacctgggaggcagaggttgcaatgagtggagatcatgccattgcactccagcctgggcaacagagtgaaactccgcctcaaaaaaaaaaaaaattaaaactgtcacttccaaacaccattaaaaaacaaagtgcctgattcggccgtacatgtactaaaattggaacactggaacggtaacagagaagattag

SEQ ID NO: 43382 - DNA, 201 bp, Homo sapiens
aagactaaaaactacatacagtttatcatacaacaaatcccatctctgtcccctgaaattcccctagtttcattcattagaaggggattaaaaaaaaaaaagacttaaagagcactttacagcagcattcagctttcctatgaaatactcagcatcttaaatattatatacaactctttttttagtaagctagacactggc

SEQ ID NO: 43383 - DNA, 201 bp, Homo sapiens
ctgggaaggaaaagatgattgattcataggcaccctgatacagtcacttataatctgaaaagcagatgtactctaaggcactcaaaataaaaataacaccrgtcctatgcttatctcttaaagtcatgttgttttctgcaaggtgttaaaaatcaaaataagattgttctaataacattgaagtttcttcagtatatgtgt

SEQ ID NO: 43384 - DNA, 201 bp, Homo sapiens
aatgcagaaattaattaaaaagcgggaataaaattctccttataacaaaacatatattaagaactcttgttggttttcattgataatttgctttttatgakctatcaagatgtacttatacgaaaagttgagatcataacctttcagtctagaaagatgagatctagtttgcaaaccagaagtctcaatactcgtagcagt

SEQ ID NO: 43385 - DNA, 201 bp, Homo sapiens
aaattagccaggcatggtggcacatgcctgtaatcccagctactcgggaggctgaggtgggacaatcccttgaacccaggaggcagaggttgcagtgagcygagattgagccactgctctctagcctgggctacacagtgagactctgtctcaaaaaaaaaaaaaaaaaaaagaaaaggaaaggaaaaaaaaaaaaagtat

SEQ ID NO: 43386 - DNA, 201 bp, Homo sapiens
atttagggagttaaagccttaggttttaaacctgatttggggttgagctctgggaaggaaaagatgattgattcataggcaccctgatacagtcacttatratctgaaaagcagatgtactctaaggcactcaaaataaaaataacaccggtcctatgcttatctcttaaagtcatgttgttttctgcaaggtgttaaaaa

SEQ ID NO: 43387 - DNA, 201 bp, Homo sapiens
attgagtttcttgggcaatgctttaaagcactgcatttcagaactttcctgtcccaagtttacagaacaatatgcaaaaaccacaaataataaacaatggmacctccactctggacatatcgtgaagtctataaaccacaactttgaaagctattaaggtgactcacacgcaagaggagcccagggaggctcttccacaga

SEQ ID NO: 43388 - DNA, 201 bp, Homo sapiens
tgagaggcagagcctgcagtaagccctgattgtgccactgcactccagtgtgggtgacagagtgagaccctgtcttaaaaaaagataaaagctatcaaatrtagtgcgtgtttattttggggactaaatgcttatttttaaggggatggttaaagtactcagcattatttagggagttaaagccttaggttttaaacctga

SEQ ID NO: 43389 - DNA, 201 bp, Homo sapiens
acccaccctatggtacaatgattcttttaagacattcaagttatagatgcagaaagaagcctcttctgagcttcccttatctgactataggcagggccttkggagaatgaagctgccataaatcccctctctgggggagcttccagccaggaaggagcctgactgttagcacctgggtgagaaattgcataaacaaacatt

SEQ ID NO: 43390 - DNA, 201 bp, Homo sapiens
agttcagctgtgactctgtctggtcctgggctttttttggttggtagtctattaattactgcctcaatttcagaacttattattggtctattcaggaattygacttattcctggtgtagtcttgggagggtgtatgtgtccaggaatttatcaatttcttctagattttatagtttatttgcatagaggtgtttatagtat

SEQ ID NO: 43391 - DNA, 201 bp, Homo sapiens
cagtggcatgaacacagcacactgcaacctcgacctcccagactcaagcgatcctcctctctcagcctcctaagtagctaagaccacaaacatgcaccacyatgccttgctaattttttaaattttgtagagccaggtcttgccatgttgcccaggctggtcttgaactcctggtgagagctgaagccagctggacttcct

SEQ ID NO: 43392 - DNA, 201 bp, Homo sapiens
ctcactctgttgccccagctggagtacagtggcatgaacacagcacactgcaacctcgacctcccagactcaagcgatcctcctctctcagcctcctaagyagctaagaccacaaacatgcaccactatgccttgctaattttttaaattttgtagagccaggtcttgccatgttgcccaggctggtcttgaactcctggt

SEQ ID NO: 43393 - DNA, 201 bp, Homo sapiens
gagatcgagaccatcctggccaacatggtgaaatcccatctctactaaaaatacaaaaattaactgggcatggtggtgcgtgcctgaagtcccagctactygggaggctgagacaggaaaatcacttgaacccaggaggcggaggttacagtgagctgacattgggccactgcactccagcctggtgacagagcgagaccc

SEQ ID NO: 43394 - DNA, 201 bp, Homo sapiens
tcaacactttgttgtagtaagaaagcagctatagggagtatgtaaactaacggatgcagctatgttccaataaaactttatttataaaaacaagctatagygccaggcgcagtggctcacgccagtaatcctagcactttgggaggccaaggcaggcagatcacgaggtcaggagatcgagaccatcctggccaacatggt

SEQ ID NO: 43395 - DNA, 201 bp, Homo sapiens
agcaattctcctgcctcagcctcccgagtagctgggattacaagcgagtgccaccatgcctggctaatttttatatttttagtagaggccgggtttcaccrtgttggccaggctggtcttgaacccctgaccttaggtgatccacccacctcggcctcccaaagttctgggattacaggcatgcaccaccgtgcccggcct

SEQ ID NO: 43396 - DNA, 201 bp, Homo sapiens
caccaggcccagctaattttttgtatttttagtagagacagggtttcaccatgtttgccaggctggtctcaaactcctgacctcaggtgatccatctgccytggcctcccaaaatgctgggattacaggtgtgagccactgctcttggcccagtttagggtttatagtgtgccaaactacgagatccctcccagttctgct

SEQ ID NO: 43397 - DNA, 201 bp, Homo sapiens
acgtgccaccaggcccagctaattttttgtatttttagtagagacagggtttcaccatgtttgccaggctggtctcaaactcctgacctcaggtgatccayctgccttggcctcccaaaatgctgggattacaggtgtgagccactgctcttggcccagtttagggtttatagtgtgccaaactacgagatccctcccagt

SEQ ID NO: 43398 - DNA, 201 bp, Homo sapiens
tctcctgcctcaacgttccaagtagctgggattacaggcacgtgccaccaggcccagctaattttttgtatttttagtagagacagggtttcaccatgttkgccaggctggtctcaaactcctgacctcaggtgatccatctgccttggcctcccaaaatgctgggattacaggtgtgagccactgctcttggcccagttt

SEQ ID NO: 43399 - DNA, 201 bp, Homo sapiens
gattggtctaaacatttgaaactcacaggtaggttttggcaggaaactcatttacagaaagggtgagaaatgttacctcccttacagcaacacaaactggraattttaaaagcaacaaaagccaaaacataataagacaatcaaaagattgtccctgttatcattctgctgcatgaaaagggaaactgcaagcattctccg

SEQ ID NO: 43400 - DNA, 201 bp, Homo sapiens
ttcatgttatctctgccttcctgggaacttgcaaatgaaccagccctcaaatgcagctctggatatgacaaaccatcccagatggacccctaaaggtcccsaatagctttgtatctttcaaaaccacataaatcttagaatctacagtttaggttttgtttgtttgtttgtttgtcttagacagagttttgctcttgttgc

SEQ ID NO: 43401 - DNA, 201 bp, Homo sapiens
aaaaaattgaactcacctacaaatagtctgaaagagtggtgtatatcaaatacgtgggtagtgttgcatttcaaatgaggctcttctggttgaaatgatayatttataagaccagaatatcacaaatgggtgatgtataatgtctctttagttttttggtatttggcctcttttaaagcctgtcggatgtatgggagaaaa

SEQ ID NO: 43402 - DNA, 201 bp, Homo sapiens
agcttgcagtgaaccaagattgcaccactgcactccagcctgggtgacagagcgacactccatctcaaaaaaaaaaaaaaaaaaaaaaaagacaaagtcartagaaagaaatgcttgggttgagataagggggggtgggctgtgattcttgttatatagatgaagcctcagatagcaggcttcagagagaatagatggtaa

SEQ ID NO: 43403 - DNA, 201 bp, Homo sapiens
tatgggagaaaacaatgaacgtgctttgatttcctatcagtcactcttaagaacatacatattgtttaagtaactcggtcttttttatctgattcttgagrcactatgggtagcaagtaaccacttacaaatttaaatgtaatatacactccttttctgtgtgtcaagtccttatttttaggtgcatattgacatttaaat

SEQ ID NO: 43404 - DNA, 201 bp, Homo sapiens
tcagcctctcgagtagctgggattacaagtgtgtaccaccacgcccagctagttttttgtatttttagtagagacggggtttcaccatgttggccaggctrgtcctgaactcctgacttcaggtgatccgcctgccttggcctcccagagtgctgggattacaggcatgagccactgcgcccagccaaacttgttttcttt

SEQ ID NO: 43405 - DNA, 201 bp, Homo sapiens
aatacaaaaattagccaggcatggtggcacatgcctgtaatcccagctactcgggaggctgaggtgggacaatcccttgaacccaggaggcagaggttgcrgtgagctgagattgagccactgctctctagcctgggctacacagtgagactctgtctcaaaaaaaaaaaaaaaaaaaagaaaaggaaaggaaaaaaaaaa

SEQ ID NO: 43406 - DNA, 201 bp, Homo sapiens
cctggcaaacatggcgaaaccctgtctctaccaaaaaatacaaaaattagccaggcatggtggcacatgcctgtaatcccagctactcgggaggctgaggkgggacaatcccttgaacccaggaggcagaggttgcagtgagctgagattgagccactgctctctagcctgggctacacagtgagactctgtctcaaaaaa

SEQ ID NO: 43407 - DNA, 201 bp, Homo sapiens
ggctgtgtgaatggcctcttttgtgaaatacttatttgacccatttataaagatttttattgtcatttgttattaatctgtggggtttctttttctttttcttttttttttttttttgagacggaatctcactctgtagcccaggctggagtgcagtggctcaatcttggctcgctgcaagctccgcctcccgggttcgcg

SEQ ID NO: 43408 - DNA, 201 bp, Homo sapiens
cagacaccggaccaaattgagaacttactaaaacagggatgcagggtggctgctttccattagacgtgcctaccagtgtgccatgtcagtttaccattgcygtggcgacacccgaagttaatgcctctttccatggcaatggcctgacaacccagaagttaccactttttcctggaaatttctgcataatctgcctcttaa

SEQ ID NO: 43409 - DNA, 201 bp, Homo sapiens
aaaaagtgcagacagggccaggcacgggggctcatgtctgtaatcctacctagcaccttggaaggctgaggtgggcagatcacttgcgctcaggagttcaygaccagcctgggcaacaaagtgagaccttgtctctatacaaaataaaaaacataattagccaggtctggtggtacacacttgtagtcccagctactcagg

SEQ ID NO: 43410 - DNA, 201 bp, Homo sapiens
gaccccaacatcctcatgaagaaagtataaaaagaagactaaattaaaatcaatctttaattgataaagatcagtggataccaatgacataaaaataaaawaaaaaacaagaaaaatcaattaaaccaaaaaccagttgtttgaaatgatcagtacaattgagaaacttctagccaaactgatcaaaagaagacataaatt

SEQ ID NO: 43411 - DNA, 201 bp, Homo sapiens
tttcatgaagaattcctcaaattgaaagagttactcagatgaagagaaatctacagatataaggaggattttaggaatcctctactgctactacttcttayttatttagagacagtctcaacctgtcacccaggctggagggcagtggtgtgatcttggctcactgcaacctctgcctcccgggttcaagtgattctccca

SEQ ID NO: 43412 - DNA, 201 bp, Homo sapiens
tttatgattcaaagaaataaagaagaaaagtgtgatctaagatagagaaactctattaacccagttgacctcaatgacgttcagagaacactccacttaayagcagcagaatacacattctaacatttatcaagatagaccatattttctgagctataaaatgtctccataaatttaaaagaattaaagtcatacaatcat

SEQ ID NO: 43413 - DNA, 201 bp, Homo sapiens
caaacttaaattcgtgattaattaaaaaggtatcttaggctgggcgcggtggctcacgcctgtaatcccagcactttgggaggccgaggcgggtggatcaygaggtcaggagatcgagaccatcttggctaacacggtgaaacgctgtctctactaaaaatacaaaaaaaattaatccggcgtgttggcgggcgcctgtag

SEQ ID NO: 43414 - DNA, 201 bp, Homo sapiens
aacagttaataaaacacttttaacctaataattaaggaaaaaatgcatctattttatctatcaaactaataaagacttaaaagtgatgaccagtgttgacraggaagaaatgaatgccattctcacagttggtgagactgaaaatttcaggaaagcaattcaggtaacaattactttaaaccaatcataccccttgactca

SEQ ID NO: 43415 - DNA, 201 bp, Homo sapiens
cacttgagcctgagaggcagagcctgcagtaagccctgattgtgccactgcactccagtgtgggtgacagagtgagaccctgtcttaaaaaaagataaaarctatcaaatatagtgcgtgtttattttggggactaaatgcttatttttaaggggatggttaaagtactcagcattatttagggagttaaagccttaggtt

SEQ ID NO: 43416 - DNA, 201 bp, Homo sapiens
ttacttttaggattcagtcctaaagaaacagatgaaatggggcaaagatttcattaaacacttacatttaagcactttcccaagtgttttataggtattartacatttaattctcactctatgaggtaagtctattagtgcctttttattatttatttatttatttatttttcttgagatgaggtctcgttctataaccca

SEQ ID NO: 43417 - DNA, 201 bp, Homo sapiens
ctgtgcagcaaaccaccatggcaaatgtttacctatgtaacaaacctgtacatctggcacatgtaccccagaacttaaaataaaagttaaaaaaaaaaaaagattctgtgccaggcatggcacagattgtcttggtaagcaagattgctcccttaaggagaatataacagagaatacaatgagttaaaatatgtaaagtac

SEQ ID NO: 43418 - DNA, 201 bp, Homo sapiens
gctactcaggacactgaggtggaaggatcacttgagcctgagaggcagagcctgcagtaagccctgattgtgccactgcactccagtgtgggtgacagagygagaccctgtcttaaaaaaagataaaagctatcaaatatagtgcgtgtttattttggggactaaatgcttatttttaaggggatggttaaagtactcagc

SEQ ID NO: 43419 - DNA, 201 bp, Homo sapiens
ttagccctaaaattctgtatgtattctttgacttttatattagaaaccatcaaagctgggcgtggtggctcctgcctataatcctagtactttgggaggcrgaggcagggggctgacatgcgcctaggcattcaacaccagcctggacaacatagcaagactctgtctctacacacacacaaaattagccaggtgtggtgg

SEQ ID NO: 43420 - DNA, 201 bp, Homo sapiens
tttaacacttattcactctttcaggctttattatgtccttgtggcagactcatagatatctgtaaataagaatttggttattcctgatgctccaaaaaaaktaatgaaacagggtgaatactcaagtttcttttcaaaataactgttctatagcataattaaatatcagtcacaactttaatccactgaattacttttcaa

SEQ ID NO: 43421 - DNA, 201 bp, Homo sapiens
aggaggcagagcttgcagtgaaccaagattgcaccactgcactccagcctgggtgacagagcgacactccatctcaaaaaaaaaaaaaaaaaaaaaaaagmcaaagtcagtagaaagaaatgcttgggttgagataagggggggtgggctgtgattcttgttatatagatgaagcctcagatagcaggcttcagagagaat

SEQ ID NO: 43422 - DNA, 201 bp, Homo sapiens
ggatcacaaggtcaggagatcgagaccatcctggctaacatggtgaaacccgtctctactaaaaatacaaaaaaaaaaaattagccaggcgtggtggtggrcacctgtagtcccagctactcgggaggctgaggcaggagaatggcgtgaacccaggaggcagagcttgcagtgaaccaagattgcaccactgcactccag

SEQ ID NO: 43423 - DNA, 201 bp, Homo sapiens
ctttgggaggccgaggcgggcggatcacaaggtcaggagatcgagaccatcctggctaacatggtgaaacccgtctctactaaaaatacaaaaaaaaaaaattagccaggcgtggtggtgggcacctgtagtcccagctactcgggaggctgaggcaggagaatggcgtgaacccaggaggcagagcttgcagtgaaccaa

SEQ ID NO: 43424 - DNA, 201 bp, Homo sapiens
ggacagcttaaggaaggagcaatacaggtcataggtggattcaaagattttctgatttggaattggtcaaaagagttaagctgaagacttaaagtcaggcygggcgtggtggctcacgcctataatcccagcactttgggaggccgaggcgggcggatcacaaggtcaggagatcgagaccatcctggctaacatggtgaa

SEQ ID NO: 43425 - DNA, 201 bp, Homo sapiens
cttaattttcctgattggtttgcattgtggattttcagaactattaataattattgaatctgtaattttagaagaatttatttatgaatacagttgaatcragtagttaattaagcaaaggtgaattggatgttcgagttcttttcaaggtgcttcctcagcgacacctctattctggtctaaacgctgttgccacctctc

SEQ ID NO: 43426 - DNA, 201 bp, Homo sapiens
aaggcagctctggggaaattcgtctgtgtaactggggtgctatgcaggcctgtctgtttgactgtcatgcaggtctgtctgtgtgatcatcagggagaatyggccggccacattttcaatctttctcctcttctggaaaaaataaccactcagtctttagcgtcagctcacccttcagggtttgacacctggagcagcagt

SEQ ID NO: 43427 - DNA, 201 bp, Homo sapiens
tgactgtctcagatttcgttgacccgagacgggtcctggcactaggaatgaaagactgtctctattattttggtttgctccaggttagggagaagcccacrcaaggctcctactgaccatatgtttcatttctagctttgctgtctgggcaccaatttccctaggtttaactatttgctcaatgttaaggcagctctgggg

SEQ ID NO: 43428 - DNA, 201 bp, Homo sapiens
gcaaaaatgctttctaagtcggattaagctgtgagcggcccagtacctacaaggcctgtctactgtggtaccagagtgattatttctatcttatctgcttyacagcttggtctggagggctgccttagactctccaatgaatctattcgaacagctgcctctgttaccttgactgtctcagatttcgttgacccgagacgg

SEQ ID NO: 43429 - DNA, 201 bp, Homo sapiens
agaaggctggagataattccaccaggccaactcaaagtgtcaacaattgtcttagtgtttatataggttggggttatgcgcctgtgtgcagtgtagcattygcctaagtctactggtaactaattttgtttcaactagaaggtcagaggcaaaaatgctttctaagtcggattaagctgtgagcggcccagtacctacaag

SEQ ID NO: 43430 - DNA, 201 bp, Homo sapiens
tgactatttttcctctcttaattgcgccagagctttgttgagaatcagttgattgtataaatgtagttctgtttctggacttaattctgtttagttgatayctttattattaagctaataacacactcctgattcttctagttttatattaagtcttgaagaaaggtattataagtctttcttctcttttcaagattgttt

SEQ ID NO: 43431 - DNA, 201 bp, Homo sapiens
gaatttattgctgtaaccagatacaggcagaaggctggagataattccaccaggccaactcaaagtgtcaacaattgtcttagtgtttatataggttgggrttatgcgcctgtgtgcagtgtagcattcgcctaagtctactggtaactaattttgtttcaactagaaggtcagaggcaaaaatgctttctaagtcggatt

SEQ ID NO: 43432 - DNA, 201 bp, Homo sapiens
ataacgagaagcagacagactaggaaagaagggaatttattgctgtaaccagatacaggcagaaggctggagataattccaccaggccaactcaaagtgtyaacaattgtcttagtgtttatataggttggggttatgcgcctgtgtgcagtgtagcattcgcctaagtctactggtaactaattttgtttcaactagaag

SEQ ID NO: 43433 - DNA, 201 bp, Homo sapiens
tctgtgcagcaaaccaccatggcaaatgtttacctatgtaacaaacctgtacatctggcacatgtaccccagaacttaaaataaaagttaaaaaaaaaaaaagattctgtgccaggcatggcacagattgtcttggtaagcaagattgctcccttaaggagaatataacagagaatacaatgagttaaaatatgtaaagta

SEQ ID NO: 43434 - DNA, 201 bp, Homo sapiens
ggacatggatggagctggcagccattatcctcagcaaactaacgctggaacggaaaatcaaacactgaatgttctcacttataagtgggagctgaatgctraaaacacatgaacacatggtggggaacaacacacactggggcctgttggggtgggggcagggggagagagagcatcaggaagaatagctaaaggatgctg

SEQ ID NO: 43435 - DNA, 201 bp, Homo sapiens
cagccctttgggaggccgaggcgggagaatcacttgagcccaggagtttgaggccagcctgggcaatttaagaccccatctcggccgggcacagtggctcrcgcctgtaatcccagcactttggacggctgaggcaggtggatcatgaggtcagatcgagaccatcctggctaacatggtaaaaccctgtcgctactaaaa

SEQ ID NO: 43436 - DNA, 201 bp, Homo sapiens
tgagtagggcaatcaggcaaacaaaataaataaagggtattcaaataggaagagaggaagtcatattatctttgttgacagatgacatgatcctatatctrgaaaaccccatcatctcagcccaaaagcttcttaagttgataagcaactttagcaaagtctcaggatacaaattcaaggtgcaaaaatcactagcattcc

SEQ ID NO: 43437 - DNA, 201 bp, Homo sapiens
ccataaaatgctggcaaaccaaatccagcagcacatcaaaaaacttatccaccacaattatgttggcttcatccctgagatgcaaggttggttcaatgtaygcaaatcaagaaatgcaattcatcacataaacagagctaaagacaaacccacatgattatctcaatagactcagaaaaagcctagaataaaattcaacat

SEQ ID NO: 43438 - DNA, 201 bp, Homo sapiens
aattagctgggtgtggtggcaggtgcctgtaattctagcgacttgggaggctgaggcagaaggattgcttgagcctgggaagttgaggctgcagggagtgrtgattgtaccaccgaattccagcctgggtgacaaagcaagaccctgtcgcaaaagtaaaataaaataaaaaaatttagagatgctttaaaactcttctca

SEQ ID NO: 43439 - DNA, 201 bp, Homo sapiens
ttataaggccagcatcatcctgataccaaaacctggcaaagatacaacaaaaaaagaaaacttcaggccaacatccgtgatgaacatcgaagcaaaaatcytccataaaatgctggcaaaccaaatccagcagcacatcaaaaaacttatccaccacaattatgttggcttcatccctgagatgcaaggttggttcaatgt

SEQ ID NO: 43440 - DNA, 201 bp, Homo sapiens
tgggtgtggtggcaggtgcctgtaattctagcgacttgggaggctgaggcagaaggattgcttgagcctgggaagttgaggctgcagggagtgatgattgyaccaccgaattccagcctgggtgacaaagcaagaccctgtcgcaaaagtaaaataaaataaaaaaatttagagatgctttaaaactcttctcagctgcat

SEQ ID NO: 43441 - DNA, 201 bp, Homo sapiens
tccctaactcgttttataaggccagcatcatcctgataccaaaacctggcaaagatacaacaaaaaaagaaaacttcaggccaacatccgtgatgaacatygaagcaaaaatcctccataaaatgctggcaaaccaaatccagcagcacatcaaaaaacttatccaccacaattatgttggcttcatccctgagatgcaag

SEQ ID NO: 43442 - DNA, 201 bp, Homo sapiens
aatgtcaggaaacactacaatggtataaaaataagataaatgaaatcataaaaaatgctttcttcagaatacataagccaaaaataaacacagccataatyatttgagcaatttagttaaaagccacaaaatacttcaaagttatcaccacatgctaacacatgtattaataacaaatacctcatgtcctgaataagagag

SEQ ID NO: 43443 - DNA, 201 bp, Homo sapiens
aatttacagatgaatgttaccagaggtacaaagaagagctgataccacttctaatgaaactattctaaaagattgaaaaggaggggctcctccctaactcrttttataaggccagcatcatcctgataccaaaacctggcaaagatacaacaaaaaaagaaaacttcaggccaacatccgtgatgaacatcgaagcaaaaa

SEQ ID NO: 43444 - DNA, 201 bp, Homo sapiens
acataaactagaaaatcaagaagaaatggataagttcctggactcatacaccctcccaagactgaaccaggaagaagttgagtctctgaatagaccaatamtgatttcagaaactgaggcattaataaatagcctaccaaccaaaattccaggactagacaaatttacagatgaatgttaccagaggtacaaagaagagct

SEQ ID NO: 43445 - DNA, 201 bp, Homo sapiens
taaagcagatctcatgatggtttattttttaaaaagaagaagaaagaaaagaaaacacaagtgcagaaggatatgaacaccatgatacttcttatagaacrataatgtaaacaatattatttggttattgagaaacatttacattataaatgtaaaaactcataattcataatatttacccatatggaaggagagaaaatg

SEQ ID NO: 43446 - DNA, 201 bp, Homo sapiens
acataatggtaaagggttcaactcaacaagaagagctaactacctaaatatatatacaaccaatacaggagcacccagcttcataaagcaagttcttagakaattacaaagagacttaggcgcccacacaataatagtgggagactttaacactccactgacaatattaaacagatcatcaagacagaaaattaacaaaga

SEQ ID NO: 43447 - DNA, 201 bp, Homo sapiens
cctatgaaatatactttcaagccacaaggtagtgagatgattaactgatacaataaacacatcagcattaatcttaaaaaagacatggaatttatgcttakgggtgaagttcttttgttcttctttaagtgaatgcttttctagactctttaactctgtgagaaatcaatagatgagtgttaagccaaggaaaaattcctt

SEQ ID NO: 43448 - DNA, 201 bp, Homo sapiens
gcatcgcgctgctcattcatccggccgcactttcttttccgtttccacccatcccttcccatttccttctccctttccccgccagcttcgcatccatctcycccaccccgtaaccccctcctgcctccatccaccggggctatggccgcagaagaggtattgcagacggtggaccattataagactgagatagagaggcta

SEQ ID NO: 43449 - DNA, 201 bp, Homo sapiens
ggagagcagtggcgcaatctcggctcactgcaagctccgcctccggggttcacgccattctcctgcctcagcctcccgagtagctgggactacaggcgccygccaccacacccggctaattttttttatatttttagtagagacggggtttcaccttgttagccagaatggtctcgatctcctgatctcgtgatccaccca

SEQ ID NO: 43450 - DNA, 201 bp, Homo sapiens
agaaatttggcttctgaaaccaaactgttaactttacatggacaagttgtgacttcctgataggataaagactaaataaatgatttctagactaaataaakagatttcttcaaaaaggagtaggcttatttaaccatacttgatcataaagtaagagtaaataaaactgttataaggttaaacagtattaacagatttgga

SEQ ID NO: 43451 - DNA, 201 bp, Homo sapiens
ccaaagttccccttgctcatttgattcctcatacctgtttgtcctggtttgtatatgggtttgtctgtctggacaaagactaggttctctgctgtagttayatatattgatttgctctttgtgaaatgcagagttgccccctctacctccacagcaatgaccacccaggaagatggtaattctggaatctgtaaaacagaa

SEQ ID NO: 43452 - DNA, 201 bp, Homo sapiens
aatgcttcgtaatctgcaaacatctgtgtaaaacggttagcaaagacctctcggagctgtacattgagctggtagtcccttagttctgcctcttcacaatkcagttttaaatccttgtctttttcacccagagaagcagagaggtccattttttccacagccacaccagtacgcttggccagagcctgcaagcgggctatg

SEQ ID NO: 43453 - DNA, 201 bp, Homo sapiens
tatccctcaggtatctgtagtagacttcaaacagtatttaacctctactgtccatactctcttaatcaggacaaggttgttagttaaaaagaaggttgtgyttctagattggggggtggagtgccaaaagtgtagcccatcacataaaaataatattgattacatcaatggttgaacataagacatggggtggaagttaat

SEQ ID NO: 43454 - DNA, 201 bp, Homo sapiens
cacatgcataatttggcttatctccctagtttcacagaaattcatctcaggtattgccaacaatgacctacggcactagaaaatgaaaggcacagcctctsgcagctcctgaagtaagagcaaagactaatcatggagtacttgacccctgtcctcagtatgacatcaatgtggagccaccacaccacctaagccacccaa

SEQ ID NO: 43455 - DNA, 201 bp, Homo sapiens
aggcaaaatgaactacagactgggacaaaaggtgtgaagtctctcgtttacatagattggattcatcacaaatttaccaggtcaagaattccatataaagsgtttcagccttcacttgcagatcatgaaaaatatgacggagatccacagaatcctcagaaactgcatattgttaccagaataaaaaagtacaaaaaggtg

SEQ ID NO: 43456 - DNA, 201 bp, Homo sapiens
catcctgggcaataaagtgagactctgtctcaaaaacaaaacaacaacaacaacaaaaaaaagtttcactagaatttcaggaggattaaaaaaagatacaygaatgcaatatttacaaagatagttgagaattttccaaaatgggtaaaggacattaattcttaaatttcaggaaacataatgaaccacaagcagaacaaa

SEQ ID NO: 43457 - DNA, 201 bp, Homo sapiens
attgctcacaatcaatatatttggtcattgaaatttggaccatggtttgaggagtagctggtgttttaactaaagcatagtaactgaaacttacccatatyagaacctcgccaagagaggactaccatgaaagttaaatgaggggcattaggttccataaaggatcataaaaatactactctactctattatacatttaca

SEQ ID NO: 43458 - DNA, 201 bp, Homo sapiens
tgtctatgagtgaactgaataacagatacctagtaaccaatcactggccgactttgaatgaagtggtgtcattggccgttggtcatgatgttatgtagtgmttttatagactgaagtgctggcagcaaagattgtgcgttatgcattgctcacaatcaatatatttggtcattgaaatttggaccatggtttgaggagtag

SEQ ID NO: 43459 - DNA, 201 bp, Homo sapiens
gcccagggaggtcaagactgcagtgagcctagatcgtgctactgcactccaggatgagcgacagggtgaggccctgtctcaaaaaaccaaacaaacaaaargaagtaatataattgacaaacttcaggtaaaaataattgggggaaaaagagaatgcacaaacagtattaggaatgaaaaggaggacaaaactacagatat

SEQ ID NO: 43460 - DNA, 201 bp, Homo sapiens
gtaattcatttttgtaaaacatcacatggatttatcactaggagacaagacaaggcaactacatccttagctgtctatgagtgaactgaataacagatacstagtaaccaatcactggccgactttgaatgaagtggtgtcattggccgttggtcatgatgttatgtagtgcttttatagactgaagtgctggcagcaaag

SEQ ID NO: 43461 - DNA, 201 bp, Homo sapiens
ttcaggtaaaaataattgggggaaaaagagaatgcacaaacagtattaggaatgaaaaggaggacaaaactacagatataacaggggtcaagaaaacaagraaatattaagactttttgctaatatattgaaagcttaataaaaattttcttagagaaaatagcaaggaacaaaaatttattcaagaaaaaaatagaggtg

SEQ ID NO: 43462 - DNA, 201 bp, Homo sapiens
tctgcacaacaaaggaaacaatcgacaaaatgaaaaggcaacctatggaataggagaaatatttacaatctgtatatctgataaggggttaatatctcaamattttttttcttttttctttatttttcttttatgtccacttccaagctcaaatatctcaaatattatgtaagaaactcacatagctcaatggcagaaaac

SEQ ID NO: 43463 - DNA, 201 bp, Homo sapiens
ccattgcactccagcctgggcaacaaaacaagacgccgtctaaaaaacaaaaaaaattccaaaagctcctgtgggcagaaggattcttccccagctttttkctgtcttggcttatctctgttgctgacctgctgtcttaaccactgccctccagttgccgcatgcctgttgatgataagagtgtcctggcacatgatcagt

SEQ ID NO: 43464 - DNA, 201 bp, Homo sapiens
agaggttgcagtgagccgagattgctccattgcactccagcctgggcaacaaaacaagacgccgtctaaaaaacaaaaaaaattccaaaagctcctgtggrcagaaggattcttccccagctttttgctgtcttggcttatctctgttgctgacctgctgtcttaaccactgccctccagttgccgcatgcctgttgatga

SEQ ID NO: 43465 - DNA, 201 bp, Homo sapiens
gttccttctccactgggacagctaggaaggcgggagaggcttccagctgcacactgacctgaaaccacacataagaaagggagtagagagggaaggagaasagagggagaatgggtttgaagtaaagcatcttgaggaattggttagatttcaggttgcctcacattaaagatgatataaatgaagatcaagtacctgaaa

SEQ ID NO: 43466 - DNA, 201 bp, Homo sapiens
cacagtaggcagtacttgggagggtcttatagaccccaccctgtggaagtgggtctcaacattacacaaccccctctcgggcccgtggacagttgctgtcytctctgttttctctctttgtgcctgtgccaccctcagagaagaagaaaggagctgaggaggagaagccaaagaggaggaggcaggagaagcaggcagcct

SEQ ID NO: 43467 - DNA, 201 bp, Homo sapiens
atttattactcacctgggaaaggacctgatcgttgccattggcagcatggttcaatggctgcaaatggatctgatggagagcgtgtggctttgggaggagygtgccgccttccacagtgagcagcgaggctgggacctgcagggatgaggtcccgggaggggatgcggcagcccttgagtgctggttggggaaggagagct

SEQ ID NO: 43468 - DNA, 201 bp, Homo sapiens
cttcggattacaagtgtgagccaccatgcctggccaggagaacttaatatattgctgacagttaatttaaaaactttcagccaggcatggtggctcacacytgtaatcccagcactttgggaggccaaggcaggcagatcactagagttcaggtgttcaagaccagcctgggcaacatgacaaaatgccatctctacaaaa

SEQ ID NO: 43469 - DNA, 201 bp, Homo sapiens
ggatgcacgttggaggggacacagggccagagcaaggtgggaatgcgggtattatgggccaggccatcctccagctggtggagcaccgcagcactgcagtrtgtggccctggcttaacagcagtgcggaaaagcttttctcttggggctgtggtgctttccaggtgtgtgaagttaaaacattttagggccatacggtagg

SEQ ID NO: 43470 - DNA, 201 bp, Homo sapiens
atcatccgcttctctacaaggctggaatttatggtggctgcacatttggaatgttttctccttttatttatttatttttagatcagacaatcacaagagamtattcttttgttttatttttagatcagacaatcacatgagaatattctgttgtgatcgctggcgtttagaaggaaacttgtctggtttgtgaagcaatgg

SEQ ID NO: 43471 - DNA, 201 bp, Homo sapiens
  misc_feature (1)...(201): n = A,T,C or G, or insertion/deletion polymorphism (see Tables 1-2)
gggatggtgttggggaacccctgattttgtagtcatccaagaaaaaatgtatgtggcctggtgctacggtttggacatggtttgttggccccaatgttggnggtgaggtgtttgggtcctgggggtggatctctcatgaatggctttgtgccattctcatggttgtgagtgagtagtttttcactcttactttccatgaaa

SEQ ID NO: 43472 - DNA, 201 bp, Homo sapiens
tgcctgtctcagcttcccagagtgctgggattacaggtgtaagccactgcaccaggccaaacttcttttctttataaattaaccagcctcaggtattttayagtaacacaaataaaccaagacacctgatacctcatttgtggctggcatcagaagtgaggacagtcttgtgagaatgaactcttaaacctgtggagtctg

SEQ ID NO: 43473 - DNA, 201 bp, Homo sapiens
tggctggcatcagaagtgaggacagtcttgtgagaatgaactcttaaacctgtggagtctgacattcagttaggaatgaattgaactgttgggcatccagytggtatcacaaattgacaggtgttggggaggaaagactctctcacttggtgtcagaaaaactgagatttgttataacagcccaggctcatggaaacctgt

SEQ ID NO: 43474 - DNA, 201 bp, Homo sapiens
gtgtagtccccagtgggtaaattctgacatgttagtagattataaagttgcatcttactttcttgaagattttcattgtgtgtatttctatgtttcatacyccggagtcatttcttaaaatgatatattacattcagtatgaagccttctttgcagtgaggaaacaggtataaggaaggaaagcaacatgcctgaggtgtt

SEQ ID NO: 43475 - DNA, 201 bp, Homo sapiens
ctcactatggaacaatcacagatggctatatgtgatccagacacaaaggtgatgattcagtcagaaatgaattgaactgttttatccaatccttgagggamcagccagtctcaaggactggataaaagctactcgaagtctgtttaccttgagaagggagactgcccaattccccctataaattccaagtggaacacccca

SEQ ID NO: 43476 - DNA, 201 bp, Homo sapiens
cctcaacacctacttaatattgtgcctggcaataaaaatgttcgttgagtaaatggatagatgaataaaaactgtactcttaggtctgaattatatactcyaaaatttttaagacacttatttaaaatattggtagctttgaaaatgattcatttcaaagccttgactatatataaactaaaatataatttaagaaataaa

SEQ ID NO: 43477 - DNA, 201 bp, Homo sapiens
gcctgcaaatgaaaccgagaaaagacagatgaaagggaaaggcttatttcacaagcatgtgacaacttcacagggaagaagtgaaaataagagaagcaatkaggaatgggggcttatatgccattttaacaaaggacaagttgtggaaacattaacaagaccaaggaagtgagatctgggcatttggggcagtaagttatg

SEQ ID NO: 43478 - DNA, 201 bp, Homo sapiens
ttaaaacattaggaacattgagagttaaccttttatttctttgtaaacagcttatcaagagtattttgatcttgccttcccataaagcttagggccgggcrcggtggctcacgcctgtaatcccagcactttgggaggccgaggtgggcagatcacgaggtcaggagttcgagaccagccgccaggctgaaaccccatttc

SEQ ID NO: 43479 - DNA, 201 bp, Homo sapiens
gactgaaggacataaaacaatgctgaaacttgaaatatccacggtatctaaggcgattttggaaaaacactctaatgggagaggacagtgcccaaaagagwtccctattgaaaaagaaatggtttatactggatcttgttaccagaggaatgcaaggaagagattctcacatatagggagcctctttttcccttggactga

SEQ ID NO: 43480 - DNA, 201 bp, Homo sapiens
ggaggccaaggtgggtggatcacttgacattaggagtttgagaccagcctggccaacatggtaaaaacccatctctactaaaaatacaaaaaatttgccargtgtggtggcgcgtgcctgtaatcccagctactcgggaggctagggcaggagaatcacttgaatctgattcagggaggcagaggttgcagtgagctgaga

SEQ ID NO: 43481 - DNA, 201 bp, Homo sapiens
taatagcacagctattctcaggagccgccgggtcaaaaggggtgtaactctggtaggcctcctggaggcgttccaaaaacgccccgggtggctcatcaggyccctggacaacttcaaatgtcttagacaaatttatgtgttttcgagcagctcctttgatacccgcaaggagatactggtgaaaatcatctaaagctctct

SEQ ID NO: 43482 - DNA, 201 bp, Homo sapiens
tgtgaaacattaaaaagtctcttactgttggttataaatatatatagaaatgaaaatatagtaaaactacttagtacttcataatttaaaacattaggaayattgagagttaaccttttatttctttgtaaacagcttatcaagagtattttgatcttgccttcccataaagcttagggccgggcacggtggctcacgcct

SEQ ID NO: 43483 - DNA, 201 bp, Homo sapiens
tgggccctgtggctcacaccttctaatcccagcactttgggagactgaagtgggagggctgcttgagtccaggatgttgaggctgcagtgagccctgatcrtgccactgcactccagcctgggcaacagagtgagaccctatctcaaaaaaattaaaaagaagaaattagagcatatagagaagtaaaacagaaataatta

SEQ ID NO: 43484 - DNA, 201 bp, Homo sapiens
cctaattttcaccggtctctaagatcaattttgtaagagtattttttagggtgtggttcatgcgttctacctgcccagagctctgggatcgagaggcacartggagcttccattgaatgtttagtgccttactgactgactgagctatggacgaggtgaaggccggtccattatcagaccctatggcagcaggcagcccat

SEQ ID NO: 43485 - DNA, 201 bp, Homo sapiens
cttgagataacaaaactgtatcttaggttctaatatatgtgatcatactatacaggcagtccttggtttgcatagtagtctgggacagtaaaaaatggtcrtgcaaactgaaaccatgcaaaacaaacttaataattaatggggaaatttacaattgttttgtgatctttaaatatttttgtgaaacattaaaaagtctct

SEQ ID NO: 43486 - DNA, 201 bp, Homo sapiens
ctatccacgtgagaggattgtacagacacgaatctaaacaaggaagtagcaagtccattcaagcattaagaggctgattagtggtttattcattctgtctrcaagcatctactgatcatctattcagtacagaccattatcacaacaaaggtgaataagacactatgcaatagccagggaaacagcctcaaaaacagttaa

SEQ ID NO: 43487 - DNA, 201 bp, Homo sapiens
cctgtggctgctgggggttagcagacacggtttgttgtctgacatacgggctctctcctcccggcccctcaccagccccagaggtgaaaaggctggagggsaaaggctgagtgagggaggtctgtggggagcactggtttccccaggccccagagacttaaacacaggaagaaaaaggcaagagagaattaacgatgccac

SEQ ID NO: 43488 - DNA, 201 bp, Homo sapiens
tcccgtggccacagggctcctgcccaggggcttgtcaccttcccctcctccttcctgagtcactccttcagtagaaggccctgctctctatcctgccccayagccctgcctggatttgtatccttggcttcgtgccagttcctccaagtctatggcacctccctccctctcaaccacttgagcaaactccaagacaccttc

SEQ ID NO: 43489 - DNA, 201 bp, Homo sapiens
cagtgtttgtcgtgggcgtggtctgcagggatcctgttacaaaggtgaaacccaggaggagagtgtggagtccagagcgctgccaggacccaggcacaggygttagctcccgtaggagaaaatgcgggaatcctgaatgaacagtgggtcctggctgtccttggggcgttccagggcagctcccctcctggaatagaatct

SEQ ID NO: 43490 - DNA, 201 bp, Homo sapiens
tcctgccctctggagacagtgtttgtcgtgggcgtggtctgcagggatcctgttacaaaggtgaaacccaggaggagagtgtggagtccagagcgctgccrggacccaggcacaggcgttagctcccgtaggagaaaatgcgggaatcctgaatgaacagtgggtcctggctgtccttggggcgttccagggcagctcccc

SEQ ID NO: 43491 - DNA, 201 bp, Homo sapiens
aatcactggtctctcactcccttaaaattttttctgtaaattgctttcaaatcgtagaggggaatggattatgaagtataaatcaagaagagcaaaattayaagaaaaagaggccgggcgtggtggttcatgcccgtaatcccagcactttgggaggccgaggcgggtggatcacctgaggtcaggagtttgagaccagtc

SEQ ID NO: 43492 - DNA, 201 bp, Homo sapiens
ttcggcccctccctgatcttaccaggtcacgtgatccctccagacaacatctgccccttgtcatctgcagcgggatctccaaccagccgctggaattcacsttccagaaaagagacctgcctcagatggtcagtcccagccagctcgctgcaccacagcctggcctcaggcagcaaagggttttctggggcagggacgctc

SEQ ID NO: 43493 - DNA, 201 bp, Homo sapiens
tgaagggcgttttggaaacagccttatctgtaatcatgtgtactaattgaataacgtttacactttccagtgcaaatttgcttaattttcaaaggaaaaarggaaaacaaaaacacttctgacataatcagttttcactgagattgtatagaatagagattttccatctcctttatgaaaaattcaaatgacatggctatt

SEQ ID NO: 43494 - DNA, 201 bp, Homo sapiens
taaatttgatatgtgcattttttcataatttaaaaaataaaaatagtatagaaaaacacctgtgaggaggaaagaagtattcaggaaaaattgtataaatytgaaaacatggaagtttaacataagtatttataacaagatgctagaaaaaaaaaaccaaaagaggtagaagaaaaaatataataaaaataaatgatgtaa

SEQ ID NO: 43495 - DNA, 201 bp, Homo sapiens
caatttgatgtttcaatacacacacacacacacagacacacacacatatctatatatgtagtataatgatcatattggggcagtgttaccagtacttcatycatttatcttttttttttatggtgaagacattcaaaaacctctcatctagctattttgtaatttgctaaatcttactgtaaactattgtcagcctactgt

SEQ ID NO: 43496 - DNA, 201 bp, Homo sapiens
tatggtgtgttctaagaaggatctgtgtgcctttacgttaatattttttctgattataaaagtcgtgtgcttactgttaaaaagatattataggcctgggygcagtggctcatgcctgtaaacccagcactttgggaggctgaggcaggcagatggcttgagtccaggaggttgaggctgcagtgagctatgatcgcccaa

SEQ ID NO: 43497 - DNA, 201 bp, Homo sapiens
agtgagactttgtctcaaaaataaaaaaaaaagtgggggggtacaatttgatgtttcaatacacacacacacacacagacacacacacatatctatatatktagtataatgatcatattggggcagtgttaccagtacttcatccatttatcttttttttttatggtgaagacattcaaaaacctctcatctagctatttt

SEQ ID NO: 43498 - DNA, 201 bp, Homo sapiens
tgatatccattggggtctggcttcttagagagcattacctgttccgttctctgtaacaagagcatgcactttgaggaaactccagtatccttaccgatttmactcaaaagcacctgtgttaatgaacttggagacacagccatctttccccaactgaaaagaacaataaaaaaaagttatattttaaaggaagactgtaag

SEQ ID NO: 43499 - DNA, 201 bp, Homo sapiens
ctcccacctcagccttccagtagctgggaactacaggtgtgcctcactatgcccagccactgcttaactctgattttatcctcaatcattgtctactgtargatgaatgctgtattttttttttttttaattctagagaggaaacctttctgtagtgtaacttgcaaaagagttggtgtttttctttctcagtgatctctt

SEQ ID NO: 43500 - DNA, 201 bp, Homo sapiens
agtatccttaccgatttaactcaaaagcacctgtgttaatgaacttggagacacagccatctttccccaactgaaaagaacaataaaaaaaagttatattktaaaggaagactgtaagaaatacctatataatataatagggaaaatgtgtgacctcactgaagcaactttaagaatattgtattacccaagttttagttt

SEQ ID NO: 43501 - DNA, 201 bp, Homo sapiens
cccacatttctgtgtggcatcagagggctagaggtgaatgagtcctcctctcctctcctctccccctcctcccctccattcccctcccctccccttcccckctcccctcctttattttttttttttatgagacggagtctcactgtgtcacccaggctggagtgcagtggtgtggtctcagttcattgcaacctccatctc

SEQ ID NO: 43502 - DNA, 201 bp, Homo sapiens
gaagaaaggaagagagaattacttaaggtaaaatttttcagatacaaaaaggtgatctgtaagtaataatggaagcagtgagtcctcagcttctgctggtsggaaggttcatgctgaatatttagcaggcgctctctctaaagagaacagccaccacacttatggcagggactttgctgtcagtagctcaagaggcaaaat

SEQ ID NO: 43503 - DNA, 201 bp, Homo sapiens
ttcactatccattaagacatagcatctctattttctctacacattcatattcagatgacaactagtatcctagtctaggctcagcattagtcttcacaaaygtactggtaaaataaaatccatagtttgttattttcttaatatgtgttggaagaactttgaatgaaagataccacaaagataacttccttctgagattaa

SEQ ID NO: 43504 - DNA, 201 bp, Homo sapiens
gaaagcaagagaaataatcaggggctagcccatgaagggccttggtaggccatgttagaactgtggggaggacaatgggaaacctctgaagggtttttagragagggacagaattagacgtgcctcttagcacatccatcttggaacactaaggggagtggttttcaaaggggttccaaagaggcagcaggaatgtctcag

SEQ ID NO: 43505 - DNA, 201 bp, Homo sapiens
caggggctagcccatgaagggccttggtaggccatgttagaactgtggggaggacaatgggaaacctctgaagggtttttaggagagggacagaattagaygtgcctcttagcacatccatcttggaacactaaggggagtggttttcaaaggggttccaaagaggcagcaggaatgtctcagggccttggaagggagtga

SEQ ID NO: 43506 - DNA, 201 bp, Homo sapiens
gcactcacatcaggagctcagtgtcaggcaggcaagcctcctgcaggggagccccgccctgctcaggtggcctcatctcccctcccagctggtggtgctgycctatcagatgctgctgcatgcggccactcggcaggctgcgggcatccggctgcaggaccaggtggtgatcatcgacgaggcgcacaacctgatcgacac

SEQ ID NO: 43507 - DNA, 201 bp, Homo sapiens
tgtaacagcctgtttctgcccttgtcccccataatctatttcccttataagagccaaagcaatccttaaaaaatatgttagatcttgtcactcttgccaamattctccaatggactcttatctcactaaaagctgatgtccttataatggcctgcagggaagccctgcatgactcagcccccaacaacctctctgccctca

SEQ ID NO: 43508 - DNA, 201 bp, Homo sapiens
taggtcctttgcctttccatataaattttatgaccatcttgtcaatttctgcaaagaatccagctgaaattctgttggagtttgcattgaatatgtaaatmaatttgggtagtattgccatcttaacattcagttttttgacccagaaacaggggctgtttatccctttatttaggtcttctttcatttctttcaacaatg

SEQ ID NO: 43509 - DNA, 201 bp, Homo sapiens
aggctggtctcaaactcctgacctcatgatccgcctgcttcgtcctctcaaagtgctgggattacaggcttgagccactgagcctggaccatcattttaakgggcatttctcgctttatgtttttttgctaatgacttattacttgctgtttattttagattttagactgaaaatgttagacaaaaaagcaaattagagca

SEQ ID NO: 43510 - DNA, 201 bp, Homo sapiens
tttccctttcctgttttatttacacagaaggcatcttagtcagttgtctgaccatcgctcctctagtgggctgcgtggttctctgttggacagatgtaggragcttatccaaccagtaccctctggataggcaggcgcatgattacagggaaaggtccgggggcacatgctgtttggtatttgtgggctgtatcttctcac

SEQ ID NO: 43511 - DNA, 201 bp, Homo sapiens
attttttttttttttttgtacttttagtagagacgaggtttcaccatgttggccaggctggtcttgaacttctggtctcaagtgatccactcgcctcagcytcccaaagtgctgggattacagtgtgagccacagtgcctggacttcagcttgtaattctttttccatcaagtaggcaatacagaaacatagtgaccacca

SEQ ID NO: 43512 - DNA, 201 bp, Homo sapiens
atacaaaaatatcacaaagggtccagtgtgacccataacatttccagtgtagatcaaaactcagttacacagtttttcttttgggaaggcagcaaggcagwtgagaaaaaaagtgagctagagagtaaaaatgatctggatttaatttctgagtcttactgcctaactttgggcaaattacttaacctttgaaaatataag

SEQ ID NO: 43513 - DNA, 201 bp, Homo sapiens
atccctttccagcccattccccacccccatagggaatccgttttactagcttatcctttcagtctttctttttcccctaaataagcaaaaacgtgtcttcwtttttccctttcctgttttatttacacagaaggcatcttagtcagttgtctgaccatcgctcctctagtgggctgcgtggttctctgttggacagatgta

SEQ ID NO: 43514 - DNA, 201 bp, Homo sapiens
gtatttttcacctccatcaggtcatttatgttcttctctaaactagttattctagttagcaattcctctaaccttttttcaaggttcttagcttccttgcwttgggttagaacatgttcctttagctcagaggagttttttatcacccaccttctgaagcctacttctgtcaattcatcacacttattttccatccagttt

SEQ ID NO: 43515 - DNA, 201 bp, Homo sapiens
ttaatcttgtcttgtgctttatttcattaagttgtcttcaatctctgatgtcctttcttccgtgtgattgattcagctatggatacttgttatgcttcacraagttctcatgctgtatttttcacctccatcaggtcatttatgttcttctctaaactagttattctagttagcaattcctctaaccttttttcaaggttc

SEQ ID NO: 43516 - DNA, 201 bp, Homo sapiens
atggttgaactaatttacactcccaccaacagtgtaaaagcattcctatttctccacatcctctccagcatctgttgtttcctgactttttaatgaatgcyattctaactggtgtgagatggtatctcactgtggttttgatttccatttctctaatgaccagtgatgatgagctttttttcatatgtttgttgcctgcat

SEQ ID NO: 43517 - DNA, 201 bp, Homo sapiens
tgaacccgggaggcgaagcttgcagtgagccgagatcacgccactgcattccagcctgggcaacagagtgagacttcatctcaaaaaaaaaaaaaaaaaaagaaagaaagtgaaggaataaataaaaggctggctactccataggcagagcagccccatgggctgctggttgactatttttatggttatctttgatcacat

SEQ ID NO: 43518 - DNA, 201 bp, Homo sapiens
tacagagtggaaactaaggttggaagtgaaatgatactgctccaaggggtaggctcaggatttggaaccagatttgggctctgttcccagtccagtgcctattttattttattttattttattttatttatttattttattttattttatttattttattttattttattttatattttattttatattttattttattaa

SEQ ID NO: 43519 - DNA, 201 bp, Homo sapiens
ctcttgagcccaggagtcccaggctgcagtaagctatgatcgcaccactgcactccagccagggtggcagagcgagaccctgtctaaatgaaagaaagaarctgggcacagtgactcatgcctgtaatcccagcactttgggaggccgaggcgggtggatcacttgcagtcaggagttcgagaccagcctgatccacaggg

SEQ ID NO: 43520 - DNA, 201 bp, Homo sapiens
acagagtggaaactaaggttggaagtgaaatgatactgctccaaggggtaggctcaggatttggaaccagatttgggctctgttcccagtccagtgcctattttattttattttattttattttatttatttattttattttattttatttattttattttattttattttatattttattttatattttattttattaaa

SEQ ID NO: 43521 - DNA, 201 bp, Homo sapiens
agacccctggagatggagaaagtttgggggctcagtagggcagacccagggtcttcacctcgtcctctcccacccccacattagcagctcttcacatccaragttgcccctgaacacagcccctggccaggtcactccgccatctcaccccctccccttagaatgctgtctcccagagcctggtcctgacctggccctggg

SEQ ID NO: 43522 - DNA, 201 bp, Homo sapiens
atggcgtgatctcagctcactgcaacctctgcctcccaggttcaagtgattctcctgcctcagactcccgagtagctgggattataggcgcccgccaccaygcctggctaatttttttgtatttttagtagagacggggtttcaccatgttggccaggctggtcttgaactcctgacctcaggtgatccacccgcctcagc

SEQ ID NO: 43523 - DNA, 201 bp, Homo sapiens
gaagggccacttagctaaccaaggatgctggattcagctacagaacccaagcccggggcactcagtggtggtcttggggagccttgatcttggcctggccyggggagcctttgaggattacagcaggcaggaggctggacgaggcaggaaaaaacaaggagatcaacctcaaccagaaggtgataggaggtggggactggg

SEQ ID NO: 43524 - DNA, 201 bp, Homo sapiens
tgaggcagaagaatggcatgaacccgagaggtggaggttgcagtgagccgagatcatgccactgcactccagcctgggtgacagagcaagactccgtctcaaaaaaaaaaaaagaaaaaagaaaagaaaagcgtttggtgcctatgttgttcccagcgcctgccccacagcagccttgtcaatgtttaagtacgggtaaca

SEQ ID NO: 43525 - DNA, 201 bp, Homo sapiens
ggactgggcaggtgaggactgagctggggtctgcactgccttccccacctgatgtactaagggtctcccctccccagcccaccccacctttctgccccagrtgggctcactctctctccaccaataccctggggagcctggtcagaatcaaaaatgtctgcaaagtgtcatattttagctctaaaagtcaagaacttgacg

SEQ ID NO: 43526 - DNA, 201 bp, Homo sapiens
tcccaggatgggggaagtgtgaacagagggtgtggtggcccaggtgagcgcagggagtctgctgtagctagaggtgaggtcaggttgggtttacggcaggygccggggcttggagagcatcaggggattgaagctgttgtatttgtccagctgcgttgtgccaagagctgcaaaggtacaggcagattctaaaatcgttta

SEQ ID NO: 43527 - DNA, 201 bp, Homo sapiens; identical to SEQ ID NO: 11309

SEQ ID NO: 43528 - DNA, 201 bp, Homo sapiens
ccgaaagtgagtggggcccccaactgggccctgggaagcagccaggccctctggtgggacaggcagcctctccgcccagccccactgccacccaaggctcrggctggtcctcggtggcccacgcctgttgccctgcaaaaatggccctgggaagaaagccggggggcttgcattctagcctggccctgttctctctggcta

SEQ ID NO: 43529 - DNA, 201 bp, Homo sapiens
gctacggcgtcaccatcctgggcctgctgctgctgcgctggaggcggcctgcactccacaggcccatcaaggtgaggccctgggacagctggccctgtgcygggtgctgccagagccacccctgcatccacagtgggcaccaggggcaggtgggatgggaggtgccagcttttgtggagtgttgggccctgctcagggctc

SEQ ID NO: 43530 - DNA, 201 bp, Homo sapiens
ctgggctgtcgccaagagggggtgtagtgggtgcaattgcccttcaggcctcagctcccagggaagggaggaaaattccccagacccccaggggtcggggrtacagacagctggaggccctgcaccatcggtgtttctgctcccccttccccaggtgaaccttctcatccccgtggcgtacttggtcttctgggccttcct

SEQ ID NO: 43531 - DNA, 201 bp, Homo sapiens
gaggatggggtagcagctcagtccgcccctaccccaggcccctcgatgccagtctgagctcggccacccaggagagctcaggggctccaggctgggattgyctttcttcccgtaaatcaccacagagtgaaggtcaggacttcagagcccacagtctcaccctggcttacaggtggggaaaccgaggccctgagataggat

SEQ ID NO: 43532 - DNA, 201 bp, Homo sapiens
ggccggggcctggagaccagacctccctcttagaggctcaccccagagcagggtgtcctagcagctgaggtgggaacacagggcccagccgccaccaaatrtctcttcccaagatgtacccaaagtttccagaaccacgggtaccgacggagcaactccctgaagacccctgcccaaggggaggtgtccggagctgggggt

SEQ ID NO: 43533 - DNA, 201 bp, Homo sapiens
cggctcctgcaggggtttgtgggccagatgtgtgttcagtgactcaggagttgacatcatgaacctcaactcctcaggaaccaatccctgctcacccagcytcagccaggaccctccctggtctccagggctgcaggtggctgggcttcccagaggggtggacctctgcagaaccccagcccctcctcaccggggccctga

SEQ ID NO: 43534 - DNA, 201 bp, Homo sapiens
agatcagccacctgcccgggctccatcctgccctgagcaggaggacagaggggtgaaatttcccttcagaaaattccagctgctataggggatgccattcycgggccgcctgggctggacttggccatggtccactgtgaaaggtcccggcctcggcgcccacccccgccttccctccgcagtgctcctgacatgggtgaa

SEQ ID NO: 43535 - DNA, 201 bp, Homo sapiens; identical to SEQ ID NO: 11314

SEQ ID NO: 43536 - DNA, 201 bp, Homo sapiens
cagagtggaaactaaggttggaagtgaaatgatactgctccaaggggtaggctcaggatttggaaccagatttgggctctgttcccagtccagtgcctattttattttattttattttattttatttatttattttattttattttatttattttattttattttattttatattttattttatattttattttattaaaa

SEQ ID NO: 43537 - DNA, 201 bp, Homo sapiens
agagtggaaactaaggttggaagtgaaatgatactgctccaaggggtaggctcaggatttggaaccagatttgggctctgttcccagtccagtgcctattttattttattttattttattttatttatttattttattttattttatttattttattttattttattttatattttattttatattttattttattaaaac

SEQ ID NO: 43538 - DNA, 201 bp, Homo sapiens
aaatgatactgctccaaggggtaggctcaggatttggaaccagatttgggctctgttcccagtccagtgcctattttattttattttattttattttatttatttattttattttattttatttattttattttattttattttatattttattttatattttattttattaaaacaaactcttgctccatagcacaaact

SEQ ID NO: 43539 - DNA, 201 bp, Homo sapiens
aatgatactgctccaaggggtaggctcaggatttggaaccagatttgggctctgttcccagtccagtgcctattttattttattttattttattttatttatttattttattttattttatttattttattttattttattttatattttattttatattttattttattaaaacaaactcttgctccatagcacaaacta

SEQ ID NO: 43540 - DNA, 201 bp, Homo sapiens
caaggggtaggctcaggatttggaaccagatttgggctctgttcccagtccagtgcctattttattttattttattttattttatttatttattttattttattttatttattttattttattttattttatattttattttatattttattttattaaaacaaactcttgctccatagcacaaactatagtgcagtggca

SEQ ID NO: 43541 - DNA, 201 bp, Homo sapiens
ctcgtgggcgacacgtacacgctcatcaactatgtgtccttcatcaactacctctgctacggcgtcaccatcctgggcctgctgctgctgcgctggaggcrgcctgcactccacaggcccatcaaggtgaggccctgggacagctggccctgtgccgggtgctgccagagccacccctgcatccacagtgggcaccagggg

SEQ ID NO: 43542 - DNA, 201 bp, Homo sapiens
gggtaggctcaggatttggaaccagatttgggctctgttcccagtccagtgcctattttattttattttattttattttatttatttattttattttattttatttattttattttattttattttatattttattttatattttattttattaaaacaaactcttgctccatagcacaaactatagtgcagtggcatgat

SEQ ID NO: 43543 - DNA, 201 bp, Homo sapiens
aagggttagcctggtgtggtggtgcgcacctgtggtcccagctacttgagaggctgaaatgggaggatcgcttgagcccgggaggttgaggctgcagtgascggtgctagggccaccgtactccaacctgggtgacagagggagaccctgtctcaaaaaaaaaaaaaaaattaaagaaaatgagactcaggaactgttcaa

SEQ ID NO: 43544 - DNA, 201 bp, Homo sapiens; identical to SEQ ID NO: 11306

SEQ ID NO: 43545 - DNA, 201 bp, Homo sapiens
ggtaggctcaggatttggaaccagatttgggctctgttcccagtccagtgcctattttattttattttattttattttatttatttattttattttattttatttattttattttattttattttatattttattttatattttattttattaaaacaaactcttgctccatagcacaaactatagtgcagtggcatgatc

SEQ ID NO: 43546 - DNA, 201 bp, Homo sapiens
gtaggctcaggatttggaaccagatttgggctctgttcccagtccagtgcctattttattttattttattttattttatttatttattttattttattttatttattttattttattttattttatattttattttatattttattttattaaaacaaactcttgctccatagcacaaactatagtgcagtggcatgatca

SEQ ID NO: 43547 - DNA, 201 bp, Homo sapiens
taggctcaggatttggaaccagatttgggctctgttcccagtccagtgcctattttattttattttattttattttatttatttattttattttattttatttattttattttattttattttatattttattttatattttattttattaaaacaaactcttgctccatagcacaaactatagtgcagtggcatgatcat

SEQ ID NO: 43548 - DNA, 201 bp, Homo sapiens
aggctcaggatttggaaccagatttgggctctgttcccagtccagtgcctattttattttattttattttattttatttatttattttattttattttatttattttattttattttattttatattttattttatattttattttattaaaacaaactcttgctccatagcacaaactatagtgcagtggcatgatcata

SEQ ID NO: 43549 - DNA, 201 bp, Homo sapiens
tgccctgagcaggaggacagaggggtgaaatttcccttcagaaaattccagctgctataggggatgccattctcgggccgcctgggctggacttggccatsgtccactgtgaaaggtcccggcctcggcgcccacccccgccttccctccgcagtgctcctgacatgggtgaacagctccagtgtgcgctgggccacgcgc

SEQ ID NO: 43550 - DNA, 201 bp, Homo sapiens
aatgcctgcatcaaataaaagcatcccttcccagccatcatccaggtaccgtggccgtggggcgatgtccagattgcaggggccagggtggctggtcaggragagcttcctggaggtggtgctgcttcagggagaccagtgagctgggcagaggcctaccacagtgagggacatgttccctgagcagactgtttccttggc

SEQ ID NO: 43551 - DNA, 201 bp, Homo sapiens
tggggcgatgtccagattgcaggggccagggtggctggtcagggagagcttcctggaggtggtgctgcttcagggagaccagtgagctgggcagaggcctrccacagtgagggacatgttccctgagcagactgtttccttggcccagcacagatatgcagggtgcatcccctctgctgaagtcacggttggactagccct

SEQ ID NO: 43552 - DNA, 201 bp, Homo sapiens
agccccctccctcctccgtgcccaagcccgcagccccggctgctccatgcagtgccccacccatccttcatggtgccgggagcagccagtgtgcggagtgygtgatgcgattttctgccaccttcaaacatgatcctgagggagatgctgcgagtggtctaggcccagagggagaaacccctgaggacctcagagacactg

SEQ ID NO: 43553 - DNA, 201 bp, Homo sapiens
caagggagaaagtcctgaactgtggcctgaggccacgtgttccaaacaatagtggcctctccacccctggcaagcccagtatctgagtcttcagccactgrgcacaaggctagtgatacagccctggaagatagggtgccagatgtggcttaccccggagctccacccaggaggccccaccaagcagaagcatggtgggct

SEQ ID NO: 43554 - DNA, 201 bp, Homo sapiens
gggggcgtgacggctctgggctccctctgctatgcagagctgggagtcgccatccccaagtctggcggggactacgcctacgtcacagagatcttcggggrcctggctgggtgagtgtggggcaccagcgggcagggggacaccctcttgggaatgggatggccaaatgagccctggcatcagtttccactcctgcttccg

SEQ ID NO: 43555 - DNA, 201 bp, Homo sapiens
ccagcccccgctggcttccaacctccctggctttcggcaaatcccagtccgccaggtcctgagaacagaggccctgctgccggatggagggaactcaaagrctctttagaaaccttacagcccacccaggcctgggcccctctgctagatgagagaggcgcttctctctctcccccgagaagtagactaagggtacagctt

SEQ ID NO: 43556 - DNA, 201 bp, Homo sapiens
acagcccacccaggcctgggcccctctgctagatgagagaggcgcttctctctctcccccgagaagtagactaagggtacagcttacctctgggggctggrgcacaggaattagttcgtccttatctggatgtatttagggctcctgggatgtgactggaaaactgagtggggcgtcgtagctgtccagactggaaatctg

SEQ ID NO: 43557 - DNA, 201 bp, Homo sapiens
gaagtgggtggtcaattgagcccaggagttcgagaccagcctcagcaacatagtgggacccctcaactctacaatttttttttgattagccgggtgtggtkgcactcacctgtaatcctagcactttgggaatccaagcagggagggtcacttgagcccaggagttggagaccagcctaggcaatatagtgagaacctgtc

SEQ ID NO: 43558 - DNA, 201 bp, Homo sapiens
cctgtctaaatgaaagaaagaagctgggcacagtgactcatgcctgtaatcccagcactttgggaggccgaggcgggtggatcacttgcagtcaggagttygagaccagcctgatccacagggtgaaaccccatctctactaaaaaagtacaaaaaatattagccaggcgtggtggctcatgcctgtaattctaactactt

SEQ ID NO: 43559 - DNA, 201 bp, Homo sapiens; identical to SEQ ID NO: 11312

SEQ ID NO: 43560 - DNA, 201 bp, Homo sapiens
ggcaggacaagtggctgcatgctgatatgcctggggctctgaggtagacgggagggctgagcatgggccttgtggggtgcctgaggagccaccgtctgccrtcgctcaggtggttcagcctcctcactttgctggccccgcctcacgggggcaatggagggctgagaaagtcaaacagggcctgtctctggcagaggggcc

SEQ ID NO: 43561 - DNA, 201 bp, Homo sapiens; identical to SEQ ID NO: 11307

SEQ ID NO: 43562 - DNA, 201 bp, Homo sapiens
tcatccccgtggcgtacttggtcttctgggccttcctgctggtcttcagcttcatctcagagcctatggtctgtggggtcggcgtcatcatcatccttackggggtgcccattttctttctgggagtgttctggagaagcaaaccaaagtgtgtgcacagactcacaggtgagccgggcagctgcaggtcacccagcacag

SEQ ID NO: 43563 - DNA, 201 bp, Homo sapiens
ctgcatcccccccaccacagcctcccgggtgctgtccatggcctgcctgagtaagcatcccctttggcccactgtccccagatcagccacctgcccgggcyccatcctgccctgagcaggaggacagaggggtgaaatttcccttcagaaaattccagctgctataggggatgccattctcgggccgcctgggctggactt

SEQ ID NO: 43564 - DNA, 201 bp, Homo sapiens
gggtttggcagcaggacccaggagagggggcgggttagccagcaattgggggcagcagtgggcagacccagcctgcagaaggccagctgctccctgagctsggatcctggtgggcactggacactcgcctggtctggaggccttggactccaaagtccccacctgagaatgggtccatgtcctgcccccacataggggttt

SEQ ID NO: 43565 - DNA, 201 bp, Homo sapiens
taatttttgtattttttgtagagactgggttttgccatgttgcccaggctgatctcaaattcctaggctcaagtgatcctcccacctcagcctcccagagkgttagggttacaggcgggagccatcatgcccggtcccagtgccctttatactgttctgatgctgggcaaattggggccagagtcagagccctgacggggg

SEQ ID NO: 43566 - DNA, 201 bp, Homo sapiens
attccagggtgggggttgggggtggggccagggctcatcctgcaggggcgtcaggaggcaggctaggggccagccgtcagccccaggtcctctcccagtgyggggccacagccgtcatcatgctcgtgggcgacacgtacacgctcatcaactatgtgtccttcatcaactacctctgctacggcgtcaccatcctgggcc

SEQ ID NO: 43567 - DNA, 201 bp, Homo sapiens
ggttgtggcccaagcaattgggaggacgttttgccatttattcatcagggaagatcgagaggagcattctgggggcaaggaggtaaaagtcgggaattccrttttgaacacggaaagtctgtgatgtccgcggctgagtggttcgttgcatatacagatttcatttagcagagcagtctatgctagggatataaatttagg

SEQ ID NO: 43568 - DNA, 201 bp, Homo sapiens
aaatggttttccaaactggtggtaccaactccacatccttgccaacattgggtgtgtaattttcaccattttggtggctactcagtggtatcttattctcrttttaatttgcatttccctgatggcccatgaggtttgagtgcctgttcaggagtttaacagtcattggacatcctcttttgggaagcacctatttaaagt

SEQ ID NO: 43569 - DNA, 201 bp, Homo sapiens
ctcaggatttggaaccagatttgggctctgttcccagtccagtgcctattttattttattttattttattttatttatttattttattttattttatttattttattttattttattttatattttattttatattttattttattaaaacaaactcttgctccatagcacaaactatagtgcagtggcatgatcatagct

SEQ ID NO: 43570 - DNA, 201 bp, Homo sapiens
gatttggaaccagatttgggctctgttcccagtccagtgcctattttattttattttattttattttatttatttattttattttattttatttattttattttattttattttatattttattttatattttattttattaaaacaaactcttgctccatagcacaaactatagtgcagtggcatgatcatagctcactg

SEQ ID NO: 43571 - DNA, 201 bp, Homo sapiens
ggccccgacgcggcccccctggatcttttccgccggcctcggctgcacagtccggacggcttccgggaggaggcagcctccctcggatccccgcactcccraccctctcccgcgaccacagcctccttctccgtgtctcccgggcattccaggtcgcctggccttcttgggccgggctggatcgcgcgggacctgcaccag

SEQ ID NO: 43572 - DNA, 201 bp, Homo sapiens
atttgggctctgttcccagtccagtgcctattttattttattttattttattttatttatttattttattttattttatttattttattttattttattttatattttattttatattttattttattaaaacaaactcttgctccatagcacaaactatagtgcagtggcatgatcatagctcactgcagcctcgacctc

SEQ ID NO: 43573 - DNA, 201 bp, Homo sapiens
caattgggggcagcagtgggcagacccagcctgcagaaggccagctgctccctgagctgggatcctggtgggcactggacactcgcctggtctggaggccytggactccaaagtccccacctgagaatgggtccatgtcctgcccccacataggggtttctgggcaggcagagagctcagaggtcatgggaatggcagtgg

SEQ ID NO: 43574 - DNA, 201 bp, Homo sapiens
tttgggctctgttcccagtccagtgcctattttattttattttattttattttatttatttattttattttattttatttattttattttattttattttatattttattttatattttattttattaaaacaaactcttgctccatagcacaaactatagtgcagtggcatgatcatagctcactgcagcctcgacctcc

SEQ ID NO: 43575 - DNA, 201 bp, Homo sapiens
ttacagagtggaaactaaggttggaagtgaaatgatactgctccaaggggtaggctcaggatttggaaccagatttgggctctgttcccagtccagtgcctattttattttattttattttattttatttatttattttattttattttatttattttattttattttattttatattttattttatattttattttatta

SEQ ID NO: 43576 - DNA, 201 bp, Homo sapiens; identical to SEQ ID NO: 11331

SEQ ID NO: 43577 - DNA, 201 bp, Homo sapiens
gcccgcagccaggggaccgggcttcttcatcacccaggcttgctgtccccgtagctgtgggtttgcaaacgggggcctggactagctacatggaggctgcyctggtgcacactggggtccctatatcttggggtgtctgggtggagggtcgtcctggaatcctgttgttgttcctgctgcaggtcccgggcagcccagtca

SEQ ID NO: 43578 - DNA, 201 bp, Homo sapiens
accgggagactcagcagtgcggttcctgccttaggtaagtaagcactttctctccttcctccactccttcagtcccttttgggtgagtggtccctgaagayaggccttcagggtcctggcactaccccgagttcctgtgtgcatcttttctacatcacaaaggagctgtttggctttggacaggcttcaacttgtctgagc

SEQ ID NO: 43579 - DNA, 201 bp, Homo sapiens; identical to SEQ ID NO: 11333

SEQ ID NO: 43580 - DNA, 201 bp, Homo sapiens
agctgtgatcgcaccactgcactccagcctgggagacagagcaagatcttgtctcagaaaaaaaaaaaaaaaaaggagtccctgcctagaacttgcagctscctgcacagagcccagcctccctcctgcctcccatcccctctgcatgaggctgggctgctgctgcacccaccatggtctctgccaacccgctttggagaa

SEQ ID NO: 43581 - DNA, 201 bp, Homo sapiens
tgtcctcaagtttcatccatgtcatagtatgtgtcagaatttccttctgttaagactgaataggtggctcacacctgtaatcccagcactttgggaggccraggcaggtggatcacctgaggacaggagtttgagaacagcctggccaatgtggcgaaacactgtctctactaaaaatacaaaaattagccaggtgtggtg

SEQ ID NO: 43582 - DNA, 201 bp, Homo sapiens
taaacgattttagaatctgcctgtacctttgcagctcttggcacaacgcagctggacaaatacaacagcttcaatcccctgatgctctccaagccccggcrcctgccgtaaacccaacctgacctcacctctagctacagcagactccctgcgctcacctgggccaccacaccctctgttcacacttcccccatcctggga

SEQ ID NO: 43583 - DNA, 201 bp, Homo sapiens
tccctccgaaggttgacagagccacggagacaggcatgacccaagaaaagtagcccagcagcttctccccgaaggtctgggtgggcacagtagagaggccrtgtgtaaggccggggcaggggcctgggcaggagccagggaccgagcaggggcccactcaccacagccaccgcattggaggagagcagctcctggggggac

SEQ ID NO: 43584 - DNA, 201 bp, Homo sapiens
tagccagagagaacagggccaggctagaatgcaagccccccggctttcttcccagggccatttttgcagggcaacaggcgtgggccaccgaggaccagccygagccttgggtggcagtggggctgggcggagaggctgcctgtcccaccagagggcctggctgcttcccagggcccagttgggggccccactcactttcgg

SEQ ID NO: 43585 - DNA, 201 bp, Homo sapiens; identical to SEQ ID NO: 11343

SEQ ID NO: 43586 - DNA, 201 bp, Homo sapiens
gtggtggctttataccaccggcaagctgccgagggtcccgtggaattgacatcttgtgcctcattgcaggccatgagcttcctaggatttaatttataggrgtatgactgaggggtgacacagagaggcccatgccagggaaagaaggctttattaattttcttgaaaggaggggacatgctacgccatgcagggccacct

SEQ ID NO: 43587 - DNA, 201 bp, Homo sapiens
ccatgaagtcacaagttgtggccttgcccttggccatggccacccttggctggactcgatcccaccatgggggaggcctgtgctgaagcccccttcccccyactgcaacccgcatcccaaccaaagatgggccggcctttctcggcctcctctcccgacagcggcctgcagtgggaagctggagcagcacacggagcggcg

SEQ ID NO: 43588 - DNA, 201 bp, Homo sapiens; identical to SEQ ID NO: 11346

SEQ ID NO: 43589 - DNA, 201 bp, Homo sapiens
ccgtaaccccccgggccagagcagaaggtgaaagtaagggccaaaccccacggaggtgggtgcttgaggggtggctggggagttctgctttcctcctcaargtcagcttggcacgggggaagaggatggttccgtcactagctgcgtgccctgtaaatggggattatcagaactgcctcccctcctgcctctgctgctgct

SEQ ID NO: 43590 - DNA, 201 bp, Homo sapiens; identical to SEQ ID NO: 11348

SEQ ID NO: 43591 - DNA, 201 bp, Homo sapiens
agttgggtttccccccaccccccgactctgggcccgtaaccccccgggccagagcagaaggtgaaagtaagggccaaaccccacggaggtgggtgcttgargggtggctggggagttctgctttcctcctcaaagtcagcttggcacgggggaagaggatggttccgtcactagctgcgtgccctgtaaatggggattatc

SEQ ID NO: 43592 - DNA, 201 bp, Homo sapiens
ccagggcttccgtctgtcttacatccgaggtgatggaggctgcagggcaggcaggacaccacggagcacaccgtgcatgcccacaggctcccggcccacargggcggcaccctccacagggccccggctccctgtgggatgtcccctgaccgccctgtcaatctcaggacagtggcaggactgggcatgcggatgccttgg

SEQ ID NO: 43593 - DNA, 201 bp, Homo sapiens
cccgcctggccccgggcctgggagggcgactctggtggcgcagccccggctcccgccccgctcggagtagcgcccggagcccgggctgagcgctggcaggmggcccttcgtgcaggcggcagccttcaacccggcccgcccgcgctgagcctggagacgagggggccccgggagctggggacaaaggccaggccggctgtc

SEQ ID NO: 43594 - DNA, 201 bp, Homo sapiens
agtggtcccgaggtggagggttctgggcccttgggccactgcccttttggggagggtgtcggggcagggggctcttgacttcctgctccacttcggcttckggctgggggtactgtgtgcactgatggagggaaggggagccgcagcagagctggaaatgacctgcgtggatgtcgcaattcttcatggagcctcccgtgc

SEQ ID NO: 43595 - DNA, 201 bp, Homo sapiens
atgtcggagaagacataaaggacacatgtgagagactgcatgtgtgagcacatgtatgtgcacgagccatgcctgcaaaggtgcagagagcgtgtatgtgygcatgcatgtaagataacaggtgtaaccatgtgtgaaccgtaagcatgtatgtgcacatgtgaatgcatgcacgcaagtgtgtccagtgctctgggtctc

SEQ ID NO: 43596 - DNA, 201 bp, Homo sapiens; identical to SEQ ID NO: 11337

SEQ ID NO: 43597 - DNA, 201 bp, Homo sapiens
tcgcaggatgggctatgccggctgggcaggcctaggggtgtgggattctccactgacccgaggccacgaggctacaccttggaggtgccggctggcaggasgggttgttggtgggttttctcccagctctgccagagatgcgggggacaggacctaggctgtagtccactgcatagggttgggggctacagctgcctcaag

SEQ ID NO: 43598 - DNA, 201 bp, Homo sapiens
acaagttgtggccttgcccttggccatggccacccttggctggactcgatcccaccatgggggaggcctgtgctgaagcccccttccccccactgcaaccbgcatcccaaccaaagatgggccggcctttctcggcctcctctcccgacagcggcctgcagtgggaagctggagcagcacacggagcggcgtggggtcatc

SEQ ID NO: 43599 - DNA, 201 bp, Homo sapiens
accacctccatgaagtcacaagttgtggccttgcccttggccatggccacccttggctggactcgatcccaccatgggggaggcctgtgctgaagcccccktccccccactgcaacccgcatcccaaccaaagatgggccggcctttctcggcctcctctcccgacagcggcctgcagtgggaagctggagcagcacacgg

SEQ ID NO: 43600 - DNA, 201 bp, Homo sapiens; identical to SEQ ID NO: 11344

SEQ ID NO: 43601 - DNA, 201 bp, Homo sapiens
cttccccccactgcaacccgcatcccaaccaaagatgggccggcctttctcggcctcctctcccgacagcggcctgcagtgggaagctggagcagcacacrgagcggcgtggggtcatctacagcccggcctggcccctcaactacccgccaggcaccaactgcagctggtacatccagggcgaccgtggtgacatgatta

SEQ ID NO: 43602 - DNA, 201 bp, Homo sapiens; identical to SEQ ID NO: 11347

SEQ ID NO: 43603 - DNA, 201 bp, Homo sapiens
cccctggtgcccactgtggatgcaggggtggctctggcagcacccggcacagggccagctgtcccagggcctcaccttgatgggcctgtggagtgcaggcygcctccagcgcagcagcagcaggcccaggatggtgacgccgtagcagaggtagttgatgaaggacacatagttgatgagcgtgtacgtgtcgcccacgag

SEQ ID NO: 43604 - DNA, 201 bp, Homo sapiens; identical to SEQ ID NO: 11332

SEQ ID NO: 43605 - DNA, 201 bp, Homo sapiens
aatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtgaggta

SEQ ID NO: 43606 - DNA, 201 bp, Homo sapiens
gaatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtgaggt

SEQ ID NO: 43607 - DNA, 201 bp, Homo sapiens
ggaagctggagcagcacacggagcggcgtggggtcatctacagcccggcctggcccctcaactacccgccaggcaccaactgcagctggtacatccagggygaccgtggtgacatgattaccatcaggtaggggcacccgggggtgtcggaaggaatcaatgtgggcccacgtgcatggggtgggtgagaatgtgtgtgtg

SEQ ID NO: 43608 - DNA, 201 bp, Homo sapiens
agaatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtgagg

SEQ ID NO: 43609 - DNA, 201 bp, Homo sapiens
gagaatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtgag

SEQ ID NO: 43610 - DNA, 201 bp, Homo sapiens
gctggctcagtgctgcagcaagaagctgaggcccccagaggcctacagtgattcctgactctgcccctccctaactgtgtggccccaggcaagtcgctgaycctctctgagcctgtttcctcacctggttccgagatctacctttggcggctttgcacttgtactcaggataaaactcaaattctgcacaaggtgtgatca

SEQ ID NO: 43611 - DNA, 201 bp, Homo sapiens
accacttcagcctcactgggccttcccttctgtggaacctcctgttcggccccctccaatgggaaagatctcttcttttggatttccttcttttttttaawtttttttggagaaaaagtcttgctgtgtcacccaggctggagtgcagtggtgtgatcttggttcaccacaacatccgcctcctgggttcaagcgattctc

SEQ ID NO: 43612 - DNA, 201 bp, Homo sapiens; identical to SEQ ID NO: 11336

SEQ ID NO: 43613 - DNA, 201 bp, Homo sapiens
gggcaggtctatgtctgtcccctaggggaggcctctggggctgagtaggaatggacagcgccttgccctgcccctggccttgtcctccaggacaggggacstcacaggtttttacccctcagcaaaaaggtgaacatgggaggttcccagccacgctgactcagaggctgacacttcagcttagcatgcgctttagagatg

SEQ ID NO: 43614 - DNA, 201 bp, Homo sapiens
aaccacctgcccgcttttggccccaggccccctggccgaagggaggctcttctgtctcctgactgtcccctgctacgtctccaccccacagggaagctggrccaggcatcctgccaggcagatgagttccgctgtgacaacggcaagtgcctgcccggcccgtggcagtgcaacacggtggacgagtgtggagacggctct

SEQ ID NO: 43615 - DNA, 201 bp, Homo sapiens
ttgagcctggaagttaaggctgcagtgagctgtgatcgcaccactgcactccagcctgggagacagagcaagatcttgtctcagaaaaaaaaaaaaaaaaaggagtccctgcctagaacttgcagctccctgcacagagcccagcctccctcctgcctcccatcccctctgcatgaggctgggctgctgctgcacccacca

SEQ ID NO: 43616 - DNA, 201 bp, Homo sapiens; identical to SEQ ID NO: 11339

SEQ ID NO: 43617 - DNA, 201 bp, Homo sapiens
gtgtgtgagcactcgtgtgaacaggtgtatgggtgtgtgcatgtgtgtgagcatttgtgagtaggtgtgtgtgcatgcagatgtgtgtgtgtgaggtaggygtgtgtaggtatttgagcaggtatgtggtgtgtgcatgcatgtgaacacatgtaagtaggtgtgtgtgcatatgtgtgtgtgtgcatgtatgtgaacaca

SEQ ID NO: 43618 - DNA, 201 bp, Homo sapiens; identical to SEQ ID NO: 11340

SEQ ID NO: 43619 - DNA, 201 bp, Homo sapiens
gaggagagagtgtcactgggctcgggaaaggggtcgtccctcacctcagtttttccatctgcaaaatgggccctgccttcatctcaggctgttgtgagaawcagatggaccagcgtggggaagggtcagggtgctgtggggtgggaggtgtggtcaagtgcaggggccagccgcctggtcctgggagggtcagggcacagc

SEQ ID NO: 43620 - DNA, 201 bp, Homo sapiens
gttgttcctgctgcaggtcccgggcagcccagtcatgtcgccctccgcccactgcttctagggccttcgagacccagatgacgcgcctggaggctgagttygtgcggcgggaggcacccccatcctatggtcagctcatcgcccagggcctcattccacccgtggaggactttcctgtctacagtgcgtcccaggtgagcc

SEQ ID NO: 43621 - DNA, 201 bp, Homo sapiens
cagcggcctgcagtgggaagctggagcagcacacggagcggcgtggggtcatctacagcccggcctggcccctcaactacccgccaggcaccaactgcagytggtacatccagggcgaccgtggtgacatgattaccatcaggtaggggcacccgggggtgtcggaaggaatcaatgtgggcccacgtgcatggggtgggt

SEQ ID NO: 43622 - DNA, 201 bp, Homo sapiens
aggctgacacttcagcttagcatgcgctttagagatgcaatgtgggggaccataccacttcagcctcactgggccttcccttctgtggaacctcctgttcrgccccctccaatgggaaagatctcttcttttggatttccttcttttttttaaatttttttggagaaaaagtcttgctgtgtcacccaggctggagtgcag

SEQ ID NO: 43623 - DNA, 201 bp, Homo sapiens
aggcacccgttgtcagggttttgctgagaggcagggcagctggcagttgtcccttcctctgctcctgatgtggctggtggcctcccaacccctgatgaagrggtcagacataggtctatgagggagaagggttctggctgaagtgagtgggaagagagaaaggtggcaggtgacacctggcttttcccagaaagcgtgggt

SEQ ID NO: 43624 - DNA, 201 bp, Homo sapiens
caggtaaccattgatccctccgaaggttgacagagccacggagacaggcatgacccaagaaaagtagcccagcagcttctccccgaaggtctgggtgggcrcagtagagaggccatgtgtaaggccggggcaggggcctgggcaggagccagggaccgagcaggggcccactcaccacagccaccgcattggaggagagca

SEQ ID NO: 43625 - DNA, 201 bp, Homo sapiens
caggaaaggacactggcccgaaagtacctggtcattccttccctacttgtgtgggccaccatggctccgagggcccaggccatcttctgcctgagagaagkcaggtcacctccagctgaagctcagacagacctcttgacagcccccaacacctccgaacccctccctcttccccattatcccgcaaatcatgcagtcctc

SEQ ID NO: 43626 - DNA, 201 bp, Homo sapiens
ctctggcaggcccttgccccagctgtgtgagcctggctcagtgggaatgtgccattggggagcattgagggtgtaaccccagcgcgcccaccccaacctcrgtgcggggtcatgtgtgctgggctctgagctgctgggtgctggcatccctggtgagcagagcagggggacaggcgctccatgcttaggagctttggcctg

SEQ ID NO: 43627 - DNA, 201 bp, Homo sapiens
cggtggggcaggaggtgcctgggtttctagttctgtgcagggcccggcttgctggagaaaggacccggagctgtcaggcagcgggacccctgctgtggtcraaggggaggcccagggtgcacagaagctgtgctcactggctcctctggcaggcttgggcctctttccctctctctctgccctgagctgtgctctcaggag

SEQ ID NO: 43628 - DNA, 201 bp, Homo sapiens
cggtggcatgtgcctgtagtcttagctactcgggagactgaggcaggatgattgcttgagcccaggagtttgagattgtagtgggctatgacggctccacygtgctccagcctgggtgacagagcgagaccctgtctgtaaaaccaaaaccaaaacctgaggtcaaggtgcagcccgggagaacaatgggggcctctgact

SEQ ID NO: 43629 - DNA, 201 bp, Homo sapiens
gagcaacatagtgaaactccatctctacaaaaaaaatctgaaaattagctgggcacggtggcatgtgcctgtagtcttagctactcgggagactgaggcargatgattgcttgagcccaggagtttgagattgtagtgggctatgacggctccactgtgctccagcctgggtgacagagcgagaccctgtctgtaaaacca

SEQ ID NO: 43630 - DNA, 201 bp, Homo sapiens
ctaggatttaatttataggagtatgactgaggggtgacacagagaggcccatgccagggaaagaaggctttattaattttcttgaaaggaggggacatgcyacgccatgcagggccacctgggaattactagatttggacaagcaggagcaggggtggaagaaaggtgtaagttagaagctgcatcacagcttccgtggga

SEQ ID NO: 43631 - DNA, 201 bp, Homo sapiens; identical to SEQ ID NO: 11335

SEQ ID NO: 43632 - DNA, 201 bp, Homo sapiens
ctgtgctgggtgacctgcagctgcccggctcacctgtgagtctgtgcacacactttggtttgcttctccagaacactcccagaaagaaaatgggcaccccmgtaaggatgatgatgacgccgaccccacagaccataggctctgagatgaagctgaagaccagcaggaaggcccagaagaccaagtacgccacggggatga

SEQ ID NO: 43633 - DNA, 201 bp, Homo sapiens
ctgactctgcccctccctaactgtgtggccccaggcaagtcgctgaccctctctgagcctgtttcctcacctggttccgagatctacctttggcggctttscacttgtactcaggataaaactcaaattctgcacaaggtgtgatcagatccaggtggcgtttccagccacagctggactttgccacctctcttcaggcct

SEQ ID NO: 43634 - DNA, 201 bp, Homo sapiens
gcttgggcctctttccctctctctctgccctgagctgtgctctcaggagcccggcctcctctgatgcttcgggctggctcaaggccgggccttgctcagcrctgacctagccccagccctgtctgctgtcctggtccacacaactgatggaggcccagtctcccatcccaatttccaggaaaaggctgactggcccagcct

SEQ ID NO: 43635 - DNA, 201 bp, Homo sapiens
ggcccaggatggtgacgccgtagcagaggtagttgatgaaggacacatagttgatgagcgtgtacgtgtcgcccacgagcatgatgacggctgtggccccrcactgggagaggacctggggctgacggctggcccctagcctgcctcctgacgcccctgcaggatgagccctggccccacccccaacccccaccctggaat

SEQ ID NO: 43636 - DNA, 201 bp, Homo sapiens
ggtctctgctgccacagtgatggggaaccacctgcccgcttttggccccaggccccctggccgaagggaggctcttctgtctcctgactgtcccctgctaygtctccaccccacagggaagctgggccaggcatcctgccaggcagatgagttccgctgtgacaacggcaagtgcctgcccggcccgtggcagtgcaacac

SEQ ID NO: 43637 - DNA, 201 bp, Homo sapiens; identical to SEQ ID NO: 11352

SEQ ID NO: 43638 - DNA, 201 bp, Homo sapiens
gagtgcgctcttgctttgactgatgctgcccaaggacctctgatcagcaccaggggagaggaggggctgctcagggagctggggtcctccggattccatcyacagcagggccagactctccccaggaaatgggacagggtggcagcggaggcttgagaaccacgggggttggcactggctggcaagggaggaagaggccgc

SEQ ID NO: 43639 - DNA, 201 bp, Homo sapiens
tgggaaggccctgtttatatgaattagaaaaagacacaccttcctttgtgggatgcagcctctgtctgtgctaggatatagaacttggagaatggagcctygggatggattccagcctaactacctcagctgggagtttttgcagaaacgacctgtacagctgtatgcagtggctctggccatccaagcctttttcaacac

SEQ ID NO: 43640 - DNA, 201 bp, Homo sapiens
atctttttggaatgggctatacagagatgtgctttttaaaatgttaagagtgtaaaaggacaaacagtgaaaaataaatcttcctcttattttgtcctccmgtctcccaattcctctactcagaggtgagaacagaacttccacaccctccagaacctccacagttagaactgtctacatgtttccattgtctttactttt

SEQ ID NO: 43641 - DNA, 201 bp, Homo sapiens
gcccggagtccggagcccagagaggagagagacagctggggagcctggtcaccgcgggcatctcccctgcgctgcagtcgcccgcctggcctgccttcccrttcctccgcctcttgccctgacttctccttcctttgcagagccgccgtctagcgccccgacctcgccaccatgagagccctgctggcgcgcctgcttctc

SEQ ID NO: 43642 - DNA, 201 bp, Homo sapiens
actagggtctgggagtgtggatggaatagtggcagatgacagggcttttaaagccaagcaggggattttaaacttgatgtggtagaaaatggggctgcgtsaggcacagtggctcatgcctgtaatcccagcactttgggaggccgaggtggatggatcacttgaggccaggagtttgagaccggcctggccaacatggtg

SEQ ID NO: 43643 - DNA, 201 bp, Homo sapiens
ggaaatgaagtcatctgctctcagcaatcagcatgacagcctccagccaagtaatctggagtcatgagagctgctaggggagcaacatgaatcatgacggyccctgggaatttcctgataactaacctgggagtttcggggtaagtcctcaggctgcagcatctctgtttatgttctggtcacgtttatttacaattaatg

SEQ ID NO: 43644 - DNA, 201 bp, Homo sapiens; identical to SEQ ID NO: 11350

SEQ ID NO: 43645 - DNA, 201 bp, Homo sapiens
tgtgctgctgacccacagtggaaaacagattcctgccaggtgagtgttccaagcatctctctccacctcttccatatctccccagagctcctgggcttgtyccagccagcttaagggtgtctctctctagccaaagccctaagtagccagaatcaggagctcaggtctttgagggtttaaaccagtccttatgtgtttgcc

SEQ ID NO: 43646 - DNA, 201 bp, Homo sapiens
ctacttcctcggcacttggaggggacagatggggaccgcctaaccagtagtgatctttctcctctgaccctctgtcctcccccagccttgctgaagatccrttccaaggagggcaggtgtgcgcagccatcccggactatacagaccatctgcctgccctcgatgtataacgatccccagtttggcacaagctgtgagatc

SEQ ID NO: 43647 - DNA, 201 bp, Homo sapiens
ctttgatgaagcctcctcccgaatctcttccagggcagcaatgaacttcatcaagttccatgtgagtatccacccctacaacagttggctgcacagacaarttgggaaggcttcaggggacatcccctccctgccctctgctgcagggctgcgccaccccttaccacttccactccccctcgcttaccccacctttgttct

SEQ ID NO: 43648 - DNA, 201 bp, Homo sapiens
agcccatggccttggggacaagtcgtgctttgaggcctctagggagggaaggaagaagtggcagatttcatgggactaagctgtttgatgggtatcttctyccacagtgattacccaaagaaggaggactacatcgtctacctgggtcgctcaaggcttaactccaacacgcaaggggagatgaagtttgaggtggaaaac

SEQ ID NO: 43649 - DNA, 201 bp, Homo sapiens
aatgaccccaagccctggttcctgacactaggggaaagagatgggggtgacagaatcacagaatccctgctatgttcctccaagtgtgcccagagatgcgtgtgtgtgtgtgtgtgtatacacaaatgtctgcttatcctcaggcaggaagggtggatgcagtcatttacacatggtctgtttttctggaggacaatttta

SEQ ID NO: 43650 - DNA, 201 bp, Homo sapiens
gcagctcagcaagcacagaagtctctccagaagacagtgggtcacctgcctcccaaaagctgaaaggctaacttgtactttccccagcaggcagctggcaycctgagccctcggctggggcagagcaaaggagccttcctccttcctaccttcctggcactctccctgccttccttctgtcactctcaggtggacccagac

SEQ ID NO: 43651 - DNA, 201 bp, Homo sapiens
agttccatgtgagtatccacccctacaacagttggctgcacagacaagttgggaaggcttcaggggacatcccctccctgccctctgctgcagggctgcgccaccccttaccacttccactccccctcgcttaccccacctttgttctctccagcgaactgtgactgtctaaatggaggaacatgtgtgtccaacaagtac

SEQ ID NO: 43652 - DNA, 201 bp, Homo sapiens
tccagtcttctggcaggtctgaaacgacatctttaaaatgtccgttggcagccgggcatggtggctcacgcttgtaatcccagcattttgagaggtcaagkttgagtggatcatttgaggtcaggagttcaagaccagcctggacaacatggtgtaaccctgcctctactaaaaatgcaaaaatcagcctggcatggtggt

SEQ ID NO: 43653 - DNA, 201 bp, Homo sapiens
ggtcacgtttatttacaattaatgggttctcaaatccaaacaaaactgaccacagtcttctagaggaagtagcaaggttggctctgaagcctatagcatckctgactcagtctgtcccctggaaggctggcagctcagcaagcacagaagtctctccagaagacagtgggtcacctgcctcccaaaagctgaaaggctaac

SEQ ID NO: 43654 - DNA, 201 bp, Homo sapiens
tcatcttttgtatctttggcgtcacagggagactcagggggacccctcgtctgttccctccaaggccgcatgactttgactggaattgtgagctggggccktggatgtgccctgaaggacaagccaggcgtctacacgagagtctcacacttcttaccctggatccgcagtcacaccaaggaagagaatggcctggccctc

SEQ ID NO: 43655 - DNA, 201 bp, Homo sapiens
agtttgagtggatcatttgaggtcaggagttcaagaccagcctggacaacatggtgtaaccctgcctctactaaaaatgcaaaaatcagcctggcatggtrgtggatgcctgtagtcccagctacttgggaggctgaggcaggagaattgcttgaacctgggaggcagagatctcagtgagctgagatcacaccactgcac

SEQ ID NO: 43656 - DNA, 201 bp, Homo sapiens
ccagtcttctggcaggtctgaaacgacatctttaaaatgtccgttggcagccgggcatggtggctcacgcttgtaatcccagcattttgagaggtcaagtktgagtggatcatttgaggtcaggagttcaagaccagcctggacaacatggtgtaaccctgcctctactaaaaatgcaaaaatcagcctggcatggtggtg

SEQ ID NO: 43657 - DNA, 201 bp, Homo sapiens
tgtagtcccagctacttgggaggctgaggcaggagaattgcttgaacctgggaggcagagatctcagtgagctgagatcacaccactgcactccaactggrcgacagagcaagactccatctcaaaaaaaaaaaataaaagttagttggaatgttcttctctttctcatattctctcatcctcctgtccccttgtagataa

SEQ ID NO: 43658 - DNA, 201 bp, Homo sapiens
aggccctctgggttggaatgacatcccctatctttctgtgttgccaggaacccagacaaccggaggcgaccctggtgctatgtgcaggtgggcctaaagcygcttgtccaagagtgcatggtgcatgactgcgcagatggtgagcatcactgacctgctgatgacagtggggtggaaggggacaaacttacatgtcccctt

SEQ ID NO: 43659 - DNA, 201 bp, Homo sapiens
cagcgccacacactgcttcatgtacggccctgggtttctcctcttcgactcttctgccccaccccaagcacatccctttctccttcccagcaaagtgttcygcctcatttctccctcatctgcccctgtccatgcagcccatggccttggggacaagtcgtgctttgaggcctctagggagggaaggaagaagtggcagat

SEQ ID NO: 43660 - DNA, 201 bp, Homo sapiens
acaagtcgtgctttgaggcctctagggagggaaggaagaagtggcagatttcatgggactaagctgtttgatgggtatcttcttccacagtgattacccamagaaggaggactacatcgtctacctgggtcgctcaaggcttaactccaacacgcaaggggagatgaagtttgaggtggaaaacctcatcctacacaagga

SEQ ID NO: 43661 - DNA, 201 bp, Homo sapiens
gctcaaggcttaactccaacacgcaaggggagatgaagtttgaggtggaaaacctcatcctacacaaggactacagcgctgacacgcttgctcaccacaaygacattggtgagggggaaccccgcgactactgtggccataatggcttggggagagtgggacccagggagagactggagctgaggttgaagctgcccggtg

SEQ ID NO: 43662 - DNA, 201 bp, Homo sapiens
ggtgggggcaacaaggaccaaaagccctccctacagcttcccagaaaccttgttaccatccccttctcccagagggctggccatagcacaagagaagtgcrgcctctggttgagtcttccctgaggggaggaggcagggaaggccctctgggttggaatgacatcccctatctttctgtgttgccaggaacccagacaacc

SEQ ID NO: 43663 - DNA, 201 bp, Homo sapiens
ccccgacctcgccaccatgagagccctgctggcgcgcctgcttctctgcgtcctggtcgtgagcgactccaaagtgagtgcgctcttgctttgactgatgmtgcccaaggacctctgatcagcaccaggggagaggaggggctgctcagggagctggggtcctccggattccatccacagcagggccagactctccccagg

SEQ ID NO: 43664 - DNA, 201 bp, Homo sapiens
gatgggtgggaggcaagagcaggcaggagttaggagctggaggtagggtgggtgacatcttcatccctatgtgacaagcataaacacacacacacgctcaygaaacagtggccacacaaatgtgaggtggggttggaaggagaccctgtccagtcttctggcaggtctgaaacgacatctttaaaatgtccgttggcagcc

SEQ ID NO: 43665 - DNA, 201 bp, Homo sapiens
caattgcgactgacttagaaggtcctgaggagtgttttgacctgaaaatgagcccagtgtgatcaagggaagactgcagagttagaggtgggagcactgargcggtggcagatgggtccagggatggatgaagagtgttgtttagggagcgatgggctgcaaaggtaaatagatggtaggggctataggtggagtaaaggc

SEQ ID NO: 43666 - DNA, 201 bp, Homo sapiens
gttaccatccccttctcccagagggctggccatagcacaagagaagtgcggcctctggttgagtcttccctgaggggaggaggcagggaaggccctctggrttggaatgacatcccctatctttctgtgttgccaggaacccagacaaccggaggcgaccctggtgctatgtgcaggtgggcctaaagccgcttgtccaag

SEQ ID NO: 43667 - DNA, 201 bp, Homo sapiens
agaacttggagaatggagccttgggatggattccagcctaactacctcagctgggagtttttgcagaaacgacctgtacagctgtatgcagtggctctggmcatccaagcctttttcaacacctggaacaaagcccttggggcatggggcaggggaggtttccaggtgataagcgaccagcagacctccctggatgactga

SEQ ID NO: 43668 - DNA, 201 bp, Homo sapiens
gggatgcagcctctgtctgtgctaggatatagaacttggagaatggagccttgggatggattccagcctaactacctcagctgggagtttttgcagaaacracctgtacagctgtatgcagtggctctggccatccaagcctttttcaacacctggaacaaagcccttggggcatggggcaggggaggtttccaggtgata

SEQ ID NO: 43669 - DNA, 201 bp, Homo sapiens
cgggctccctgggctccccggcggctgcacggagtcaaggcgccccgtcccgggcgtcccccgcgggtgccgatccaggctgcccggagtccggagcccakagaggagagagacagctggggagcctggtcaccgcgggcatctcccctgcgctgcagtcgcccgcctggcctgccttcccgttcctccgcctcttgccct

SEQ ID NO: 43670 - DNA, 201 bp, Homo sapiens
ctgacaccatgggccggccctgcctgccctggaactctgccactgtccttcagcaaacgtaccatgcccacagatctgatgctcttcagctgggcctgggraaacataattactgcaggtgaggtgggggcaacaaggaccaaaagccctccctacagcttcccagaaaccttgttaccatccccttctcccagagggctg

SEQ ID NO: 43671 - DNA, 201 bp, Homo sapiens
ttgccctgacttctccttcctttgcagagccgccgtctagcgccccgacctcgccaccatgagagccctgctggcgcgcctgcttctctgcgtcctggtcktgagcgactccaaagtgagtgcgctcttgctttgactgatgctgcccaaggacctctgatcagcaccaggggagaggaggggctgctcagggagctgggg

SEQ ID NO: 43672 - DNA, 201 bp, Homo sapiens
atccaggctgcccggagtccggagcccagagaggagagagacagctggggagcctggtcaccgcgggcatctcccctgcgctgcagtcgcccgcctggcckgccttcccgttcctccgcctcttgccctgacttctccttcctttgcagagccgccgtctagcgccccgacctcgccaccatgagagccctgctggcgcgc

SEQ ID NO: 43673 - DNA, 201 bp, Homo sapiens
actgtctacatgtttccattgtctttacttttattcttgcctgcacaaataaatgaattgctcattatggaaacttcccaaaagacccgttaacacttcartaggaagcaccaacagtttatgccctaggactttgttcccacaatcctgtaacatcatatcacgacacctaacccaatccttatcaagccctgtcaaaaa

SEQ ID NO: 43674 - DNA, 201 bp, Homo sapiens
ggtcaccgcgggcatctcccctgcgctgcagtcgcccgcctggcctgccttcccgttcctccgcctcttgccctgacttctccttcctttgcagagccgcygtctagcgccccgacctcgccaccatgagagccctgctggcgcgcctgcttctctgcgtcctggtcgtgagcgactccaaagtgagtgcgctcttgcttt

SEQ ID NO: 43675 - DNA, 201 bp, Homo sapiens
gcgggcatctcccctgcgctgcagtcgcccgcctggcctgccttcccgttcctccgcctcttgccctgacttctccttcctttgcagagccgccgtctagmgccccgacctcgccaccatgagagccctgctggcgcgcctgcttctctgcgtcctggtcgtgagcgactccaaagtgagtgcgctcttgctttgactgat

SEQ ID NO: 43676 - DNA, 201 bp, Homo sapiens
aattgcttgaacctgggaggcagagatctcagtgagctgagatcacaccactgcactccaactgggcgacagagcaagactccatctcaaaaaaaaaaaawaaaagttagttggaatgttcttctctttctcatattctctcatcctcctgtccccttgtagataagtcaaaaacctgctatgaggggaatggtcactttt

SEQ ID NO: 43677 - DNA, 201 bp, Homo sapiens
agcctcctcccgaatctcttccagggcagcaatgaacttcatcaagttccatgtgagtatccacccctacaacagttggctgcacagacaagttgggaagrcttcaggggacatcccctccctgccctctgctgcagggctgcgccaccccttaccacttccactccccctcgcttaccccacctttgttctctccagcga

SEQ ID NO: 43678 - DNA, 201 bp, Homo sapiens; identical to SEQ ID NO: 11353

SEQ ID NO: 43679 - DNA, 201 bp, Homo sapiens
ttcataacggtctccaaacctctttgtccaggaggaaatgaagtcatctgctctcagcaatcagcatgacagcctccagccaagtaatctggagtcatgaragctgctaggggagcaacatgaatcatgacggcccctgggaatttcctgataactaacctgggagtttcggggtaagtcctcaggctgcagcatctctgt

SEQ ID NO: 43680 - DNA, 201 bp, Homo sapiens
aaatgaccccaagccctggttcctgacactaggggaaagagatgggggtgacagaatcacagaatccctgctatgttcctccaagtgtgcccagagatgcgtgtgtgtgtgtgtgtgtatacacaaatgtctgcttatcctcaggcaggaagggtggatgcagtcatttacacatggtctgtttttctggaggacaatttt

SEQ ID NO: 43681 - DNA, 201 bp, Homo sapiens
ctgtgagatcactggctttggaaaagagaattctagtaagtgacaattgcgactgacttagaaggtcctgaggagtgttttgacctgaaaatgagcccagygtgatcaagggaagactgcagagttagaggtgggagcactgaggcggtggcagatgggtccagggatggatgaagagtgttgtttagggagcgatgggct

SEQ ID NO: 43682 - DNA, 201 bp, Homo sapiens
gctgatctgaagatacaggagagggacgaactcgcctggaagaaactaaagcttgacggcttggacgaagatggggagaaggaagcgagactcatacgcarcctcaatggtacgtttgtttctttcctaatgcaggtcgagtatccctcttcctaaatgcttgagagcggcagtgttttggatgtcggattttgtttttgg

SEQ ID NO: 43683 - DNA, 201 bp, Homo sapiens
gcccatgtcaccgcaaggcctgtcctgccccgggtatggcgccgtcccttggcgtccttgcagttcacccgggaccacaagatggcgtggcgagcacgggragggaacactcacctatggaaaccttgttccaggaggagctcaagcacttcgaagccaaaatcgagaagcacaaccactaccagaagcagctggagattg

SEQ ID NO: 43684 - DNA, 201 bp, Homo sapiens; identical to SEQ ID NO: 11377

SEQ ID NO: 43685 - DNA, 201 bp, Homo sapiens
ggcgctcccgcgagacgcggggatggaatgctagcgtgcacctagcttcacctgaccacggcaaagctcggtgttggttaagaaagccgtgtggcactgcmtgaggcacccgcaccgttggggcagaggtcagggccgctgagagaagggaccttcggtgagttattcaccctgagccacgggcttctatgtggagaggga

SEQ ID NO: 43686 - DNA, 201 bp, Homo sapiens; identical to SEQ ID NO: 11379

SEQ ID NO: 43687 - DNA, 201 bp, Homo sapiens; identical to SEQ ID NO: 11382

SEQ ID NO: 43688 - DNA, 201 bp, Homo sapiens
tcgaggaggcagcagccgccaggagatggcatctgtgccctcatggtgataagacagcagggctggtctctgtccccggtgccaggcagagccaccgcctmgtctccaggatggtctgcccagaggcagcctccagcacagcagtcaaatgtgtccacgcgggcccaggtccccttgggtggctgtgctgctgtcacctga

SEQ ID NO: 43689 - DNA, 201 bp, Homo sapiens
agaatgttcctgtgtctgagcctggaagaggctcgggtctggctccgggcgtggttcccttcccgtgtctgagcctggaagaggctcgggtccggctccgrgcgtggttcccttcccgtgtctgagtctggaagaggctcgggtccggctccgagcgtggttcccttcccgtgtctgagcctggaagaggctcgggtccgg

SEQ ID NO: 43690 - DNA, 201 bp, Homo sapiens
ccttctgcgctgagcactggcagccacacatcaggggaaagggagctggcttttgtgagacatgcggtgtgaaatttagaccccctgttgcctgagagttkgggaatcagagggagaaaatgactttcccctgtgggttgcagattttacagcccacagagcacctgcccttgattctcccagcaccctagggaggcagac

SEQ ID NO: 43691 - DNA, 201 bp, Homo sapiens
ccttagcctgacctggtgctggtgactgtcagccgtaggcttttggccgtagtgctgggggctggaccaccttgtaggcctgcgatgcagtttgctgagtkcctgtgctggagagacccggatgagcctggctatagtccatgcaggaaagggcgactcagccccacacacttctcttcccacctcgggctgtccccaagg

SEQ ID NO: 43692 - DNA, 201 bp, Homo sapiens
tgagttcctgtgctggagagacccggatgagcctggctatagtccatgcaggaaagggcgactcagccccacacacttctcttcccacctcgggctgtccycaaggcagttgtgtccagcggctcctgcagttctcttgcgggtctgcctgggccttccagcaagccccaccagcccagggtcctcggggtcctgagcagg

SEQ ID NO: 43693 - DNA, 201 bp, Homo sapiens
ggtcaccgggctgctgccctgtccccctccttgggatcttctgctccccaccccagccagctcggtagctgtcccctgttgagcctggacacgtccaagaraagggtggttgcctgccggcagctcttctccggtttgttttttgttttcctgcccttcgtgaggccaagaacctggcctggcactcacgtaggcaagggc

SEQ ID NO: 43694 - DNA, 201 bp, Homo sapiens
ccgggtaaggaaacacggccctctccttctagctctctcctgtggtgaagattctcttgcagtttccgggtaaggaaatgcagccctctcctccaagctckctctctcaagattctcgcagtttcttccttaaccactcggtgaacctgcttgcgttttccttctcatctgcgtgggaactcgtgtttcaggggcggggcc

SEQ ID NO: 43695 - DNA, 201 bp, Homo sapiens
aaggcggcgcgggctgcgggacactgggaaggcagccggctcttgacgcttcgtggggatgttcactgttttacgtaaactttattgaaatataacacacrtactttggatactagcttgtgttgtatttatgttagaaaatagctaatgaaatatagataaaagattaatatttcaaacctctaagggaaaacagactcc

SEQ ID NO: 43696 - DNA, 201 bp, Homo sapiens
cgccaacctcacggacaaggagctggaggcgttccgggtaaggaaacacggccctctccttctagctctctcctgtggtgaagattctcttgcagtttccrggtaaggaaatgcagccctctcctccaagctctctctctcaagattctcgcagtttcttccttaaccactcggtgaacctgcttgcgttttccttctcat

SEQ ID NO: 43697 - DNA, 201 bp, Homo sapiens
accctggtcccacctcatgacacgttctggttcacacagctgggccactctgctctgcacggaagagccttcgcttccctgaagggctagcctgccccagygcacgcctcttagcggccgggccagccccgaggccagagttgatgagagctggccggtgggtttcattctgctgcttgcctcggccgcctggcattctgg

SEQ ID NO: 43698 - DNA, 201 bp, Homo sapiens
acctctctgtgccccataagccccatgtgagctactgagcagatgccctctgtgccccataagactttgagtgcacgcacccgtgtttcacacacatgcargtcgcgcctgcaaaccctcataggctccacgcacactcagcgtggttgccgcggggctggctgtggtgtgcaccccgggtgctgctgaggccactcttgc

SEQ ID NO: 43699 - DNA, 201 bp, Homo sapiens
caggagctctaagggctcggtgctcctgaggccgcctccagcttcagtgctctgtgactccattccatgcagaagaacccagcacctccagaatccagaascttccatagtccctgctgctgatcgcagccgtgggtactctgccttttgatggggtctgaccagccactttgggctctggctcagagcttttggctccaa

SEQ ID NO: 43700 - DNA, 201 bp, Homo sapiens
ccggccgctcacggaggaactacaattcccaggagaccgcgcggtgggtgggggcggggtagtgggcggggcatcggcaggctaggttttctccgcgcagsgccagtcgcagaggaagatggcgccgcggagggtcaggtcgtttctgcgcgggctcccggcgctgctactgctgctgctcttcctcgggccctggcccgc

SEQ ID NO: 43701 - DNA, 201 bp, Homo sapiens
tggagaccctgagcaggaccgaaggtgccccccgcccccaccccctcctgccctctgccccaccccctcctgccccccacccctcctgcacctgaggctcrttgtgctcagtgggcagcctcagctcccctcaggaacacggcaggggcagggaggcggcaccagacgccctcccagggttccaccggacttgtgagtggg

SEQ ID NO: 43702 - DNA, 201 bp, Homo sapiens
aggcagttgtgtccagcggctcctgcagttctcttgcgggtctgcctgggccttccagcaagccccaccagcccagggtcctcggggtcctgagcaggaargggtcagcagaggagggagcaggggccactgttgcggggctccatgggcaggcggctctggactactcactcctggttggagagtggtgacagccccgga

SEQ ID NO: 43703 - DNA, 201 bp, Homo sapiens
ctcagcacttagagacacgggctggcatggcgggtgctggcggcaggggtgagaaataaactttcagccctagaggaggagcccaagaggagagcatgccrtcacctggagtctctggtatgtgcctggcacctgtactgattgcattaaccactgtgattttttagaagatgtactagtttgaaatgtataatacatacg

SEQ ID NO: 43704 - DNA, 201 bp, Homo sapiens
gatttgtctggagttgcagagccgagtagtgcagcaaagatttggagtcagggttttctgactcctgagcaggtggtctgttcccagccacccctcttctsccattggcaggcatcagcagacatgtcatgtggctgcgcccgggttaaagacagagggccggcttcatttttgctggtttatgccaccatgttcaagagt

SEQ ID NO: 43705 - DNA, 201 bp, Homo sapiens; identical to SEQ ID NO: 11392

SEQ ID NO: 43706 - DNA, 201 bp, Homo sapiens
ttcaggttgggacagtcctggaaagcagcccctgcagagatgggggcgcagagcatctaccaggagggcccagacaaaagactgtcctgggaccacccacyaagggttagagaaccttctagagaattagaagctttcctctgccctaggccctgccattcattttgtgcctaccgtttgctatctttttaccattgggga

SEQ ID NO: 43707 - DNA, 201 bp, Homo sapiens
aattagaagctttcctctgccctaggccctgccattcattttgtgcctaccgtttgctatctttttaccattggggatcttggctcagtaatctgaattcrtccctaactaaattttaaactcctggagggtggggcctgtgtggctagggcagccacagagtcaggctgggcttctgagagaagagagggcggagctgac

SEQ ID NO: 43708 - DNA, 201 bp, Homo sapiens
tttattgaaatataacacacatactttggatactagcttgtgttgtatttatgttagaaaatagctaatgaaatatagataaaagattaatatttcaaacstctaagggaaaacagactccatatttaaacacacatgatcagagacaggcgttaggtgatgggcacctggagctcagaggcaggagctggggttccctcc

SEQ ID NO: 43709 - DNA, 201 bp, Homo sapiens
actctcctttcctaggagcacccctccataatcacctccacaggaattccatctcagctctgcttccaggaaacctgacccaagacagaggttgttgcaarggcagaggccacaggcatctacaccagcctctgtgcgttcagtctgtgagcggcccaacgctgcccatgtgctcctccttaaagcctactcaaccctggg

SEQ ID NO: 43710 - DNA, 201 bp, Homo sapiens
tgttgcggggctccatgggcaggcggctctggactactcactcctggttggagagtggtgacagccccggagtctctcactgcgtcccttcgtgagcaccrgggtccaggagccgtcttggtttgtttggctcctcccaggagcccgaatgtttgactttcacgagcacaacatcctgctggagaccctgagcaggaccga

SEQ ID NO: 43711 - DNA, 201 bp, Homo sapiens
ggttccaggaccggggaggccacagttcccctgcaggaaagatgaggccgcccacatgcagctcagggcttcctgtagatggggtgtgggccccacgctgytgtcttccctgtccgagttgaaccccagggccacaagtgtgtggggcactgaaggccacagcagccatgctaggggagccccccgggcttgtagtgcagt

SEQ ID NO: 43712 - DNA, 201 bp, Homo sapiens
aaagcttaggatttgtgttgggggctcaccctcatgagggaggtggccactggcttcagtgtttgggggggctaaccctcatgagggatggtggctgctcscctcagtgctgtgggctacgcctctgactccttggcttttggccaaggggcccattgggcacagcctgcggggggctatcctccgagcacagatgcgccc

SEQ ID NO: 43713 - DNA, 201 bp, Homo sapiens
ctatgtggagagggaggtggcgcccacgagcagggttttgtgagaatctggggagagctacagtgaccccagcccaggctgggctgacgcagcacctgctsccactggggtggtatctgtggggatgctctgggctgttgtgatgtgaggagctggaggtccctctccttccctcccaggccctgaggaggaaggcgcctt

SEQ ID NO: 43714 - DNA, 201 bp, Homo sapiens
cctggtctcccagaacctcccggtggccagcctcctccgaggtcagtttctcgctgtgtcctggtccgtcctgctcgtggctcacaggctcctccccttcrttcgcagctgcatcttcctcccgtgaggctggccgagctccacgctgatctgaagatacaggagagggacgaactcgcctggaagaaactaaagcttgac

SEQ ID NO: 43715 - DNA, 201 bp, Homo sapiens
tcccaggccctgaggaggaaggcgcctttcccagagctctgtcccagtctctctggtcattgcttttaaaaataacactgtggggctgggcacagtggctyacacctgtaatcccagcactttgggaggctgaggtgggtggatcatctgagctcaggagttcgagaccagcctgggcaacatggtagaaccccatctcta

SEQ ID NO: 43716 - DNA, 201 bp, Homo sapiens
ggcgcatcagggttggaagggccccagggtacagcatgtgggtgcctgttcctttgtggacttgtgtgtgtgtggctggtggggcggggggtggattctgsttcttttttttcccattatcctgagagccttaaggtactcagtgtgttggtgagactcagccctgtcatctagcagaagcgtgttccttttcattgctgt

SEQ ID NO: 43717 - DNA, 201 bp, Homo sapiens
ctctcggcccggaggggaaggcaggaccccattctgtgggaggcggggccctgggagaattcccccagcccccaggaaagggcgggcaggcaagcccaccrcccgctaaggaggcgggtgtggttgcatgggccccggattccaggggacctagtagagggcctgtcacacagagccacagcacaggacttggaagtggga

SEQ ID NO: 43718 - DNA, 201 bp, Homo sapiens
ggggaaggcaggaccccattctgtgggaggcggggccctgggagaattcccccagcccccaggaaagggcgggcaggcaagcccaccgcccgctaaggagrcgggtgtggttgcatgggccccggattccaggggacctagtagagggcctgtcacacagagccacagcacaggacttggaagtgggaattggggcctggg

SEQ ID NO: 43719 - DNA, 201 bp, Homo sapiens
agggtcacgggtgaaggcccagaggaggcgctggggtccgggagtcaccatctgggtgaagaggtcctcggggtgaggggaagtgtgaggcgaagggaggytccgagcccagcatcttgggagaggcctactcggggccctctcggcccggaggggaaggcaggaccccattctgtgggaggcggggccctgggagaattc

SEQ ID NO: 43720 - DNA, 201 bp, Homo sapiens
tggggcctggggagagctactgccgtggagggcgaggccagcccccaggctctgctctcacatcccaagtgcaggacttgtcctgttggcaccagggcccrcgtcgagcgcctgctttcatatcatgttggtggcagcgtgtggtgacagacacagcccacagatgccgagtcccccctagggaagcggggctaggggagc

SEQ ID NO: 43721 - DNA, 201 bp, Homo sapiens
tgtgattagaaaggtgccctcgtgtgtggggctgggctttcaccctgtgcctgggaagggtgcggggccaggcgctgggacccagcagggcctggtgggcygtggcagggtgtttacctgccgcagctcccccatttccagcggctcctgctccagaacagtttctctggatcacattgatttggggtcaacagttagact

SEQ ID NO: 43722 - DNA, 201 bp, Homo sapiens
tttgttttttgttttcctgcccttcgtgaggccaagaacctggcctggcactcacgtaggcaagggcctgcctggccatgaggagtggttggctgaagagyggccctggccacacgagcccgcggcgggttcactccaggccttgtttccctcttaggcgaagacctctgggaaattctccggcgaagaactggacaagct

SEQ ID NO: 43723 - DNA, 201 bp, Homo sapiens
ggtgacccagcagagagggggcagggcaggggtccagagtcagcccccaggggacctggtgccccagctgtcaccgccaggcgccacttggtgcgcgtgtcccggcgtctcgcctgtctcgcctggaaaggaagctgtgccaacggtcgtttctgcggcgctgcaggaccgcggaagggggacattttcagcccagaaatg

SEQ ID NO: 43724 - DNA, 201 bp, Homo sapiens
cccagcagagagggggcagggcaggggtccagagtcagcccccaggggacctggtgccccagctgtcaccgccaggcgccacttggtgcgcgtgtcccggcgtctcgcctgtctcgcctggaaaggaagctgtgccaacggtcgtttctgcggcgctgcaggaccgcggaagggggacattttcagcccagaaatgagagc

SEQ ID NO: 43725 - DNA, 201 bp, Homo sapiens
ggggtcggaggcggaggggggcgcagccggggcacctgtgccctacgcgccctgtccttggcacagcctcccccaagtgtcaggtggggcgccccgacccyttctgcagcaggaaaggtacccgtgccggcgacgacgccgtgtgaagcaggtggcggccggcaccccgagggtcagtgtcgccctccccagcctgggcgg

SEQ ID NO: 43726 - DNA, 201 bp, Homo sapiens
aggtggctcggccggtggggccccccgggacaacagcttcctaattggtgcgtgaccctgggccagctgctctcttcattaagatacggttgcttcatttsttaggtgttcctgaaaacacctgaaatgggtgttttcgaactatgccgaccatctgggcctcattatctcatctcaaatgcaggagtcagattagatctc

SEQ ID NO: 43727 - DNA, 201 bp, Homo sapiens
tctgggcctcattatctcatctcaaatgcaggagtcagattagatctctgtctcaatagtccagttttaagcattcctgagtctttgagagggaaagtaartgatttgcagaataagaaggaacttttggaacgaaaagggagaggagaaacaggtgggggacagacagacgacagacggttataagactgcgtggggatg

SEQ ID NO: 43728 - DNA, 201 bp, Homo sapiens
gattcaaaaataggaaaggcctaaaaaataaatgaaggtagaagttctgataggagagggtggtgcgggtctgcctggcagaatgtgcaggagagcagccygtggcccttgcccgtgggcaggagctcaggtccagggtgagcaccaccatgtggggtttgcagggcgctcccgcgagacgcggggatggaatgctagcgt

SEQ ID NO: 43729 - DNA, 201 bp, Homo sapiens
gaggcaggtgggatgacaatgaggggctggcagaggtccccctaggaaggtggccttgctgtcctcaccacctgcagccgggagagccaggcaagcccggrgtcaccgggctgctgccctgtccccctccttgggatcttctgctccccaccccagccagctcggtagctgtcccctgttgagcctggacacgtccaagag

SEQ ID NO: 43730 - DNA, 201 bp, Homo sapiens
tccaggaggagctcaagcacttcgaagccaaaatcgagaagcacaaccactaccagaagcagctggagattgcgcacgagaagctgaggcacgcagagagygtgggcgacggcgagcgtgtgagccgcagccgcgagaagcacgccctgctggaggggcggaccaaggagctgggctacacggtgcgcacgggttccagga

SEQ ID NO: 43731 - DNA, 201 bp, Homo sapiens
ctggggcgttgagaagcagcagcaggttattggaaagttccagaaagctctgctggcacgcgggtggtgctgtgtggggaagggccactgctgaggtcccragcagtgctgggcccttgggtctggtcaggaggacacggtcggctctgcttgtgtctggggacacaggaccggcgtcgtttgatcagctgagccggcttt

SEQ ID NO: 43732 - DNA, 201 bp, Homo sapiens
agctcaagcacttcgaagccaaaatcgagaagcacaaccactaccagaagcagctggagattgcgcacgagaagctgaggcacgcagagagcgtgggcgayggcgagcgtgtgagccgcagccgcgagaagcacgccctgctggaggggcggaccaaggagctgggctacacggtgcgcacgggttccaggaccggggagg

SEQ ID NO: 43733 - DNA, 201 bp, Homo sapiens; identical to SEQ ID NO: 11395

SEQ ID NO: 43734 - DNA, 201 bp, Homo sapiens
cgaggtcctggcagcctctgcacacaggccacgtccatcctctgcctcctgcttcagaggcagccagggcgggctgtggcgcttcccaggctctgatggargcaggtgtttctggacacaaaggagaagcagttgtttggccaaggggacagagaagccacatttcagcgaggtcatgtgagctactgacctctctgtgcc

SEQ ID NO: 43735 - DNA, 201 bp, Homo sapiens
ggaaactactggaaaatgagaggcaaacctgtctcacccaccgtggcaacccagatgtgttggcttttgactgtttttcacaggaaaccatatcaaatagwacctcccctctctcctagtcatcttggccaagtatggtctggacggaaagaaggacgctcggcaggtgaccagcaactccctcagtggcacccaggaaga

SEQ ID NO: 43736 - DNA, 201 bp, Homo sapiens
acggccctctccttctagctctctcctgtggtgaagattctcttgcagtttccgggtaaggaaatgcagccctctcctccaagctctctctctcaagattstcgcagtttcttccttaaccactcggtgaacctgcttgcgttttccttctcatctgcgtgggaactcgtgtttcaggggcggggccaggctctggaggga

SEQ ID NO: 43737 - DNA, 201 bp, Homo sapiens
gagctgggagggcaggggtgggatgaatgaagcgtggcctgccctgcggagagggatgagggtggggcggggaagttcctcagccccagtgcggcagctcrttccggggcgctgcctgtgtggtctacgccagcaggtaagtgagagggtgacagattcctgctccagaaggatctggggctgtgtaagaaccgtctcagc

SEQ ID NO: 43738 - DNA, 201 bp, Homo sapiens
ctgaagatacaggagagggacgaactcgcctggaagaaactaaagcttgacggcttggacgaagatggggagaaggaagcgagactcatacgcaacctcartggtacgtttgtttctttcctaatgcaggtcgagtatccctcttcctaaatgcttgagagcggcagtgttttggatgtcggattttgtttttggatttgg

SEQ ID NO: 43739 - DNA, 201 bp, Homo sapiens
ggcttcagtgtttgggggggctaaccctcatgagggatggtggctgctcgcctcagtgctgtgggctacgcctctgactccttggcttttggccaaggggsccattgggcacagcctgcggggggctatcctccgagcacagatgcgcccttggccgtggtctcagtttgctgtcacagatgccattggcacgccagaggg

SEQ ID NO: 43740 - DNA, 201 bp, Homo sapiens
tcccgagggtggggccgtctctggttgtgttttggggacaagcaggcaggtgcttgtagcgacgggaacctgggcctgtggacgcagcggagaccctcggygcgctcagtctacccaggggtggtcacaggcctcgctcccaggagctgctccgtgaaggtcactcgccgtccccagccttgtacctggagactagcggag

SEQ ID NO: 43741 - DNA, 201 bp, Homo sapiens; identical to SEQ ID NO: 11375

SEQ ID NO: 43742 - DNA, 201 bp, Homo sapiens; identical to SEQ ID NO: 11376

SEQ ID NO: 43743 - DNA, 201 bp, Homo sapiens
agttcagtgcccctggagggctccacgtccatcccacagggacccggactctcatcttcctcctgagcgtgctctccctggagacctggcattggaattcrccctgccaccttctggtctccccaagtggaaacctgggcgtcagtctggacgcttgtcaccaaattctgtcccttccaccttcacatggcctctccatct

SEQ ID NO: 43744 - DNA, 201 bp, Homo sapiens
ccgaaggtgccccccgcccccaccccctcctgccctctgccccaccccctcctgccccccacccctcctgcacctgaggctcgttgtgctcagtgggcagyctcagctcccctcaggaacacggcaggggcagggaggcggcaccagacgccctcccagggttccaccggacttgtgagtggggaggttgctgtgcaggca

SEQ ID NO: 43745 - DNA, 201 bp, Homo sapiens
ccccctcctgccctctgccccaccccctcctgccccccacccctcctgcacctgaggctcgttgtgctcagtgggcagcctcagctcccctcaggaacacrgcaggggcagggaggcggcaccagacgccctcccagggttccaccggacttgtgagtggggaggttgctgtgcaggcaggctctgggagtcgcctgcctg

SEQ ID NO: 43746 - DNA, 201 bp, Homo sapiens
cctgccctctgccccaccccctcctgccccccacccctcctgcacctgaggctcgttgtgctcagtgggcagcctcagctcccctcaggaacacggcaggkgcagggaggcggcaccagacgccctcccagggttccaccggacttgtgagtggggaggttgctgtgcaggcaggctctgggagtcgcctgcctgcattgg

SEQ ID NO: 43747 - DNA, 201 bp, Homo sapiens
gggcagtggcggcagcgggcctgggagcagcccttcccagcgtctccccagcctcagcagcacggcccctcccgtgctgctgttggccaagaacagagacyactcgtcaaacatagctccgtctccatctcatgccacccacaccgtccatcagtccccctcagcccggcaggggcaggacgcccgctgaggccacagagc

SEQ ID NO: 43748 - DNA, 201 bp, Homo sapiens
gaaacgcgagtccggagaggagttccgcatggagaagttgaaccagctgtgggagaaggcccagcgagtgagcgcggcccgcggtcggtggagcggggccygggggcgggggccgtggttggggtcgttggagcggggcccaggggtcggaggcggaggggggcgcagccggggcacctgtgccctacgcgccctgtcctt

SEQ ID NO: 43749 - DNA, 201 bp, Homo sapiens
tcagcagctcatctccctccactgcaggccctcagtggccaggctctgcaccactgcttcttgccccgtacccgggccagagccttgtgcagggtgtaccrgaagcctgctggcctcactcacgcagcttccgattctgtacctcatcctccacgtgcacactgagcaccagctgcacgccaggcactgctctaggctcga

SEQ ID NO: 43750 - DNA, 201 bp, Homo sapiens
tgcacagcaggcacacggagctgaaggagaagctgcgcagcatcaaccagggcctggaccgcctgcgcagggtcagccaccagggctacagcactgaggcyggtgagtgcccgcccgggactgttggttcccgagggtggggccgtctctggttgtgttttggggacaagcaggcaggtgcttgtagcgacgggaacctgg

SEQ ID NO: 43751 - DNA, 201 bp, Homo sapiens
tctctggttgtgttttggggacaagcaggcaggtgcttgtagcgacgggaacctgggcctgtggacgcagcggagaccctcggcgcgctcagtctacccasgggtggtcacaggcctcgctcccaggagctgctccgtgaaggtcactcgccgtccccagccttgtacctggagactagcggagggcagtggcggcagcgg

SEQ ID NO: 43752 - DNA, 201 bp, Homo sapiens
cgggctgggacccgttgctagtgtgatggcctcccagctgccgccccctcattgcccatgtcaccgcaaggcctgtcctgccccgggtatggcgccgtccyttggcgtccttgcagttcacccgggaccacaagatggcgtggcgagcacggggagggaacactcacctatggaaaccttgttccaggaggagctcaagca

SEQ ID NO: 43753 - DNA, 201 bp, Homo sapiens
cggcgcgctcagtctacccaggggtggtcacaggcctcgctcccaggagctgctccgtgaaggtcactcgccgtccccagccttgtacctggagactagcrgagggcagtggcggcagcgggcctgggagcagcccttcccagcgtctccccagcctcagcagcacggcccctcccgtgctgctgttggccaagaacagag

SEQ ID NO: 43754 - DNA, 201 bp, Homo sapiens
tcctgctggagaccctgagcaggaccgaagggaaacggcctgtgcctgcgtctggacctggctgaacttgcaggtgcccccacccgaggtcctggcagcckctgcacacaggccacgtccatcctctgcctcctgcttcagaggcagccagggcgggctgtggcgcttcccaggctctgatggaggcaggtgtttctggac

SEQ ID NO: 43755 - DNA, 201 bp, Homo sapiens
aagggagaggagaaacaggtgggggacagacagacgacagacggttataagactgcgtggggatggggattgacgcctgggcatcagctccacaggccctycctgaactgctcctgggaccagcagtcaagccccaggcgtaatgttcagcctgcggaggtgggaggtgggagaacgctctgggctggagcggcagggcgg

SEQ ID NO: 43756 - DNA, 201 bp, Homo sapiens
gcgggtcctgtggatggtcaacagttggtcgggacccagccacagcctggggggaggggaccaaggacactaccgggatcgtttaggggtgtcaccacttsctgagatggaggcccagggagggaaggagaccacctcaggtggcaggggctcctggggcgtgtggagtgccagatcattctgagggtggagaattcatca

SEQ ID NO: 43757 - DNA, 201 bp, Homo sapiens
ccctgcactggtccagctaccctcgggctgcccctgcactgtcccccggtgctgggtgctcgcctgaccagtttcagtcttgggttgggtcatgtctcctraacctccctgaggttcactgggcaccatggtagggcgagctgctcacctccactttggactgagccttggactagatgatctttctggtccctttaagtc

SEQ ID NO: 43758 - DNA, 201 bp, Homo sapiens
tcctgggctcaagtgatcctcccgcctctgcctcctaaagtgttgggattacaggtgtagtcccaggaggcaccgcacgcagacagtccttagttctgacrtgaatggtgactgcaatgagagtgtgtgaagcatcttgttctcagaggtctgacgagtggaaactgaggtctgcagagaggagccctcagagccccaccc

SEQ ID NO: 43759 - DNA, 201 bp, Homo sapiens
ctgggtggaatcttccttccagtggcgtttcagtcccctgggtctgcctcactcttcaccaccgtcttgtgcttctgcactgagctccagccagaccacckgcctgcagccacctggcgctacctgttcccgtgtgcttcctgcctttgcctggagagaataacaatctatagtccaaactcaaggacaaaaacaaactgc

SEQ ID NO: 43760 - DNA, 201 bp, Homo sapiens
caggggctcctggggcgtgtggagtgccagatcattctgagggtggagaattcatcagctcggtgagcacccagcagggctgtgaggagtggggagtccakcgggggtcctgggtgggcagccttgagtatggtatccggccatgagttcacccagggtccctatagctggtgtctgttgggagggaggtgggtgtggtcc

SEQ ID NO: 43761 - DNA, 201 bp, Homo sapiens
ggggcaccttagctggccgcaggcacgtgcatggggcttggcaggtggggccacatggagggccctgggtctggagcgtggggtcaaggcagggcagggcrcctacaggagcagggacagagctgcagtccagcagcagtggagcccaggcaggctgggggcagggtgcagaggcagccaccacagaagcacagcccctgg

SEQ ID NO: 43762 - DNA, 201 bp, Homo sapiens
tcttagcggccgggccagccccgaggccagagttgatgagagctggccggtgggtttcattctgctgcttgcctcggccgcctggcattctggcccagtcwttctgacgtggggacactcttggcctaaatcctgtctttgcaaccaaaaagcagtgtgcccagcggtcacctcacttgcttccttctctcacccagggtc

SEQ ID NO: 43763 - DNA, 201 bp, Homo sapiens
gttggggctgctccggagagtcgagtgctcagctgcctgctgtcagctatgtgtagcagccctaggagctgctgtgcctccacccaactgctgcccctggscctgaccccaggcaccccttccccaatcccctcccccgctgctccctgtgtgacctgggcccccggcacagtcccctgccccccacctccgtttcctcct

SEQ ID NO: 43764 - DNA, 201 bp, Homo sapiens
agaggctcgggtctggctccgggcgtggttcccttcccgtgtctgagcctggaagaggctcgggtccggctccgagcgtggttcccttcccgtgtctgagyctggaagaggctcgggtccggctccgagcgtggttcccttcccgtgtctgagcctggaagaggctcgggtccggctccgagcgtggttcccttcccgtgt

SEQ ID NO: 43765 - DNA, 201 bp, Homo sapiens
cagccaccagggctacagcactgaggctggtgagtgcccgcccgggactgttggttcccgagggtggggccgtctctggttgtgttttggggacaagcagrcaggtgcttgtagcgacgggaacctgggcctgtggacgcagcggagaccctcggcgcgctcagtctacccaggggtggtcacaggcctcgctcccaggag

SEQ ID NO: 43766 - DNA, 201 bp, Homo sapiens
gacaggctcagagagggtgatttgtctggagttgcagagccgagtagtgcagcaaagatttggagtcagggttttctgactcctgagcaggtggtctgttmccagccacccctcttctcccattggcaggcatcagcagacatgtcatgtggctgcgcccgggttaaagacagagggccggcttcatttttgctggtttat

SEQ ID NO: 43767 - DNA, 201 bp, Homo sapiens
cgagtttgagctccccagcagtgggcgttctagacagtggtctgggcaggcagtgcgaggactcccagcctcatggcgtcctgccttcggttttacagaartccacgagaacgtcattagcccctcggacctgagcgacatcaagggcagcgtcctgcacagcaggcacacggagctgaaggagaagctgcgcagcatcaa

SEQ ID NO: 43768 - DNA, 201 bp, Homo sapiens; identical to SEQ ID NO: 11381

SEQ ID NO: 43769 - DNA, 201 bp, Homo sapiens
caacctggcctgggcttacccacggccaggcgctccgcggagggcagaagcgggctgggccaggctcctcagcgccaggcccgggccgcagtgccaacccsgcaacggcactggacatgcaagagtcggcgtcagtgcgcgtgaagccggagcattatcaggctcagccaaacgcggcccggttcttgggctttccgctct

SEQ ID NO: 43770 - DNA, 201 bp, Homo sapiens
tccccagctgatgagacgtttctgtccacaggtgaagaagcatctgcaggacctgtccggcaggatctccagagctcggcacaacgaactctgaaggcatyggggagcccagcccggcagggaagaggccagcgtgaaggacctgggctcttggccgtggcatttccgtggacagcccgccgtcagggtggctggggctgg

SEQ ID NO: 43771 - DNA, 201 bp, Homo sapiens; identical to SEQ ID NO: 11384

SEQ ID NO: 43772 - DNA, 201 bp, Homo sapiens
ctgtggtgaagattctcttgcagtttccgggtaaggaaatgcagccctctcctccaagctctctctctcaagattctcgcagtttcttccttaaccactcrgtgaacctgcttgcgttttccttctcatctgcgtgggaactcgtgtttcaggggcggggccaggctctggagggaggggctttggttcttttgtccgtgt

SEQ ID NO: 43773 - DNA, 201 bp, Homo sapiens
cggcactggacatgcaagagtcggcgtcagtgcgcgtgaagccggagcattatcaggctcagccaaacgcggcccggttcttgggctttccgctctttctktggggcagagagggaaagaggcctcgagtcgtgcgggctccaggctccgggctctgggtgaggcctgatccctgctcccacccggccaccctcattctcc

SEQ ID NO: 43774 - DNA, 201 bp, Homo sapiens
agctgatgagacgtttctgtccacaggtgaagaagcatctgcaggacctgtccggcaggatctccagagctcggcacaacgaactctgaaggcattggggrgcccagcccggcagggaagaggccagcgtgaaggacctgggctcttggccgtggcatttccgtggacagcccgccgtcagggtggctggggctggcacgg

SEQ ID NO: 43775 - DNA, 201 bp, Homo sapiens
catctgttgagtgggtggagtcccccctccccatgaggaatggggagcccgaaatagactccctgaccgattggaggtggcgctgaggaagtgcactcggrcccaggaaccccagcggctcccttttgggtgctggcccaagtcttccacctgctctgcagggccgccctggtgcgctccaccttacctccagccacctcc

SEQ ID NO: 43776 - DNA, 201 bp, Homo sapiens
gctctgggagtcgcctgcctgcattggatgaaccaagtctcaccggcgcctgcccccactatgggcacagctgctgcctttgtcagacctgagcttcgctratgggtccttcattctggactcgtgaccctccccaaatgtgtgactttcccaccccacaaagctggagtaaaatggagggtgacccagcagagagggggc

SEQ ID NO: 43777 - DNA, 201 bp, Homo sapiens; identical to SEQ ID NO: 11387

SEQ ID NO: 43778 - DNA, 201 bp, Homo sapiens
tcctgaagttctagttgtgtgggcaagtcttttttgctgaacagaacgtgaagttcttcgggggtgagggtgttttgggggattttgtgtgtcttcccccmttccagagagcctggtactatggcaggcaggcctgcagagcccattcgtcctgattttccttccagataacggaagcttggagggtggcggtgctgtgag

SEQ ID NO: 43779 - DNA, 201 bp, Homo sapiens
cctgctggcctcactcacgcagcttccgattctgtacctcatcctccacgtgcacactgagcaccagctgcacgccaggcactgctctaggctcgaggagrcagcagccgccaggagatggcatctgtgccctcatggtgataagacagcagggctggtctctgtccccggtgccaggcagagccaccgcctcgtctccag

SEQ ID NO: 43780 - DNA, 201 bp, Homo sapiens
caggaaacctttgcctttgatgggcttgggctgtgagacctgcgttgaggttgccgccaagaagatgctgagacccgctttcatcaggcgagacccggccrggggggtgctgcttcatcctctccagcaacttgaatcttgactttctgtgactctcccagttcctctttcacaggcgggctccactgtgttgcaagactc

SEQ ID NO: 43781 - DNA, 201 bp, Homo sapiens
caccagctgcacgccaggcactgctctaggctcgaggaggcagcagccgccaggagatggcatctgtgccctcatggtgataagacagcagggctggtctytgtccccggtgccaggcagagccaccgcctcgtctccaggatggtctgcccagaggcagcctccagcacagcagtcaaatgtgtccacgcgggcccaggt

SEQ ID NO: 43782 - DNA, 201 bp, Homo sapiens
gcccagggtcctcggggtcctgagcaggaaggggtcagcagaggagggagcaggggccactgttgcggggctccatgggcaggcggctctggactactcastcctggttggagagtggtgacagccccggagtctctcactgcgtcccttcgtgagcaccagggtccaggagccgtcttggtttgtttggctcctcccagg

SEQ ID NO: 43783 - DNA, 201 bp, Homo sapiens
atgtaggtaaataatacaaatcacattctttggccagagtgcaattgaggaggaaatcagtaacaaaaagacaattaaatccatttgattcttttgttttmgttttgtagtaacttgcacttccctggtgccagaggcatgacacctttttgtctgctcttggccatttgggtggcgtctttgggaagggcctacttaatt

SEQ ID NO: 43784 - DNA, 201 bp, Homo sapiens
cagcctgctcctcatggtgggtgccttgcagtctggcgcgggcactcaggtgagcgctgggaggatggcacatgccctctgaagaggtggtccattggcgrtcctggtggcattggaacctgcccagcctgaactgtgctgtgtgtgcaggttgacaccagtggtgtagctgtggaccctggcctgggtttcctggggcgt

SEQ ID NO: 43785 - DNA, 201 bp, Homo sapiens
gggcactcaggtgagcgctgggaggatggcacatgccctctgaagaggtggtccattggcggtcctggtggcattggaacctgcccagcctgaactgtgckgtgtgtgcaggttgacaccagtggtgtagctgtggaccctggcctgggtttcctggggcgttgagaagcagcagcaggttattggaaagttccagaaagc

SEQ ID NO: 43786 - DNA, 201 bp, Homo sapiens
ccacttcctgagatggaggcccagggagggaaggagaccacctcaggtggcaggggctcctggggcgtgtggagtgccagatcattctgagggtggagaaytcatcagctcggtgagcacccagcagggctgtgaggagtggggagtccagcgggggtcctgggtgggcagccttgagtatggtatccggccatgagttca

SEQ ID NO: 43787 - DNA, 201 bp, Homo sapiens
gctcatgccaagttctttctggagggagctggggctcaggagccccatctgtgccttttaaactttgaactgcaggcatgtgttaccgattcaaaaatagsaaaggcctaaaaaataaatgaaggtagaagttctgataggagagggtggtgcgggtctgcctggcagaatgtgcaggagagcagcctgtggcccttgccc

SEQ ID NO: 43788 - DNA, 201 bp, Homo sapiens
gcctgggcaacatggtagaaccccatctctaccaaaagtagaaaaaattagccgggcgtggcggtgggcacctgtagtcctaagtacatgggaggctgagrtgggaggatcacttgagcctgggaggcagaggttgcagtgagctgagatcatgccactgcactccagcctgggtgacagagcgagaccctttcagtaagt

SEQ ID NO: 43789 - DNA, 201 bp, Homo sapiens
acaccatgggcctatcacagagaccctgagctttccacttcagcatgaactgctcctggctggtggctcttagcgttctttggtgggattttctagttagyactgagctgcttttgtgatttgagcatttctggatgggtgtggaattggaaagtcagatgtgcagggcttgcgccttttccttttggatcgcgcgtctcc

SEQ ID NO: 43790 - DNA, 201 bp, Homo sapiens
cgagcgtgtgagccgcagccgcgagaagcacgccctgctggaggggcggaccaaggagctgggctacacggtgcgcacgggttccaggaccggggaggccrcagttcccctgcaggaaagatgaggccgcccacatgcagctcagggcttcctgtagatggggtgtgggccccacgctgttgtcttccctgtccgagttga

SEQ ID NO: 43791 - DNA, 201 bp, Homo sapiens
gtccccagctgatgagacgtttctgtccacaggtgaagaagcatctgcaggacctgtccggcaggatctccagagctcggcacaacgaactctgaaggcaytggggagcccagcccggcagggaagaggccagcgtgaaggacctgggctcttggccgtggcatttccgtggacagcccgccgtcagggtggctggggctg

SEQ ID NO: 43792 - DNA, 201 bp, Homo sapiens
cccccggcaaaatcccgcccacccttggaggccttttcagatcattcttgccagatgagctccccttgtcccttctctgagcccaaaggggcccagctgcygtctgtctccctccttccccttgtttcccgcgctacctccagggcacttcccaactcactggccaagcccccaacgagcggtctatgctaactttggctc

SEQ ID NO: 43793 - DNA, 201 bp, Homo sapiens
agaccatcactgtgggcctcgcatctcagaccctcccgggcagtgcagcacggtaagtaaggcgcctacagggtagcagcagccacggggaagtagagatrgaagcagacctgttcctccaggagtttgggtcacaaacaagataggcaggtgtgggctccccctcctcctgaggcaccgactgcccctcctgagagttca

SEQ ID NO: 43794 - DNA, 201 bp, Homo sapiens
gtggatggggctggctgggtggatggggctggctggggaagaggcacacaggtaggggtgtgtcgaaggctgccagggaaagggttttcaggttgggacartcctggaaagcagcccctgcagagatgggggcgcagagcatctaccaggagggcccagacaaaagactgtcctgggaccacccaccaagggttagagaac

SEQ ID NO: 43795 - DNA, 201 bp, Homo sapiens
tgtccccagctgatgagacgtttctgtccacaggtgaagaagcatctgcaggacctgtccggcaggatctccagagctcggcacaacgaactctgaaggcrttggggagcccagcccggcagggaagaggccagcgtgaaggacctgggctcttggccgtggcatttccgtggacagcccgccgtcagggtggctggggct

SEQ ID NO: 43796 - DNA, 201 bp, Homo sapiens
cctggggggactcgaactttccatacagagggagaagcagcataatgagcttcatcctggggtctacagtggcagacagtggggaaagcagtgacagggaktttgccagcagaggaggcagctgagggtgtcttactcaaagaccctccctgaatgctgggagctgggaaggggttggttttgcccaagcacatggggtct

SEQ ID NO: 43797 - DNA, 201 bp, Homo sapiens
tgccaccatgttcaagagtctggttgagacgtaagccaagatacggcggcagggactgcctggggaagagagacatggctgaaacaattctggatggttgygtccccaccagcgtgtctagtgggccattcccaagggccaagaaagagcctgtcctggaggtgcccccaggaagaagggactggctatgcagcagggcag

SEQ ID NO: 43798 - DNA, 201 bp, Homo sapiens
ttctctcgtaagcaagatactcagcttcagcactgaccagcctcacaatccgtcctcaccaagtggagggccctccctccgggttcctccacggccgtatstgtctctgttcatacaccttcccctcagcacttagagacacgggctggcatggcgggtgctggcggcaggggtgagaaataaactttcagccctagagga

SEQ ID NO: 43799 - DNA, 201 bp, Homo sapiens
cattcccaagggccaagaaagagcctgtcctggaggtgcccccaggaagaagggactggctatgcagcagggcagcattcggggcctggaggagacagagyagcttgcagggggcacagaagtgggctaagaaccagctccctcctgcaggccaggcagtgtccttgcagggtgtccaggtctgtggcccaagtggagctg

SEQ ID NO: 43800 - DNA, 201 bp, Homo sapiens
agcagctcaaggcgggtacggctgtgcccttgtccacggagctcaggtggaaggagctggggcacagtggctgggctgggacagtgcatgccacctgccgkggtgagacaggtacagcgtgccaggaagccttggtcaccgccacagcctgctcctcatggtgggtgccttgcagtctggcgcgggcactcaggtgagcgc

SEQ ID NO: 43801 - DNA, 201 bp, Homo sapiens
ccaggaggagctcaagcacttcgaagccaaaatcgagaagcacaaccactaccagaagcagctggagattgcgcacgagaagctgaggcacgcagagagcrtgggcgacggcgagcgtgtgagccgcagccgcgagaagcacgccctgctggaggggcggaccaaggagctgggctacacggtgcgcacgggttccaggac

SEQ ID NO: 43802 - DNA, 201 bp, Homo sapiens
ccaataaatataagatgtgtgctgtcagaaagccctgccaccctgcacagtctgcaggtggcctctgtcctgtggtccttagagtttttgccctatggcakcaggtgaggctgcaaattttgttcttgaaaatctgtgcagctggtcgctaaagacgggccaatcggtaaccactcttacagcccagcccaccagctgctt

SEQ ID NO: 43803 - DNA, 201 bp, Homo sapiens
ttggatttgtcagaggacttaattgctttgttagattgttgtcttgttctcctctttggaacaatggctaggacaaaacacagcattggttagtgggaggrtgggaggtggttgatcagccatgtgcctctgaggccacaaagaagcctcacaggtcatggtttccactgtcagttggtcattacatcctcctgttgaaga

SEQ ID NO: 43804 - DNA, 201 bp, Homo sapiens
tgcagtggtgcatgcctgtcgtccaagctactcaggagaccagggtgggaggatcacttgagtccagaagttcgagaccagcctgtgcaacatagcaagaycctgtctcaaaaaaaaaaaaaaaaaaaaaagttgaaaaagaaaaaagttgaaaatgagagaaaaaaaggaattgaaggaccagtctgggacacttaacat

SEQ ID NO: 43805 - DNA, 201 bp, Homo sapiens
tcacagaccgtcctgagcaaggaccccccgagaacccgggagcctagggggacacagcaccatgtaaagccccggatcccggcaccgggtggccaccgtcyggggagtggtggtgcgggtggatcactccgacgttggcactgacaccgtcagcctcttgcaggtgccactgcccaactcggtcttcgtcaacaccacgga

SEQ ID NO: 43806 - DNA, 201 bp, Homo sapiens
agcctgggtcccagtggccagtaggtggacaggtggtgggaaagccataggccagggcggcccctcacagaccgtcctgagcaaggaccccccgagaaccygggagcctagggggacacagcaccatgtaaagccccggatcccggcaccgggtggccaccgtccggggagtggtggtgcgggtggatcactccgacgttg

SEQ ID NO: 43807 - DNA, 201 bp, Homo sapiens
gcccctccaggcgatcaccccccgatgggcagagtttcaggagcttctcctttgaaaagccccggcaaccctcacaggctgacactggcggggacgactcrgacgaggactatgagaaggcaaggctgagcggcaagcctgggtcccagtggccagtaggtggacaggtggtgggaaagccataggccagggcggcccctc

SEQ ID NO: 43808 - DNA, 201 bp, Homo sapiens
gccattgcactctagcctgggcatctcaaaaaaaaagaaattgcaaagttaggcacacttgtgagtggccctggctaggagggagacgtgtgtaaatgacratgtggaggactagtggtggccactcacaagagtctgcgcgccatactaagacacaccggggcccctctgccaaaacgaggctgaccccgaagatgtcct

SEQ ID NO: 43809 - DNA, 201 bp, Homo sapiens; identical to SEQ ID NO: 11441

SEQ ID NO: 43810 - DNA, 201 bp, Homo sapiens
tacaggcgtgcaccaccattgggcatggtggtgcatgcctgtagtcccagctactcggaaattatttcacacaagttcttttttaaaaaaaaaaaaaaaaatagagacgagtcttactattatgttgcccaggctggtcttgaattcctgggctcaagtatcctcccacctcagccttccaaagtgctaggattacaggca

SEQ ID NO: 43811 - DNA, 201 bp, Homo sapiens
ttggggaagaggggcagtgaccctgtgaagatgcttgacagacaacccccaccacctcagaagtgtgtgtgagtggtgaacccttttaagccatcttccarccattctcactggagggagatttgatgggtacagagcagacccctacctgtctaccctccttcggacccctaggaagcttcgcaggccttccaggctgcc

SEQ ID NO: 43812 - DNA, 201 bp, Homo sapiens
aaatttttaaatggagaattgggtgcgagatgtggtttccagcctggtgcctggggtgctgagctagtgagtggtgcagtccaggacacctttgctttatstcacttacacggtcacctggagccggctcaagtggctaaagcatcctggggcccagagccaggtgataggtccctctggccaactggacagttgaggcct

SEQ ID NO: 43813 - DNA, 201 bp, Homo sapiens
attacaggcatgagccactgtgcctggccccttcctgtaaaatttttaaatggagaattgggtgcgagatgtggtttccagcctggtgcctggggtgctgwgctagtgagtggtgcagtccaggacacctttgctttatgtcacttacacggtcacctggagccggctcaagtggctaaagcatcctggggcccagagcca

SEQ ID NO: 43814 - DNA, 201 bp, Homo sapiens
ggacagctgggtatgaggtgcttacggcacagtgtccagggcagctgggtgtgcagggactgggggctcccggaagattttttggaggaagtaacagctaygatgggatgggaacagtggaccctaagcaggccaagggtgcgtagggacggtggtacccagatgcccaagtcttccaggcaatacctggctcaggcccag

SEQ ID NO: 43815 - DNA, 201 bp, Homo sapiens
tcagcacgagccctacccggatctctgttgtcctgagctttttagggtcacaggggccatagcaggcagcttgccgtcctcacacagagggtggagtgggsaggggagcagagggtggccgccccgtgtctgacagtgaaatggtcctgccttcctctccctgcccctccaggcgatcaccccccgatgggcagagtttca

SEQ ID NO: 43816 - DNA, 201 bp, Homo sapiens
acacctctgagatgcctgctgcctgtgtggaagtgcctctgagcagcccttgtcacactcgtggttctagttcaccaagggctgcagagatgcagatgttyggaagtcacgtttttccatgactgtggggatagcggttccagggctcagcctcacccacaggctggcctcccatgctggcgtggcccgttaatcctccct

SEQ ID NO: 43817 - DNA, 201 bp, Homo sapiens
tcttactgaaacataaaaattaaacatatatagcctaatgaaaatttaagatggaaaatttcatccctgttcatttgtcacagctgctgatgtcagttatrgtctcttgtgtcacgtgtggtagtggaagaaattggctgtgggagcctttctccttgggccggaactgcccatcaccagttacggggagcctaggttctc

SEQ ID NO: 43818 - DNA, 201 bp, Homo sapiens
tcaccatgttggccaggctggtctcaaactcctgacctcaggtgatccgcctgcctctgcctcccaaggtgctgggattacaggcgtgagccacctttccyggccatcccgtccttttgagtggcccttccagctgccacctgtcccattgccagagtgggtccagagttccttctcctttgaaatgcagatgctcacctt

SEQ ID NO: 43819 - DNA, 201 bp, Homo sapiens
ctgcactccagcttgggtgatatagcgagactcagtctcaaaaacaaaacaaaacaatcttcatatgtacccatatcctttctcaatcctgatttttttttaatgttacctttttccccctttttcagccttgacagaagcttacagaaccgactttcggttttattaatcacatatgcttctctgtttcctcagtaattt

SEQ ID NO: 43820 - DNA, 201 bp, Homo sapiens
aggccgaggcaggtggatcacttgaggccaggagttccagaccagcctggccaacatggtgaaacaccgtctctagtaaaaatagaaaaatgagctgggcstggtggcgggcacctataatcccagctaactcaggaggctgaagcacaagaatcgcttgaacccaggaggcagaggttgcattgagccgagattgtgcca

SEQ ID NO: 43821 - DNA, 201 bp, Homo sapiens
atcatacacatttgtgtcaaaaataatggattatcccaaagtttggcctgaaattcatgaaaatgctcattgcatttgtggcttagtcatgttgcatgtattttttttttcctactcttcagcctacaaattttattttacacacctttattgcttttttggtgggataattgttaaaaaaaaaagataaactgtgtctaa

SEQ ID NO: 43822 - DNA, 201 bp, Homo sapiens
tgtggcttagtcatgttgcatgtattttttttttcctactcttcagcctacaaattttattttacacacctttattgcttttttggtgggataattgttaaaaaaaaaagataaactgtgtctaaagtttcctcttttgataagcctaatacaaacccatttggattgtacactgaacttctagaaagaaggaaagagcag

SEQ ID NO: 43823 - DNA, 201 bp, Homo sapiens
tgcttgtcctgtatctgtgtttatctgtatacttccatgtctgtgtgacagagtccttgtgtctgtgtgtctacatgtctgcgcgtgtccctgtgtctttktgtatatatatccatgcctgtgtgcctgtgttcctgcgtgtgcttgtgtgtgcacgtgtgcatttgtgtgtttgtcagagtatgtgtgcatgtgtgtgtc

SEQ ID NO: 43824 - DNA, 201 bp, Homo sapiens
attacaccactgcactccagcctgggcgacagagtgagaccctgtctcagtcaattgaccaatcactcaatatttttttaaaagaaatctaaaaaataaamtaaaattgtcactaggcttaagttatgcttctagtcatctaggaaacacctcaccaggctataatagtgaagtctaaattttcatcgacaaagacagaaa

SEQ ID NO: 43825 - DNA, 201 bp, Homo sapiens
aggccatggcgcggcccgcagtcctgcccaggccagagaagccgcagctcccgcacctccagtgagtttgtgtggcggctgcaagccctgcctccagctasagggaccctggcctggcctctgacgggcactctgcccacctcgctcccctggcactcttagcccacgacggggtaccaggtgcaagggtaggaaggttcc

SEQ ID NO: 43826 - DNA, 201 bp, Homo sapiens
caccacccccctctccccatgcagactatgagcacgacgatgaggatgactcctacctggagcctgactccccggagcccggaaggcttgagggtaggtgrggcgggtgggcccggggagctctgggtgtgtaggaagcaggggctgggaccgggagcagagcccctcccaggctggggatgctggcccaggtaccgctct

SEQ ID NO: 43827 - DNA, 201 bp, Homo sapiens
cagtcctcccagcaggtgcttgccccttgcctcctggactcagccccatgcatggagcattgctcggagactgggcctgggccggtttggctctcaccacmcccctctccccatgcagactatgagcacgacgatgaggatgactcctacctggagcctgactccccggagcccggaaggcttgagggtaggtggggcggg

SEQ ID NO: 43828 - DNA, 201 bp, Homo sapiens
gaatgattctcctggcggggcgccactgggcagtctgagccttggcagcctcccccgtgagctggcccgacgtgcagcagatactctctggattgggactycctggcccgagacgatgtggagggaacaaaccttcctgtcctttcacaggtggggacaggaggcccagggagggctgggcacagccaaggctgccctgca

SEQ ID NO: 43829 - DNA, 201 bp, Homo sapiens
ccccggagcccggaaggcttgagggtaggtggggcgggtgggcccggggagctctgggtgtgtaggaagcaggggctgggaccgggagcagagcccctccsaggctggggatgctggcccaggtaccgctctgggtggcttccgcttccctgctgtgtcccaagtattatgaggattggagcagaagaggtgtagctgctg

SEQ ID NO: 43830 - DNA, 201 bp, Homo sapiens
acaacgttttccccttcaagatcatccacatcagcaagaagcaccgcacgtggttcttctcggcctcctccgaggaggagcgcaaggtgactgggggtcckaggacgagtgcaaggtgactgggggtgtgggcctgcaggcaccaggctggacctgccttgggggctcgctggtcctggggcgctggcctctcagccccgg

SEQ ID NO: 43831 - DNA, 201 bp, Homo sapiens
gggcaaagagaaggtgtggctgggacacaggcagctgggtgggtgctgccccagctccatccccatgcccagagcctggtgccagcgcccacacaaggaayatgctgtcctgggaggtgcccctgtgggctgaggggagccacacagccatgttgtatccagccgggtcgcctcctctgaccttgggagtcacagcagagc

SEQ ID NO: 43832 - DNA, 201 bp, Homo sapiens
ttatagatttatttaaagaaaaaaagttttatcttccccaggtggtcctggtgttttcctgacgcagttggtgagaagcctccgtgctcctgagcggccgygtcacctgggcagggaccctgtgtggccatggggctctgagcatgggagtgcgtctctcctcttctttcctgccctccttgtcttctttccccccttctt

SEQ ID NO: 43833 - DNA, 201 bp, Homo sapiens
ctgagtggctataaccggtaagtgcccgacctgcctgctgacctcgggcccccacagccagcgggtccctcccagcagagccccagctgggcctgcccctwattcccgcccaaggaaagtgctttcccgaagcagccttcgtgcccatcccctgtcctccccgcccagcctccacagtgcctcgccctctccgcgtgtcct

SEQ ID NO: 43834 - DNA, 201 bp, Homo sapiens
aggttgaggctgcagtgagcatgattgcgccactgcattacagcctgggtaacagagtgagaccccatctcaaaaacaaaaataaaaaacaaaaaaaaaamcagatcaagtagtaagggtacaagttggttttaattatttttttattttttatttattttatttatttttttgagacagggtcttgtctgtcacccaggc

SEQ ID NO: 43835 - DNA, 201 bp, Homo sapiens
ctcctggggacagggacaggtgggagggcagggtccatgcttccaaggtcctctggacacgggacccaggtggcagctccaaaacctggctaggatgggcrcagtggctcatgccagtaatcccagcactttgggagctgaggtgggtggatcgtttgagcccagtagttcgagaccagtctgggcaacatggtgagacgc

SEQ ID NO: 43836 - DNA, 201 bp, Homo sapiens
gatctgcaacattatttgccatggtttggtaaatagggggtcctcagagggctcttgacagacattctattctacccttaattaacagcaatacatctgtytgttgtgtgcttcccccaagtgataggtactcttagactgtcccttggcaatctcctgcaatatgttttcagctcaagcagtgacaaactagaagtaaat

SEQ ID NO: 43837 - DNA, 201 bp, Homo sapiens
actctcttctggcttgtagggtttctgcagagagatctgctgttagtctgatgggcttccctttgtgggtaacccaacctttctctctggctgcccttaasattttttccttcatttcaaccttggtgaatctgatgattatgtgtcttggggttgctcttcttgaggagtatctctgtggtgtttctgtatttcgtgaat

SEQ ID NO: 43838 - DNA, 201 bp, Homo sapiens
catggtgtgccctctggattttcccattccctctctggtggctggcacccctggagaagcagaggttgacttccctagcccccaggactgtagcagggtcyggggtggtgcacagtgctggccagctggcaaggggagctgcagcctgcagccaggacctggggaccacaggtggccaggtaggtctggcctctggtgctg

SEQ ID NO: 43839 - DNA, 201 bp, Homo sapiens
gcattgaatctataaattactttgggcagtatggccgttttcacaatactgattctttgtatccatgagcatggaatgtttttctatttgtttgtgtcctrtttcgctgagcagtggtttgtagttctcctcgaagaggtctttcacatcccttgtaagttgtattcccaggtattttattctctttgtagcaattgtgaa

SEQ ID NO: 43840 - DNA, 201 bp, Homo sapiens
acagcttctacggcgcagttgagcggcctgtggatatcagcctttccccgtaccccacggacaatgaaggtgaggtctttctccgcatccactgcccgttygcctctccccacctggcctcctcttggccgctgtggaggagagggaggtgtgttcggctgtgctccttgctctggccctttggcagtgcgcagtagcatc

SEQ ID NO: 43841 - DNA, 201 bp, Homo sapiens
ttccatatgaaatttgaagtagttttttctaattctgtgaagaaagtcagtggtagcttgatgggcatagcattgaatctataaattactttgggcagtayggccgttttcacaatactgattctttgtatccatgagcatggaatgtttttctatttgtttgtgtcctatttcgctgagcagtggtttgtagttctcctc

SEQ ID NO: 43842 - DNA, 201 bp, Homo sapiens
ctggggcccaagtgcacaagcagcagggctcccaggcagcatggctgctcaggactgttgatgtgtgcctctccttcccaccctcagatccgagagcagawtttacaggacattaagacggctggccctcagtcccaggttttgtgtggtgtagtgatggacaggagcctcgtccaggtgagagcccagagtgtctctgac

SEQ ID NO: 43843 - DNA, 201 bp, Homo sapiens
tgcttgtgtgtgcacgtgtgcatttgtgtgtttgtcagagtatgtgtgcatgtgtgtgtctgtcagcgtatccatgtgtgcatgtgtgtgtctgtcagcgkatccgtgtgtgcatgtgtgtgtctgtcagcttaaccatgtgtgcatgtgtttgtcagtgtatccgtgtgtgcatctgtgtatctgtccatgtatccgcgt

SEQ ID NO: 43844 - DNA, 201 bp, Homo sapiens
ttaggattgtcttggccatacgggctcttttttggttccatatgaaatttgaagtagttttttctaattctgtgaagaaagtcagtggtagcttgatgggsatagcattgaatctataaattactttgggcagtatggccgttttcacaatactgattctttgtatccatgagcatggaatgtttttctatttgtttgtgt

SEQ ID NO: 43845 - DNA, 201 bp, Homo sapiens
aagcccctggaatggaggagacaggggctgaagcagactcatctgtgcatgactagttcattaggagttcagttgaaattagattagatgctcctaaaacyatgggcaaccaaatacataaagtggggctttcttttccccttgtaacagtgttttactttatagatttatttaaagaaaaaaagttttatcttccccagg

SEQ ID NO: 43846 - DNA, 201 bp, Homo sapiens
tgctgaatcctgagaagtacaaagccaagtcccgttccccagggtctccggtaggggaaggcactggatcgcctcccaagtggcagattggtgagcaggawtttgaagccctcatgcggatgctcgataatctggtaagaatggtgccaccacttgatgataaaccttttgttctaaaagcatcagtgttggtgttcttac

SEQ ID NO: 43847 - DNA, 201 bp, Homo sapiens
ttttccttcttcatggcgaccatttggtctctaggtctctgcaatgaaatgtggcctcttgccaatctccccggaggcgctttcccttggagaagtggctwatcatgactaccatggcattctggttgatgaagaggaaaaagttttgattcagaaaaatctggggcctaaaagcaaggtcagtaggcatctaatctggta

SEQ ID NO: 43848 - DNA, 201 bp, Homo sapiens
ggcgcgatctcggctcactgcaacctccgcctcccgggttcaagggattctcctgcctcagcctcctgagtatctgggactacgtgtgtgcaccaccatgyccagctaatttttttttttatttttagtagagacgggatttcaccatgttggccaggatggtctcgatctcttgacctcgtgatccgcccacctcagcct

SEQ ID NO: 43849 - DNA, 201 bp, Homo sapiens
aaacctcccaagtgcataggaccccgcctacctttaccaaggaccgcataaaaaaagaggagccccaagcaccttctgggtaggcatggatagccgcccayggtacactctaatggcagcaacggtatttgcctttggcccagagaacgctgtctcagggccctcctccacagtcttgttagtgtttgtagcagtaacaga

SEQ ID NO: 43850 - DNA, 201 bp, Homo sapiens
acgacatagtgccacctgctaagtctctgtcttgccaacatgagctgcagtcaagttgtattgcattaggtcattgaaacctcccaagtgcataggacccygcctacctttaccaaggaccgcataaaaaaagaggagccccaagcaccttctgggtaggcatggatagccgcccacggtacactctaatggcagcaacgg

SEQ ID NO: 43851 - DNA, 201 bp, Homo sapiens
tgtgggaagcacgtgaaaggctccttaatccaagagtgtctctgttgacgacatagtgccacctgctaagtctctgtcttgccaacatgagctgcagtcargttgtattgcattaggtcattgaaacctcccaagtgcataggaccccgcctacctttaccaaggaccgcataaaaaaagaggagccccaagcaccttctg

SEQ ID NO: 43852 - DNA, 201 bp, Homo sapiens
gcaccaccatgtcgggctaatttttgtatattttatagagatggggcttcgccatgttgcccaggctggtctcaaactcctggactcaaacgattagcccrtcttcacctcccagagtgctgggattacaggcatgagccaccatgcccagcccaggagcacatctaaaaatgctctgtgctctggctcaggaaggaatgc

SEQ ID NO: 43853 - DNA, 201 bp, Homo sapiens
acttccccgccagggtggatccgccgggcataggcaccctggatggtggccatggtgaggccgatgaggaaaaacatcttcccctgctgtaggctgggagygggtgtgttagtgcagggcacccggggcagggccacccagggcagggccagggcgagagtggctgccaaggcttcctggggatgggggttgcttccctga

SEQ ID NO: 43854 - DNA, 201 bp, Homo sapiens
tcccgatcggccctttctgacatgaagtcatccttgtaagcgagaatctgaagagaggcgagacacacatttctgctcaaggaaggaggaagcgccccaccaggcttctcccacccccaccgtgaccactgcccactcagtgccaccaagccttcagcccagcctgtcccatgatttcggccaccaccggccagcagacat

SEQ ID NO: 43855 - DNA, 201 bp, Homo sapiens
gtggagcattgaggccatttacattcaatgtcagtattgagatatgaagtactgttctattcatcatgctatttgttgcctgaataccttgggttttttttcattgtgttgttgttttataggtcctgtgagatttatgctttaaggaaattgtattttggtgtgatttgaggatttgtttcaagatttagagctcctttt

SEQ ID NO: 43856 - DNA, 201 bp, Homo sapiens
ggggtttccttgcctgtcatggccctaccctccaagctgtgtcctggatcttggcagtgtccccctgagcgccctggctcagacatctcctgcctgaccgyagctgagccacgtgcctttgtcctttattgcagcttcatggcggctgaagagatgcattggcctgtccctatgaaggccattggtgcccagaacctgcta

SEQ ID NO: 43857 - DNA, 201 bp, Homo sapiens
gtgagcatcaagggacctcccaggcctggtgctcaccgtccgccccaacgcaccctgcattgcagcgactccagctcggacacagacagcttctacggcgyagttgagcggcctgtggatatcagcctttccccgtaccccacggacaatgaaggtgaggtctttctccgcatccactgcccgttcgcctctccccacctg

SEQ ID NO: 43858 - DNA, 201 bp, Homo sapiens
agtggaccaggggctgactgagtggagcccgtggctctatctctccctggggtcccacctggaagcccaaggccctcagaaaaggggtttccttgcctgtyatggccctaccctccaagctgtgtcctggatcttggcagtgtccccctgagcgccctggctcagacatctcctgcctgaccgtagctgagccacgtgcct

SEQ ID NO: 43859 - DNA, 201 bp, Homo sapiens
agcgtatccgtgtgtgcatgtgtgtgtctgtcagcttaaccatgtgtgcatgtgtttgtcagtgtatccgtgtgtgcatctgtgtatctgtccatgtatcygcgtgtgcctgtgtgtacctttgtgtgagcatcaagggacctcccaggcctggtgctcaccgtccgccccaacgcaccctgcattgcagcgactccagct

SEQ ID NO: 43860 - DNA, 201 bp, Homo sapiens
agcgtatccatgtgtgcatgtgtgtgtctgtcagcgtatccgtgtgtgcatgtgtgtgtctgtcagcttaaccatgtgtgcatgtgtttgtcagtgtatcygtgtgtgcatctgtgtatctgtccatgtatccgcgtgtgcctgtgtgtacctttgtgtgagcatcaagggacctcccaggcctggtgctcaccgtccgcc

SEQ ID NO: 43861 - DNA, 201 bp, Homo sapiens
tgcccagccaccagagcctgctgctgcggcacccctacggctacactgggcctaggtgatggcagtccatgtggctgccaggccaaggcagtcacaggggycctgaccccaggccacacagacggacatgggcccacatgggagggtgagcaggagcaaggctgtgcttgcctagggcctctgtgatggacatctcgtagg

SEQ ID NO: 43862 - DNA, 201 bp, Homo sapiens
gagacatgagacatcaatcaacatatacaagatgaacattggttccatctggaaaggcgggacaactggaagcaaacccggggagactcgaagcggggagrggcttccaggtcatacataggtagataggagacaagtgatcgcattcttttgagtgtctgatgagcctctccaaaggaggcaatcagagatgcacttatg

SEQ ID NO: 43863 - DNA, 201 bp, Homo sapiens
tcctgttgaagattgtgtttaccaagctcatgtgctcatcatgaaacactgttagacattgatttgaaaacaataatttcttttattttgattctgtaggracctagaaagattgtacaatgaatggtgattctcgtgctgcggtggtgacctcaccacccccgaccacagcccctcacaaggagaggtacttcgaccgag

SEQ ID NO: 43864 - DNA, 201 bp, Homo sapiens
gcagagatcacctctcttcttggtctcctattgacaattccaaaggctctctggagtcgggtgccaggtggccaaggacattaccaggggataccactttsattatctcctttttcccacggagcagtaattcattattagctgacaatcaaagagcattagaaatctgacaagatcctttgggtcctctagcaggcattt

SEQ ID NO: 43865 - DNA, 201 bp, Homo sapiens
taagaccagctggttgttaatcttaactttagccaagacaaatgccaattcagttacttacccagggatgggtctcaggctgtagatttctctctaccatmctagaagcaggaaaaaactcaccttccctgttggaagcaagctcaaactccataagggagttacctgccttccatcatcatggaaacaggaaatcttgcc

SEQ ID NO: 43866 - DNA, 201 bp, Homo sapiens
tctagaggcagacatactagctacgtttgctttatcaactttgggaattgacgtgattttggaaacataagaccttcttaattcagagatacaaaacccartttgatatgcagattgtccatttgcagtctggaatttccttgtgagtggcgaacttgtgagtgaaatttggagtgttttagtttgttgctgtactccaag

SEQ ID NO: 43867 - DNA, 201 bp, Homo sapiens
gtcagcccttgataaaatgtatttatttgtacctcaaaaaaaaaaaaaaaaaccctaaataacatttttaaatgccacagaggagaaagacttaggagagwctgaaacccctcactgtgattccctctgtgtgcgggcatctagtatgtggagtaggtggaagatctgtctgaacccacccacgtagaaggaaatcctccc

SEQ ID NO: 43868 - DNA, 201 bp, Homo sapiens
ggccaagttttagagaatggattgttgtgggggttgttaagagactggaagtagagaaaccaattaggaggccgttgagtgtccaggaagtgagtgatgasaacttggatttgagtgacatctgggggatgggagatgtggaggaagcagatgtcacttgggcaggccatacttatttgtcacggttcatccagatttttg

SEQ ID NO: 43869 - DNA, 201 bp, Homo sapiens
agctggaggcctcagataggtacttttttttttttttttttgagacagagtctcattcagttgcccaggctggagtgcagtggtgtgatctgggctcaccrtgacctccgcctcccgggttcaagcaattctctgcctcagcctcccgagtagctgggattacaggcatgtgccaccacgcctggctaatttttgtatttt

SEQ ID NO: 43870 - DNA, 201 bp, Homo sapiens
tatcattgaaagatgtcatttcagaggaatgggaattcagacagtctttgtcagcccttgataaaatgtatttatttgtacctcaaaaaaaaaaaaaaaaaccctaaataacatttttaaatgccacagaggagaaagacttaggagagtctgaaacccctcactgtgattccctctgtgtgcgggcatctagtatgtgga

SEQ ID NO: 43871 - DNA, 201 bp, Homo sapiens
caacgtctccagggactgaagcacacatactttgacaacagaatcaccagcaatgtcactgacctagggtgtctgcagcattcagtgtcttctattttctrtactaggtgttttctgtactgtttgtaaagcaggaaatatctttttttttttttttttttggagacagagtcttgctctgtcacccaggctgaagtgcag

SEQ ID NO: 43872 - DNA, 201 bp, Homo sapiens; identical to SEQ ID NO: 11438

SEQ ID NO: 43873 - DNA, 201 bp, Homo sapiens
ttcaacaggcaccagagagaggagggcatttcaggcagagggtgtgaattgtatgaaagtgagtttgtaaactttggagccttgaatggacaaaggcccgygatgataccttttttttttgagacggagtctcgctctgtcgccaggctggagtacagtggcgcgatctccagtcactgcaatctccgcctcccaggttca

SEQ ID NO: 43874 - DNA, 201 bp, Homo sapiens
cgtgaagaatttcattcttttgcaaggactggagagaaaattttatgtggaaggtagcccttggaaatgacctcaaagaataggtaggatcttagcctgcrtttgaaagcctggaaaaaaacaggatgacaggatgaagaggccacagcacagctgcagacaatgggagtggggagatgggaacatgcaacgtacggtgca

SEQ ID NO: 43875 - DNA, 201 bp, Homo sapiens
ccttgaactcctgggcttaagccattctcccacctctgactctgaagtagctaagactgcaggttcatgccaacaggcttggctaatttttttttttttttgagataaggtttcaaaagcctgagctgtgttgctcaggctggtcttgaattcctggtctcaagtgatcctcctgtctcagcctctgaatatgctaggata

SEQ ID NO: 43876 - DNA, 201 bp, Homo sapiens
aggcggaggcttcagtgagctgagattgtgccattgcactctagcctggatgacaagagcgaaactccttctcaaaaaaaaaaaaaaaaaaaaaaaaaaamccggtgtggtggtacatgcctgtagtcctagctacttgggaggctgaggcagagaattgcttgaaccttggaggtggaggttgcagtgagccgaaactgc

SEQ ID NO: 43877 - DNA, 201 bp, Homo sapiens
ggtgggcaccatctaatcagctgccagcgtggccagaataaagcaggcagaaaaatgtgaaaagagagactggcctggcctcccagcctacatcttgctcygtgctggatgcttcctgcccttgaacataggactcccaagttcttcagtttcggaactcgggactggctctccttgttcctcagcctgcagacggcctat

SEQ ID NO: 43878 - DNA, 201 bp, Homo sapiens
tcatgcaaaacatcttattttgagagcttgagattttccctgggggtgcccgccttcccccaggctctgtgcccacccaccctcctagggctcagtgcccrccttcccccaggctctgtgcccacccaccctcctagggctcagtgcccaccttcccccaggctctgtgcccacccaccctcctagggctcagtgcccacc

SEQ ID NO: 43879 - DNA, 201 bp, Homo sapiens
gtccctgtgtctttgtgtatatatatccatgcctgtgtgcctgtgttcctgcgtgtgcttgtgtgtgcacgtgtgcatttgtgtgtttgtcagagtatgtrtgcatgtgtgtgtctgtcagcgtatccatgtgtgcatgtgtgtgtctgtcagcgtatccgtgtgtgcatgtgtgtgtctgtcagcttaaccatgtgtgca

SEQ ID NO: 43880 - DNA, 201 bp, Homo sapiens
gcagacaccggcgggcttgcttacaggccctgctgactccagagtcttactgccacccgagcagtacgtggaggtgcttgtcctgtgaccgccccccccccgggctgatgacgggccaggtggcacttcacctgggggctctggggaggctgtctcgggctcccgtgccaggggtgggtgcagggaggctgggcaggcagg

SEQ ID NO: 43881 - DNA, 201 bp, Homo sapiens
acggtcccaaggcccaccctgtagggcttacacagctgcctacacagggtgcccatcgtggtggctcctgacctctgccgttggctctgggtgggagcagyggggctgggtttctctgactggcgcccctactgcatgccaccccagcaggagccccagggcctcggcatctccactctgttcccttgttatctcgccctg

SEQ ID NO: 43882 - DNA, 201 bp, Homo sapiens
tacggtcccaaggcccaccctgtagggcttacacagctgcctacacagggtgcccatcgtggtggctcctgacctctgccgttggctctgggtgggagcartggggctgggtttctctgactggcgcccctactgcatgccaccccagcaggagccccagggcctcggcatctccactctgttcccttgttatctcgccct

SEQ ID NO: 43883 - DNA, 201 bp, Homo sapiens
acctctgggagttgtttgtgtgagctttagtctccaaatcgagtcatctagaggcagacatactagctacgtttgctttatcaactttgggaattgacgtrattttggaaacataagaccttcttaattcagagatacaaaacccaatttgatatgcagattgtccatttgcagtctggaatttccttgtgagtggcgaac

SEQ ID NO: 43884 - DNA, 201 bp, Homo sapiens
caaaaaagcaaaaccaaagcagacatttcccatctaccaaaacagagaaattttagtgatagcctctgcttccttttcggagtatgtaagccaaaaggaartgaaactttttatttaatcctcacccattttggaggttttctttactgtaaggtttcctttccagtgtcaggcttaaccttcaagcagttaccactttag

SEQ ID NO: 43885 - DNA, 201 bp, Homo sapiens
aaagttcactcacatttgttcagttaaacagatggttggcttatctttagttgcttcactcagtcatttccaaaaccacacccaaggccaggcagtggctyatgcctgtatttctagcagtttgggaagctgaggtcagaggatcacttgaaaccaggagtttgagaccagccttggccacgtagtgagaccatggctcaa

SEQ ID NO: 43886 - DNA, 201 bp, Homo sapiens
gcaatctcagctcactgcaacctccgtctcccgggttcaagcgattctcctgcctcagcctcccgagtagctggaattacagtgcacgccactacgcccgrctaatttttgtatttttagcagtgacggggttttgccatgttggccaggctggtcttttttttttttttttaaactagatgtttcctttattcattcaca

SEQ ID NO: 43887 - DNA, 201 bp, Homo sapiens
gggacacagcgggtacagaaggggtctctggagtttcgtgaggaagtattcgggctgtgcggcgccgcgaccctggcaggacgctgctgtcccgccagcgraagcggggcgcgctcagggctgcgggcagcgggggtgcagcggggagagccagggcctgggcgcggaggaggggctggtatgggaccctccgggtgggcg

SEQ ID NO: 43888 - DNA, 201 bp, Homo sapiens
cctcccaaagtgctgggattacaggtgtgagccactgtgcccggcccagcattatttgtaataatgaaattattattattattattattattattattatwttaggcagagtctcactctgtggcccaggctggagtgcagtggcatgatctcggctcactcaacctctaccttccgagttcaggcaattctgctgcctca

SEQ ID NO: 43889 - DNA, 201 bp, Homo sapiens
tggtgtgaacccgtgaggcggagcctgcagagagccgagattgcaccactgcactccagcctgggcgacagagcgacactccatctcaaaaaaaaaaaaaagatggaattagtctcttactccacaacagaggtaaggaagagtatgcatggaatacaggagatccattaggacatctcttagtattatctaatgccctgt

SEQ ID NO: 43890 - DNA, 201 bp, Homo sapiens
ggagagacggtggcgtcacccagtccccgagggggctggcacttgggaggcgagggcaggtgcttggcccccagcctgccccagcaccatcccgcgccctyacctgaagcggccaccaggggccccgcggccctggccagagcacctaggctgcgcagtgtacccatgaccgtgcccttctgccctggtgagcctgtggga

SEQ ID NO: 43891 - DNA, 201 bp, Homo sapiens
cccaggaacataccaggcacagcagcatcaccgggcgcctccccaagcagtcagaggtggccccagtgagtggcgcacacagaaactgcaggacagagaakgccgagccaatgagacctgagagacagatgtcaccatcatggggctgcctggcaccatgagctgtggtcttggggccctcaaggccaatgtccagccccg

SEQ ID NO: 43892 - DNA, 201 bp, Homo sapiens
gtgagcatgcgcatgctccagtaaacacactacgcatgctccctcccaagtgctagcaggccagtgtgtgtgcaggcagcccaccccaagggaggaattgsgagaagggacgcgaggccctgaagtatgccaacacctagaaccctacatcagaggccggatggggcacttgcctctcgagttgcccacttggcctcttcc

SEQ ID NO: 43893 - DNA, 201 bp, Homo sapiens
cgggtgatctgcccaccttacctcggcctcccaaagtgctgggattacaggcgtgagctgccacacccggcccaattttttttttttttttttttttttttggtagagaaggcatctctttatgttgcccaggctggcctctgagtatctttccacctcagtcttccaaagtactaggattacaagcatgaactacctccc

SEQ ID NO: 43894 - DNA, 201 bp, Homo sapiens
ggctctcaggccacttactgctatacggtcccaaggcccaccctgtagggcttacacagctgcctacacagggtgcccatcgtggtggctcctgacctctsccgttggctctgggtgggagcagtggggctgggtttctctgactggcgcccctactgcatgccaccccagcaggagccccagggcctcggcatctccact

SEQ ID NO: 43895 - DNA, 201 bp, Homo sapiens
aaccctgtctatactaaaaatagaaaaaaattacctgggtgtggtggcggacacctgtagtcccagctacttgggaggctgaggcaggagaatggcgtgarcccaggaggcagagcttgcagtgagccgagatcgcgccactgcactccagcctgggcgacagagcgagactccgtctcaaaaaaaaaacaaaaaaactct

SEQ ID NO: 43896 - DNA, 201 bp, Homo sapiens
ggtggatcacttgagggtcaggggtttgagaccatcctggccgacatggtgaaaccccacctttactaaaaataccaaaaaaaaaaaaaaaaaaaaaaaaaagccgggtgtggtggtgcacatctgtagtcccagctactctggagtctgaggcaggagaatctcttgaacccaggaagaggaggttgtagtgagcccaga

SEQ ID NO: 43897 - DNA, 201 bp, Homo sapiens
taggcgaggcgcggtggctcacgcctgtaatcccagcactttgggaggccgaggcgggaggatcacgacatcaggagatcgagaccatcctggctaacgcrgtgaaaccctgtctatactaaaaatagaaaaaaattacctgggtgtggtggcggacacctgtagtcccagctacttgggaggctgaggcaggagaatggc

SEQ ID NO: 43898 - DNA, 201 bp, Homo sapiens
ttcccttgttggtaagtcagcgggatttgaacttgtgcctcgggatcgacagatttctgtgtagtactagagcatgtccctgttgtcacagggccacctggcacccccccaagtgtggtattgacagggaaaagagcattttaccaattcaggtctgtgcataccggcaagggagcacctctcagcagcctcctgcactgg

SEQ ID NO: 43899 - DNA, 201 bp, Homo sapiens
ctgctactgctaataataatagtgatagctaccacttactgtttactatgtaccttgtgctaaacacttgacataagttaactcgtttaatcttaaaccarggaagtagataatgattctcattttacagatgaagaaactgaaatagacagagatgaagaaatgtgcctaaggttacgcggtttagtgaactgggatcag

SEQ ID NO: 43900 - DNA, 201 bp, Homo sapiens
aagctactcaggagaccagggtgggaggatcacttgagtccagaagttcgagaccagcctgtgcaacatagcaagatcctgtctcaaaaaaaaaaaaaaaaaaaaaagttgaaaaagaaaaaagttgaaaatgagagaaaaaaaggaattgaaggaccagtctgggacacttaacatctacataatatgtctagataggga

SEQ ID NO: 43901 - DNA, 201 bp, Homo sapiens
caccactcccaaccttcacctaagttcttgaaagataattttgcttgatatagaaatccagattgacagttatttcttttcagcattttggagttatcctrctgctctctacttttgttgtttctgttggcaagtttggcagtagtcggtttgttattcccttgtaggtgatctgtctttttttcttctggcttctgttag

SEQ ID NO: 43902 - DNA, 201 bp, Homo sapiens
actacaggtgtgttccacgacaccaggctaatttttgtattttttatagagatggcggcgggggtggggtgcacctcactatgttgcccaggctggtcttkaactcctgggctcaagtgatcctcctgcctcagcctcctaaagtgctgggattacaggtgtgagccaccgcctggcctccgtaattcttttacttcctca

SEQ ID NO: 43903 - DNA, 201 bp, Homo sapiens
tagtctattttgtggtgctgtaacagaatactcaagactgggtcatctgggtcatttatagaacagatttctttcttttctttttttttttttttttttttgagatggagtcttcctctgctgccaggctggagtgtggtggcgggatctcggctcattgcaacctccgcctcctgggttcaagcgagtctcctgcctcag

SEQ ID NO: 43904 - DNA, 201 bp, Homo sapiens
attttacttgaaaactaagttgatgaaacctgcagtcataattgataaaaatgaaggacaggtttgtactgcaaagtagaattatgcttaatcttgattaytgggctcagaatgtgtatactttcattttgatttacatttatagacttccttattgaaggaatggagcatgtatatacctggcctgcagtgtttatctta

SEQ ID NO: 43905 - DNA, 201 bp, Homo sapiens
acgtgaagtataatgatccttattctttatggcattttttttttttttttgacggagtctggctctgtcacccaggccagagtgtgcagtggcgtgatctyggctcactgcaagctccacctcctgggttcacgctattctcctgcctcagcctcctgagtagctgggactacaggcgcccgccactacacccggctaatt

SEQ ID NO: 43906 - DNA, 201 bp, Homo sapiens
ctatgaaaaatgttccagaagttagttttttgcatgtttttccctttctctctctttttttaactttttgattaaataatattattattattttttaagayggagtcttactctgttgttcaggctggagtgcagcggcatgactcagctcactgcaaactttgcctcccaggttgaagtaattcttgtgcctcagcctcc

SEQ ID NO: 43907 - DNA, 201 bp, Homo sapiens
atccatacgtgaagtataatgatccttattctttatggcattttttttttttttttgacggagtctggctctgtcacccaggccagagtgtgcagtggcgkgatctcggctcactgcaagctccacctcctgggttcacgctattctcctgcctcagcctcctgagtagctgggactacaggcgcccgccactacacccgg

SEQ ID NO: 43908 - DNA, 201 bp, Homo sapiens
gggtcaggcagtgggcaggggcctgacctaggctcccactctgcctggtgcccacagcctgggcacagtggctcagctactcagccttgagcgtctgtgcygggtaactcagcttctgcaggaggaagaaggggagcaaaaagagcccggaccacgtggtgaagcaggcctgggccccggccagccagtacactgcggaga

SEQ ID NO: 43909 - DNA, 201 bp, Homo sapiens
caagcgattctcctgcctcagcctcccgagtagctggaattacagtgcacgccactacgcccggctaatttttgtatttttagcagtgacggggttttgcyatgttggccaggctggtcttttttttttttttttaaactagatgtttcctttattcattcacacacttaagtaacatagacttataatttgtaacaaata

SEQ ID NO: 43910 - DNA, 201 bp, Homo sapiens
ctccccagcgtgggcccctgagcgctgggggaagttggttggtttgttaatgacagagtctcgctctgttgcccaggctggagtgcaatggtgcaatctcrgctcactgcaacctccgtctcccgggttcaagcgattctcctgcctcagcctcccgagtagctggaattacagtgcacgccactacgcccggctaatttt

SEQ ID NO: 43911 - DNA, 201 bp, Homo sapiens
gccacaccatgcccagcagagcgggccccatctcctcagggggagcggcgcctgtgtgcccatagccctttcccggttctcatgaagcgtggcctggaatyagcctggggcagctggcagggtgggggtgcttccagcttcccaaaggtaaagcactgagagtttggggcctgggcctcctgtgctgctcctaaccactca

SEQ ID NO: 43912 - DNA, 201 bp, Homo sapiens
aagcttcagtgagctatgcttacgccacctcactccagcctaagcaatagagagatcctttctccaaaaaaattaaaacaaaaggcaaaccattaggattmcacagcaagcttttgaccactaaactacaaagaggtcttcagcctgaccaaggagccccatggcaagaccagaggaggtgctgctgcttcatgggtttgc

SEQ ID NO: 43913 - DNA, 201 bp, Homo sapiens
agagcggcccagcctccctggcatctggggctggcacacaggggcactttacatcgctatggaatcaagcctccagcccctaggcctgtgggtcccagacyacagccctacccgtttctccaggggcagcgtctctggcaggaagcagaagatgaacagcaggtcggaggctgcgaagagcagggcaaaccagggtgccat

SEQ ID NO: 43914 - DNA, 201 bp, Homo sapiens
ctgcaggttccgagccccgccccgcgggaatgcagctaaggcccggcgagaaattgagcacagcagctgctggcccaggtgctaagcccctcactgcctgkggccggtggggccggctggctgctccgagtgcagggtccgccgagcccacgaaccccaccagaaggaagaaactctgaacacgtccgaacatcagaagga

SEQ ID NO: 43915 - DNA, 201 bp, Homo sapiens
gcctgcagagggaggccagctccccgccccagggtcagccaggctggcaggcaacagcctcaagaaggcagtgtgcgtgccatggcacacggggctgaggycgcgaggcaggggccgagggaagcggcacagagcttctctcaggcaccagaggggagctgagttctgggctcagagcaggcttcgtctgagggcttcagc

SEQ ID NO: 43916 - DNA, 201 bp, Homo sapiens
ggcgctcgtcagggaggctcgggctgcacaggagcccacggaggagcgggggaggctcaggcatggcgggctgcaggttccgagccccgccccgcgggaakgcagctaaggcccggcgagaaattgagcacagcagctgctggcccaggtgctaagcccctcactgcctgtggccggtggggccggctggctgctccgagt

SEQ ID NO: 43917 - DNA, 201 bp, Homo sapiens
ctttaggggggaaatagatgacccccaccatccggatactcagtttttattcttttttttttttgagatggagtttcgctcttgttgcccaggctggagckcaatggctcgatctcggctcaccgcaacctccgcctcccaggttcaagcaattctacttcagcctcccgagtagctgagattacaggcatgcatcactac

SEQ ID NO: 43918 - DNA, 201 bp, Homo sapiens
acaaaggttcttcacgtccccgccagattagctagatacattgtcgattggtgcattcacaaaccctgagctagacacagggtgctgattggtgtgtttaygaaccttgagctagatacagagtaccgattggtgaatttacaatcccttagctagacataaaggttctccacgtccccaccagactcaggagcccagctg

SEQ ID NO: 43919 - DNA, 201 bp, Homo sapiens
gacccaaagactaaaagaacaaagcttccacaatgtggtaagggtaccccagcgggttgccgctcctggctcgggcagccttcttttattctcttatctgrccccacccacatcctgctgattggtagagccgagtggtctgttttcacagggtgctgattggtgtgtttacaatccctgagctagacacaaaggttcttc

SEQ ID NO: 43920 - DNA, 201 bp, Homo sapiens
ctccccccacagcctccacccacagctgggcttctgggcttcccccgccaggccagacaccagtggcttcttccctggcgtggagcagacggagggtctcyggatgcgggggaatatcaggctcagcggggctgaggtttcatgctgaaggtgggaggatgtgatgcacatttacatgatgccaagaccccagcgccgtcc

SEQ ID NO: 43921 - DNA, 201 bp, Homo sapiens
acatttccaaattaccctcctggccccaattaatattcttacatttccatctttgggcacctatgaagtatatctatagatacattctcagaagtgagatkgccatgtcaaagagtaattacacttttactttccgtagatgtttccagattatcctcctaagaagttacgttggtttatactcctaccaactgtgtattt

SEQ ID NO: 43922 - DNA, 201 bp, Homo sapiens
gtgtggacccaaagactaaaagaacaaagcttccacaatgtggtaagggtaccccagcgggttgccgctcctggctcgggcagccttcttttattctcttrtctggccccacccacatcctgctgattggtagagccgagtggtctgttttcacagggtgctgattggtgtgtttacaatccctgagctagacacaaaggt

SEQ ID NO: 43923 - DNA, 201 bp, Homo sapiens
tgaggagctcgggcggggtctggggaaagggtgggggctgccacagacagaagtgggttcgtcgaggctgcagaaggctgggtgggagtggaggaggtgaygtgaccaggatggggtcggtgacccctgcacaggggctacaggggatgaaaggggagggagcagcagactgctgagattggggtggcattggccctggtg

SEQ ID NO: 43924 - DNA, 201 bp, Homo sapiens
gaatgcatagattctctccttgtgcttttttctccctgtggctgcgtcacaagcaggagacggatgcgctagagagtacctgttaccctagtaagtaccgygctgcctccgctctccaccggtgccctgcgctttgcctcattctcctgcttctttgttgtttattaagttttgttttctgtttatttaaaataaaaacag

SEQ ID NO: 43925 - DNA, 201 bp, Homo sapiens
gagtgcagcaagcaggggagggactggagtagccatagaagggaccaggacagactgagccccaaacgtcccccttgcctggcccagcccatgtgtttccrgtattggtgggttcttggtctcactgacttcaagaatgaagctgtggaccctggcaatgagtgttacagctcttaaaggcagcgtgtccggagtttgttc

SEQ ID NO: 43926 - DNA, 201 bp, Homo sapiens
ggccccctcgaagacctacccagagccacccttgcggcaggcagggtcctggcccttccagtacgaagctgggaaaaggcagcaccaaagatgccaggggygcctcacggatccccccgggggggcctccttgagggggagcaggaggaggggccaggctgagggctcaggctgtgtgaaagacaccctggttttgaaaag

SEQ ID NO: 43927 - DNA, 201 bp, Homo sapiens
gtatgtgagctgtgaccaggtaggaaggccggcctcgggggtcggaacccaccatggttgctggtgtccacgttgcccattgctcgcacactcctcgtgcygtgttgtcatgcagatgccaccttcggaggtgccctccgctgtgtgagccacacgccggctgcctctcagccaccgtgtgtctgtggtgtgtgatcccgg

SEQ ID NO: 43928 - DNA, 201 bp, Homo sapiens
tcccaagtagctgggactacaggcgcccgccaccacgcccagctaattttttgtatttttagtagagatgggttttcaccatgttagccaggatggtctcratctcctgacctcgtgatccgccgccttggcctcccaaagtgctgggattacaggcatgagccaccgcgtccggacccttgtgtccatttttaatttaat

SEQ ID NO: 43929 - DNA, 201 bp, Homo sapiens
ccagtttgtgttactttgttacagcagctctaggaaattaacacacccaaccccaattacttcttaaagaatttaaaaaggttcttaaaatgacaattttwttttgagatagggtctcgccctgtcacccaggctggagtacagtggtgccaccatggttcactgtagcctccacctcccagactcaagtgatcctcttgc

SEQ ID NO: 43930 - DNA, 201 bp, Homo sapiens
tttaacaattggccgggcatggtggctcatgcctgtaatcacactacttcgggatgctgaggcgggaggattgctgagcccaggagttggagaccagcctrggcaacatagtgagaccccgtctgtacaaaaaaaattaaaaaattaaccagtgtggtgcgtgcctgtacttccagctacttgggaggctgaggtgggaag

SEQ ID NO: 43931 - DNA, 201 bp, Homo sapiens
agaaatctgtgaattagcaacttgcataggatagcatctgctctggataggaaggtctccaagtgtttcctttcaccataatctcttaagcactgtaattktgaacctttacagttgtaacaatcattaaaaacaactgtgaaggtcatagttcttttattcagaattaaatagaacagaaggatttttcaggtgctattt

SEQ ID NO: 43932 - DNA, 201 bp, Homo sapiens
cctgtaatcccaacacttttggaggccaaggcaggaggatcacttgagctcaaaagtttgggaccagcttgggcaacatagtgaaaccctgtctctatttwaaaaaaaaaaaaaaaggtcagcatgctttttaagataaaggaggctgggcacggtggctcatgcctctaatcccagcatttttggaggccagaaaaagtg

SEQ ID NO: 43933 - DNA, 201 bp, Homo sapiens
ttgaacttctggcctcaagccatcctcccatttcagcctcccaaagttttaggagtataggtgtgaggcaccatacccagtctggatgcttttaatttcartttctttttctttttttttgagacggagtctcgctctgttgcccaggctggtgtgcagtggtgctatctcggctcacggcaagctctgcctcccaggttc

SEQ ID NO: 43934 - DNA, 201 bp, Homo sapiens
gtgtttgtgggggctggggggagggggacaagacggggtggcccagttagcacagtggactgggcttcctctctcggtggcacttagctgatggcttggcctgcccattctgatgtcagtggaatgctgtcaaggctttgcacctgcagaacctggcaggtgcttgttcaactccattctggattccagagaatgctaagc

SEQ ID NO: 43935 - DNA, 201 bp, Homo sapiens
ccataatttctgaaggttagaactgaagagagtcaaggcatacttacaatctccatttgaatcttgtttttcttgctcgaatatcaatcttgatttcgcawcaccccatagcagctctgtggaggccttttttgtctgtatagaagcaaagagaggagttaaaaaaaaatagtggaatattaaaatttcaggaaaggtttg

SEQ ID NO: 43936 - DNA, 201 bp, Homo sapiens
ggcgggcggatcacgaggtcaggggattgagactatcctggctaacacagtgaaaccccatctctactaaaaatacaaaaaatcagccgggcgtggtggcrggtgcttgtagtcccagctactcgggaggctgaggcaggggaatggcgtgaacctggggggtggagcttgcagtgagccgagattgtgccactgtactcc

SEQ ID NO: 43937 - DNA, 201 bp, Homo sapiens
tggcgtgaacccgggaggcggagcttgcagtaagccgagatcatgccactgcacttcagcctgggtgacatagagagactccgtcccaaaaaaaaaaaaaattagccgggcatagtggcgcatgcctgtaatcccagctactcgggcggctgaggcaggagaatcacttgaaaccgggaggcggaggttgcagtgagcgga

SEQ ID NO: 43938 - DNA, 201 bp, Homo sapiens
cccccacctggctcaccctttctcttcctctcctcctctgggcaccttctttgactcccacaggctcctagctcagacctctccactcttcctggctttcyttcagggaggtcaggaaagtcagggacccgtggataaagaccaggagaacacaatgtaagtatctgggcaaagaacctcctaggcagagggcttggcgag

SEQ ID NO: 43939 - DNA, 201 bp, Homo sapiens
cttgcctggctcccagggctagggttagggctctggaggtgctttcactcaaccaagggggccacagcactggggagtgaaactgccccgcctcaccctgygttgccctctgggtctgtgagggtgggctggcaggaggcctaggccttgccctaggggcagtcctgcttcctcattttatagatagggaaactgaggctt

SEQ ID NO: 43940 - DNA, 201 bp, Homo sapiens
aggcgacgctttattccatagaacaggatggggctcccaccctggggaccatacaagtgactccctcaggcagccacccctttctaggcaggctgggggargggctggcacaccagcaccagatagctctggcttaagcctgatggagacacagactgggacctccctctgccagatgttcctgaccccatctccacctcc

SEQ ID NO: 43941 - DNA, 201 bp, Homo sapiens
gtctttatttgaagattattatctcaggactatgtatgggttcaagtagacaaggggtggactcatgatggttaatactgagtgtcaacttgattgaaggwtaggaagtattgatctgggtgtgtctgtgagggtgttgccaaggagattaacatttgagtcagtgggctggggaaggcagatccaccctcaatcggggtg

SEQ ID NO: 43942 - DNA, 201 bp, Homo sapiens
cccaggttgaagtaattcttgtgcctcagcctcctgagtagctgagattacaggtgcgtgcccccacgccccgctaatttttgcatttttattagaaacarggtgtcaccatgttgcccaggctggtttcaatctcctgagctcaggcatccacttgcctcggcctcccaaagtgccaggattacagacatgtgccactgt

SEQ ID NO: 43943 - DNA, 201 bp, Homo sapiens
gaggcagaggcaggctgatcacctgacgtcaggagttcgaaaccagccaggccaacgtggcgaaaccccttctctactaaaaatacaaaaattagccgggygtggtggcaggcgcctgtaatcctagctaatcgggagcctgaggtgggagaatcacttgaacctgggaggcggaggtagcagtgagctgagccgagatca

SEQ ID NO: 43944 - DNA, 201 bp, Homo sapiens
aggccagaagtttgaaaacaatatcactggaccaaaatcaaggtgtcactagggctgtgcattcttcctctggaggtcgtatgggagaatctgttcctcgyctcttccagcttctcatggctgccacattccttggctgtggctgcatcactccaatctttgtgacccaggtcagattggtttcttgtcttctgtgtggtt

SEQ ID NO: 43945 - DNA, 201 bp, Homo sapiens
ctctgcaggggtttcctcttcagcctgcctggggtgagaggtcagtgcaccacagccgaggctggagcacagggagcttctgttgttctgatctatctctrgaaaaccagccattcctcctccctgcagtcagaattctttgccctgtctgacctgaacttgcttagggagtcatgccactccccactgtggccatagttt

SEQ ID NO: 43946 - DNA, 201 bp, Homo sapiens
aggcaaagggaatacagaatgggtagtagaagaaggtaggcatcaataacggctatgaccacatgaccagctgcaggaaccaggactgtaattgctgtgagtatttcctccttttgataaaaaacgtttgtgcatgtatacgctagtactaagaaaatctcttcatttcctttctcctttatcgtgtgacataagatttat

SEQ ID NO: 43947 - DNA, 201 bp, Homo sapiens
ctaggaggcgtaggctgcagtgagccaagatcatgccactgcattccagtctgggcgacagaatgagactccatcttaagaaagcaagcaagcaagcaagmaagaaagaatatgtatttaatttgtgtgagaaagggaggtgcaaggttctgtatatctctaatgatctaactttttgcttgcattgctcatatttcctat

SEQ ID NO: 43948 - DNA, 201 bp, Homo sapiens
aaggcaaagggaatacagaatgggtagtagaagaaggtaggcatcaataacggctatgaccacatgaccagctgcaggaaccaggactgtaattgctgtgagtatttcctccttttgataaaaaacgtttgtgcatgtatacgctagtactaagaaaatctcttcatttcctttctcctttatcgtgtgacataagattta

SEQ ID NO: 43949 - DNA, 201 bp, Homo sapiens
gagatggggtttcaccgtgttagccaggatggtctcaatctcctgacctcatgatccgcccgcctcggcctcccaaagtgctgggattacaggcgtgagcyaccgcgcctggccacgcccggctaatttttatatttgtagtagagatggggtttcaccacgttgcccaggctggtcttgaactcctgacctcaagtgacc

SEQ ID NO: 43950 - DNA, 201 bp, Homo sapiens
gaaggcaaagggaatacagaatgggtagtagaagaaggtaggcatcaataacggctatgaccacatgaccagctgcaggaaccaggactgtaattgctgtgagtatttcctccttttgataaaaaacgtttgtgcatgtatacgctagtactaagaaaatctcttcatttcctttctcctttatcgtgtgacataagattt

SEQ ID NO: 43951 - DNA, 201 bp, Homo sapiens
tgcctcagcctcctgagtagctgggaacaggtgtgtgccaccatgcccggctgatttttttttctgagacggtgtcttgctctgtcgcccaggctggagtkcagtggcacgatcttggctcactgcaagctctgcctcccgggttcacgccattctcctgcctcagcctcctgagtagctgggactacaggcgcctgccac

SEQ ID NO: 43952 - DNA, 201 bp, Homo sapiens
ttctgaagtcacaattacaacaccaactaggtgacaatactttgcagggctgggaccaagttctccagaaggccatgtatgctctgaatcagcatccaagmtatgatattgtttctcccttaaccaggatgcacgggtccaggaatcaaggcactcaagtggaagtggcaccactcgccatcacccctagtgatccactag

SEQ ID NO: 43953 - DNA, 201 bp, Homo sapiens
ataggcaaatctttttgttttttgttttttgtgagactgaatctcactctcttgcccaggctggagtgcagtggtgcgatcttggctcactgcaacctccwcctcccaagttcaagcgattctcctgcctcagcctcctgagtagctgggaacaggtgtgtgccaccatgcccggctgatttttttttctgagacggtgtc

SEQ ID NO: 43954 - DNA, 201 bp, Homo sapiens
ttatcagcgatggggctgttggtcacctttgccctccctctcttttcttttttcttaatcttttattttcgttttttgggagatgtcagagggcctttccctgttaggatgacttttatctttgctcttgtaatggctcaagatagttgggaggtaatttgcattcactttatgcatacccaccttgaaaaacgtattttg

SEQ ID NO: 43955 - DNA, 201 bp, Homo sapiens
aaaatacaaaaattagctgggtgttgtggtatgcacctgtagtcctaactatttgggaagctgaggcaggagaatcgcttgaacctgggaggcagaggttrcagtgagccaagatcgtgccactgcactccagcctgggtgacagagactccatttgaaaaaaattaaaaattagctaggtgtggccaggcacagtggctc

SEQ ID NO: 43956 - DNA, 201 bp, Homo sapiens; identical to SEQ ID NO: 11432

SEQ ID NO: 43957 - DNA, 201 bp, Homo sapiens
ttgattctgtgctgggtggagggggctggaggcagaggaagcctgaggagaggaagtggagggggttgccaagaggcaatggagaggggcctggcagggcrgctggaaggaggtgggatccttgaggcaggccagacaagggcactgagaacagaggcacagagatgggacagagcctcgaaggctgggtgcagtgggaag

SEQ ID NO: 43958 - DNA, 201 bp, Homo sapiens; identical to SEQ ID NO: 11420

SEQ ID NO: 43959 - DNA, 201 bp, Homo sapiens
gaactggacatcagggacatcaagatgtacagccccaaggtcatgagtgttttgtcaggagccttagaccagtctggcccagcctggagctccctccgcaygtggcctctgacaggagtgacgcagccccatgcggtgctaacagtggcagcactgaacgtcggatggggctgagcccagccacttccacaatggctgtag

SEQ ID NO: 43960 - DNA, 201 bp, Homo sapiens
gtagatgtctggcattatttctgaggcctctgttctgttccgttggtctctatatctgttttggtaccagtaccgtgctgttttggttactgtagccttgwagtatagtttgaagtcaggtagtgtgatgcctacagctttgttctttttgcttaggattgtcttggccatacgggctcttttttggttccatatgaaatt

SEQ ID NO: 43961 - DNA, 201 bp, Homo sapiens
tgagaaggcaaggctgagcggcaagcctgggtcccagtggccagtaggtggacaggtggtgggaaagccataggccagggcggcccctcacagaccgtccygagcaaggaccccccgagaacccgggagcctagggggacacagcaccatgtaaagccccggatcccggcaccgggtggccaccgtccggggagtggtggt

SEQ ID NO: 43962 - DNA, 201 bp, Homo sapiens
atggttgtagatgtctggcattatttctgaggcctctgttctgttccgttggtctctatatctgttttggtaccagtaccgtgctgttttggttactgtarccttgtagtatagtttgaagtcaggtagtgtgatgcctacagctttgttctttttgcttaggattgtcttggccatacgggctcttttttggttccatat

SEQ ID NO: 43963 - DNA, 201 bp, Homo sapiens
ggtctcaaacgcctgggttcaagtgattctccaacctcagcctcccaaagtagtaggaaaacaggcatgagccaccatggccagcttcagatctcctctttggtgtcagtttcaggaaggaaaaaccaagaaacaagaatgttgactatttgcctggctaagacctgacacaggaatccttttaaacagctttagagttga

SEQ ID NO: 43964 - DNA, 201 bp, Homo sapiens
gctggtctcaaacgcctgggttcaagtgattctccaacctcagcctcccaaagtagtaggaaaacaggcatgagccaccatggccagcttcagatctcctctttggtgtcagtttcaggaaggaaaaaccaagaaacaagaatgttgactatttgcctggctaagacctgacacaggaatccttttaaacagctttagagt

SEQ ID NO: 43965 - DNA, 201 bp, Homo sapiens
gggacaggggtctcactgtctttctcaggctggtttcaaattctggggctcaagcaatcctcccacctcggcctcccacagtgctgggattacaggcgtgrgccaccgtgcctggcctaggttcatttcctgaccttgtctgaagtgctctgggtgcaggctcctggacatggaggacggaggggaagtgaggtgggaaca

SEQ ID NO: 43966 - DNA, 201 bp, Homo sapiens
gggctggtctcaaacgcctgggttcaagtgattctccaacctcagcctcccaaagtagtaggaaaacaggcatgagccaccatggccagcttcagatctcctctttggtgtcagtttcaggaaggaaaaaccaagaaacaagaatgttgactatttgcctggctaagacctgacacaggaatccttttaaacagctttaga

SEQ ID NO: 43967 - DNA, 201 bp, Homo sapiens
cagcattcgaagttgttactgagaaatggccagtctgagcaacgtggtgcatttctgcagttccgcacgggactttggtcagtgcgtgttttgggtttcaraatttgccttttccatgactctgactgcagacagcctcttctgggcagtctgttgctgttggcagcggccactcccgagtgcccttccaccctcgctggt

SEQ ID NO: 43968 - DNA, 201 bp, Homo sapiens
gaagtcacgaaattaccaagaactatggtgaactaattactccaaaccctagggctgtgactacctcttgggagaggacagcacggcgccacggttagcaktgtcaggttttgtgacctgggggtgctgtgactcaggattctccctgctggttatgtggctgtcctgtgtgtcagacaccgtgtgcatgtctcacgtagt

SEQ ID NO: 43969 - DNA, 201 bp, Homo sapiens
ctgttaaattactttggaaaagagtttggcagactctagcaaaattgaagttgtgcctcccgtgcaaccccacaaacagctgcacacttgtgtgcacgacyagaggttctcctgcatgtcccgggggcggggcaaacgtgaggcaagcagcagcatctgtctgttcactgccatgtgttcataccgcagtgaagacgaaca

SEQ ID NO: 43970 - DNA, 201 bp, Homo sapiens
tcccctcccaccttcaggctcccgggtccagcccctcttctcctgccgctccctccctccttccctctggggtcccagtgccaacagtccttcagcccacsagggtctgcgggccgcttgcctcagtttccttccatgcagagctcttgtctcacagtgttcaccatgcctgtcccttcgcccacacactactgccttccg

SEQ ID NO: 43971 - DNA, 201 bp, Homo sapiens
gtagtcccagctactcaggaaattgacacaggagtatcccttgagctcaggagtttgaagcttcagtgagctatgcttacgccacctcactccagcctaarcaatagagagatcctttctccaaaaaaattaaaacaaaaggcaaaccattaggattacacagcaagcttttgaccactaaactacaaagaggtcttcagc

SEQ ID NO: 43972 - DNA, 201 bp, Homo sapiens
tctctgacatgccccgggcccactcctttacctccaagggccccggtcccctactgccacccccgccccctaagcacggcctcccagatgttggcctggckgctgaggactccaagagggacccactgtgcccgaggcgggctgagccttgccccagggtacctgctaccccccgaaggatgagcgatccccctctgagca

SEQ ID NO: 43973 - DNA, 201 bp, Homo sapiens
gcctgtagtcccagctactcaggaaattgacacaggagtatcccttgagctcaggagtttgaagcttcagtgagctatgcttacgccacctcactccagcytaagcaatagagagatcctttctccaaaaaaattaaaacaaaaggcaaaccattaggattacacagcaagcttttgaccactaaactacaaagaggtctt

SEQ ID NO: 43974 - DNA, 201 bp, Homo sapiens; identical to SEQ ID NO: 11425

SEQ ID NO: 43975 - DNA, 201 bp, Homo sapiens
ttgagagaaggtagggagatgagcacagaaacagagacctggagagtgtatcccaggtgccccgtcttccctaatgtgcatgtgcacacacacacacacacgcacacacgcacaagtgtacaggctcaaatgcaaatctccacgtgtgcacacatgcaaagatcacatactttctggaagggctcatggagcccagcagcc

SEQ ID NO: 43976 - DNA, 201 bp, Homo sapiens
aggcagagcttgcagtgagccgagattgcaccactgcactccagcctgggcaacagagcaagactccgtctcaaaaaaaaaaaaaaaaaaaaaaaaaaaaagccaggcatggtggtacatgcctgtagtcccagctactcaggaaattgacacaggagtatcccttgagctcaggagtttgaagcttcagtgagctatgct

SEQ ID NO: 43977 - DNA, 201 bp, Homo sapiens; identical to SEQ ID NO: 11427

SEQ ID NO: 43978 - DNA, 201 bp, Homo sapiens
tttgagagaaggtagggagatgagcacagaaacagagacctggagagtgtatcccaggtgccccgtcttccctaatgtgcatgtgcacacacacacacacacgcacacacgcacaagtgtacaggctcaaatgcaaatctccacgtgtgcacacatgcaaagatcacatactttctggaagggctcatggagcccagcagc

SEQ ID NO: 43979 - DNA, 201 bp, Homo sapiens
gaggcagagcttgcagtgagccgagattgcaccactgcactccagcctgggcaacagagcaagactccgtctcaaaaaaaaaaaaaaaaaaaaaaaaaaaaagccaggcatggtggtacatgcctgtagtcccagctactcaggaaattgacacaggagtatcccttgagctcaggagtttgaagcttcagtgagctatgc

SEQ ID NO: 43980 - DNA, 201 bp, Homo sapiens; identical to SEQ ID NO: 11429

SEQ ID NO: 43981 - DNA, 201 bp, Homo sapiens
ggccttggtgtttgggtcctaagtacacacatgttgtgtatgtgagtgtgtgtttctgttgtgagggggtaacggagagagctgtacaaggtccctgctgcccacctggggagtgccatgctctgaaacctgcaatgtggaggaccctcagggacctcagggactgccgggctggggctgtgctcgcagagcccaggctgg

SEQ ID NO: 43982 - DNA, 201 bp, Homo sapiens
ggaggcagagcttgcagtgagccgagattgcaccactgcactccagcctgggcaacagagcaagactccgtctcaaaaaaaaaaaaaaaaaaaaaaaaaaaaagccaggcatggtggtacatgcctgtagtcccagctactcaggaaattgacacaggagtatcccttgagctcaggagtttgaagcttcagtgagctatg

SEQ ID NO: 43983 - DNA, 201 bp, Homo sapiens; identical to SEQ ID NO: 11430

SEQ ID NO: 43984 - DNA, 201 bp, Homo sapiens
tggccttggtgtttgggtcctaagtacacacatgttgtgtatgtgagtgtgtgtttctgttgtgagggggtaacggagagagctgtacaaggtccctgctgcccacctggggagtgccatgctctgaaacctgcaatgtggaggaccctcagggacctcagggactgccgggctggggctgtgctcgcagagcccaggctg

SEQ ID NO: 43985 - DNA, 201 bp, Homo sapiens; identical to SEQ ID NO: 11433

SEQ ID NO: 43986 - DNA, 201 bp, Homo sapiens
gtggccttggtgtttgggtcctaagtacacacatgttgtgtatgtgagtgtgtgtttctgttgtgagggggtaacggagagagctgtacaaggtccctgctgcccacctggggagtgccatgctctgaaacctgcaatgtggaggaccctcagggacctcagggactgccgggctggggctgtgctcgcagagcccaggct

SEQ ID NO: 43987 - DNA, 201 bp, Homo sapiens
ggaggcgggggccagcctgctggggtggggcccaggtccgggaacttctcatgatacagcctgcagggtggccttggtgtttgggtcctaagtacacacatgttgtgtatgtgagtgtgtgtttctgttgtgagggggtaacggagagagctgtacaaggtccctgctgcccacctggggagtgccatgctctgaaacctg

SEQ ID NO: 43988 - DNA, 201 bp, Homo sapiens
gggaggcgggggccagcctgctggggtggggcccaggtccgggaacttctcatgatacagcctgcagggtggccttggtgtttgggtcctaagtacacacatgttgtgtatgtgagtgtgtgtttctgttgtgagggggtaacggagagagctgtacaaggtccctgctgcccacctggggagtgccatgctctgaaacct

SEQ ID NO: 43989 - DNA, 201 bp, Homo sapiens
tatttatttatttgagacagagtctcactgtgtcacccaggctggagtgcagtggctcaatctcggctcactgcagcctccacctcccaggttcaagcagytctcttgtctcagcctcccatgtagctgggactacaggcgccagccaccatgcatagttaattttttttttgtatttttagtggaaacggggtttcacca

SEQ ID NO: 43990 - DNA, 201 bp, Homo sapiens
gaggtgtttccttggagcactttcccagaagggagagggctgggtcaaaaggtaagtgtgttcccggtgtggtggctcacgcctgtaatcccaacactttkggaagctgaggcaggaggattacctgaggccgggaatttaagaccagcctgggcaatatagcaagaccccatctctactaaaaaaaaaaaaaaaagccac

SEQ ID NO: 43991 - DNA, 201 bp, Homo sapiens
cacgtcattgtgagcaccacgggccccaaccccttcaccacactcacagaccgtgagctggaggagtaccgcagggaggtggagaggaagcagaagggctstgaaggtgagtgcttgtggtcctgggcacggccactccagaaggtgaaagtgctctgggagcttctttgtggtccaggtgctggctgtgggtggtgataa

SEQ ID NO: 43992 - DNA, 201 bp, Homo sapiens
taacagagttttccttttttagttaatgaaataaattttggtgattttcaaaatgttggaaaaccttgcattcctgggataactcacatttggttgtgatrtattatccttttgctaggttgctggattggatttactaatgttttgttaaggatttttgtgtctatgttcatgaaggatattagtctataaatttcttgt

SEQ ID NO: 43993 - DNA, 201 bp, Homo sapiens
agttcccacatagaagcaggtttatagcaaagattctgtattcctgtctgtaatccctgctaataacattattttgcatatttacttattaattccacagktcctgtttttccctgtgcttagagcatccttccagctgccattcttggaagagcttctcagagcaggggagaaagatgactctgcctgttgcttgttttt

SEQ ID NO: 43994 - DNA, 201 bp, Homo sapiens
tcattggagagactacgtgttcctgttcagtggcgctctgtgagcactttgagggaccgcctgcatgcatgcgcacacgccatgtctcccacgtgagcccyttgctgcttgtgtatgactccctagtaaccctgggactatgcaccctctgcgctgcctcttgtctgtgaaatgggcaggacagtgggtggtcatgtgcaa

SEQ ID NO: 43995 - DNA, 201 bp, Homo sapiens
tggatctagccacccagtagagctaccagactctggactggtactggggagtgtcttcaaggagtcctgggatgtgatctgtcttcaggtctctcagctgyggataccagtacctgctccagtggaggtagcaggggagtgaagtggacttggtgagggtccttggttgtatttttgttaggtgcactgcttttgtgttgg

SEQ ID NO: 43996 - DNA, 201 bp, Homo sapiens
ctgtttttgtgtgtgtttgaaaatgtcagtaattaaaaaaaaaaaaagttttgtccgggtgctgtggttcatgcctgtagtcccagcacttcgggaagccmagacaggcggatcacttgaggtcagttcaagaccagcctgggcaacatggtgaaatcctgtctctacaaaaaatacaaaaaaagtaagccagatatggtg

SEQ ID NO: 43997 - DNA, 201 bp, Homo sapiens
agacaaggtttcaccactttgcccagtctggtcctggacttgagtgatccgcctgcctcagcctcccaaagtgctgggattataggcacgagccaccacawctgacctgacaattttttaatatctggccttaaatttgtacttttccgttttcaaagaatcctccaaaataaacagtacattacatgaaggaggtgaagc

SEQ ID NO: 43998 - DNA, 201 bp, Homo sapiens
caggagaattgcttgaacccaggaggtggaggttgcagtgagctgagatcgtgccactgcactccagcctggcaatagagcgagactccttatcagaaaasaaaaaaaaattggggtattaggaaaatgggtgcttttttcctagtgcattcctatagacttgcataccccactcatgctccttgggcctgggttccctgt

SEQ ID NO: 43999 - DNA, 201 bp, Homo sapiens
tcagtcagttaagcccattcacacttagtgatataactatgtggttggtctcaaccctgtcattattttataatttctgtattttctatttactgttttgytttttgggtttttttaaaatgtgttgtggggttttttgcttttttatttaaaaaaaaaattgtggggctgggcgtggtggctcatgcctgtaatcccagc

SEQ ID NO: 44000 - DNA, 201 bp, Homo sapiens
ccattctcctgactcagcctcccaagtagctgggactacaggcgcccaccacctcgcccggctaattttttgtattttttagtagagacggggtttcaccrtgttagccaggatggtctcgatctcctgaccttgtgatccacccaccttggcctcccaaagtgctgggattacaggcgtgagccaccacgcccggccact

SEQ ID NO: 44001 - DNA, 201 bp, Homo sapiens
ccatgttagccaggattgtctggatctcctgaccttgtgatccgcccgcctcgtcctcccaaagtgctgggattacaagtgtgagccactgcacccggccytttttttttttttttttttttttttgagacgaagtctcgctctattgcccaggctggagtgcagtggcgccatctcagctcactgcaggctccgccttct

SEQ ID NO: 44002 - DNA, 201 bp, Homo sapiens
agtggtgtgatcttggctcactgcaaactccgcctcccgggttcatgccattctcctgactcagcctcccaagtagctgggactacaggcgcccaccaccwcgcccggctaattttttgtattttttagtagagacggggtttcaccatgttagccaggatggtctcgatctcctgaccttgtgatccacccaccttggcc

SEQ ID NO: 44003 - DNA, 201 bp, Homo sapiens
cagtggtgtgatcttggctcactgcaaactccgcctcccgggttcatgccattctcctgactcagcctcccaagtagctgggactacaggcgcccaccacytcgcccggctaattttttgtattttttagtagagacggggtttcaccatgttagccaggatggtctcgatctcctgaccttgtgatccacccaccttggc

SEQ ID NO: 44004 - DNA, 201 bp, Homo sapiens
gagtgcagtggtgtgatcttggctcactgcaaactccgcctcccgggttcatgccattctcctgactcagcctcccaagtagctgggactacaggcgcccrccacctcgcccggctaattttttgtattttttagtagagacggggtttcaccatgttagccaggatggtctcgatctcctgaccttgtgatccacccacc

SEQ ID NO: 44005 - DNA, 201 bp, Homo sapiens
caaaggaaatttccagaactgtctctttcacttgtcacaccttcattgagatgcatgtgtcactttagtggtgttccagttcccacatagaagcaggtttrtagcaaagattctgtattcctgtctgtaatccctgctaataacattattttgcatatttacttattaattccacaggtcctgtttttccctgtgcttaga

SEQ ID NO: 44006 - DNA, 201 bp, Homo sapiens
tggagtgcagtggtgtgatcttggctcactgcaaactccgcctcccgggttcatgccattctcctgactcagcctcccaagtagctgggactacaggcgcycaccacctcgcccggctaattttttgtattttttagtagagacggggtttcaccatgttagccaggatggtctcgatctcctgaccttgtgatccaccca

SEQ ID NO: 44007 - DNA, 201 bp, Homo sapiens
aaaaaaaaaaaaaaaaccctaaataacatttttaaatgccacagaggagaaagacttaggagagtctgaaacccctcactgtgattccctctgtgtgcggkcatctagtatgtggagtaggtggaagatctgtctgaacccacccacgtagaaggaaatcctccctaagaatctaggctgctagtgtgcaggagttggtgc

SEQ ID NO: 44008 - DNA, 201 bp, Homo sapiens
acctaggcctcccaaagtgctaggattacaggcatgaaccaccgtgcccagcctaccttgttaatttctgctttcgtctttattttctttctgtgctttcttttttttttttttttttgagacagagtctcgctctttcgcccaggctggagtgcagtggtgtgatcttggctcactgcaaactccgcctcccgggttcat

SEQ ID NO: 44009 - DNA, 201 bp, Homo sapiens
aaaaaaaaaaaaaaaaaccctaaataacatttttaaatgccacagaggagaaagacttaggagagtctgaaacccctcactgtgattccctctgtgtgcgsgcatctagtatgtggagtaggtggaagatctgtctgaacccacccacgtagaaggaaatcctccctaagaatctaggctgctagtgtgcaggagttggtg

SEQ ID NO: 44010 - DNA, 201 bp, Homo sapiens
ctttaaaaaaaattttttttaatgtggctgttagaagaatcttttgtgtgtggctcagactcagatttcagattatatttcttatttttttttttttttttgaggcagagtctcactccatcacccaggctggagtgcagtggcgcaatctcggctcactgcaacctctgcctcactgcggactttatttcccaggttcaa

SEQ ID NO: 44011 - DNA, 201 bp, Homo sapiens
ccctccccgtctcctctcttcaggcattgtcttagttactgaagtagcttcaaatggatctttaacctgtttgtgagattgtacagaaggttctgttctayctacttgattctttaattaaaacatttgctatgaggtgtgataacaatttccagcattcgaagttgttactgagaaatggccagtctgagcaacgtggtg

SEQ ID NO: 44012 - DNA, 201 bp, Homo sapiens
cctggggacagggacaggtgggagggcagggtccatgcttccaaggtcctctggacacgggacccaggtggcagctccaaaacctggctaggatgggcgcrgtggctcatgccagtaatcccagcactttgggagctgaggtgggtggatcgtttgagcccagtagttcgagaccagtctgggcaacatggtgagacgcta

SEQ ID NO: 44013 - DNA, 201 bp, Homo sapiens
atgacatccacattcaccagctcccacttcaagtggatcctgctcctgactatcttgctgagaggagcccgcccagtgtgtcatctgcaagctcggggtcyggctccagctctcccatcacaattcagcagcaccccaggctcatcctcacagacagtggctcggcaccaactttgtaagttgtgactttgtaataaagtt

SEQ ID NO: 44014 - DNA, 201 bp, Homo sapiens
caccaccacggctggctaattttttttgtatttttcatagaggtggggtttcatcgtgttagccagaacggtcccagtcttgtgaccttgtgatccacccrcctcggccttccaaagtgctgggattacagatctgagccaccgtgcctggctgaatttcaccattttaaaaatatttcactttaaaccaccttgagtttt

SEQ ID NO: 44015 - DNA, 201 bp, Homo sapiens
cacctgctggaggtggatctgaagggagggcactcaggcagcccaagcctgtcagacagagcagggctttgagacggcgccccctccccccgcttcccacycctggcctgcctgctctcctaaagcagggttgggccaggaaggaattgagagcggccctggtttaaagatgacactagtgtgagcaagggtaaagaagga

SEQ ID NO: 44016 - DNA, 201 bp, Homo sapiens
ttagtagagtcggggtttcactgtgttagccaggatggtctcgatctcctgacctcgtgattcgcctgccttagcctcccaaagtgctggaattacagccstgagccaccgtgccctgccaggaagaatattttaatagcctcttcaaatcctgatagatcttctctgagagtacaccaacgcgggagagtttcttaatgg

SEQ ID NO: 44017 - DNA, 201 bp, Homo sapiens
agccaagtattttcagggtttgacctgtgagccactggtattgcatgaggtccctctctgtggtatgtgcttttattagaagttaggtttccagccaagcrtggtggctcacacctgtaatcccagcacttcgggaggattgcttgggcccaagagttcaagactagcctgggcaacatagtgacttgtctctacacaaaa

SEQ ID NO: 44018 - DNA, 201 bp, Homo sapiens
ttgggtgttggttcctgggaggtgacagcaaaggcaacgccggcttctctgaggaagcgatctttaggccgaggcctgcaggatgagtgcgagtgtggtarcgagctgaggcttgcacattctagagcatggacacagcacaagcagaacttagggccaagaaggtgaataggcgtgtgccggccaaggggaggcctgtgt

SEQ ID NO: 44019 - DNA, 201 bp, Homo sapiens
tcaactgtgactcttgacctaaatcaaagatgatatagtgatactggaggtcaggaagtagcaatttaagtgtgcttttcagggatatgaagatgaaaccmaaagaatgagctgcaagttgaaggcagttgcctccagagatgtgagtacaggggactgctgtattttgtaagcagccttgtaaaactatgtagctgttta

SEQ ID NO: 44020 - DNA, 201 bp, Homo sapiens
tgtgggcctcatgactcagtctgcggctcttgctcctcatgtcttgcacccatgttccatgtccgagtgggtgtgggtggtagaggacaggcgagtcaccyagctcctggataaactcagtgtgtgcgcagtggaaagcagtttgttgtgtttgcatatttgtgtcagagctttcatttaaagcaacagttttccttttct

SEQ ID NO: 44021 - DNA, 201 bp, Homo sapiens
ctcactgcaacccctgcctcctgggttcaagcgattctcctgcctctgcctcccaagtagctgggattacagccatgcaccaccacacccggctaattttrtatttttagtagagacagggtttctccttgttggtcaggctggtctcaaactcccaatctcaggtgatctgcccaccttggcctcccaaagtcctgggat

SEQ ID NO: 44022 - DNA, 201 bp, Homo sapiens
ctgatatcacctgtgatgtattatttccttttgcggatggagtatattaggaggttatgttttgctcagcttactctgtgagaaccacagccctccatagyggatgcttccctgtgagggttggcgtctgctgatgcgagagctgcctgagacctgggctcctcttgagggcctccagactgctgcccccacacgtcactg

SEQ ID NO: 44023 - DNA, 201 bp, Homo sapiens
gaccttgtttctacaaaaacaaaaataaataaataaaatcatcttgtcccagtgattcaagatgccacctttgtcctacaataaatttctttctttctttyttttttttttttttttttgagacagagtttcactcttgttgcccaggctggagtacaatggcatgatctcagctcactgcaacccctgcctcctgggttc

SEQ ID NO: 44024 - DNA, 201 bp, Homo sapiens
gttttaatttactttttttttccaaagatacttagtagctctttatattctcttgttccttgttttttttttctttctttaagcatttcacacatagttaytctgtgtttgaatgaaaccttgagcatccagattcgttttctgctgatatcacctgtgatgtattatttccttttgcggatggagtatattaggaggtta

SEQ ID NO: 44025 - DNA, 201 bp, Homo sapiens
aggatcacctgagcctgggaggcggaggttgcagtgagtcaagatcacgccactgcattccagtctgggcaacagagcaagaccctatctgaaaaaaaaawaaaataaaaatttttaaaaaggtaagtgctttcatagtttttttgctagctacgtccaagttctccaaaccctccagtcagcccacccaccagcagcatc

SEQ ID NO: 44026 - DNA, 201 bp, Homo sapiens
tctaattcattaagatgtgaagttagggagggttttttgtttcattttatttgttgttgttattgagacaaagcttactcagttgcccagcctggagtgtrgtggtgcgatcttgggtcactgcaacctcgacctcctgggctcaagcaatcctcctgacccatagtctcgtagcttggactacaggtgtgtgccaccatg

SEQ ID NO: 44027 - DNA, 201 bp, Homo sapiens
tcctttatagcaaaaaaaaaaaaaaaaagctcttgttgtttctcctgacatgggatccaatccaggatcccatgtcgtatctctttaatttcctttccttkggatcggtttctctgtttttcatgacctttacttttttgaagagtgcagcgcatttattttttagaggatcccttggtcagggtgcatgccccatgtctt

SEQ ID NO: 44028 - DNA, 201 bp, Homo sapiens
acaggcgtgagctacagcgccgagcccagccagtactttcttataataccttttatgtttttttcttaattttaatttaattttctgctttttagagataygcttgctctgttgcccaggctggagtgcagtagcacgatcatagctcactggagcctcgaacgcttgagctcaaatgattctcctgtgttagcctcccaa

SEQ ID NO: 44029 - DNA, 201 bp, Homo sapiens
agagagaggatttctaccccctccagttccccaactttagttccccaacatcagtatttcccatgtttgcttcgttattctctctctccctctctctcttrtttttctggacagaaggagagtcacttcatacatgatacccctttaacctaaaatacttccatgtatatttcctcaagataaagacacttataaaaccac

SEQ ID NO: 44030 - DNA, 201 bp, Homo sapiens
cgacagagcaagattccgtctcaaaaaaaaaaaaattttcatgcagtccaatttgtctattctttgttgcctgtgcctttggcgttacatccaataaatcwttgccagatccagtgttgtgaagcttttgctctctgttctctcctaagagttttgttctttccttacatttaggttggtaatccattttttagttcattt

SEQ ID NO: 44031 - DNA, 201 bp, Homo sapiens
aggagaatcgcttgaacccaggaggcagagattgcagtgagccaagatcatgccgttgcactccagcgtgggtgacagagagactccatctcaaaaaatayatatagagagagagaggatttctaccccctccagttccccaactttagttccccaacatcagtatttcccatgtttgcttcgttattctctctctccctc

SEQ ID NO: 44032 - DNA, 201 bp, Homo sapiens
gccaccatgcctggctaatttttgtatttttagtagagatggggtttcaccatgttggccaggctgatctcgaactcctgacctcaagatccaccttcctyggcctcccagagtgctgggagtacagacgtgagccactgcacctggccagactttctttttaagacaaattctgttacctttgaactcgcctgtttgaag

SEQ ID NO: 44033 - DNA, 201 bp, Homo sapiens
tgaagttttttcttctgcttgtttgattctattgctgagactttccagtgcattttgcaattctctaagtgtgcccttcatttccagaagttgtgatagtwtttttttaattcatgttatctatttcactggagatttttccattcataccctgtatcatgttttcgatttctttaagttggatttcccctttctctggtg

SEQ ID NO: 44034 - DNA, 201 bp, Homo sapiens
ttggactaggtgaccatgaggtctcatctcagatttcatttcagggacacatctgtccctgactggggctggtggcctctgtgcctggtattcattgtttmccagggatttgcagagtacccttcatgggaggcacttgtctgcaagtctaagtgcaaatcagccttgcctgtcaacaaagatgacttgggtgtgtcggtg

SEQ ID NO: 44035 - DNA, 201 bp, Homo sapiens
tagtgcgatctcagctcactgcaacctccacctcctgggttcaagcgattcttctgcctcagcctcccaagtagtgagactacaggcatacgccaccatgyctggctaatttttgtatttttagtagagatggggtttcaccatgttggccaggctgatctcgaactcctgacctcaagatccaccttcctcggcctccca

SEQ ID NO: 44036 - DNA, 201 bp, Homo sapiens
gacactggatacaaaattcttggctgataattcttttgtttaaagaggctaaagataggaccccaatcccttctagcttgtagggtttctgctgagaaatytgctgtttatctgataggttttcctttatagattacctggtgcttttgcctcacagctcttaagactcttcccttcgtcttgactttagataacctgatg

SEQ ID NO: 44037 - DNA, 201 bp, Homo sapiens
gaaagagttttaattgagtcacagttccacatggctagggaggcttcaggaaatttacaatcatggtggaaagcacctcttcacgggggagagaacgagtrcacggcgaagggggaagccccttataaaaccatcagctctcgtgagaactcactcactatcactagaacagcatgggggaaaccatccccacgcttcagt

SEQ ID NO: 44038 - DNA, 201 bp, Homo sapiens
tactgaagtcccccactgttcctgtgttgccctctatctcatttcttaggtctagtagtaactattttataaagttttttataaatttgggagctccagtrttaggggcatatatatttacaattgtgatcctgttggactagtccttttagcattatataatgaccctctttgtctttttttaactgttgttgctttaaa

SEQ ID NO: 44039 - DNA, 201 bp, Homo sapiens
attacagcaggatgatgggcgcttgtgttaatcaattctcacactgctatgaagaaatacccaagactggatgatttataaaggaaagagttttaattgastcacagttccacatggctagggaggcttcaggaaatttacaatcatggtggaaagcacctcttcacgggggagagaacgagtacacggcgaagggggaag

SEQ ID NO: 44040 - DNA, 201 bp, Homo sapiens
tcaccttccctgttggaagcaagctcaaactccataagggagttacctgccttccatcatcatggaaacaggaaatcttgccttccctgttggaagcaagwaaaactccaaaaaaagaggagtcatacagcaaaataacctctaaatcttgaccaaatttggggagatgagggattctctggagggggtgctctcggactt

SEQ ID NO: 44041 - DNA, 201 bp, Homo sapiens
agttaaacaaaacaaatgatcacacagcttatatgattactgagtgttctaatgataaggagaaattaagaccagctggttgttaatcttaactttagccragacaaatgccaattcagttacttacccagggatgggtctcaggctgtagatttctctctaccatcctagaagcaggaaaaaactcaccttccctgttgg

SEQ ID NO: 44042 - DNA, 201 bp, Homo sapiens
tcactgatgacatccacattcaccagctcccacttcaagtggatcctgctcctgactatcttgctgagaggagcccgcccagtgtgtcatctgcaagctcrgggtccggctccagctctcccatcacaattcagcagcaccccaggctcatcctcacagacagtggctcggcaccaactttgtaagttgtgactttgtaat

SEQ ID NO: 44043 - DNA, 201 bp, Homo sapiens
cccccagcacaccacgtgtgtgtgtgtgtgtgtgtgtgtgtgtgtgtgtgtgtggtaatttagccactttagaggccttgttccccataatttggaacttycctttggattggatcaagtcagatacagttggtcaaacccaatgggaaaaagactgaaacaacaacaaaaacagaaacaaacaaagaacaacaacaacaa

SEQ ID NO: 44044 - DNA, 201 bp, Homo sapiens
ggcacatgttatcgtcccggctgagcatgcccgactgccccaactgcaactacaggagaaggtaaggctgggttgtggtgtcagcacgactggcccattgraccttcactgggctgagtggaggcctagaaccgacccttagagagcatggtctagtcttgtgcattggttggcttggtaactgtccttaattcctgatca

SEQ ID NO: 44045 - DNA, 201 bp, Homo sapiens
ggaagggtcttgcaagattaaagcattttaaaatttcctctagttaaccaataagaaagcagttactggcgagaacaacttcacagacaccatgaggcacrtgttatcgtcccggctgagcatgcccgactgccccaactgcaactacaggagaaggtaaggctgggttgtggtgtcagcacgactggcccattggacctt

SEQ ID NO: 44046 - DNA, 201 bp, Homo sapiens
gattacatacaaacaccccttaaagcttctgcatcctatgaaatacatatggtacaattcacccacttaaaatgtacaattcaatgacttttgatatattwcattttttaaaaattatggtaaagtatatataacataaagcttaccattttaactagtgtatatttcaataacattaattatattcatagtgtttataac

SEQ ID NO: 44047 - DNA, 201 bp, Homo sapiens
gagaaagttaaaaacaagcccacccagtactcacaccatcaagtctgttatagagtgtacgactgtattaacacggaggcctgcctggctacttttttaamatattgttaagtaatattaaaatcatgtctttctttttgaaagatggaatacattagtacagcaggagacctcggctgcttctttctgctgggggagtgg

SEQ ID NO: 44048 - DNA, 201 bp, Homo sapiens
gacctccccagggtcaagcagtcctcccacctcagccctccaagtagccgggactacaggcacatgcaccatgcctggctaattttttttttcttcttttkgtagagacggggtttcgccacattgcccaggctggtctcgaactcctggcctcaagtgatctgcccacctcagcctcccaaagcgccagaattacaggtg

SEQ ID NO: 44049 - DNA, 201 bp, Homo sapiens
gatttgagttagggtctcactcttgttcgcccaggctggagtgcagcagtgcagtctcagctcattacagcctctgcctcttgggttcaagcgattctccyacctcagcctcccaagtagctgggactataggtgcccaccaccacgcacggctaatttctgtattttttggtagagacggggtttcaccattttggccag

SEQ ID NO: 44050 - DNA, 201 bp, Homo sapiens
gcctaggacaccagggtcacaccaggaacatgggagggccgtgcttgtctctagacgaggggaatgggggaagggccacaacctctgtttctgtgacccascagcatcaagcccctcgctgggcacctcgcacacaccccctgccttatctctgcctgcacgccctgttccctccacctagactgcctgctgagggggcag

SEQ ID NO: 44051 - DNA, 201 bp, Homo sapiens
acaggcgtgagccaccgcgcctggcctgttttgtagtttttatgatacaactcttccacttctttggttaattcccgttggtgttttgttttggttttggwggttttttttttttttttttttgagacagaatctcactttgtcgcctacgctggagtgcagtggcatgatcttggctcactgcaccctccaccacccagg

SEQ ID NO: 44052 - DNA, 201 bp, Homo sapiens
tgtgacctcactgagccatgctctcccgggtgtgtcggagtggttattggtggttatgagctgttgctcatcagaggctctctgagggctgccagtgtcgyccccgctgtccttgtgcaggtggtctggagtccctccccgccccccgagggccacaggacccagccttgatggttctgcccccctatccccagcccatgg

SEQ ID NO: 44053 - DNA, 201 bp, Homo sapiens
tgacgtgaacccgggaggcagagcttgcagtgagccaagattgcaccactgcactccagcctgggtgacagagcgagatcccgtctcaagaaaaaaaaaawaataataaaataaaaaagacaaggtcctaggagagaaaaacaaaaacatgaaggccttttaaatacaaacacgcacacatacacacccgcacatatgcac

SEQ ID NO: 44054 - DNA, 201 bp, Homo sapiens
cccagctggcaccctggctggccagggctctgctgggctgcttctgtcagcctcacggcagcccgacgtgctcagctcctgagacctacaacagcgagagracagaaagccaggcttgggagcggggcgggaaggtccgtgtgaaagctgcccgaggaggactcacccgctaatatgactgtcttattttaggttgttcaa

SEQ ID NO: 44055 - DNA, 201 bp, Homo sapiens
atcccagtgctttgggaggctgacgtgagaggattgattgagcctgggagctcaagaccagagcaacatagtaaaaccctgtctctaccaaaaaaaaaaaaaaaaaaattcttgaaattaaaaagacttgaagactaatttctgttttcaagtgtctccataccagtgacataccgaatttatatatggagtataagttat

SEQ ID NO: 44056 - DNA, 201 bp, Homo sapiens
cactgcaacctctgcctcccaggttcaagcgattctcttgtctcagcctcccaaatagctgggattacaggtgtgtgccacaatactcagctaatttttgyatttttagtagagatggggttttaccatgttggtcaggctggtctctaactcctgacctcaggtgatccacccacctcagcctcccaaagtgctgggatt

SEQ ID NO: 44057 - DNA, 201 bp, Homo sapiens
gagtgagtagttcctgatttttaatatatgttctgtagttttcaggtaaaatttcctgaagattgctcatgtgaaataagtgggcatttaactgtataacrtaacagagttgagtattttgaaaattaatgtgttttcgttagtcatagtaaaagataggctggaattctgaaatcatcttgaatgttgcagactcctctt

SEQ ID NO: 44058 - DNA, 201 bp, Homo sapiens
cgaacccaggaggcggaggttgcagtgagccaagatcacgccactgcactccagcctgggcaacagagggagactctgcctcaagaaaaaaaaaaaaaaaaggcaccctgaaaccccagagcagcgtggaaagctatccttgatttttttttttttttttaagagacaggatcttgctgtgttgcccataatggagtcagt

SEQ ID NO: 44059 - DNA, 201 bp, Homo sapiens
tcgaacccaggaggcggaggttgcagtgagccaagatcacgccactgcactccagcctgggcaacagagggagactctgcctcaagaaaaaaaaaaaaaaaaggcaccctgaaaccccagagcagcgtggaaagctatccttgatttttttttttttttttaagagacaggatcttgctgtgttgcccataatggagtcag

SEQ ID NO: 44060 - DNA, 201 bp, Homo sapiens
gggcaccacaggtatacagatggcaccagtgttgtggcatgcttacctcttccctttccccattctgcatgtgtccctgtgcttttgttgttgttgttgttttgagacaaagtctcactctgtcgtccaggctgaagtgcagtggcgtgaactcggctcactgcaacctctgcctcccgggttcaagcggtactcgtgtct

SEQ ID NO: 44061 - DNA, 201 bp, Homo sapiens
gctcgaacccaggaggcggaggttgcagtgagccaagatcacgccactgcactccagcctgggcaacagagggagactctgcctcaagaaaaaaaaaaaaraaaggcaccctgaaaccccagagcagcgtggaaagctatccttgatttttttttttttttttaagagacaggatcttgctgtgttgcccataatggagtc

SEQ ID NO: 44062 - DNA, 201 bp, Homo sapiens
tgggcaccacaggtatacagatggcaccagtgttgtggcatgcttacctcttccctttccccattctgcatgtgtccctgtgcttttgttgttgttgttgttttgagacaaagtctcactctgtcgtccaggctgaagtgcagtggcgtgaactcggctcactgcaacctctgcctcccgggttcaagcggtactcgtgtc

SEQ ID NO: 44063 - DNA, 201 bp, Homo sapiens
ggagtctcgctctgtcgccaggctggagtgcagtggcgcgatctcggctcactgcaacctccgcctcccgggttcaagggattctcctgcctcagcctccygagtatctgggactacgtgtgtgcaccaccatgcccagctaatttttttttttatttttagtagagacgggatttcaccatgttggccaggatggtctcg

SEQ ID NO: 44064 - DNA, 201 bp, Homo sapiens
ctgggcaccacaggtatacagatggcaccagtgttgtggcatgcttacctcttccctttccccattctgcatgtgtccctgtgcttttgttgttgttgttgttttgagacaaagtctcactctgtcgtccaggctgaagtgcagtggcgtgaactcggctcactgcaacctctgcctcccgggttcaagcggtactcgtgt

SEQ ID NO: 44065 - DNA, 201 bp, Homo sapiens
acctttaataacagagcttcacctgtctcctctctcctaaactctgatatgactaaatactgcaagactttttttttttttttttttgagatggagtctcrctctgtcgccaggctggagtgcagtggcgcgatctcggctcactgcaacctccgcctcccgggttcaagggattctcctgcctcagcctcctgagtatct

SEQ ID NO: 44066 - DNA, 201 bp, Homo sapiens
tagatcatgatatgtcattctttattccattattaaatttattagctgatatttgatttaggacgtgtgtgtgtgtgcgtgtgcgcctgtgtgtgtgtgtstgtgtattcggacagctatataaaattatttttagagacagggtttcacactgctggccaggctggagtgcaatgacaagatattagttctctgcagcct

SEQ ID NO: 44067 - DNA, 201 bp, Homo sapiens
gtgagcccaggaggcagagcttgcagtgagccgagatcgcgccactgcactccagcctgggcgacagagcgagactccgtctcaaaaaaaaaacaaaaaaactctccaagtttatttgagcaattagtagactggactgggtcctggatcaaattggatcaaattggttctgataattcactggactggattcagctggag

SEQ ID NO: 44068 - DNA, 201 bp, Homo sapiens
gctacttgggaggctgaggcaggagaatggcgtgagcccaggaggcagagcttgcagtgagccgagatcgcgccactgcactccagcctgggcgacagagygagactccgtctcaaaaaaaaaacaaaaaaactctccaagtttatttgagcaattagtagactggactgggtcctggatcaaattggatcaaattggttc

SEQ ID NO: 44069 - DNA, 201 bp, Homo sapiens
aatagaaaaaaattacctgggtgtggtggcggacacctgtagtcccagctacttgggaggctgaggcaggagaatggcgtgagcccaggaggcagagcttkcagtgagccgagatcgcgccactgcactccagcctgggcgacagagcgagactccgtctcaaaaaaaaaacaaaaaaactctccaagtttatttgagcaa

SEQ ID NO: 44070 - DNA, 201 bp, Homo sapiens; identical to SEQ ID NO: 11440

SEQ ID NO: 44071 - DNA, 201 bp, Homo sapiens
cttgcaagattaaagcattttaaaatttcctctagttaaccaataagaaagcagttactggcgagaacaacttcacagacaccatgaggcacatgttatcrtcccggctgagcatgcccgactgccccaactgcaactacaggagaaggtaaggctgggttgtggtgtcagcacgactggcccattggaccttcactgggc

SEQ ID NO: 44072 - DNA, 201 bp, Homo sapiens
gaaagtctcctcttgaaaatgtcttgtataattgtcgcaggtattaaagtttttcttttttttctgttttttacatccccttactagatgacaatgaaaamcaagcagcgcatgttaacagaagactgggagctttttaaacaaagaagattcattgaagaacaggtaagcttgtcaataagagaggcaattaaaggaagt

SEQ ID NO: 44073 - DNA, 201 bp, Homo sapiens
gggtgcacagacgctgccttcagacaccgcatgctcgtgcgaggcctgcagtgagcgcaggtatgtgacgtgtgtgccacgttgctcacacctgtccacartgacatgcagacctgcatattggagctggacggagaaactgggctaatgtgacagacagcaacaagagtaaggcagttgcttcgctattgagagaaagaa

SEQ ID NO: 44074 - DNA, 201 bp, Homo sapiens
gtgcgaggcctgcagtgagcgcaggtatgtgacgtgtgtgccacgttgctcacacctgtccacaatgacatgcagacctgcatattggagctggacggagwaactgggctaatgtgacagacagcaacaagagtaaggcagttgcttcgctattgagagaaagaaccatatgagtaagacaaaaactgttgctcttgagga

SEQ ID NO: 44075 - DNA, 201 bp, Homo sapiens
ctgggtgcacagacgctgccttcagacaccgcatgctcgtgcgaggcctgcagtgagcgcaggtatgtgacgtgtgtgccacgttgctcacacctgtccayaatgacatgcagacctgcatattggagctggacggagaaactgggctaatgtgacagacagcaacaagagtaaggcagttgcttcgctattgagagaaag

SEQ ID NO: 44076 - DNA, 201 bp, Homo sapiens
aaaaagaagaagaaggagaggccaagtaaagactgccccaagttggacatgctcactagaaatttccaggcagcaacagagtctgttcctaactctggaarcatccacaatggctcactagagcaaactgaagaaccagaaacctcttctcactccccatccaggcatatgaaccactcagagcccaggccagggctaggg

SEQ ID NO: 44077 - DNA, 201 bp, Homo sapiens
gttagattgttgtcttgttctcctctttggaacaatggctaggacaaaacacagcattggttagtgggagggtgggaggtggttgatcagccatgtgcctstgaggccacaaagaagcctcacaggtcatggtttccactgtcagttggtcattacatcctcctgttgaagattgtgtttaccaagctcatgtgctcatca

SEQ ID NO: 44078 - DNA, 201 bp, Homo sapiens
gagccgagattgcaccactgcactccagcctgggcaacagagcaagactccgtctcaaaaaaaaaaaaaaaaaaaaaaaaaaaaagccaggcatggtggtrcatgcctgtagtcccagctactcaggaaattgacacaggagtatcccttgagctcaggagtttgaagcttcagtgagctatgcttacgccacctcactcc

SEQ ID NO: 44079 - DNA, 201 bp, Homo sapiens
gggtaagcctcggcggcgggtctcggcgggtctcgggggtctcgcgggggggcggtctccgcgtctggaaggggctcggcgggccttggcggtctgggggytctcggcgggtctcgggggtctcgggggagtctcggggtcccgacaggtctcggcgggtctcgggggtctcgggggagtctccggggagtctcaggggtc

SEQ ID NO: 44080 - DNA, 201 bp, Homo sapiens
agcgctcggcgggtaagcctcggcggcgggtctcggcgggtctcgggggtctcgcgggggggcggtctccgcgtctggaaggggctcggcgggccttggckgtctgggggctctcggcgggtctcgggggtctcgggggagtctcggggtcccgacaggtctcggcgggtctcgggggtctcgggggagtctccggggagt

SEQ ID NO: 44081 - DNA, 201 bp, Homo sapiens
gaccaccgcaccccgcgcacatcctcagacggccctgttgaaggcagcaccaagtcactagctttgtcctgagctgcaagccaggaattcccgactgaggyccagaggcgcatgtgggtagcccctgtgtgttagctgctggttttccggaagggatgggaaacctgttggcatcacagatggcttgggcctcctgggcct

SEQ ID NO: 44082 - DNA, 201 bp, Homo sapiens
gggaaaagcttcgcttacggctgaccaagaggaaagaggagcaacctaaaaaaatggaccagatctcagaaagggaaagcgtcgttgaccatcggagggtrgaggatttgttgcagtttataaatagctccgaaaccaaaccagtgagcagcacgcgtgcagcgaagcgagcaaggcataagcaaaggaaggcaagtgaca

SEQ ID NO: 44083 - DNA, 201 bp, Homo sapiens
tcatcagccacgtcctctgtgtcctgcacagctaccacagtgcagtccagcaacagccagttcagagtgtcatccaagagacctccttcagtaggtaaggyttgaaggctcactggccctcggggtctgcaggaaggctgggcttactgacttctcgtctttgtaactcatctttgtaactgccttttacttggcctagcc

SEQ ID NO: 44084 - DNA, 201 bp, Homo sapiens
tgtccacgaggaggcggtgtggacccgcggccccagaccaggcctcaggcagaaggcgagcgcgagcgccccgcccagcccctccccgtcccgcaacccgygccccgaccagcgcccccagcacctctccaccctcgctctcgagcagtctccacgtttgtctcagaggagacccactttgctccccagcgtgggcccctg

SEQ ID NO: 44085 - DNA, 201 bp, Homo sapiens
tgtacttctcttggtagcccgctgacaaaggcggtcttgtttttgtcaaagatggggcagtcttaaaatgaatacaaataagcggctcaagtttgagaccctcacggagcaggtggtttcaaatgtcaggctttgaaaaggaaatgttgagaactaatgagagaagcaggtctccaaagcctattccttgagggcttttgg

SEQ ID NO: 44086 - DNA, 201 bp, Homo sapiens
attctcaaagtaaccctgagagataggtcattttcccccggctggagcagaggaatagggagctcagacagggcggctcgcgagaacgaggttgtgcgtggccgagccctgatttggacagaagcgcactgccttcctcactgagtctttggtcacagcagtcagccccggcctctgtgcagggggacgctctgaacgtcc

SEQ ID NO: 44087 - DNA, 201 bp, Homo sapiens
cgggaggtgtctcccagtcaggaggcacaggggtcagggacccacttgagttggctgtctgtccctcagcagagcttgagtgctgtgctgggagatccacygctctcttcagagccagcaggtagtaacttcagtctgctgaagttgtgcccacagccaacccttcccccaggtgctctgtcccagggagatgggactttt

SEQ ID NO: 44088 - DNA, 201 bp, Homo sapiens
catttatgttcttctctacactggttattctagttggcaattcctctaatcttttttcaaggttcttagcctccttgcattgggttagaacatgctccttkagctcagaggagtttgttattacccaccttctgaagtctacttctgtcagttcatcaaactcattctctgtccagttttgttcccttgctggtgaggagt

SEQ ID NO: 44089 - DNA, 201 bp, Homo sapiens
accattatgtaatgccctgctttgtctttttaaatttttgttggcttaaagtctgttttattagagactaggattgcaactcctgctttttttttttttttgcttttcttttgcttggtaaatattcttctatccctttattttgagccagtgcatatcttcgcatgtgagacaggtctcctgaatacagcacagtgacag

SEQ ID NO: 44090 - DNA, 201 bp, Homo sapiens
gtcctgcacagctaccacagtgcagtccagcaacagccagttcagagtgtcatccaagagacctccttcagtaggtaaggcttgaaggctcactggccctyggggtctgcaggaaggctgggcttactgacttctcgtctttgtaactcatctttgtaactgccttttacttggcctagccagaggcgtaagtgtaattaa

SEQ ID NO: 44091 - DNA, 201 bp, Homo sapiens
cgggcaccagcagcaggagggcctgcaggtgggcacggcagcctcagcacagcccgtgccctgcaggactcaggggactgcctgccacccgctttggaggragccccctacccgcttcacggcagcaacttccccgccagggtggatccgccgggcataggcaccctggatggtggccatggtgaggccgatgaggaaaaa

SEQ ID NO: 44092 - DNA, 201 bp, Homo sapiens
gaggcgagccagctgttagggtgggagcagaggccctgggagctcagaaggatgatgatagctgctggttcaaaatacggacctgctgatcctaagctatkaatcttaaacttctgaaataaagacagagatggaaggagttagaatagtgctggtccatattttccccgaaatgagaagtagacttggaatccttttcta

SEQ ID NO: 44093 - DNA, 201 bp, Homo sapiens
agctgatgatgaagaagcggacggcgagagtagtggggagcccccaggggccccgaaggaagatggagtgctgggaagcaggagccccaggacagaggagrgcaaagcagacagtccacccccatcctacccaacacagcaggtaggactttgcttgctgttttgccaaggatctctttttctgtgtgtattttctctaaa

SEQ ID NO: 44094 - DNA, 201 bp, Homo sapiens
gcaacctccacctcctgtgttcaagcctcagcctcctgagtacttgagactacagacacacgccaccacacccggttaatttttgtatttttattagaggyggggtttcaccatgttggccaggatggtctcgatctcctgaccttgtgatccacctgcctcagcctcccaaactactgggattacaggtgtgagccaccg

SEQ ID NO: 44095 - DNA, 201 bp, Homo sapiens
atgaagatgttgcaccattgtcagccaaatttgctgatatttatccattgagtaattatgatgataccgaggtggtggccaacatgaatggaatccacagygaattgaatggtggcggggaaaacatggccctgaaggatgaggtatggacatggcttcttcgtagcaacaataaatgacataaaatgatggtctgacatt

SEQ ID NO: 44096 - DNA, 201 bp, Homo sapiens
aattgcaaagttaggcacacttgtgagtggccctggctaggagggagacgtgtgtaaatgacgatgtggaggactagtggtggccactcacaagagtctgygcgccatactaagacacaccggggcccctctgccaaaacgaggctgaccccgaagatgtcctgccgtggtcccatccagcagctgtgatgagaggagaca

SEQ ID NO: 44097 - DNA, 201 bp, Homo sapiens
tacataaatacatacaaatacaaaattagccaggtgtagtggcgcatgcctgtaatcccagctactcgggaaggctgagtcaggagaatcgcttgaacccrgggggcggaggttgcggtgagccgagatcgtgccattgcactctagcctgggcatctcaaaaaaaaagaaattgcaaagttaggcacacttgtgagtggc

SEQ ID NO: 44098 - DNA, 201 bp, Homo sapiens
taaaaaaatttatatagagatgaggtcttgctgtgttacccaggctggtctcaaacgtctgggctcaagtggtcctcccatctcggcttcccaaaatggtrggattacaggcgtgaaccgccatgcccagccgaattgtttcctttttgtatgtatgtgtgtgtctgtgtgacaatgtctctgtcacccagacaggagtgc

SEQ ID NO: 44099 - DNA, 201 bp, Homo sapiens
gtgttacccaggctggtctcaaacgtctgggctcaagtggtcctcccatctcggcttcccaaaatggtgggattacaggcgtgaaccgccatgcccagccraattgtttcctttttgtatgtatgtgtgtgtctgtgtgacaatgtctctgtcacccagacaggagtgcagtggggcatgatcacggctgactatagcctc

SEQ ID NO: 44100 - DNA, 201 bp, Homo sapiens
gaaaccatatactcagaaagtaaacagtttattaaaacattcaaagacaaacagctttaaatagtggttaccctagacctctaataagcaaatatgttccmcctccaaaacttttttttttttttttttttttttttggtgggagcacaaagtctggttctgtccgtccaggccgtagtgcagtggcgcattctcagtttg

SEQ ID NO: 44101 - DNA, 201 bp, Homo sapiens
tgagcacctaacctgtgcatggtccagcactgggaatgccagtccagatccaagttggccctgctcgtagatgaaaatctgatggtcagagaggtcagccrctagtgcaggttgcacagcctcgggtggagctcttgttccacccaggttgcctcagtcaagtatggaaagttactgggcctgtgttttgctttagaggct

SEQ ID NO: 44102 - DNA, 201 bp, Homo sapiens
tccagttggctttggtgttggatgattttcagagcagtgaaccaatggtctctgaggggcctcccctgctggtcccagggttatggggctcagctctgtcrtcagcctaccttatgacccagattcagctgggctttccagatggtggttttccatcagtcatgactttgacttccagcattaactggtctttatgtggct

SEQ ID NO: 44103 - DNA, 201 bp, Homo sapiens
ctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttacca

SEQ ID NO: 44104 - DNA, 201 bp, Homo sapiens
atttccagaagcccctggaatggaggagacaggggctgaagcagactcatctgtgcatgactagttcattaggagttcagttgaaattagattagatgctyctaaaaccatgggcaaccaaatacataaagtggggctttcttttccccttgtaacagtgttttactttatagatttatttaaagaaaaaaagttttatct

SEQ ID NO: 44105 - DNA, 201 bp, Homo sapiens
ctggtgcctgcagggaaattgctggcctctgtcatctaattatacttgacagaatgctgtggtggagattagtgctaagtggttgcctgaagatcagtgcrgtgaaaatgttacagctgtgattggaaacgtaaccctaactgtgataacagcttcaccttcttcgcaggttttaaagtgctgtttgcctagtcctatttt

SEQ ID NO: 44106 - DNA, 201 bp, Homo sapiens
ctgctgtggccccaggacccgtggcaaagagtaggcatgcagtaaacttaggtgaaaaactgaatgaaacccccggctgaactgaaattacctcagtgaarttgtgaacaagagctcgctgggaccttttgacatttgattggtgggtccagttagcctagcacaaatgccagctcccttcctggtgcctgcagggaaatt

SEQ ID NO: 44107 - DNA, 201 bp, Homo sapiens
ttttttttagtagaaacagggtcttgctacattgccttagctggctataactcctgggctaaagcagtcctcctgcctcagcctcccacagtgctgggatyacagacgtgagctaccatgcccggccttagcaccagttattagaaagttcatcctggaccaggtgtgagggtgatggctcatgcctgtgatcccagcact

SEQ ID NO: 44108 - DNA, 201 bp, Homo sapiens
atgcagatgtctaaagaaaaagtaattccaccaatacttccatctctcttgaggcaagcagtgtgtgcgctgttcacgttgctgaaatgtttcctccatastcacacacacatgggtttttctgcacatggactcataaccagcggtgcttcgttaagctccattctggactcagaggaatgctaagcctcttgaggtgac

SEQ ID NO: 44109 - DNA, 201 bp, Homo sapiens
gagtagctgggactacaggcgcccgccaccacgcctggctaatttttttgtatttttagtagagacggggtttcaccatgttagccaggatggtctcgatytcctgaccttgtgatccgcccgccttggcctcccaaagtgctgggattacaggcgtgagccaccctgcccggccccttcctgccttgttagattcacagt

SEQ ID NO: 44110 - DNA, 201 bp, Homo sapiens
atggtcagctgtgcaagaatgcagctttgccatggcaattgagtttgcaaatgttaacatgacaaagcatcaactaatctgagccactgcatattgtaccytggattagtctctgatgggtctggttggatagtcaaatctgattgcccgaaataaggtactggtttctgttagatctgctgacatttgctatttacctgt

SEQ ID NO: 44111 - DNA, 201 bp, Homo sapiens
gtgcctcctcatagtggagccagcagtggtagctcctggactagatgtgcagtcccagctttcatcttgatagctccagaattcctcctttccttgccacsttcactgccattgcttcatcctttctcatcccctgactaacctactcgtcctccttccgccttctggttcatccacagcattgccacaaattgatctttc

SEQ ID NO: 44112 - DNA, 201 bp, Homo sapiens
gcttacgccacctcactccagcctaagcaatagagagatcctttctccaaaaaaattaaaacaaaaggcaaaccattaggattacacagcaagcttttgamcactaaactacaaagaggtcttcagcctgaccaaggagccccatggcaagaccagaggaggtgctgctgcttcatgggtttgcagctagcgagccctccc

SEQ ID NO: 44113 - DNA, 201 bp, Homo sapiens
agctcgcctagaagcagaggccagggcccgggagcacctgcacctccaggaggagcagaggcggcgggaggaggaggaggatgaggaagaagaggaggatygtttcaaggaggaatttcagcggcttcaggagcttcagaagctaagagctgtaaaaaagaagaagaaggagaggccaagtaaagactgccccaagttgga

SEQ ID NO: 44114 - DNA, 201 bp, Homo sapiens
caagtgacagttctcagcacctggaggcgccaggtctgagggcatttgaaggtgccgtgccacgccagtctctaggcagggctgagccacaggaggtcggkgctctgacgtgtgttcacttgcccacaactttgttctgagagccagcctgtctctggtggcctgaactggagactggtaaaaaacttaactttgtgtttt

SEQ ID NO: 44115 - DNA, 201 bp, Homo sapiens
tattgacatgaaaagatattcacaccatgttaaataacaggtagaggccaagcatagtggcttatgcctgtaatagcagcactttgggaggctaagggagsatctcttgagcccaggaattgaagaccagcttgggcgacacaggagaccctgtctctacaaaagataaagaaaattagctgagtgtgacagcacacccct

SEQ ID NO: 44116 - DNA, 201 bp, Homo sapiens
tagtcccagcactttaggtggccctggtgagaggattgcttgagcccaggggttcaggaccagcctggacaacatagtgagacactgtctcttagaaaaasgtgattttttttttttctttgagacggagtcttgctccgtcacccaggctgctggagtgcagtggtgcgatctgtgatcctcctgcatcagcctcccgcg

SEQ ID NO: 44117 - DNA, 201 bp, Homo sapiens
ctctgggccaccggagtccagacctggtccaagaggcgaggtccccctgggaagtgcctgaaaagtaccctggaggacatttggaaacaaagacaaggttycctggtgcccagcaagccctcccccacctcccctgctcctgtcttggccagggcctaagtcgcactcacggggcaggggtggggccgcccaggatcagga

SEQ ID NO: 44118 - DNA, 201 bp, Homo sapiens
ctgagtggagaggtggcactgtagggcatcacagtgttgggggttcgcacataagagcccatgtcatcggggagagggtggcactttggggaggggtgttytcagggccgtagcaggggcctttagggctgccagcatggtttaggggacccacaagtgtggaattaaggccaaggtccactcccaaggatggagaagtgg

SEQ ID NO: 44119 - DNA, 201 bp, Homo sapiens
tgagagaggagatttaattttccaaacaataagtcctactaaaaacagtatgaagccgattaaatttgtttttctttttagtttttcttttttttttttttgagacggagtttccctctgtcacccaggctagagtgcagtggcacaggctcagctcactgcaacctctgccccctgggttcaagcaattctcttgtctca

SEQ ID NO: 44120 - DNA, 201 bp, Homo sapiens
cctgacctcaggtgatccacccccccttggcctcccaaagtcctgggattacaggtgtgaaccaccacgcccagactgtcaaaatttttaaatacacagamctaaaaagataattaaaacattgcatatgaaaacctgcgggatatcgaaaaacgttaactttttagagctgtttatgtaaggctataattgcctaaatta

SEQ ID NO: 44121 - DNA, 201 bp, Homo sapiens
tccacctccaaaacttttttttttttttttttttttttttggtgggagcacaaagtctggttctgtccgtccaggccgtagtgcagtggcgcattctcagyttgttacagtgggtagctagtcaggtgtgagcagggcaggggagggcctcctccatccaccagggatgtcaggtgaccatcaggtgatggttaggcagtt

SEQ ID NO: 44122 - DNA, 201 bp, Homo sapiens
ccagccgggcgcagtggctcctgcctgtaatcccactactttgggaggccaaagcgggcggatcacgaggtcaagagatagagaccattctggccaacatrgtgaaaccccgtttctactaaaagtacaaaaattagctgggcgtggtggtgctcgcctgtagtcctagctactctggaggctgaggcaggagaatcgctt

SEQ ID NO: 44123 - DNA, 201 bp, Homo sapiens
gttgaattttgtcaaacacttgttcttcgtctatcaaaatcatgtggttgtcctttattctattgatatggtgtattacattaattgttttgaatattaarccatccttgtattcctgggataaatcccacatggtcttggtgtagaatcccttttatatgttgcaggattcagttggccagtattttgttgaggatgttt

SEQ ID NO: 44124 - DNA, 201 bp, Homo sapiens
aacccaggaagaggaggttgtagtgagcccagatcgtgccattacactccagcctgggcaacaagagcaaaactccgtcccaaaaaaaaaaaaaaaaaaaattgtgaccagccgggcgcagtggctcctgcctgtaatcccactactttgggaggccaaagcgggcggatcacgaggtcaagagatagagaccattctggc

SEQ ID NO: 44125 - DNA, 201 bp, Homo sapiens
tgtgttcctgagttggtttgctaatattttgttaggatttttgcatctgtgttaatactaataaaatatattggtctgtagtttcctatctttgtgatgtmtttgtctgactttggtatcagagtaatactggcttcataggatgagttaggaaatgtttttttcacttatgttttctgaaggagtttgtttaagattgag

SEQ ID NO: 44126 - DNA, 201 bp, Homo sapiens
aaactttcagtcttttaccactaggtatgttagctgtgggtttttcatagaaccctttatcagattgaggaacttcccttctattcctggtttgttgactsttcttatcatggaggagtgttgaattttgtcaaacacttgttcttcgtctatcaaaatcatgtggttgtcctttattctattgatatggtgtattacatt

SEQ ID NO: 44127 - DNA, 201 bp, Homo sapiens
gtacaggctcaaatgcaaatctccacgtgtgcacacatgcaaagatcacatactttctggaagggctcatggagcccagcagccaccaccagctttggccrcccaacgctggcccatgtgtctccagagccctgccccagagagcagctgcagaggtgtcaggggactctgagagtggactcctccatacccactttacac

SEQ ID NO: 44128 - DNA, 201 bp, Homo sapiens
gccccgtcttccctaatgtgcatgtgcacacacacacacacacgcacacacgcacaagtgtacaggctcaaatgcaaatctccacgtgtgcacacatgcaragatcacatactttctggaagggctcatggagcccagcagccaccaccagctttggccacccaacgctggcccatgtgtctccagagccctgccccagag

SEQ ID NO: 44129 - DNA, 201 bp, Homo sapiens
caggccatgaccacacacgccacagggctcatggggccccagggtggtgggagccacagagcctgcattaaatggaacccgatggggtgtctctgtgggamtgagcacttttcacctgactgctctgccccccaccgcagcagcctcaggccttggggtcacctgaaccaattgcaactttgagagaaggtagggagatga

SEQ ID NO: 44130 - DNA, 201 bp, Homo sapiens
tgcacgtcctgtgtgagtgcaccacctgtgacattaactgggtgtgcagagacacagcgcacatgagggcctgcacaggccatgaccacacacgccacagrgctcatggggccccagggtggtgggagccacagagcctgcattaaatggaacccgatggggtgtctctgtgggactgagcacttttcacctgactgctct

SEQ ID NO: 44131 - DNA, 201 bp, Homo sapiens
ctcccacaaatggggccaacctgatcaccactaacagtaagtccttgaccctgtggtcacatgaggtgctggctcccttaccacagccaggatgatcctgyaggagcccagcctcccagagcccccaccctgctcctatgcaggggctcacgcctgtgtgcatgcgagctgtgcagctcatgtgcacgtcctgtgtgagtg

SEQ ID NO: 44132 - DNA, 201 bp, Homo sapiens
ggagtgcccagtgcgctcggcacaaggcctgatcctctcccagcctctatacccaagtctgtaaaatagaagtaaagtattgagctcaggtggaccctggkcgatttagtgagctgtgaggtacagcttggcactgggccctggcagggctgggagtggtggtgatgattctgtgctcaggcttcaggacacggagacaca

SEQ ID NO: 44133 - DNA, 201 bp, Homo sapiens
gccgggctggggctgtgctcgcagagcccaggctgggccaccctgcctctggccagcagtgcttctctggcatagctggttactgggcctttacgggagamttttggttttgattatgttaacagagaaagattctgggaacaggaaggaaacaagggaaaccgaaaaggaagagcagacagctgtggggaggcagggcag

SEQ ID NO: 44134 - DNA, 201 bp, Homo sapiens
gtgccatgctctgaaacctgcaatgtggaggaccctcagggacctcagggactgccgggctggggctgtgctcgcagagcccaggctgggccaccctgccyctggccagcagtgcttctctggcatagctggttactgggcctttacgggagacttttggttttgattatgttaacagagaaagattctgggaacaggaag

SEQ ID NO: 44135 - DNA, 201 bp, Homo sapiens
aaggttttctagcatctgtggagataaccatgatgtttctccttagatgtattaatacgatgttttacattatttgatttttaagtattgaactgaacttsaattcctggaataaagctcacttgattatggtatatccttttgttttggaatctgtttacattatttaatatatttacatctatattatttttaggagag

SEQ ID NO: 44136 - DNA, 201 bp, Homo sapiens
ctgttgattctctggggttttccaggcattctattatatatgtgtacaaatagagaaagttttacttctactttttcaattcttacgcctctaattgttgkcttttacttaactgcatcttttctgatcttaacagaaatgtctctggtgtttccacattaagtaagatgttggctttagggttaaggtttatatattata

SEQ ID NO: 44137 - DNA, 201 bp, Homo sapiens
cagccaagaatttttttatatggtagggacattagccttttactcatgcagtatgctgcagacattctctcccagttcataagttgtcttttgactttgtrtatgcttttcagtcaggtggaaatgttcttccttttatgcggtcagcttcttgattttttattgcctctggattttgaataattgttagaaagctttacg

SEQ ID NO: 44138 - DNA, 201 bp, Homo sapiens
ggcggcaacaccactgatgtggccagtccctgttggtatatcccaccaggaagtgggtgacggtgtctgtcccatcactggggatgggaactctgatcctsggttgagctggtctgcccattttcactacggtcaagttaatatttctcctttgctaattagtaagtgtcttatggggaaatgagtatcctgtttttattg

SEQ ID NO: 44139 - DNA, 201 bp, Homo sapiens
ctccaattgtccttttaacatcctttatagcaaaaaaaaaaaaaaaaagctcttgttgtttctcctgacatgggatccaatccaggatcccatgtcgtatytctttaatttcctttcctttggatcggtttctctgtttttcatgacctttacttttttgaagagtgcagcgcatttattttttagaggatcccttggtca

SEQ ID NO: 44140 - DNA, 201 bp, Homo sapiens
gtgtgtttctgttgtgagggggtaacggagagagctgtacaaggtccctgctgcccacctggggagtgccatgctctgaaacctgcaatgtggaggaccckcagggacctcagggactgccgggctggggctgtgctcgcagagcccaggctgggccaccctgcctctggccagcagtgcttctctggcatagctggttac

SEQ ID NO: 44141 - DNA, 201 bp, Homo sapiens
gtcaaaggctaaggtggtcgacctcatgtccatcacagagcagaaaagagaggagagaaaagtcaacagtaataacaataacaaaaagcagctgaaccacrtcaaggacgaaaagtcaaacccaacccctatggagcccacctctcccggtgagcatcagcagaacagcaagctggtgctggcagagtcccctcagccaaa

SEQ ID NO: 44142 - DNA, 201 bp, Homo sapiens
caggtccgggaacttctcatgatacagcctgcagggtggccttggtgtttgggtcctaagtacacacatgttgtgtatgtgagtgtgtgtttctgttgtgrgggggtaacggagagagctgtacaaggtccctgctgcccacctggggagtgccatgctctgaaacctgcaatgtggaggaccctcagggacctcagggac

SEQ ID NO: 44143 - DNA, 201 bp, Homo sapiens
tagcagagctggtgtggttgcggggacgtgaaaaggctggggatagagtaggaatcgaggaatgccagagcccaggcctagtccctcagtcccttggtgtsaaagggcacagagatggccaccttgaaattcatagaaccgggtgcaagacataacagccctctgtgtggcctcagatggcagagcagggtggcagcagct

SEQ ID NO: 44144 - DNA, 201 bp, Homo sapiens
ccagctccagcttccctctgggaagatagggttggggaaggggctggtgtggatttgtcccccacccccagggtcccctcacctggcctgctcctctcctmtgggctggactccccctgtagcatcacagcattggaccagggctgtggggggaatgggcctgggccagggtcaggtgggtcttctgcttgcttctgcctc

SEQ ID NO: 44145 - DNA, 201 bp, Homo sapiens
ttttcactctgagctctgaaggatgtactggttacaacctcgctggggtctggcctcatgtatggacatgacagtgaactcatctgtttgtctgtctgtcyttctcttgggtcctgccatgggcctggtgcccatctgggccttggagattcagtgggacttggacccgtggggagtgccagggacacatggggtaatgct

SEQ ID NO: 44146 - DNA, 201 bp, Homo sapiens
ccgaacacactgcgtcttctgggaacactgctgtctccagtgcaccagcctttctctgttttgcagcgagcagcctcacgtgcgtgcccagggctggccgscggcttgtctcactgggcagaggtccaggggtgtggaagggcctcagctgcggccgtgctgcactccagttctttgaaaacctctctcattgagagtcca

SEQ ID NO: 44147 - DNA, 201 bp, Homo sapiens
agaggtgactgtgggcagggaagcacccccaaccttcacacccactgtgcccgtggcccaggcgtcccacgcatcccaggagggtctggttggcgggagcsctctgcttctgcttcctctagatgaggaaggtgcccggcaggtttcctacctaagcacaccccctgggcccggagggtcagcagccaggctggtgtgggc

SEQ ID NO: 44148 - DNA, 201 bp, Homo sapiens
tgaagtttaacaatcctgcagagtaagagaattggaggtgggtgtgtgttaagttttgatttattacagcctcttcagagtttatgttccatatgtgattygtttttgaaattatcttagtttttctgtatgacttaatttttagcactcactgtagtcttaaattgccttctttttgcattggcagctggaggagaaagc

SEQ ID NO: 44149 - DNA, 201 bp, Homo sapiens
ctgtggtattggttacatcatccactcggccaggcggcatgatgccctgccgcacctgtgagggggtagctgactccctggatgtgtgctttgcagctgckttgtccttggttactgtgtttagtaccaggtcaaaggctatcgggaattttttgttaactaccacccccccccccacacacacacacacaaataagtaag

SEQ ID NO: 44150 - DNA, 201 bp, Homo sapiens
cttcccaaatagctgggaccacagtcgtgcgccctcacatccagctaattttgatactttttgtagagacggggttttgccatgttgcccaggctgctctygaactcctaggatcacaggtgtgagccactgcaccagcctggtacacatttcttacattccctgttcaagtgaatgcattagccttcgcctggaaaggtg

SEQ ID NO: 44151 - DNA, 201 bp, Homo sapiens
gaggatgccaactggccagtgtgtgccagcgagtgtcctgatggagttggtctctcctctgctcccgtgcaggcccacagctcactctagacactggactscaggacccatccacgaggtggctgctgggtgctgctcctgacatacacatggagaaggatgttaaataatttttacttgaattgtcaaatgaaattttta

SEQ ID NO: 44152 - DNA, 201 bp, Homo sapiens
agggacagcaatagttgacctatggactctgtcccgtagcaggtccaaaccgggggcctgtgctggggcagccgttctgctggagaccagggcacctgccyttacatgcttgttatttgtccatatattgacaaggcacgtgtgctggatttagatcagctctgagaggatgccaactggccagtgtgtgccagcgagtgt

SEQ ID NO: 44153 - DNA, 201 bp, Homo sapiens
aatgtatctatgaaagaactaggccatctgtcctgggggtgctttggtctggatcctgcgtgggcgtgttcacagagcagtttggccacctccatcctctktcctgcctgagaattggtggtaggatctgaaggttctggacggctctgctcagatcccctggcaggccaaggcgtaggcggggggtgtttctatcagggg

SEQ ID NO: 44154 - DNA, 201 bp, Homo sapiens
attcaggagcgtccagcatcggggtacccacgatggtccaaggccctgagacgtcccattgggattcactggaggcctctgggacgccttcctgagttttsagggtactctccaccccaggctcttgccctctgaccttgcaggtggtctgaatccagacttgaggcccagctgaaccttagaggctgatgtcataggccc

SEQ ID NO: 44155 - DNA, 201 bp, Homo sapiens
ccagaagactagagactgctggagtgcagagaacacagtgtgtcctccattcaggagcgtccagcatcggggtacccacgatggtccaaggccctgagacstcccattgggattcactggaggcctctgggacgccttcctgagttttcagggtactctccaccccaggctcttgccctctgaccttgcaggtggtctgaa

SEQ ID NO: 44156 - DNA, 201 bp, Homo sapiens
ctcgaggtcctaatcgggagaacaaaacgagcagttggcgatggagcgggcacagagctggcgcactcagaacacagtggacatttccttgggggctcccygcccctcccttggtccagcagcctagccctcctatcacaagaggtgactgtgggcagggaagcacccccaaccttcacacccactgtgcccgtggcccag

SEQ ID NO: 44157 - DNA, 201 bp, Homo sapiens
cccctgcttccccaggccttcctgtcctgctgagctgggccctgcggtagcttcctccctgtaccccacatggcgtggcccaccctgtgtcccctggcctyctacccagagccctgccccctccacagaggccagggcccacccccactgtccttaaggttggtgggcttccttctgagagtgggcctggggtttctcctc

SEQ ID NO: 44158 - DNA, 201 bp, Homo sapiens
ttacaggcatgagccaccacgcccggccaagaaattttttttaaaaaaccaaactgtcgatgttctgaggagttcataccgaagtgttcagaggtgagtgyaacttgcagacgttcggctaaaaagtgtgtgtgcctgtaagaaataaagtttataaatatgacagaatattaggtcgtgaagatgaagcaaggtgaagga

SEQ ID NO: 44159 - DNA, 201 bp, Homo sapiens
tcatcctgtcccctgcccgggccccgaggctctggggttcccaggctgaggaggaacacacagctctcggttccccaacccggggtctggcccactccttsttccttctttttgcctctctgtcagcacctcttcctgttgcctccctcttgctcctgggcctgcctgcatctcccttcccctgtccggccagagaccccg

SEQ ID NO: 44160 - DNA, 201 bp, Homo sapiens
aggacccccaacccccacctctgcagaggatctagcgggccttgccccatgccagggttcctgccggctggcatcaaggggacagctgttccagggctggkgtcctgagaagcaggggggacccacttgggacccaggccccctcgaagacctacccagagccacccttgcggcaggcagggtcctggcccttccagtacg

SEQ ID NO: 44161 - DNA, 201 bp, Homo sapiens
agaagattgagaaaggacccccaacccccacctctgcagaggatctagcgggccttgccccatgccagggttcctgccggctggcatcaaggggacagctrttccagggctggtgtcctgagaagcaggggggacccacttgggacccaggccccctcgaagacctacccagagccacccttgcggcaggcagggtcctgg

SEQ ID NO: 44162 - DNA, 201 bp, Homo sapiens
ggctcaggtggctccaccaggccaggccgtgtgacctgggcatcctccgccttctctgggcagggcagggacaggaagtgcagcctcatgggatgcgtgarggtgagggtgtgcccatccagctgctggggcggggtgtgtgggagtggccccccaggagctgcacgcagcacggggcctgggaaactccaaagccggcgt

SEQ ID NO: 44163 - DNA, 201 bp, Homo sapiens
ctgagtggcaggtgggggtacacagccctgcatggagaccaggctcagagccagaggaggcaggccaggaaactcggcactcatctcctctctcggaaacrcccctccctgaccccagctgcttcctctcctcctactcgaggccagaaagggaagcccctttccagtggggtgagtggctggcgctgcccgaggcggtcc

SEQ ID NO: 44164 - DNA, 201 bp, Homo sapiens
acccggcagcagggacccagctgcttctgggcctggtctcggtggccctggcagcggtagatagggaggaccaaagcctggtgaggaagagccgccgagckgagtcggtgtcccctgtcctctccctgaacgaaagtgctttctttctctgtagctgctcttcctaaacgtgtgttggcttgagattggagttagcctggc

SEQ ID NO: 44165 - DNA, 201 bp, Homo sapiens
ccttgctgctggctgcccctggacaaggtgggaagggatcaggggtcattctgggagcctggaatgctgggcggtccttggctttttctcagccttgggartctggggcagtggtgcgcctttaccacccaccctggtttctgcctctggggcagtggtggacctccttcagaaggctgctgcccagccccgggccccact

SEQ ID NO: 44166 - DNA, 201 bp, Homo sapiens
ctcatgtgaaataagtgggcatttaactgtataacataacagagttgagtattttgaaaattaatgtgttttcgttagtcatagtaaaagataggctggarttctgaaatcatcttgaatgttgcagactcctcttttcttagccagtgagactttatttccgaggcagatgactttttatgtgtcttcccagcccctatg

SEQ ID NO: 44167 - DNA, 201 bp, Homo sapiens
gcacagctaccacagtgcagtccagcaacagccagttcagagtgtcatccaagagacctccttcagtaggtaaggcttgaaggctcactggccctcggggwctgcaggaaggctgggcttactgacttctcgtctttgtaactcatctttgtaactgccttttacttggcctagccagaggcgtaagtgtaattaactgcc

SEQ ID NO: 44168 - DNA, 201 bp, Homo sapiens
ttgctcctaacctcttcctgtcctccctctgccccagccaggccagcaggattctgccgaaccatcgcccattcttaagaaccctccagggaaccctcccrcttgagtttaaagaattcactactcatttctgcatcccagaggatgtgatgaccaggttgcccataactgggcacttctcctctccagcagacagaagtc

SEQ ID NO: 44169 - DNA, 201 bp, Homo sapiens
gcagctcttagcttatcgctgctttgtagaaatgggtatctattgaaatacgtttttttattttcctggctcttgtcccatggggctcccttaccaaaacratgacttcaggccctttactgtatcctgggtggcccgtctggacctgtttattcctgctgttgagtcctgagtgtctgctctaccctcctctcccccttt

SEQ ID NO: 44170 - DNA, 201 bp, Homo sapiens
aaaccaaacaactcatggtcgtgtcttgaggagtccaggaggcacttaacgtagcttcagagccctgagagtgcttctagtcatggtttaccagctgggcsggcacaatgggactgctgctcaaagctagcagtttggcatctgtcacgggcttctgccttttacaagaaggtcctcaagaccaagaagtcttctacttgt

SEQ ID NO: 44171 - DNA, 201 bp, Homo sapiens
ctcgctgcaacctcctcctactggcttcaagtgattctcctgcctcagcctcccaagtagctaggattacaggcacaagcttccatgcccagctaactttkgtatttttagtagagatgaggttttaccatgttggccaggctggtctcgaactcctgacctcaagtgatccgcctcccttggcctcccaaagtgctggaa

SEQ ID NO: 44172 - DNA, 201 bp, Homo sapiens
tagggttttgaagcataagcaagagctctctgaacacacatgggtggtggagcccaggctctcagccaggcttttcaaacctgaaaccaaacaactcatgrtcgtgtcttgaggagtccaggaggcacttaacgtagcttcagagccctgagagtgcttctagtcatggtttaccagctgggccggcacaatgggactgct

SEQ ID NO: 44173 - DNA, 201 bp, Homo sapiens
gtagtgatcattcatttggtagagaagcaaagcagggacaagggaccaccttctccctgcccaggcccaccccacctggcccaggccagagcccggatggraggtcttcaggccacaccacctttcacactgtccttatcccgtcccacctaccagtttgagctgtttgtcttttaaatatttggaatgtaaatattctaa

SEQ ID NO: 44174 - DNA, 201 bp, Homo sapiens
ttcgagggccagggtgtatctttacactccctctctgggttactttgagacttaagtaaaaccactggaaacgcatttaatacagttaaaatatgattcarttaaatatagtttaaagtataagtgcagatttagattgggcaggtaaagctatgtggataatagggtcataaataggttgcaatatggggatcacattgt

SEQ ID NO: 44175 - DNA, 201 bp, Homo sapiens
catgaagtcatccttgtaagcgagaatctgaagagaggcgagacacacatttctgctcaaggaaggaggaagcgccccaccaggcttctcccacccccacmgtgaccactgcccactcagtgccaccaagccttcagcccagcctgtcccatgatttcggccaccaccggccagcagacatctggtcagtgccgtccggag

SEQ ID NO: 44176 - DNA, 201 bp, Homo sapiens
ccacccagctgctttcaagattttctcttttttttttttttgttttttgttttttgagacagagtcttgctcagccgcccaggctggagtgcagtggcgcyatctcggctctctgtaaccactgtctcccaggttcaagtgatgctcctgtctcagcctcccaggtagctgggattacaggctcccgccatcatgcccggc

SEQ ID NO: 44177 - DNA, 201 bp, Homo sapiens
aatcagatgtttactgcgctcctgctgagcctgctccaggcagctgggtggggcgtagggtgcctgtctgctcaagcctgcagagggaggccagctccccrccccagggtcagccaggctggcaggcaacagcctcaagaaggcagtgtgcgtgccatggcacacggggctgaggccgcgaggcaggggccgagggaagcg

SEQ ID NO: 44178 - DNA, 201 bp, Homo sapiens
cgttcccgatcggccctttctgacatgaagtcatccttgtaagcgagaatctgaagagaggcgagacacacatttctgctcaaggaaggaggaagcgccccaccaggcttctcccacccccaccgtgaccactgcccactcagtgccaccaagccttcagcccagcctgtcccatgatttcggccaccaccggccagcaga

SEQ ID NO: 44179 - DNA, 201 bp, Homo sapiens
aaaggtaacatttaacagattactcccgacccttccctattccctgtgacattgctgtcattattttcacttatccacatgtttatcacccagtacagtgwtgatgattactttcaacagttatcttttagatgaataataataagaagaagatattttactttgtctttattccttctctagtattcttcctttctttat

SEQ ID NO: 44180 - DNA, 201 bp, Homo sapiens
gccctcccccaaccttctctcttctccccaggctctgtaacttccaaggccatgagagtggtcaggccctgcttggtttcccggcccccgatcacagatcrtgctggaactgctggccccaacgccctgaggtgactggccctttcttcatggattccggtcacatctggtccatctttgtcagctggcctctgggaagaa

SEQ ID NO: 44181 - DNA, 201 bp, Homo sapiens
catcactactgttcagtctgtgccaggagaggaagctctttgagtggggcccaggctattcccagggccaaaagtgtgttaggtacttgatgaggagctamataaacttctcctggatttttgcagagcacaagtcagtgaggagaaggaagaggccatgggtcacacactgaggaacttcatcggttcccattcatgcca

SEQ ID NO: 44182 - DNA, 201 bp, Homo sapiens
tttcttactccatctcactaaagttttgtcagttttgtttctcttttcaaagaactatattttggtttcattgattttttttttcccctattgtttttctrttctctatttcattgatcattaatctctgctctaaattacctttcttctgctagctttgggtttagattgttctttttctaattcattaagatgtgaagt

SEQ ID NO: 44183 - DNA, 201 bp, Homo sapiens
caggccgcacccaggtcgggcggtgggggcgagcggaggggctgaggggcggagaggcctggcgggccgctgctgcgggccaggggacgggggcggagccrgagccggagccgacgggcggtggccgcactgggaccccggaatcccgcgcgctgcccacgattcgcttctgaggtgaggctagctagcgggggcggcggg

SEQ ID NO: 44184 - DNA, 201 bp, Homo sapiens
tagacaggatggtgccaagagcaagggactggccctcagccacgggccaggagacctgagccttgtaggcgaattgcacttcctgaccctcagtttcctgwtctgcaaaacgggatgacagaagtccctggctctggaccacgctgctggatttgggttccgtgccgggcccctgactacactcatccttcaagggtgacg

SEQ ID NO: 44185 - DNA, 201 bp, Homo sapiens
tgctgtaaatactgttcagtccctgcaccccagcttccaacacaaattctcagagcagtcacagcagcaagaacgtttattataaaaataggtgaataaartaagtgtgctttaacttccggctggatgacaaatgctactgaaatgcagtttctcagtgcagacatgtggctcgcaatggcgggggtggccaccctagtg

SEQ ID NO: 44186 - DNA, 201 bp, Homo sapiens
gggccgtcaggaggagggatctgagccgggcgggcagccatgcaggtacagacagactaagccaaaggcgggcggtagggagggtgggagaccagtttgaygggagtggcctttgcatgccaggtgtggtgagggtatggaggggcctgggaggcaaggagaaggggccgtgcagaccctggaatccttcctccaggatag

SEQ ID NO: 44187 - DNA, 201 bp, Homo sapiens
ctggaggagttagggggcggggacagccccttccacctgtacgctggcctccctgcagcccagcactttcccgctgctctgggcctcggctccctgggggyattgagggcctgagccctgctgtggggagccttctgctggtgctcctttccgtgagcacctcctatcccctctctgtgcctcagtttgctcatctgttga

SEQ ID NO: 44188 - DNA, 201 bp, Homo sapiens
cacttccacaatggctgtagttcctatctcttcctccctgctaggaaaatgtgaaatagcccagagtggggggtgggcagaagagttgcaggctacccaakgctgggatgagcagagttgagacctggggagccaggcccaggacacttacaggtggggatgtgagcaggcaccccagagagtgagcaccccagccagcca

SEQ ID NO: 44189 - DNA, 201 bp, Homo sapiens
ttgctgtgacccaatggcatctgctcatttgtccatttgctcctctcgtgagccacaagggtagggacttccttgtatcatcttgggtccccggggtctgrtgtggggccaggcatttatttagctgaactggacatcagggacatcaagatgtacagccccaaggtcatgagtgttttgtcaggagccttagaccagtct

SEQ ID NO: 44190 - DNA, 201 bp, Homo sapiens
gtaatttagatgatatcttagtccattcatgcagctatgaccaaatatcacagactgagtaatttataaataatagaagtttatttctcacagttctggargctgtgaagttcaagagcaaagtgcaccaacagattcagtgtctggtaagggctcactctctgcttccaaagtggcaccttgttgctgtatcttcatatg

SEQ ID NO: 44191 - DNA, 201 bp, Homo sapiens
cccccttctctttggccttattctgtgggtgtgattggggcatcaccatgggcttctaccccggatgtgccctgtggaggtctgctccccagctccctgcyggccaggggtcctcgccttacctctgctcacctgccctgcataccctcccagcaggcgaggtcatcctcctcacccatccctgctctgtcagcctcagcg

SEQ ID NO: 44192 - DNA, 201 bp, Homo sapiens
ctttgttctccacaatctactgtctccgagtgtacacgttgcgctgtttgtgtttgatccccctgacttgtagccagcttgtgtaagatcccttgcagaaygagaaagttaaaaacaagcccacccagtactcacaccatcaagtctgttatagagtgtacgactgtattaacacggaggcctgcctggctacttttttaa

SEQ ID NO: 44193 - DNA, 201 bp, Homo sapiens
ggcatcagtgcggacgactccagggttgctggcccagggaaggaaaaagagacttggcaggcgcatgaagccccctgctgggacgcctgtgacacgtagascagcggcagatcttgccctcgccatcctaaccgtcagcctcaccctcagcaggtcctgccctaccccccagacagcagctgcctctgcctgttctgggtc

SEQ ID NO: 44194 - DNA, 201 bp, Homo sapiens
caggaggccagtgtggccaatgctaagcggggctatggagagagaactcagggagcaggcaggtggcacaggctcggtctgggccctgcccatgcaaggayagaaggcatttgccttgggggaggtgggatctacagaaagttctgagtgaagaagtgacatgacctgactcacactgtgactgcacccctctggtgtgat

SEQ ID NO: 44195 - DNA, 201 bp, Homo sapiens
tacaggtcgtctgaaatgctctttatgcatagggctcctgtactgtggttttcttctttttgtgtcttccttaccaagctttaagtttctggatggcaagraccatattatttatcagtatgtatatccttagtgtctaaaacagcgcctggtacttagtagtgtgtgtcgaattgagctttccctagatctgtatgtgga

SEQ ID NO: 44196 - DNA, 201 bp, Homo sapiens
ttcaccatgttggtcaggctggtctcgaacccctgacctcaggtgatccacccacctggacctcccaaagtgctgggattacaggcgtgagctacagcgcygagcccagccagtactttcttataataccttttatgtttttttcttaattttaatttaattttctgctttttagagatatgcttgctctgttgcccaggc

SEQ ID NO: 44197 - DNA, 201 bp, Homo sapiens
ggctcaagcattcctcctcccttggccccccaatagctgggattacaggcatgtgccaccactcccagctaattttttttttattgttttggactcttccagagagaagacagggtctcactatgttacccagtctggactgaaactcctgggctaaagcagtcctactacctcagcctcccaaagtgctgggattatagg

SEQ ID NO: 44198 - DNA, 201 bp, Homo sapiens
gtgaatggaattgttttcataatttccttttccaactgaccattgttagtgtatagacatgcagctgatttttgagtgttgattttgtatcttcctacttygctgaattcatctattctaacagactgtttttgtggaatctttggagttctctacattgtaaaatcatatcatctacaaacagagataattttacttctt

SEQ ID NO: 44199 - DNA, 201 bp, Homo sapiens
tttgaaaacaataatttcttttattttgattctgtaggaacctagaaagattgtacaatgaatggtgattctcgtgctgcggtggtgacctcaccaccccygaccacagcccctcacaaggagaggtacttcgaccgagtagatgagaacaacccagagtacttgagggagaggaacatggcaccagaccttcgccaggac

SEQ ID NO: 44200 - DNA, 201 bp, Homo sapiens
tacattgtagttttgatttgcatttccttagtgtttagtgatgttgggcatcttttcattgttcattgactattcgtatatcttctttggagaaacatctmttcaagtcctttgctcgtttttgaatcaggtttgttgttgttgcattttagttctctttctattctggatattagtcctttatcagatatatgatttgca

SEQ ID NO: 44201 - DNA, 201 bp, Homo sapiens
ttaatttttggaggaactgccaccgtttcctacagtggctgcaccattttacattcccaccaacagtgcacaagggtttcagtttctccacatcctcattracacttgttattttctgttttgcttttttaatagtaaccatcctcaaggatgtaaggtggtatcccattgtagggctttttgtcttgtgtaaatgaccac

SEQ ID NO: 44202 - DNA, 201 bp, Homo sapiens
agcgtttcaccatgttggtcagcctggtctcgaactcctgacttcaagtgatcctgtcttggcctcctaaagttctgggattacaggcatgagccaccgcrcctggcctatttattatttttatgtctcactctgtcacccagactgcagtgcagtggtgcgaacacagctcactgcagcctcgacctcctgggctcaaat

SEQ ID NO: 44203 - DNA, 201 bp, Homo sapiens
ctacctagaacactcagtagctcccacttctcccagcctcatgttcagcctgtctctgtgtgccctatcagagtatgacttcactctgagtgaaggtgaakagggcagggcctggttggggagagggtagggagagccagcttctggaggtattcggacgatgaggccacaggatttcctggtggacaggatgcaggtagg

SEQ ID NO: 44204 - DNA, 201 bp, Homo sapiens
gggcatgcgggagaatgagtgtgtatatatgtgttagtgtggatggtgtgagtgttaactgtacatgcatgagtgtgacaggatgcgcatatatgagcgtrtgaataaagtgcacagggtgacctggtatcttctccctttgggctggatccccagccccaacttgccctgtggctcccacaaatggggccaacctgatca

SEQ ID NO: 44205 - DNA, 201 bp, Homo sapiens
ggctgagacctgagcgggcctccatgcttccacccctcaaccagcacacacgtcctaccatcccacccaacctccactgctccccctccagccccaggctsctcctttccccttcattcggtaaaggagaaaatattccccatcccacccagggcaaggcgtgaggcagccaggcctggcctgggatgcagagatggccca

SEQ ID NO: 44206 - DNA, 201 bp, Homo sapiens
gccagggtgtctgtgcccatgctaaggaggccccagacctaaaagcccaagctcctcaccctctaggagacagtggggtgtctgcagcccaaacgggcccygagggggaccttggcagcagggctggggctgcagacacagctggggagacggagctccttagcctgggagctgccttttttgagtgacccgacacctagg

SEQ ID NO: 44207 - DNA, 201 bp, Homo sapiens
agtggaggcagaggggaggccagtgtgcagggcactctggcgtggggtctggctgagacctgagcgggcctccatgcttccacccctcaaccagcacacasgtcctaccatcccacccaacctccactgctccccctccagccccaggctgctcctttccccttcattcggtaaaggagaaaatattccccatcccaccca

SEQ ID NO: 44208 - DNA, 201 bp, Homo sapiens
gtggccagccttctgctgaaggtgtggtctgcccttggccacctgaggggactgaggctggcacaggctggggacgccagggtgtctgtgcccatgctaargaggccccagacctaaaagcccaagctcctcaccctctaggagacagtggggtgtctgcagcccaaacgggccccgagggggaccttggcagcagggctg

SEQ ID NO: 44209 - DNA, 201 bp, Homo sapiens
tctctgtccatccaagcgagagctgcaagttagtcctgcctcctatccgccatctccccacaattgtggttctttttttttttttttttttctcctgagayggagtctctctctgttgccaggctggagtgcagtggcaaaatcttggctcactgcaacctccactcctgggttccagcgattcttctgcctcagcctccc

SEQ ID NO: 44210 - DNA, 201 bp, Homo sapiens
tctccatggttaccggcacagggtaaatgtcaaggagtggccatggctgaggaggggagaatggcctgtgtttaggaatatgaacggcagtgtcatatgcygcagggatgaagaggaattgagagagcaattggagaagctaaggcccagagaggaggggtctgcagaggtcacccagcagcccaggactcccagctccag

SEQ ID NO: 44211 - DNA, 201 bp, Homo sapiens
tcagcagtggtaggatcaggtggtggatagggccacagagctcccaagaaactatgtcctttgtcttcagagttcctcagctgtcccatggagcctgcagyggcaatccacctccttcaaaggagtctgtggattctctcagctttcctggtatattcctgcagtagttcttggagcaaaagttcatgatgtgggtctcca

SEQ ID NO: 44212 - DNA, 201 bp, Homo sapiens
aacaccaaataaatctttaggagacagattaagaataatagagaaaaaaagacacaaaaaatagcataattagatggaagaagaattaagatgttgataaytatcaaagtcaggtgatggctatgttcattatgctatactatctgtttttgtgtgtgtttgaaaatgtcagtaattaaaaaaaaaaaaagttttgtccgg

SEQ ID NO: 44213 - DNA, 201 bp, Homo sapiens
tttccttaacatgggcctgccccctgggcagcttctgctggcagctgtgctctgcctgactccaacggagacttagggcagtccctgggcttgcgtgcgarttagatttctgggaatcttcttgctaaagggctctctgatgggctgcctgtcatataatgaccagtcacatggggagtctaggttctggcaaacatgtct

SEQ ID NO: 44214 - DNA, 201 bp, Homo sapiens
gagactggagagtggctccaggcgagcagcagtgccagccgtggcttcccccagacccacctcgccttgcctcacttcactgtctccagccccacctcacygtctccagccccacctcaccctcaccaccctcggcctggaagcccgccctggcctcctccctccagccagtgtacggcccctgcctggccaggccagagc

SEQ ID NO: 44215 - DNA, 201 bp, Homo sapiens
tctgccattctgtatcttttaggtggagcattgaggccatttacattcaatgtcagtattgagatatgaagtactgttctattcatcatgctatttgttgyctgaataccttgggttttttttcattgtgttgttgttttataggtcctgtgagatttatgctttaaggaaattgtattttggtgtgatttgaggatttgt

SEQ ID NO: 44216 - DNA, 201 bp, Homo sapiens
cactgtgcccgtggcccaggcgtcccacgcatcccaggagggtctggttggcgggagccctctgcttctgcttcctctagatgaggaaggtgcccggcagrtttcctacctaagcacaccccctgggcccggagggtcagcagccaggctggtgtgggcgtggggtgtcccggccacagctgatctgctcagtgactgctg

SEQ ID NO: 44217 - DNA, 201 bp, Homo sapiens
tgtctgtgtgacaatgtctctgtcacccagacaggagtgcagtggggcatgatcacggctgactatagcctcaacttcccaggctcaagtgatcctgtcayctcagcctcctgggtagctgggactacaggcgggcaccaacacgcccggcctattttttgtatttcttgtagcagtggtgtttcaccatgttgcccagcg

SEQ ID NO: 44218 - DNA, 201 bp, Homo sapiens
cagcctgctggggtggggcccaggtccgggaacttctcatgatacagcctgcagggtggccttggtgtttgggtcctaagtacacacatgttgtgtatgtragtgtgtgtttctgttgtgagggggtaacggagagagctgtacaaggtccctgctgcccacctggggagtgccatgctctgaaacctgcaatgtggagga

SEQ ID NO: 44219 - DNA, 201 bp, Homo sapiens
tgaatgcctgggagaaccaccttcctgtagggttgatgtctgggtcctcttcctgtcaagggcacattcgagggacagccctttccttaacatgggcctgycccctgggcagcttctgctggcagctgtgctctgcctgactccaacggagacttagggcagtccctgggcttgcgtgcgaattagatttctgggaatctt

SEQ ID NO: 44220 - DNA, 201 bp, Homo sapiens
aattttttcctgataccaaattggttaaagttgtgtttcctgtttttcttacaccaagattttatagactgattattctagttctagtcaggaaaagagartattagaaatctattatgacagcacttccagcagacatgccagctctttttcctcctcaagttggagctcttttcttctagaacttcttgtgggcggctg

SEQ ID NO: 44221 - DNA, 201 bp, Homo sapiens
gagaccccggcctgggagtggctgtggcctgctctcccaccccgatgcctgctgcagccccagcagaggggctggcctgtcgccttgagcccacctgtgcyggcctgtgagtggccccaggaggaagccagcgcaaggacaagacccagcctagacaggaaacctcctgaggccaacctaaaatttactaaggaataaaaa

SEQ ID NO: 44222 - DNA, 201 bp, Homo sapiens
gcatggttgggggcggagaggaggagaccctgatccagactccacccctgcctgtcttgaccgcggaggaccggggcccagactgcaggggtgcagagagsctgcggcagaggctgggggctgggctcctttcccggcaggccgggcccaccgccagacccttgtcctcactgggcctctctgaacagtggagcgttgtga

SEQ ID NO: 44223 - DNA, 201 bp, Homo sapiens
actgctgcccctgctctccttcggcccatttgcctgacgagacagccttgtccttggccctttgtttccagcctttttctgagtgccttggttttaggackttctcttgtgtgaagcaaacctgaggcttgctttgtgagccaaattgaaaatcttcttttcagtcagttaagcccattcacacttagtgatataactatg

SEQ ID NO: 44224 - DNA, 201 bp, Homo sapiens
ggtccagagctgcctccctggggagggaaagggcatccccaagtcactcctgaggctgtgtccccagagtgtccaccgggctgtgccacctccctgtctgrtgcagcctgcccctgcctgagctgcccgagcctgccccgtggctgcttcccagccaggaggaggccctaggggcagacaccggcgggcttgcttacaggc

SEQ ID NO: 44225 - DNA, 201 bp, Homo sapiens
ttctgtgttttcttgcatctcctgtttccgtgttgtttggtgcacattcctgttatatatttttagttacttgtggctttttgtgttgagaagcggccacsttctggtcgtgctttgtgcctgcggcctaagtcctgctctgtctgcgttgtgactgctgcccctgctctccttcggcccatttgcctgacgagacagcct

SEQ ID NO: 44226 - DNA, 201 bp, Homo sapiens
cagggcagaggggaagatgacgggggtgcatcccccgagctgggggaagtgacttcccgttgccatcacctcttgtggcctcaggcgttcccaggctgagwcctctaggaacacaggtgctgggtggctcaggtggctccaccaggccaggccgtgtgacctgggcatcctccgccttctctgggcagggcagggacagga

SEQ ID NO: 44227 - DNA, 201 bp, Homo sapiens
ctaggacaaagtgctgctatttcagaagtaccaagtatcaaaccagaaagggcttgatttaggaaccaaacccaggctgtcatggtgaaaaaaaaaaaaaatgcaggaccttaggtatagaactgcagggtggggtgacagccattgctctttcagtttggcatggctcgcaacaagctagccttgttatgtaaataaaac

SEQ ID NO: 44228 - DNA, 201 bp, Homo sapiens
gtgtatatatatgtacgtatgtatttacatatggagatacatatatgtatacacctccatgatacattaattctgttgtttagtcttctgtatatccttaytttgtgtcctcatggcctgtcttctgtggcttattattaatatgtttctgtgttttcttgcatctcctgtttccgtgttgtttggtgcacattcctgtta

SEQ ID NO: 44229 - DNA, 201 bp, Homo sapiens
aaaaaaataccaaaattagctgggcatggtggtgggaggattgtttgaacctgggaggtggaggccgaggtcgcaccactgcactccagcctgggcgacasagccagaccctatcaaaaaaaaaaaaaaaaagaaaagaaaaaatgaagtcctcttggtattttacatttttatttttttattttcaggttaagatcaatc

SEQ ID NO: 44230 - DNA, 201 bp, Homo sapiens
cagtgggtcgctgagggtgctctccctggtcctcagggccgctgtatgtcctgttttgggtgggggcagggactggcctggagaggcctgggtaaaggccraggctcccaggttcctgcccacattggactaaggcctgagtccatcaggagtggccagtgttgggcagcccctgggtcttcctgcgttctgtcctcaaaa

SEQ ID NO: 44231 - DNA, 201 bp, Homo sapiens
gagctccttaaaaaatcctttaaaatctcattaccatattttagctaggacaaagtgctgctatttcagaagtaccaagtatcaaaccagaaagggcttgatttaggaaccaaacccaggctgtcatggtgaaaaaaaaaaaaaatgcaggaccttaggtatagaactgcagggtggggtgacagccattgctctttcagt

SEQ ID NO: 44232 - DNA, 201 bp, Homo sapiens
ccagggatgcacgcacacaagcaggcccacagacgggaagtccaggggcccagagagacgagatggccagccttggttcctgaggggcagggaggaagggygcaaactcagccaggatcttgggtgtgaactcagatgccaccagtttccagctgtgtgatcatggccaggaggcttccccctgccacccctccgttttct

SEQ ID NO: 44233 - DNA, 201 bp, Homo sapiens
cttttaaatacaaacacgcacacatacacacccgcacatatgcacacatacacacatatatcttggatgttagccttttacttaagctgacttttaaccaytgagctccttaaaaaatcctttaaaatctcattaccatattttagctaggacaaagtgctgctatttcagaagtaccaagtatcaaaccagaaagggctt

SEQ ID NO: 44234 - DNA, 201 bp, Homo sapiens
cctgcaccaactccatgagcctggacaagctcctgccctcactggctcaggccctgtgggaccagaggaggggctgggctccaccccctcctggttcttcscactctgtccactgtctcctctacgtagacaccgtcgaagggccctcttggagcccaacctcagggccccactccaggcactccactcctggcaggacag

SEQ ID NO: 44235 - DNA, 201 bp, Homo sapiens
ggagtctcagggtcccggcaggtatgggcgggtgtcgggggtctcgggtgcgcagcagcctcccccgggccccggggcctccgtgtccttgccaaaggacrcacggggcctgggcacggcgggcagtgcccgagggagcgcggcttcggggcgggggccgggtgtcccttgccgggggctcaggggtgggaggcggtgcga

SEQ ID NO: 44236 - DNA, 201 bp, Homo sapiens
cctgtgactcaatgtcacaaggactgttaaagcacatatagaaagatacgggaatgtaacaactttaatttaaaacctttgttttaaatgaggttcaagcrattctcatgcctcagtctcccaagtagctgggattacaggcatctgccaccacgctggctaagttttgtatttttagtagagacggggtttcaccatgtt

SEQ ID NO: 44237 - DNA, 201 bp, Homo sapiens
cacatggcctagtcaaagagacaggctgatacaggtggtcacacgtggatgacggaagcacgagctgggtggggaggacgtgtctctgtcctcctctgtcscctccctcccttcctccctccctattgtctctccagccccctcatcttgtcaatttcctcatgtctggggctgatccttgatccttccattttccctgcg

SEQ ID NO: 44238 - DNA, 201 bp, Homo sapiens
gctgtgaaccaggccgtgacccctggcgctgtgcccccagggtgatgcgggcggctgaggagaccacgtccaacaacgttttccccttcaagatcatccayatcagcaagaagcaccgcacgtggttcttctcggcctcctccgaggaggagcgcaaggtgactgggggtccgaggacgagtgcaaggtgactgggggtgt

SEQ ID NO: 44239 - DNA, 201 bp, Homo sapiens
gaatcttttacgaacactctttatgttgctgttttgattgtctgagattcggtcagtgggagccccctcggaatggctttttccttagaccatttgatgcrgccctaccagcctttaagcattttatactttgtgtcatggttcgatgctccgggctcatctcgtgtcttctctctcccagccctgaaccagccatttctc

SEQ ID NO: 44240 - DNA, 201 bp, Homo sapiens
acaaactcagaaggatccaacgtaatatttgcaggatttgtgcccagaacattttatccaaatctaccaagacaagacaaatccaaattggcagacaggtrgcctattaaaaatgttaagtcttgtgaaaagagaaaagggttggaagaggctgggttagtgggaaagctataatggacatgtgaaggaaattggaaaatg

SEQ ID NO: 44241 - DNA, 201 bp, Homo sapiens
tctactcacagcttcctgggctctgggacctggggtccagtccccactcctcatggggaggagtccccccacgccccaagcagttgactcccgcactggtkgggggtccgctcgccctcaagctctgcaggcccagcttggtctccccagcctcttcactttctccacggctccctccacctacctggccctgagagctcc

SEQ ID NO: 44242 - DNA, 201 bp, Homo sapiens
ctccctcactggggtctaagttcagccccgagagctaggctgtaggtgggtagagtcacagccccagcgccggtgtgaggggtggccctgggccaggtagrgtgagtatctgcctgctgtcatgccccatccacttctgccgcctccccagtagaggaccccctccatttcacagatggggaaaaggggccctgttgtctg

SEQ ID NO: 44243 - DNA, 201 bp, Homo sapiens
taccatgtcgccagcttctttacagtacacgtggtgacaaagaaaagggaagatggagcctccgtgttgaacatacctggctcccaggtagcccttttctrttggcacagctgctggcattcacccgtgcaagctgccagcttgcttatctatgtttgcagctcgatttttcaggctgctttttgttagaaaagaaatgat

SEQ ID NO: 44244 - DNA, 201 bp, Homo sapiens
actgcaacctcaacttccctgggctcgggtgatcctccccactcaccttctcaagtaggtggtaccacaggtgggcaccaccacactcggctaattttttygtagtttttgtaggaacagcattttgccagattgtccaggctggtctcaaactcctggtctcaagccatctgcccacctaggcctcccaaagtgctagga

SEQ ID NO: 44245 - DNA, 201 bp, Homo sapiens
tcagggacatcaagatgtacagccccaaggtcatgagtgttttgtcaggagccttagaccagtctggcccagcctggagctccctccgcatgtggcctctkacaggagtgacgcagccccatgcggtgctaacagtggcagcactgaacgtcggatggggctgagcccagccacttccacaatggctgtagttcctatctc

SEQ ID NO: 44246 - DNA, 201 bp, Homo sapiens
tctggccacccccactctaatcttttattatgcagatgggttttctacctggctggtaccatgtcgccagcttctttacagtacacgtggtgacaaagaawagggaagatggagcctccgtgttgaacatacctggctcccaggtagcccttttctattggcacagctgctggcattcacccgtgcaagctgccagcttgc

SEQ ID NO: 44247 - DNA, 201 bp, Homo sapiens
cgttcgagacaagcctggccaacatggtgaaaccccgtctctactaaaaatacaaaaatttgccaggcgtagtaacacgcacctgtaatctcagctactcragaggctgaggcaggagaatagcttgaacccgggaggtggaggttgcagtgagccgagaacacgccactgcactccagcctgggacagagagactccacc

SEQ ID NO: 44248 - DNA, 201 bp, Homo sapiens
ttgagtttaaaggaatgaggggaagcacatttaatacagtttgccttttgagcttaatttttctagaagtacctttttaaacagttgttataactaatgtrtaacactgtttttgataactgtcagcttaaacatgttgagcatatatttatttaattaatttattttttttgagacagactcttgctctgtcacctaggc

SEQ ID NO: 44249 - DNA, 201 bp, Homo sapiens
ccgtccacactgtctgcagtgaccctgctccgtcaactctgagcttggcatctgaggccagccctgtacaccctgccctgtagtcaggccctggcggggcmgcaccgacgtttggctttgctccactcccctcccggtctctgcccctttccccagctggtcccctgggaacaggacacttgctgtgacccaatggcatct

SEQ ID NO: 44250 - DNA, 201 bp, Homo sapiens
ggttttgccatattggccaggctgatctcaaactcctgacctcaagtgatccacccgccttggcctcccaaagtgctgggattacaggtgtgagccaccaygcctggcctgctaatgcttttctgtactcactggaaatagcaccctgtcctttccagttactaaccgaatcagatatagaagccctatccaaatgaggcc

SEQ ID NO: 44251 - DNA, 201 bp, Homo sapiens
tcaggctcaccccatcttttatttttagagacagtctcactcttgtcacccaggctggagtgcagtagcacgatcttggctcactgcaacctctgactccygggttcaagcaattctcctgcttcagcctcctgagtagctgggatcgcaggcgtgagccactgcacccggccttagtccccctcttttagctctggggta

SEQ ID NO: 44252 - DNA, 201 bp, Homo sapiens
aagttggatagaagaggtagaacagcaagggagactcacagcagtagctggagaggttggaggaaaaccagaaactgatgtctgaaaactggaagaggacrgtgactcctgaaagtgggagcagctgtgccagatgctgctgagagctggtaaagtgaatgcgctcagaaggaattgaaactagcttcactgaatgggtct

SEQ ID NO: 44253 - DNA, 201 bp, Homo sapiens
gctgctttcaagttccaaattgggctctgggggtgagagcaggcgactctggatgtaaaaatagaaaagccagtgcgtgcgtgggtcctgggtcctccacscacaggcctggtattacaaaatagagcttcctaatgggacctgcctgacactctcgttttatgtagaaaattgactcaagcaaacctcagaggacagagc

SEQ ID NO: 44254 - DNA, 201 bp, Homo sapiens
accttcgcctcccaggttcaagtgattctcctgcttcagcctccgagtagctgggattataggcatgtgccaccacacccggctaatttttatattttcastagagatggggttttgccatattggccaggctgatctcaaactcctgacctcaagtgatccacccgccttggcctcccaaagtgctgggattacaggtgt

SEQ ID NO: 44255 - DNA, 201 bp, Homo sapiens
atgtgttgcgatcttgtggttttcgttttttattttgttaccgtggtgtgtcacatcagttgatttaaggatattaaatcaacctgtgttcctgggataamtcccacttggcggtggtatataatccttttcatgtgttcctgagttggtttgctaatattttgttaggatttttgcatctgtgttaatactaataaaata

SEQ ID NO: 44256 - DNA, 201 bp, Homo sapiens
ctggaactacagatgtatgccaccgtgtccggctaagttttgtattttttgtagagatggggtttcacatgttgctcaggctcaccccatcttttattttyagagacagtctcactcttgtcacccaggctggagtgcagtagcacgatcttggctcactgcaacctctgactcccgggttcaagcaattctcctgcttca

SEQ ID NO: 44257 - DNA, 201 bp, Homo sapiens
tgcttctgcaagaggacatccggagacacaggaatagaaatgatccgatcagagtaattaaaggcttttaactgagctctgaggtcccaaacagggcacaytccgtcagcctaaagctgtgaagaagaaccttcaacataaggtgggtgttctcttttagggtggtggagaactgtgtcattaggctagtactgtaagcag

SEQ ID NO: 44258 - DNA, 201 bp, Homo sapiens
agtggccccagaatagaatgtgctgctttcaagttccaaattgggctctgggggtgagagcaggcgactctggatgtaaaaatagaaaagccagtgcgtgygtgggtcctgggtcctccacccacaggcctggtattacaaaatagagcttcctaatgggacctgcctgacactctcgttttatgtagaaaattgactcaa

SEQ ID NO: 44259 - DNA, 201 bp, Homo sapiens
acctcaacggaaagctgacaagggaggtttttcttcagatgcaggtgggatcctggatgtgggcggctttcccaaggtcacaaatccagacttctctgtcwtcacgaaagccttttattttttcctttttttatttcctgttgtcttagtcccttccctttccttacaggagaatccactggaccataatctgtggatggc

SEQ ID NO: 44260 - DNA, 201 bp, Homo sapiens
ggcctgtccctatgaaggccattggtgcccagaacctgctaaccatgcctgggggcgtggccaaggctggctacctgcacaagaagggcggtacccagctkcagctgctgaaatgtgagtccctggggtggtagggtgcacagtaggagggcatgggggcagggctagccatgtaagtaagcatcctctccaagcctctgc

SEQ ID NO: 44261 - DNA, 201 bp, Homo sapiens
aagtgtcaccgttgtaaatcattacagccttgaactcctgggctcaagtgatcctcctgcttcagccttctgagtagctgggattataggtgggcaccacygtgcccagctaacttatttttattttttagtagagcaggggtcttgctatgttgtccaggttggtttgaactcctggcctcaagcaatcctcccacctcc

SEQ ID NO: 44262 - DNA, 201 bp, Homo sapiens
agcttgtccccaagcagtggtcttggagatggtgagaacccaccaggttctgggggggcttctgaagtggagcgaggaattcctaataacgacagaatcarcataatcatgacccccgcccccagacttccacatcctaatccccagaatttgtaaatgtgttaccttccatggcaagggggaataaaggcagcagatgaa

SEQ ID NO: 44263 - DNA, 201 bp, Homo sapiens
cccaaggccctcagaaaaggggtttccttgcctgtcatggccctaccctccaagctgtgtcctggatcttggcagtgtccccctgagcgccctggctcagmcatctcctgcctgaccgtagctgagccacgtgcctttgtcctttattgcagcttcatggcggctgaagagatgcattggcctgtccctatgaaggccatt

SEQ ID NO: 44264 - DNA, 201 bp, Homo sapiens
aaaaaaaaaaaaagaaagaaatactgccactttaagcatatttttatcttatctttacatttagaacagaaatatcaaattgatctttttcttaaaaaaaracactaatttcttcaactgattctttggttattggttccacaataaaaatatcttttttgcataataaactctactttataggcttgttatccaaagtgc

SEQ ID NO: 44265 - DNA, 201 bp, Homo sapiens
gaaccagtggagagaaagggctgcacgtagcgctcaggatcctggggttgggtttgtggctgagtggaccaggggctgactgagtggagcccgtggctctrtctctccctggggtcccacctggaagcccaaggccctcagaaaaggggtttccttgcctgtcatggccctaccctccaagctgtgtcctggatcttggca

SEQ ID NO: 44266 - DNA, 201 bp, Homo sapiens
cgcttaagcccaggaatttgaggtggcagtcagctatgactgtgccactacactctagcctgggtagcaaagtgagactctgtccctcttaaaaaaaaaagaagaagaagaaaaaagaaaatgtgcatgtataactctgatgaaaagtaaaaactaaattcgaaacacactcatgacttacataccgttttcccttgttgg

SEQ ID NO: 44267 - DNA, 201 bp, Homo sapiens
ccactgggcatctgggtctgaccttagctgctccactaagggcttaacaggacactggccacaggcctgctcccatccaactccactggggccacaggagkgaccctacccaggatggagtgagggcaggcacagaccaaacagtgcagggtcggggggtactgttcactgggacaagagatgaggaagatgctggattta

SEQ ID NO: 44268 - DNA, 201 bp, Homo sapiens
gctgaggtgggaggatcgcttaagcccaggaatttgaggtggcagtcagctatgactgtgccactacactctagcctgggtagcaaagtgagactctgtcyctcttaaaaaaaaaagaagaagaagaaaaaagaaaatgtgcatgtataactctgatgaaaagtaaaaactaaattcgaaacacactcatgacttacatac

SEQ ID NO: 44269 - DNA, 201 bp, Homo sapiens
agcctcaaactcctgggctcaagtgatcctcctgcctcagcctcctagagcagctgggactacagatgcaccccaccatgcctgactaattaaaaaaaaawttttttttagagatagggtcttgctatgttgccctggcttagttttctttatgtatgttttttggggttggagctgtagtggaaccagtcccagccccac

SEQ ID NO: 44270 - DNA, 201 bp, Homo sapiens
gcctaggcgggcagatcacttgaggccaggagttcgagaccagcctggctaacatggcgaaactctgtctctactaaaaatacaaaaaattagccaggcawggtggtgggcgcctataatcccagctacctgggacgctgaggcaggagaatcgcttgaacctgggaggtggaggttgcggtgagctgagatcgccccgtt

SEQ ID NO: 44271 - DNA, 201 bp, Homo sapiens
cacggggcttgtcgatctgcgggcagctccccgcgggcggactgggcacggggctccctcctccatccccactgcggggctccttcgggccgggcgcggtwgggcgggcggcggggtgtggcggcgcctttgttccaaaccttggcctgtggttgggggtcctgcggctgggacccgcccctgacccctccctgcccagag

SEQ ID NO: 44272 - DNA, 201 bp, Homo sapiens
tgggggactcaggccggcacggggcttgtcgatctgcgggcagctccccgcgggcggactgggcacggggctccctcctccatccccactgcggggctccytcgggccgggcgcggttgggcgggcggcggggtgtggcggcgcctttgttccaaaccttggcctgtggttgggggtcctgcggctgggacccgcccctga

SEQ ID NO: 44273 - DNA, 201 bp, Homo sapiens
aggattcagttggccagtattttgttgaggatgtttatgtctatacccataagggatattggtttgtagttttattgtgatgtctttgtctggttttggtrttgggataatgctgctctcatagaatgagttccctcctcttctattttctggaagtttgtgaaggatccatgttcttttgagccaactcttgatggctgg

SEQ ID NO: 44274 - DNA, 201 bp, Homo sapiens
tcagggctgcgggcagcgggggtgcagcggggagagccagggcctgggcgcggaggaggggctggtatgggaccctccgggtgggcgcggccccgcggggycttgcggccacaccgccaccgtgcccagcggccccatcagcgcatattcaggatgaaccccggacacgcgcccagaaccgtctggtgacccagtgatgaa

SEQ ID NO: 44275 - DNA, 201 bp, Homo sapiens
aggtaaccatgagctactggcaggccgggggacacagcgggtacagaaggggtctctggagtttcgtgaggaagtattcgggctgtgcggcgccgcgaccytggcaggacgctgctgtcccgccagcggaagcggggcgcgctcagggctgcgggcagcgggggtgcagcggggagagccagggcctgggcgcggaggagg

SEQ ID NO: 44276 - DNA, 201 bp, Homo sapiens
agccagccgggatgaccagacatctgagagattcctctgatgtggaagagagagacaaaacaaacagaaaaaggacaactggaaggaaacagagactgttytgcgagaagacagcttggaaaaaactgtcattaatatattcaagaaggaaagataaaattttgtatttatgaaaaaagaactaggtgccataaagaaaga

SEQ ID NO: 44277 - DNA, 201 bp, Homo sapiens
tggttgagcccaggagttcaaggttacagtgagctatgatggccccaaggcattccagcctaggtggcagtgtcacagaccaagaccctgtctctaaaaawataaaaataaaaataaaaaaacaaacaaacaaaactaaatcattaaaatgttccttaaataattaaaaatccccccatgctgggcgtggtggctcatgcc

SEQ ID NO: 44278 - DNA, 201 bp, Homo sapiens
ctggcctccttcctgttcaaccccagcccctccacacaccgagcggggtgtctgtatttcatccccacggagccttcatctcagctgccagtgagggttcmggtgccatctgaggcgtctgctgatagccaaggtgttaccactcaactccggtgttgggtgatggctacagcgcagtctgcaaattaagatgtttgatgg

SEQ ID NO: 44279 - DNA, 201 bp, Homo sapiens
gggctctcatagatgagagcaacctagcaacggcttgcttcctgctgtgtctttaactctgcactgccacctcagtgaacccagggcctgcaggaggtgasaaacctctccattcttccacaggttccatgaccgacctcagattgaacgttgggatgagcaataaatatgtaattgcataaaataccagataaggccagc

SEQ ID NO: 44280 - DNA, 201 bp, Homo sapiens
cttctggcctccttcctgttcaaccccagcccctccacacaccgagcggggtgtctgtatttcatccccacggagccttcatctcagctgccagtgagggytcaggtgccatctgaggcgtctgctgatagccaaggtgttaccactcaactccggtgttgggtgatggctacagcgcagtctgcaaattaagatgtttga

SEQ ID NO: 44281 - DNA, 201 bp, Homo sapiens
ctaggctggtcttgaactcctggcctcaagcaatcctcctcctgcctcagcaggggtcaccgtgcccaggtaaaatctgatttcggagcctccttcctgcrttggtcaaatgctgacagtaggagaaacaaacagctccacaaacaggagggcagcatgtccacagctcgtagatcctgagggcgtggctctctcttgcct

SEQ ID NO: 44282 - DNA, 201 bp, Homo sapiens
caacccaggggcacttgtcggcctggcgtctctgacaaactccagtgatgggtgggtgtggcacacggcagctgaggacagacgagcacagcaagaagccygcacagccccggagtgggagggcctggcgtgtggcctgcaggctctggtggccttcacagatctttcctctctgtagccttgatgtttgcgtctgttcaa

SEQ ID NO: 44283 - DNA, 201 bp, Homo sapiens
gggccaaggagccagctctcagaccctcggcctcttccgcgagccccttaggagtgaggggtcagcagagcagggctttcccagccagcatcccaaggacrtgggaggagtgacaacccaggggcacttgtcggcctggcgtctctgacaaactccagtgatgggtgggtgtggcacacggcagctgaggacagacgagca

SEQ ID NO: 44284 - DNA, 201 bp, Homo sapiens
gcccctccctgttctgtagagagcagacactaggcccgctagagaatcctgaggcagcacgatgacacccgtacgcaagcagcatgaacggaggtggactyggtgcagctttgctgtcttagaaaatggacctcctgctgctaactcttgcatctcctttactgacttgtggattaattttagggggatggagatggacag

SEQ ID NO: 44285 - DNA, 201 bp, Homo sapiens
tgccaggagagggttggtcacagccataccccttgcctgtcttcagaccagctctgggggagcagcccagtggaggtgtggctgccccacctgctgccttsccccagccagccccctagcccagtcctgcaggcccctgtctgcctgtgatacagactatatccccgggagccctttcacaaacgccatttttctccatct

SEQ ID NO: 44286 - DNA, 201 bp, Homo sapiens
acccatggcatctgagagcacccaccctgtccctgagggcagctgcaccgggccaggaggccgcaagggcacgggtgagtctcggtcactggcagcactcrgccacatgcctgaggagctcttccccttgctcgtcactgaagcactgcaggcagtgagggcactgaaggtccccctggcctctctgggccgcgccaggat

SEQ ID NO: 44287 - DNA, 201 bp, Homo sapiens
aacgcagtgtgagaaggatttgacccagtgttgctgactttgagcctggaggaaggggccacgagccagggaatgccggtggcctctaggaggtggaaacrgccaagaatggattctcccctagagccccagaaagaatgtggccctgccaacaccttgactttagctcagggagacccctgtctcagacttctgacctcc

SEQ ID NO: 44288 - DNA, 201 bp, Homo sapiens
gcatcagccaaggaaagaaccctcacttacagtttgtaagccatgtgttcttctcaaacgaaatgtgaaagacactcacgtgagtcaccttctgttttaayagtcgattttcttcctgcaacttctcaataacactctggacagaggtgtgcccatctgtgtgttccgactgcatgaggaagggacagagagaagacactc

SEQ ID NO: 44289 - DNA, 201 bp, Homo sapiens
gtcagggacccgtggataaagaccaggagaacacaatgtaagtatctgggcaaagaacctcctaggcagagggcttggcgagtgcagagccccagggaccygtgcagggcctgatcaagacccttggaggagtccaggggtggctagagtgcagcaagcaggggagggactggagtagccatagaagggaccaggacagac

SEQ ID NO: 44290 - DNA, 201 bp, Homo sapiens
ccaacaagtagaaattatgcagaaatgagggaaaagcttcgcttacggctgaccaagaggaaagaggagcaacctaaaaaaatggaccagatctcagaaarggaaagcgtcgttgaccatcggagggtggaggatttgttgcagtttataaatagctccgaaaccaaaccagtgagcagcacgcgtgcagcgaagcgagca

SEQ ID NO: 44291 - DNA, 201 bp, Homo sapiens
tccagaattcctcctttccttgccaccttcactgccattgcttcatcctttctcatcccctgactaacctactcgtcctccttccgccttctggttcatcmacagcattgccacaaattgatctttccacaaagctgaccaaatcatctcactctgctgtttaaatccctctgtgactccccagccccttcagaacaaagt

SEQ ID NO: 44292 - DNA, 201 bp, Homo sapiens
tgtaccaaatgtctacccagcagctccgcaaggagggatggctgccttaaacatgagtgagtagttcctgatttttaatatatgttctgtagttttcaggyaaaatttcctgaagattgctcatgtgaaataagtgggcatttaactgtataacataacagagttgagtattttgaaaattaatgtgttttcgttagtcat

SEQ ID NO: 44293 - DNA, 201 bp, Homo sapiens
ctccactcttcctggctttccttcagggaggtcaggaaagtcagggacccgtggataaagaccaggagaacacaatgtaagtatctgggcaaagaacctcytaggcagagggcttggcgagtgcagagccccagggacccgtgcagggcctgatcaagacccttggaggagtccaggggtggctagagtgcagcaagcagg

SEQ ID NO: 44294 - DNA, 201 bp, Homo sapiens
agctcagacctctccactcttcctggctttccttcagggaggtcaggaaagtcagggacccgtggataaagaccaggagaacacaatgtaagtatctgggmaaagaacctcctaggcagagggcttggcgagtgcagagccccagggacccgtgcagggcctgatcaagacccttggaggagtccaggggtggctagagtg

SEQ ID NO: 44295 - DNA, 201 bp, Homo sapiens
taatactatcaccttgggcactaagttctaacatatgaacatataaaccatagcagatgagatggacaaatttctagacaggaagaagctacaagaactgrctccagaagaaatagacaatctgaatagacctataatgagtgaagatgttgaaatagtaatttaaaacagggaaaagtacccacaaaagctcaagcctag

SEQ ID NO: 44296 - DNA, 201 bp, Homo sapiens
gcactcatgatttgaacacttcccagaaggccccacctcttaatactatcaccttgggcactaagttctaacatatgaacatataaaccatagcagatgaratggacaaatttctagacaggaagaagctacaagaactgactccagaagaaatagacaatctgaatagacctataatgagtgaagatgttgaaatagtaa

SEQ ID NO: 44297 - DNA, 201 bp, Homo sapiens
ttggcaacactcccagtactgttgggagagcgatatcctgtgggtacttgcacctggtctccccgccgggcccgctctatgtgccttatttttcctttgcygattttcttctgtgtccttttgctgtaatgaataactgtgagtccttctactgaatcgtcaaacctgaggactgtcttgacaacagggctttttgcagca

SEQ ID NO: 44298 - DNA, 201 bp, Homo sapiens
cagaaaaatgtgggacaccattaagcataccagcctatgtataatgggaatatcaaaaggagagcaaagagcaaaaaaaatattcaaagaaataatagtcraaaacctcccaaattgaaaaatagtaacatgtatcccagaagttgaaaatgtttatattaagaaacaagaaagatctcactcaaatcaataaactaactt

SEQ ID NO: 44299 - DNA, 201 bp, Homo sapiens
tgggatagtttgttctgcagcaatggaaaatgaacagctaaaatctgacttagtgctcccactgggacatggtacagcaccacaaaaccagacagattacwatttctgcaaagacagggtgaccattcagactgcgagatgaatgaagatcagaaaaagccttgtagctgttgaagtcagattttgtaccacctttaagaa

SEQ ID NO: 44300 - DNA, 201 bp, Homo sapiens
accttggcctcccaaagtgctgagattacaggcatgagccactgcacccagcctaaattttaaaattagcagaaggaaaaataagtggatttgaagatagrctgatggagattatgccagccaaagaacatagagaaaaaaataatgaaaataaagagtctcagaaaaatgtgggacaccattaagcataccagcctatgt

SEQ ID NO: 44301 - DNA, 201 bp, Homo sapiens
tatcatcaagtaaccctgtgaagaggtccatgtggcaaggaactgaggcttcatggcagcagccggcgcccacttgcccactgtggtgaagaagccacttygggactgtatcctccgaccctagtcaagccttcagaagacagtagcccccactgacatactgactgtgactccatggaagaccccgggccaggaccgccc

SEQ ID NO: 44302 - DNA, 201 bp, Homo sapiens
ctgtttgtgtttgatccccctgacttgtagccagcttgtgtaagatcccttgcagaacgagaaagttaaaaacaagcccacccagtactcacaccatcaartctgttatagagtgtacgactgtattaacacggaggcctgcctggctacttttttaacatattgttaagtaatattaaaatcatgtctttctttttgaaa

SEQ ID NO: 44303 - DNA, 201 bp, Homo sapiens
tgggtaactaagagggtactgcagaaatgatggagtgtgacttctgcagctagctcccacaagacatcacggctactgccttgccctctttcggagcattmtctctgggggaagccacccaccctatcatcaagtaaccctgtgaagaggtccatgtggcaaggaactgaggcttcatggcagcagccggcgcccacttgc

SEQ ID NO: 44304 - DNA, 201 bp, Homo sapiens
agcctgggtgacagagactccatttgaaaaaaattaaaaattagctaggtgtggccaggcacagtggctcacgcctgtaatcccagcactttgggaggccraggcaggcggatcactttaggtcaggagtacagatcagcctggtcaacatggtgaaaccctctttctactaaaaatacaaaaatcagctggacgtggtgg

SEQ ID NO: 44305 - DNA, 201 bp, Homo sapiens
ttcaaataggtacatataactgggggagccagctttcaaagaggatcccctccttccaatatccatgctcctgtgtagtcccctccaatccactggagagrgctgacctgggtaactaagagggtactgcagaaatgatggagtgtgacttctgcagctagctcccacaagacatcacggctactgccttgccctctttcg

SEQ ID NO: 44306 - DNA, 201 bp, Homo sapiens
gaactcctaagttgaagtgatttgccctcctcagcctcccaaagtgctgggattacaggtatgagccaccacaccctgcctgggcctgataatttaagggsgctcacagctctcagattaaacgtttcttttctttctcaggactccttccgcccacccattcctcctcccgagtcctttccccttctcaagtgcagcctg

SEQ ID NO: 44307 - DNA, 201 bp, Homo sapiens
agtggtgcgatcttggctcactgcaacctctgcctcccaggctcaagtgatcctcccacctaagtctccctagtggctgggagcacgggcacgtgccaccrtgcccggctaattttttgcactttttgtagacagggtttcaccatgttgctcagccttgtctcgaactcctgggctcaggcaatctgcccgccttgcctc

SEQ ID NO: 44308 - DNA, 201 bp, Homo sapiens
tttgcttgaacccaggaggcggaggttgcagtgagttgagatcgtgccactgcactccagcctgggcaacagagcaagactccgtctcaaaaaaaaaaaaagtttgaagtaaaaaagactaatttagaatttaaaatttgattttaggaagtatgtcagatatcaaaggtttaaaacacttgatatcaaaataagatcatc

SEQ ID NO: 44309 - DNA, 201 bp, Homo sapiens
ggtggtctcagcttatctacaatcatatcacagtgagtattaaatgggctagtaactgaacgataaatgaaatattttgtgtctggcaccacctctttccrtttaggagaagagggaagcaggctgagcttcagtaagtcttggaatacctcttctgattcctgactacagagtgtaataacctgagaatcagccagtttg

SEQ ID NO: 44310 - DNA, 201 bp, Homo sapiens
ggaacaccaatggccaccgactgcaagtatactgctctggttgtgaggtccctgcatcctgtcccaccaacattctggagatgacttcggagtgtccttcygggtccttggtctgtactcatctgtggctcctggcatccacaactctaaaacctgttggtgcagaccaggtgacctctaaacttcccttctgctctagtg

SEQ ID NO: 44311 - DNA, 201 bp, Homo sapiens
agtaatactgggaacacagaactaattctatctgaggctaccaggaagctgcaataagctgcttggtgagtggccagatacacaggacaccagggaacacrtgtgagcggaacaccaatggccaccgactgcaagtatactgctctggttgtgaggtccctgcatcctgtcccaccaacattctggagatgacttcggagt

SEQ ID NO: 44312 - DNA, 201 bp, Homo sapiens
tgtttatgtaaggctataattgcctaaattagtttttaaaaatcctgaaacataatgagttaaagatttcacttgagaaattaggaaaagaacaatagaayaaaccaaagaatatataaagaaggagataagagagataatgaaatagaaaacaaagatttggtagagaagatcaacaaagctaaaatatgattgattgaa

SEQ ID NO: 44313 - DNA, 201 bp, Homo sapiens
cttggggttttttctaactttttaatttagaaattcagttcattttgttttttcttccatttttattgataaaagtgttcagcacgtggaactttcctctsatctttttcttaacaatatcccatggaatctgatagataatttttccttttttgtttgtttgtttgtttgttttgtttttgagatggagtctctctctgt

SEQ ID NO: 44314 - DNA, 201 bp, Homo sapiens
ttcgcctgaaactgttgttggtttgagcataatttatgtttagaaagacaaaaagcaattgtcatatctccaaagaccaaagacatagctgatagctgtakgcattactggtaagttaaagaaagattttttgtgtgaaaaattgactgagatcttaatggggataggaaatagaatgctgataggtcgactgtgtctatg

SEQ ID NO: 44315 - DNA, 201 bp, Homo sapiens
aatcagaatctaagagcagcctcagtgaatgagaggagcgatgggggagagcctgactggctgcttctcagtggctgaggggagagccctggagctcatctttttttttttttttttttttttttgagacagggtctggctctgtcccccaggccggagggcagtggcgtgatctccgctcaccacaacctccgccttcca

SEQ ID NO: 44316 - DNA, 201 bp, Homo sapiens
agaaagcaaaagaagacctggcgtggatgccccatcaccagacacaaacatactcactcagaagttgggcgtttgaactaacaattactcactcagaagtygggcatttgaactattaactctggagtttttcagcctacaatgttctgttctgaaacttcatctcaaattttttttttttttgagacagagtttcactct

SEQ ID NO: 44317 - DNA, 201 bp, Homo sapiens
gtagcagccagtgtgtagttgatgtgcccgcatctgttgaatgtgtgtgtgagttagcgaatgagcttcctagcttcttcagcatattgctgtctctctctttttttttttttttttgagacggagtctcgctctgtcacccagggtggagtgcagtggcgcagtcttggctcactgcaagctccgcctggcgggttcatg

SEQ ID NO: 44318 - DNA, 201 bp, Homo sapiens
ggaactggaggcactccccatccccagcagtaccacctggctctgcttcagtttcctcggatggaggatgtgactacacttcctccaggcagctctgccasgctcagctcctcctcctcatcctcagctgaggcagatgaaagccaagtgccatctcccacctgggagcggggtcggccacaggcctggtgctgggcagtg

SEQ ID NO: 44319 - DNA, 201 bp, Homo sapiens
atgaaacctgcagtcataattgataaaaatgaaggacaggtttgtactgcaaagtagaattatgcttaatcttgattactgggctcagaatgtgtatactktcattttgatttacatttatagacttccttattgaaggaatggagcatgtatatacctggcctgcagtgtttatcttatcccattcacacagcaatttgt

SEQ ID NO: 44320 - DNA, 201 bp, Homo sapiens
atcggccgggtgcggtggctcacgcctgtaagtcccagtactttgagaggccaaggcgggcggatcacaaggtcaggagatcgggaccatcctggctaacrtggtgaaaccccgtctctactaaaaatacaaaaaattagccgggcgtggtggcgggcacctgtagtcccagctattcgggaggctgaggcaggagaactg

SEQ ID NO: 44321 - DNA, 201 bp, Homo sapiens
ggggtttcgccacattgcccaggctggtctcgaactcctggcctcaagtgatctgcccacctcagcctcccaaagcgccagaattacaggtgtgagccccygcacccagctagaaaatccactaatgttagttgctacattaatatattaaagaagagccatatgatcatggcttagtagatcatggatcagtagatttcc

SEQ ID NO: 44322 - DNA, 201 bp, Homo sapiens
gcaagatggaaggtgcctggcacacagatgccttgggccactgctcccctacttttctgcctaggagccccctggtttctcctgatgctgaaactcccacrgtccttctctctcccactagaccccacagagagctacagcccagatccagcctatcctggaggtccagcgaacccttctttggccctcactgtcacttgg

SEQ ID NO: 44323 - DNA, 201 bp, Homo sapiens
ttgtggcttagtcatgttgcatgtattttttttttcctactcttcagcctacaaattttattttacacacctttattgcttttttggtgggataattgttaaaaaaaaaagataaactgtgtctaaagtttcctcttttgataagcctaatacaaacccatttggattgtacactgaacttctagaaagaaggaaagagca

SEQ ID NO: 44324 - DNA, 201 bp, Homo sapiens
tggagcccatgacactgtcctgtctgcagacaatcgggttcaaccaggtgattctggacacagcaatctaacctctgccccacgcagggtcaggagtcacmgaagccacaacccaaaccaacccccactaacaactacagagctgaatgaaaagtctcctgaaactcgtgtgtaccctacaattctgactgtatctcagtg

SEQ ID NO: 44325 - DNA, 201 bp, Homo sapiens
cagggtgggcctggccatgcaccctgcttacctcctttggagcccatgacactgtcctgtctgcagacaatcgggttcaaccaggtgattctggacacagsaatctaacctctgccccacgcagggtcaggagtcaccgaagccacaacccaaaccaacccccactaacaactacagagctgaatgaaaagtctcctgaaa

SEQ ID NO: 44326 - DNA, 201 bp, Homo sapiens
cctggtacttagtagtgtgtgtcgaattgagctttccctagatctgtatgtggatttgaaaaccattgaaatagatcctttgaattttcagactgagggckcctgaaggcaaggagcttgtttaatttagcttttgctttccctgtgaccagcactgtctgtgatgttcaggagatgccatctgtatctcttactctctct

SEQ ID NO: 44327 - DNA, 201 bp, Homo sapiens
gacatgataaagtcttctcattgccagagatttgccattatcacagacagcagggaaggcaggaagctgaatcccattgtaaaccagaggatctccagtgrgggggcccccagctgcccagggtgggcctggccatgcaccctgcttacctcctttggagcccatgacactgtcctgtctgcagacaatcgggttcaacca

SEQ ID NO: 44328 - DNA, 201 bp, Homo sapiens
tctgaaattcgcatcagtcaacacccaggtcacagcttcctttatcctctcttggagaggatcagggaaagggttgagagagccctgccttctcagagggyggccgagcgggctgccccatctgccatggaggcaggtacaggctcatggcgtggcgtccacagctcctaccatatccttcttgcttctctgcagagaatc

SEQ ID NO: 44329 - DNA, 201 bp, Homo sapiens
agggtcttacctgcaaggcctgcaccagtgtctgtgtgacccaactccacagcacctgccacaggcccttgggagtttccttgtgcttggctcagcagcakactggggtagtgcaagcatctgaacagaccttgccaagtccagcccagggtgagccccaggctccttgccacaggccaccacccgtctctctgggggctt

SEQ ID NO: 44330 - DNA, 201 bp, Homo sapiens
ttcatacgatggaatagtagttggcaatagaaaggattgaagcactcatacctggtacaacatggatgaactctgaaaacatgctaagtggaagaagccaracacaagagaccatgtgcttcatgattttacttatgtgaaatgtcttcaataggcaaatctttttgttttttgttttttgtgagactgaatctcactctc

SEQ ID NO: 44331 - DNA, 201 bp, Homo sapiens
cttaagaccaagagttagaggctgcagtgatctatgatggtgccactgcactgcagcctgggtgacagagtgagaccctgtctgaaaaaaaaaaaaaaaaagccaggcttagtggctcacacctgtattcctagcactttgggaggctgaggcaggtggattacttgagcccagaagtttgagatcagcctgggtgacata

SEQ ID NO: 44332 - DNA, 201 bp, Homo sapiens
ctcagtctcccaaagtgctaggattacaggtgtgagccactgtgcccagctgagcatctcctttttacaagtctgtcctgggtgccttgcatggggatctrttgatccctcacagctccctgctgtggtgcagagtggcaccctgttttccacgttgggaggcgagatgacaaagcaggatagtatcagcaggaagcacat

SEQ ID NO: 44333 - DNA, 201 bp, Homo sapiens
atctcccgacctcaggtgatccacccacctcagtctcccaaagtgctaggattacaggtgtgagccactgtgcccagctgagcatctcctttttacaagtytgtcctgggtgccttgcatggggatctgttgatccctcacagctccctgctgtggtgcagagtggcaccctgttttccacgttgggaggcgagatgacaa

SEQ ID NO: 44334 - DNA, 201 bp, Homo sapiens
gaggcatagtttcaccctgtctcccaggctggagtgcagtggcgcgatctcggctcaccccaacctctgcctcccaggttcaagcgattcttctgtctcascctcctgagtagctgggattacaggcatgtgccaccacacccagctaatttttgtattttttgtagagacagggtttctccatgttggccaggctggtct

SEQ ID NO: 44335 - DNA, 201 bp, Homo sapiens
ttgaacccgggaggcggagattgcagtgagccaagatcgcgccattgcactccagcctgggcaacaagagggaaacactgtctcaaaaaaaaaaaaaaaaagattgtttgggttattcaggatcccgtgagattctatatgaatttagggtggatttttctatttcttcaaaatacatcattggcattttgatggggactg

SEQ ID NO: 44336 - DNA, 201 bp, Homo sapiens
gagccacacagccatgttgtatccagccgggtcgcctcctctgaccttgggagtcacagcagagcaggcagggcagtgaaggtggaggggtgcggtggggyccaccctggtggcaccgtgcccaccacagccccgctgacctgcagagctggatggccttgctgcgcagggagattggccacttccacgaaaagaaagacc

SEQ ID NO: 44337 - DNA, 201 bp, Homo sapiens
tcattcctgcccatttcacccatgaaaagatcctaatttccacatagcttgtttattataaaatcattagattgtcattacaaataaaattatgaaaatayagaaaatcgtaaacaaagttaggttttataaataatttagtatttcttatacattttttccctatgtccactatacgtatttttaaacatgctgtagtca

SEQ ID NO: 44338 - DNA, 201 bp, Homo sapiens
cctggtggcaccgtgcccaccacagccccgctgacctgcagagctggatggccttgctgcgcagggagattggccacttccacgaaaagaaagacctgccsttggacaccaggtgagcccgggcccagggcataccgggcagtgagggtccctggggcgcctgggcctgacccgggtgtccgcctcccagccccgggcttg

SEQ ID NO: 44339 - DNA, 201 bp, Homo sapiens
ctttgggcttccctaaatgactgcccagttacacctaacctctgctgccttccctggagagactgcaataggtgagtgcacagatggcttcagtagctgcraggttcccaggtgcgatttacctgagggtggagataggtcagaggagaagagggagtcattcctgcccatttcacccatgaaaagatcctaatttccaca

SEQ ID NO: 44340 - DNA, 201 bp, Homo sapiens
acgaaaagaaagacctgcccttggacaccaggtgagcccgggcccagggcataccgggcagtgagggtccctggggcgcctgggcctgacccgggtgtccrcctcccagccccgggcttggcatagaattccgtccttaaaggtttcctggaggtgccagctgggctgcgtctctctgctcctgtctacagataaacacag

SEQ ID NO: 44341 - DNA, 201 bp, Homo sapiens
aaggagatatagtagatcgtggaagcactaatctgggagtgaatcaggccggcttcaccttacactctgcaatttatgctgcacgcccggacgtgaagtgygtcgtgcacattcacaccccagcaggggctgcggtgagtggctgccctggtagcatctcaaggtctaaagctgctgagtgaaaggcactgcacgtttcct

SEQ ID NO: 44342 - DNA, 201 bp, Homo sapiens
catccttgtattcctgggataaatcccacatggtcttggtgtagaatcccttttatatgttgcaggattcagttggccagtattttgttgaggatgtttawgtctatacccataagggatattggtttgtagttttattgtgatgtctttgtctggttttggtattgggataatgctgctctcatagaatgagttccctcc

SEQ ID NO: 44343 - DNA, 201 bp, Homo sapiens
agctggattctgtgtgaagaatggaaaccagtcacggaagagcaaggctggcagagaagaagtgggagaaaaactacttcacgggctgcagtgtggcagawccctggcgccactggagtccatgtcttaaggagttttgtctcctgaggggcagaaacagccttaggagaacagctttgatgttttgaagtagcctcaatc

SEQ ID NO: 44344 - DNA, 201 bp, Homo sapiens
tagtgtatatttcaataacattaattatattcatagtgtttataaccattaccaccatgtactttaaaattttttcctcacccgaaacagtaactctacccattaaacagtaactctccattgtccccttcttttttccccatagcctttgaaagtctgtaatgggcagtttccttcccttgactccccaccattttttgt

SEQ ID NO: 44345 - DNA, 201 bp, Homo sapiens
gctaatgtacagatacgcatttaacaattcataaaaattttgctactgattacatacaaacaccccttaaagcttctgcatcctatgaaatacatatggtacaattcacccacttaaaatgtacaattcaatgacttttgatatattacattttttaaaaattatggtaaagtatatataacataaagcttaccattttaa

SEQ ID NO: 44346 - DNA, 201 bp, Homo sapiens
accagcacgttccctgagcagcactgacgacgccaggacacgccatgcctttgtgctctgcagctgactcccttgtcagcctgagactaattcaagataawtcagatttgcattgctaatgtacagatacgcatttaacaattcataaaaattttgctactgattacatacaaacaccccttaaagcttctgcatcctatg

SEQ ID NO: 44347 - DNA, 201 bp, Homo sapiens
gcatcggaagagaattcacagtggtgaatctggaatgtggagtaggctttgtccctggttatgacgttcagattcatcaaaagcacttttcatgagaagayatgcatcttgggagaggggctctgaaaacaagattccagggaatctaccttaaaaaaaatattttactggtaagccagtgagttccgtcagcctgtcaga

SEQ ID NO: 44348 - DNA, 201 bp, Homo sapiens
tcactggtgtgctctctccaaatgtgtttataggtgtttactttcaatcattataatcattataatttgttctctcagcccccataccaactagggttatyaggtgacataacagtgaaatctttgtgtcgttcatttgctaaggtctccatcaactcagcttggctatattgtaaacaggagcagacctctaaacccagt

SEQ ID NO: 44349 - DNA, 201 bp, Homo sapiens
tcaccatgttggccaggctggtctcgaactcctgacctcaggtgatctgcccgcctcggcctcccaaagttttgggattatgggcgtgagccagcgcaccyggccaacatatttcttaagaagagtgggtcactcacacctctccagatctctctgtaaaagcagtgggagtctcatctgcattcagtctgttgtcatagg

SEQ ID NO: 44350 - DNA, 201 bp, Homo sapiens
tctaaaaatagtcatccattatcttctgtagccacagttccattgtcacatccatgaagactgacggtaatagtaatttcttaccgactaatgccagccartctctttttatggttgggttattccaatcaggacccaaaaatcttcacaaattcatagccacattattacactgccatccagtgatctatgcagcaccag

SEQ ID NO: 44351 - DNA, 201 bp, Homo sapiens
ttggtagctgtcagccagctgccacatgagctggagtgtgaataaatgttggtgtggtatgaacagcccaagcctggaagttactttacagtggtccaggrttgctggtaaagtcaggcagcatgcagatcacctctggaaaccttcaatctgacctcagagaattcgaatagataaaatccccccaaatgagcagctcac

SEQ ID NO: 44352 - DNA, 201 bp, Homo sapiens
agcttcccagagacttggtagctgtcagccagctgccacatgagctggagtgtgaataaatgttggtgtggtatgaacagcccaagcctggaagttacttyacagtggtccaggattgctggtaaagtcaggcagcatgcagatcacctctggaaaccttcaatctgacctcagagaattcgaatagataaaatcccccca

SEQ ID NO: 44353 - DNA, 201 bp, Homo sapiens
ttctctttggcagcttgtatgtgcaggtcatgttaggtcattcaacatcttcagatcagctaaatatgtaaaacccaagaaacaagaaagagcctatgttytatgtggtgtgttcagttagagaaaaacctttgagagaagttacaaatattgtaatcttgagtttgaatagtttctagttagggtaatttgaagtcctct

SEQ ID NO: 44354 - DNA, 201 bp, Homo sapiens
ctgggctttccagatggtggttttccatcagtcatgactttgacttccagcattaactggtctttatgtggctgcatcctgctcccatggcgactctgctragtgacccagattagatgtggtcattggttcagtcctctctgtgatgttcagtgcatgaccagatgtgagataaactgaatagattggatgctatgtcac

SEQ ID NO: 44355 - DNA, 201 bp, Homo sapiens
gaattgcttgaacctgggaggtggaggttgcagtgagccgagatggggccgctgcactccagcctgggcaacaagagcaaaactccgtctcaaaaaaaagrtgaaatcttttaaagtgtatggctgagatggcatgaaagggagtaagtcgtagtggtgaaaaaccaattgaaagctggaatcctgagaaatacatgggct

SEQ ID NO: 44356 - DNA, 201 bp, Homo sapiens
agaccagcctggccaacgtgatgaaaccccgtctctactaaaaatgcaaaaaattagcctggcgtggtggcacgcgcctataatcccagctacttgggagrctgaggcaggagaattgcttgaacctgggaggtggaggttgcagtgagccgagatggggccgctgcactccagcctgggcaacaagagcaaaactccgtc

SEQ ID NO: 44357 - DNA, 201 bp, Homo sapiens
aatatggtatgtaggtgaaaggatttactatgtaaaatccaggagctgtagtttaatacattttacaactcatttctgttagagtgatgaactcaaactgstttctcctggtgatgggttatggacgaatttttattattacatcagtggttttaggtttccatctagaggctcctggattaaaatacaattaaatttaac

SEQ ID NO: 44358 - DNA, 201 bp, Homo sapiens
tggttatttccttaaatttataaaatacagaaatagacaaaaaaaaaaaagagatctaagtccgacatgctaagagaacagtgacgtgggtgtccagtctrcttctaagtttggttgtctctgtcaaaatttgaccttctgtggctttattttaatagatgaaatgcattctgtttcagaggacagttttttatactagta

SEQ ID NO: 44359 - DNA, 201 bp, Homo sapiens
tctttttatataacttaaaaaaaaatctgtttgcaaaagtatcacatggttatttccttaaatttataaaatacagaaatagacaaaaaaaaaaaagagayctaagtccgacatgctaagagaacagtgacgtgggtgtccagtctgcttctaagtttggttgtctctgtcaaaatttgaccttctgtggctttattttaa

SEQ ID NO: 44360 - DNA, 201 bp, Homo sapiens
aaagaaagacctgcccttggacaccaggtgagcccgggcccagggcataccgggcagtgagggtccctggggcgcctgggcctgacccgggtgtccgcctyccagccccgggcttggcatagaattccgtccttaaaggtttcctggaggtgccagctgggctgcgtctctctgctcctgtctacagataaacacagatac

SEQ ID NO: 44361 - DNA, 201 bp, Homo sapiens
agacctacaacagcgagaggacagaaagccaggcttgggagcggggcgggaaggtccgtgtgaaagctgcccgaggaggactcacccgctaatatgactgwcttattttaggttgttcaaggctacaagcccccggggagagccccaggatggactctactgcatccggaactcctctaccaagtcggggaaggtaggcgc

SEQ ID NO: 44362 - DNA, 201 bp, Homo sapiens
atcatgtgtggtgctctccattcctttgtgtagatccacattttcatttggtattattttccctgtctcaagaactgcctttaacatttcctgtaggccarggtagcttctgtttgaaatcttttttgcctttgttttaaaaagatatttctgtttggaatttgaggttgttggtcatttctttcgtggcctctccagttt

SEQ ID NO: 44363 - DNA, 201 bp, Homo sapiens
gctggcagcccctgtcatgagcctggggaaggctctctagcaccctgcatcaccctgtgggcaccctcagctctgagacctgagccctgagcccctgttcscaaggagcagagtccttctcagggcctcttctagaaggagccttggtgccgatggaagggtaactgagcgggaggaggaacctagggttgtgttgtgttc

SEQ ID NO: 44364 - DNA, 201 bp, Homo sapiens
gagtgggaatagtgcaatactcaagacttaggtgaattcctttctggaagtctctcttgtgactgtatttcttttcctcatgctgtgggggtcagggggaygcaatgattatggagctggcagcccctgtcatgagcctggggaaggctctctagcaccctgcatcaccctgtgggcaccctcagctctgagacctgagcc

SEQ ID NO: 44365 - DNA, 201 bp, Homo sapiens
gtcggggaaggtaggcgccaggggaagatgccccagggcccctctggctctccacacacccaggctgtgggtgggcccaggactccacagttcctaaaccrctccccttgtggactcttacttggtgtctcagctgaattctcttcccagcagcaccccccaatctattccctaatagatctccatctgcaaattgggggc

SEQ ID NO: 44366 - DNA, 201 bp, Homo sapiens
acatgctgtagtcatatctttagttaccatgagcatatttccatttcaaaatatatatgtgtatatatacatgaatgtgtgtgtgtgtgtgtgtgtgtgtkaatgggtagacataattataaaattggtaacaagtatctggttaccaagtactgattctcctagatgtgccatgatgcatttggtagcttctagtgtttt

SEQ ID NO: 44367 - DNA, 201 bp, Homo sapiens; identical to SEQ ID NO: 11593

SEQ ID NO: 44368 - DNA, 201 bp, Homo sapiens; identical to SEQ ID NO: 11594

SEQ ID NO: 44369 - DNA, 201 bp, Homo sapiens; identical to SEQ ID NO: 11595

SEQ ID NO: 44370 - DNA, 201 bp, Homo sapiens
gacattctcccagtttacaagtactcatgcttgccagattaggaaagatacaaagtaaaattcttctgtgaagcatctcactatagctctaattccacttygctgcagccaaataatataccctgggtacaaagtgatcagcactgttcatctttcactgtaatagtttagaaattattttcacacttctttttttaacac

SEQ ID NO: 44371 - DNA, 201 bp, Homo sapiens; identical to SEQ ID NO: 11596

SEQ ID NO: 44372 - DNA, 201 bp, Homo sapiens; identical to SEQ ID NO: 11597

SEQ ID NO: 44373 - DNA, 201 bp, Homo sapiens; identical to SEQ ID NO: 11598

SEQ ID NO: 44374 - DNA, 201 bp, Homo sapiens; identical to SEQ ID NO: 11599

SEQ ID NO: 44375 - DNA, 201 bp, Homo sapiens; identical to SEQ ID NO: 11600

SEQ ID NO: 44376 - DNA, 201 bp, Homo sapiens
cttttcctcttaggttttattctcttgaataatgtcgtccatatttaatacaacagtttaatttttaaactaaataaatccacacttgaattacccatttygattttagtacaagttgagtttagaatattcatgatcatgtatgtaagaaaagaagcagatgaatttttgttatcactgacaagtcaattcaaacaattg

SEQ ID NO: 44377 - DNA, 201 bp, Homo sapiens
gccactctttgaccggttgctcattttctggtctgaccggcggaacccccacgaggtgaagccagcctatgccaccaggtatgacctgtacttctggagamgcacccaggtgctccccctgtgacaatgtcctgtcagagcctcagagtgactagggagcgacgaagtattgagagggggcctaggtgggagcagaaccgg

SEQ ID NO: 44378 - DNA, 201 bp, Homo sapiens
gagcctcaggaactccgggtccccatagcgatagcggttcccgaagacaagaacagataacattggatacagcattatccagtagccgcacggggtcaaayggggctcctgggggtaggaacaggacggtggtcataacgcgtggtcctgcccccagccagccccatgggcttactggctttcttccacccaaataccttc

SEQ ID NO: 44379 - DNA, 201 bp, Homo sapiens
gcccttccgctctcccggccaggccgaagcaatggtggcttgaaattcgtctagcagacaagccgcctcctccaggacgcgcgcctcgacggtccgcgtayccaacccgaacttcttaagcgctccaagtgcaaaattgcgcagtgtccaccagcacggccggttagaaaacaagattcctgtggtggggacgggaaagga

SEQ ID NO: 44380 - DNA, 201 bp, Homo sapiens
aagttgtcactgaagaggttcaggagcctcaggaactccgggtccccatagcgatagcggttcccgaagacaagaacagataacattggatacagcattayccagtagccgcacggggtcaaacggggctcctgggggtaggaacaggacggtggtcataacgcgtggtcctgcccccagccagccccatgggcttactgg

SEQ ID NO: 44381 - DNA, 201 bp, Homo sapiens
tacctggaaatgagatagagaccggctggacagaccccggggaccctgcaggtcaccacacccttctctttcagctcacctgttctccaggaccagccctrctggggcccaggcccaggctctgagaggccgtgtcctaacctgccctggccccggagaagctacgttgccacctgtcccccttccctggcctggtggggc

SEQ ID NO: 44382 - DNA, 201 bp, Homo sapiens
gaactaatgatgcagaagttgtcactgaagaggttcaggagcctcaggaactccgggtccccatagcgatagcggttcccgaagacaagaacagataacaytggatacagcattatccagtagccgcacggggtcaaacggggctcctgggggtaggaacaggacggtggtcataacgcgtggtcctgcccccagccagcc

SEQ ID NO: 44383 - DNA, 201 bp, Homo sapiens
catctggaactaatgatgcagaagttgtcactgaagaggttcaggagcctcaggaactccgggtccccatagcgatagcggttcccgaagacaagaacagrtaacattggatacagcattatccagtagccgcacggggtcaaacggggctcctgggggtaggaacaggacggtggtcataacgcgtggtcctgcccccag

SEQ ID NO: 44384 - DNA, 201 bp, Homo sapiens
ccggctggacagaccccggggaccctgcaggtcaccacacccttctctttcagctcacctgttctccaggaccagccctgctggggcccaggcccaggctytgagaggccgtgtcctaacctgccctggccccggagaagctacgttgccacctgtcccccttccctggcctggtggggcctggctttggggcaagactga

SEQ ID NO: 44385 - DNA, 201 bp, Homo sapiens
tgggggcctggccttgagtccaaggcttggtgtcctttggacaaggccctgtggggagtgcccactgctcaacacagtgatgcctggctggctgatggcaygggcagtgttgtgccctgcaggcgtgaggctgagctcctgatgtcctctgcctcctcctgcagatcccatcttgggttctgcttctgtgtggctttcctc

SEQ ID NO: 44386 - DNA, 201 bp, Homo sapiens; identical to SEQ ID NO: 11639

SEQ ID NO: 44387 - DNA, 201 bp, Homo sapiens; identical to SEQ ID NO: 11611

SEQ ID NO: 44388 - DNA, 201 bp, Homo sapiens
ctttggggcaagactgagccacgggggaagggggaatcccgtacctgctgctgcttcctctgtcttggctaacgtctgtccccctgaacccctaaccataycccaagagctcccaaagcctgagaccagggtcatttgtccccaactccccatctggccctgctgttgctagtacctgttatttattacctggaggcctgt

SEQ ID NO: 44389 - DNA, 201 bp, Homo sapiens
atatggtagctggaattgcagaaaactaatgtccaaccaccctggtctccaggtacgccatcactgtctggtattttgatgccaaggagcgggcagcagcyaaagacaagtatcagctaggtacctgcttccctcccttcagtccttcctattctgtgggccctcttgggcctgatgccaccccatccccctcatcagcct

SEQ ID NO: 44390 - DNA, 201 bp, Homo sapiens
cctcaggtgatccgcctgcctcggcctcccgaggtgttgagactacaggccactgcgcctggctcaaatacacttctaaagacacccctggcattcctgtsctctgtgcctgtgattcctaggagctcacacctgagcccttgtcacttccattactcttaggaccctgtgtactatgcttgttccccagatctgccttca

SEQ ID NO: 44391 - DNA, 201 bp, Homo sapiens
aaggccatgaaccaggctgtcgaagcattggtgccctcatggcccatgtggacgccgtcatccgccactgcgcagggcggctgggcagctatgtcatcaaygggcgcaccaaggtaaggctaggtgggggcctctttggaggggctttgcagcaccctggtttgcagcattcagtgctctgagcacagtgggtttggagac

SEQ ID NO: 44392 - DNA, 201 bp, Homo sapiens; identical to SEQ ID NO: 11601

SEQ ID NO: 44393 - DNA, 201 bp, Homo sapiens
ccaggaccctccagccatccccagactgcagcctcccattctgggtctctccgggttgcacacctgccacctctaggtacttaagcagaatgaggagcccrtagcacagggtggtgctcgtggtttcggtgacgccaaaaaaaaaatgcgtcgtcattaccgacgtctactcctggaaatggctctccgggtcctgctgtt

SEQ ID NO: 44394 - DNA, 201 bp, Homo sapiens
caggaactccgggtccccatagcgatagcggttcccgaagacaagaacagataacattggatacagcattatccagtagccgcacggggtcaaacggggcycctgggggtaggaacaggacggtggtcataacgcgtggtcctgcccccagccagccccatgggcttactggctttcttccacccaaataccttccagtgg

SEQ ID NO: 44395 - DNA, 201 bp, Homo sapiens
ggaagtctggggggacactgcccaggccagtgcactgcaggtgaggttgatggtgccagggcgtaccacagggagcaggcagaacctctgtaaggtggccrtaaggaataggaagatacccgagtgggccaggcctgtgcccaggcacatctgctttgccgggtacacaggtgcacagtgagcaccaggtaccccagagcc

SEQ ID NO: 44396 - DNA, 201 bp, Homo sapiens
gtccatccctgtttgctggcccatgtttctagtccatccatcctgtctccaaggcaggagaagcagaagggggagggtggctgtgatgagtgagccctggsctgagggaaggaaaggggtgctgcccgctgggccgagtgcttggccctggactgcattgtgccctgggtccccactgtggcatctgcatcgaggacagtc

SEQ ID NO: 44397 - DNA, 201 bp, Homo sapiens
tccatccctgtttgctggcccatgtttctagtccatccatcctgtctccaaggcaggagaagcagaagggggagggtggctgtgatgagtgagccctgggstgagggaaggaaaggggtgctgcccgctgggccgagtgcttggccctggactgcattgtgccctgggtccccactgtggcatctgcatcgaggacagtct

SEQ ID NO: 44398 - DNA, 201 bp, Homo sapiens; identical to SEQ ID NO: 11605

SEQ ID NO: 44399 - DNA, 201 bp, Homo sapiens; identical to SEQ ID NO: 11608

SEQ ID NO: 44400 - DNA, 201 bp, Homo sapiens; identical to SEQ ID NO: 11640

SEQ ID NO: 44401 - DNA, 201 bp, Homo sapiens
tcaagtctgtcctggtcgtcttccccactcctgcccataccatcccggctttcccctgcctgcctgtctctagtttctctcacatccctttttttttttcytttctctagccaccctgaagggtcccttcccaagcccttagggaccgcagaggacttggggaccagcaagcaacccccagggcacgagaagagctcttgc

SEQ ID NO: 44402 - DNA, 201 bp, Homo sapiens; identical to SEQ ID NO: 11602

SEQ ID NO: 44403 - DNA, 201 bp, Homo sapiens
tgaacagaggtctctggttttcctaggcagaggaccctgcggccttctgcgtgtttgtgtccctgggtacttgagattagggagtggtgatgactcttaaygagcatgctgccttcaagcatcgccacagtggttcttgactttgccaggaaccctcttaaactcatgagagctgctgacattcacagcgtggaccttggt

SEQ ID NO: 44404 - DNA, 201 bp, Homo sapiens
ggtcaccacacccttctctttcagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacct

SEQ ID NO: 44405 - DNA, 201 bp, Homo sapiens
acggaatacgaaaaccaggttacatccccagtgagtctggcagtttggggaggggagagtaggagaagatctcttgtgttttggtgcctctggtgcccacyttctatgtggttggggacagggccccagcgaggattggggaaggggcgtgtttggacttttttagccctaggtgaccttgattgtcctagggaagtaagg

SEQ ID NO: 44406 - DNA, 201 bp, Homo sapiens; identical to SEQ ID NO: 11633

SEQ ID NO: 44407 - DNA, 201 bp, Homo sapiens
agcagaaccgggtggctcaaaaggatggccgcctagtgtgtgtggatatggtagctggaattgcagaaaactaatgtccaaccaccctggtctccaggtaygccatcactgtctggtattttgatgccaaggagcgggcagcagccaaagacaagtatcagctaggtacctgcttccctcccttcagtccttcctattctg

SEQ ID NO: 44408 - DNA, 201 bp, Homo sapiens
cccgctccgccccgggtcctccctcccagcttccctccggtctatttttctgtctctgggcccctcgttctctttgtttttggactccccagtttcctctgtcttttgacccccccgcccccaccctgactctccctggaacccccacgtttctcgttgtctttctggaacgccgaggcaggtccctcctattttccaaac

SEQ ID NO: 44409 - DNA, 201 bp, Homo sapiens
gggcctctatagtcaagtctgtcctggtcgtcttccccactcctgcccataccatcccggctttcccctgcctgcctgtctctagtttctctcacatccctttttttttttcctttctctagccaccctgaagggtcccttcccaagcccttagggaccgcagaggacttggggaccagcaagcaacccccagggcacgag

SEQ ID NO: 44410 - DNA, 201 bp, Homo sapiens; identical to SEQ ID NO: 11635

SEQ ID NO: 44411 - DNA, 201 bp, Homo sapiens; identical to SEQ ID NO: 11636

SEQ ID NO: 44412 - DNA, 201 bp, Homo sapiens; identical to SEQ ID NO: 11612

SEQ ID NO: 44413 - DNA, 201 bp, Homo sapiens
cagactccgtctcaaacaacaacaacaaaaagcctaagggaaggcagagctgccttcctgctccaggggtaactgattgtgttttggtctgcacagcgcamacctgctgattctggctgatctcatgcacccgggtcccgcacgggatccccagactcagtgggtacctttgggcagacagtggctgtgcaggtgggtgtc

SEQ ID NO: 44414 - DNA, 201 bp, Homo sapiens
caatgaaatcgcggggctccgctggctgccgcatctgccagtgtcgttgaatttgctcagagatgacccgcagctccgaaaagtttcggaagattcggtgrtgcgggcccgggagccagtccatgagggacaggcaaatgtacatctggagagacagggtctgtctcaacatgggccctgcacaaggccactaggccttag

SEQ ID NO: 44415 - DNA, 201 bp, Homo sapiens
gcagaatgaggagcccatagcacagggtggtgctcgtggtttcggtgacgccaaaaaaaaaatgcgtcgtcattaccgacgtctactcctggaaatggctstccgggtcctgctgttactgtgggcagaggagatgtgctgccgcgtgccaggcacctgttggtgggcggcatggatagagtttagagagctgggacccat

SEQ ID NO: 44416 - DNA, 201 bp, Homo sapiens
aacatcaacgtcctactgttatgaatctaataaaatacaaaatctctcctatacagttttgggaacacacaaaatcgaagatggtacgttagcctctaagrctaaaggaacatttgcacaccgtgacttcagtgcagaatatgaagaagatggcaaatatgaaggacttcagtatggagcttttattgaattgaaacctta

SEQ ID NO: 44417 - DNA, 201 bp, Homo sapiens; identical to SEQ ID NO: 11653

SEQ ID NO: 44418 - DNA, 201 bp, Homo sapiens; identical to SEQ ID NO: 11654

SEQ ID NO: 44419 - DNA, 201 bp, Homo sapiens
attgcttgaacccgggaggtggaggttgcagtgagccgagatcacgccgttacactccagcccgggtgacagtgtgagactgtatcttaaaaaaaaaaaaagtatgaactctgggcatagatttaattctaacttccctgtcttgaagctgtgcgcacttggggaagttggttgatattatgtgtatctgtttctgtctgt

SEQ ID NO: 44420 - DNA, 201 bp, Homo sapiens
gtcgctatgcataaatatcctggaaaatggggtatagctgaatggtgcagattcattcattcatattcagcaaattatgttctaagcacctacttcagtaygtgaacagcactaaactcagaatattggtctgctggggtcctttattagcttccatgattccctgaacttggccaagacccttctggtcggctgcagata

SEQ ID NO: 44421 - DNA, 201 bp, Homo sapiens
tctagaaaaaagcaagtaataaggtcaagattctagtgagattttaataaagcagctcctgtgaaatgctaaggtcagctcctggcctgtggtattcaaayacttgtttagataaatggacatcaagagtggggactactaggctggcatacaacaaagaaacctgatgccattttcttgtctgattttctttctcagatt

SEQ ID NO: 44422 - DNA, 201 bp, Homo sapiens
atatttattgagaacatagtgatattttgatacatgtaatgtatggtgatcagatcagagtaattagcatacccatcatctcaaacatttatcatttcttygtgttgggaactttctgagagagtgtaggctgtgggagataagtccgtcaccttttcctcctgatgtaaccagagtggctgcagccaggtcctcagaaac

SEQ ID NO: 44423 - DNA, 201 bp, Homo sapiens; identical to SEQ ID NO: 11656

SEQ ID NO: 44424 - DNA, 201 bp, Homo sapiens; identical to SEQ ID NO: 11657

SEQ ID NO: 44425 - DNA, 201 bp, Homo sapiens; identical to SEQ ID NO: 11659

SEQ ID NO: 44426 - DNA, 201 bp, Homo sapiens; identical to SEQ ID NO: 11662

SEQ ID NO: 44427 - DNA, 201 bp, Homo sapiens
agataccaaaaaaatgacttccaatttccctgtggatctctccgattatcctaagagcttgcatatgtatgctaatagactcctggatcacagagtccctsaaacagacatgactttccggcacgtgggttccaaattaatagttgtaagtatgagtctgccagtcaataaatacatggatataagtgctaattacatcct

SEQ ID NO: 44428 - DNA, 201 bp, Homo sapiens
caaggatttttcccagacagtgtcaacaaagctttgtactgggttaatggtcaagttcctgatggtgtctctaaggtcttagtggaccactttggctatamcaaagatgataaacatgagcaggtgtgtatttgtgaagtatcttcttaaggaaagctttgggtctcaatgcaaaaacaattcttttctaagcatggaagt

SEQ ID NO: 44429 - DNA, 201 bp, Homo sapiens; identical to SEQ ID NO: 11759

SEQ ID NO: 44430 - DNA, 201 bp, Homo sapiens; identical to SEQ ID NO: 11667

SEQ ID NO: 44431 - DNA, 201 bp, Homo sapiens; identical to SEQ ID NO: 11669

SEQ ID NO: 44432 - DNA, 201 bp, Homo sapiens; identical to SEQ ID NO: 11672

SEQ ID NO: 44433 - DNA, 201 bp, Homo sapiens; identical to SEQ ID NO: 11673

SEQ ID NO: 44434 - DNA, 201 bp, Homo sapiens
gtaagaaatatcctgcctcctctcctagatactgtatattttcaatgagagttatgagtaaataattatgtatttagttgtgagtagatgtacaattactsaatgtcacaaaattttaagtaagaaaagagatacatgtataccctacacgtaaaaaccaaactgtagaaaatctagtgtcattcaagacaaacagcttta

SEQ ID NO: 44435 - DNA, 201 bp, Homo sapiens
caggcacggatgtgactgtaagtatttgtattccgtatccatcgtggatcagggaattactgagttttcacaatcatcaaaaagagagaagcattagttamccttccctagttaggttcctttaattatcattttcatgtgtttctaaaaatctcatgctttaaacttcttgagattataaaactgagatgctttgtttaa

SEQ ID NO: 44436 - DNA, 201 bp, Homo sapiens
gtggctggggaggtctcacaatcatggcggaaggtgagggacagcaagtcacatcttatgtagatggtggctggcaaagagagcttgtgcagagaaactcmtgtttttagaaccatcagatctcccgacacccatctgcaatcacgagaacagcacgggaaagacctgcccccatgattcaatcacctccccccgggtccc

SEQ ID NO: 44437 - DNA, 201 bp, Homo sapiens
caccaaactgcctctaatctcatcacttgagagtaatgactactcacctctgagaaggttccggggatggatgtagggcagcaaaaccaccttctgttctyttctgcacaaggactccttgtgccagctccaagcctctggcctttgaagaagtcccaagacctgtgttctccccctctccctcatcccatgaagtggagt

SEQ ID NO: 44438 - DNA, 201 bp, Homo sapiens; identical to SEQ ID NO: 11675

SEQ ID NO: 44439 - DNA, 201 bp, Homo sapiens
tgagaaggttccggggatggatgtagggcagcaaaaccaccttctgttcttttctgcacaaggactccttgtgccagctccaagcctctggcctttgaagragtcccaagacctgtgttctccccctctccctcatcccatgaagtggagtgacttagagtgctccagcttcttgtccttccacccccagtaccaccctga

SEQ ID NO: 44440 - DNA, 201 bp, Homo sapiens
gctttttcttttttacatttttatataaatttatgtggaacaagtgtaattttgttacatgaatagattgtgcagtagttaagtcagggctttcagggtatccatcacccagacaacatatagtgtacccactaagtaatttctcaccatccatctccctccacttccacaccttctgagtctcaattgtctatcattcca

SEQ ID NO: 44441 - DNA, 201 bp, Homo sapiens
gtctttgatccatcttgagttgatttttttatatggtgacagataggagtccagttttattcttctgcatatggcaatccatctttcccagcaccacttaytgaaaagggtgtcctttccctagtgtatgtttttgtcaattttgtcaaagatccgttgactgtaagtatgtgactttatttctgggttcagtattctgtt

SEQ ID NO: 44442 - DNA, 201 bp, Homo sapiens
attcttgatagacaacctcaatgctctgctaccctgaattctcaggttgagctggaggttccccagctctgcagcttcatcctgaagaccagccagtgcaycctgaaagaggtgtatggcttcaaccctgagggcaaagccttgctgaagaaaaccaagaactctgaggagtttgctgcagccatgtccaggtaagtcatg

SEQ ID NO: 44443 - DNA, 201 bp, Homo sapiens
tgacaaccatgtcaggctggtttcgaactcctgacctcaagtgatcctccagcctgggcctcccacagtgctggaataacaggtgtgagccactgcacctracctgaaggtccttttaagattgaaatgatacaatgattataaaagaaagtatttggcaaactataattcactatctaaatatgctataatttttattat

SEQ ID NO: 44444 - DNA, 201 bp, Homo sapiens
gtttttattaagttgtgattttttgttatctatttgttttgagaatgaagaaacaatagctctggagagatcatctttggaaaattaatattttccccccmaaaaaatacctaagaacatattgatttgaggtagctaggtaggtaaagcatgaaactcctaacctcgtgataatggaatacagcctcttttggagagttc

SEQ ID NO: 44445 - DNA, 201 bp, Homo sapiens
aggaaggaggcgcccttcattttaataagaactacagtgggagagcttctggtttcaaggaaagtgacaaattcagttttggatgtgctgtatttgatgtmctcctatgaaacaaccagtttagaaatctagctgtcaaatagacctatggatctgagcccagtaaagaggcttgggctccacatatggatttgggaatca

SEQ ID NO: 44446 - DNA, 201 bp, Homo sapiens
aaaacctcttcttaaaaaggtaaaagaagaaagcagcaaggcttcttgaaccatgcaaagtaaatgaaagattttacatagcatgatttagacattttttwaaatttttaaaggaaataatttaagcattttaaggagattaataactatagcacaaacactgtggcatctttgcattagtaaacatgagaacaccaaccc

SEQ ID NO: 44447 - DNA, 201 bp, Homo sapiens
atctttgcattagtaaacatgagaacaccaaccctgtcaggaagaatctaagaaagtcattagaggattctggtactttcaccctaagatattttattcartacaacctgttataagcaaattctccctctgactgtgaagaattcagaatggctagaggcgttattgactacaggcttgctgttaagctagagagagtca

SEQ ID NO: 44448 - DNA, 201 bp, Homo sapiens; identical to SEQ ID NO: 11679

SEQ ID NO: 44449 - DNA, 201 bp, Homo sapiens; identical to SEQ ID NO: 11678

SEQ ID NO: 44450 - DNA, 201 bp, Homo sapiens; identical to SEQ ID NO: 11683

SEQ ID NO: 44451 - DNA, 201 bp, Homo sapiens; identical to SEQ ID NO: 11685

SEQ ID NO: 44452 - DNA, 201 bp, Homo sapiens; identical to SEQ ID NO: 11686

SEQ ID NO: 44453 - DNA, 201 bp, Homo sapiens; identical to SEQ ID NO: 11687

SEQ ID NO: 44454 - DNA, 201 bp, Homo sapiens; identical to SEQ ID NO: 11688

SEQ ID NO: 44455 - DNA, 201 bp, Homo sapiens
gaacacaggcaccaatgtagataccaaaaaaatgacttccaatttccctgtggatctctccgattatcctaagagcttgcatatgtatgctaatagactcmtggatcacagagtccctcaaacagacatgactttccggcacgtgggttccaaattaatagttgtaagtatgagtctgccagtcaataaatacatggatat

SEQ ID NO: 44456 - DNA, 201 bp, Homo sapiens; identical to SEQ ID NO: 11782

SEQ ID NO: 44457 - DNA, 201 bp, Homo sapiens
catcatctaaatcataggcaagctcagccataggcagggtatatttttcagagaggactggtttctgtagtatttaaaactttaaaattcttccccacaakagaattgctagatgagatacatcaaattcctctcatgtcatttacaagctctgccagggccaaatcaagggtgacattaccagaggagaagaccaaacat

SEQ ID NO: 44458 - DNA, 201 bp, Homo sapiens; identical to SEQ ID NO: 11691

SEQ ID NO: 44459 - DNA, 201 bp, Homo sapiens; identical to SEQ ID NO: 11692

SEQ ID NO: 44460 - DNA, 201 bp, Homo sapiens
gcaccctgatgggttcttgtttcttttcttcaatgcaggtcattggaaatatgggccaaaccatggagcagttaactccagaactcaagtcttcaatcctsaaatgtgtccaaagtacaaagccatcactgatgatccagaaagctgccatccaggctctgcggaaaatggagcctaaagacaaggtaaagtccacaagaa

SEQ ID NO: 44461 - DNA, 201 bp, Homo sapiens
ctttgagccaacattggaagctctttttgggaagcaaggatttttcccagacagtgtcaacaaagctttgtactgggttaatggtcaagttcctgatggtrtctctaaggtcttagtggaccactttggctataccaaagatgataaacatgagcaggtgtgtatttgtgaagtatcttcttaaggaaagctttgggtctc

SEQ ID NO: 44462 - DNA, 201 bp, Homo sapiens
ccgtgacttcagtgcagaatatgaagaagatggcaaatatgaaggacttcagtatggagcttttattgaattgaaaccttataccttttgaaaactcattstgattttcttcatctccatacccctttcgtgatagctcatctgtttttctgctttcagggaatgggaaggaaaagcgcacctcaatatcaaaagcccagc

SEQ ID NO: 44463 - DNA, 201 bp, Homo sapiens; identical to SEQ ID NO: 11795

SEQ ID NO: 44464 - DNA, 201 bp, Homo sapiens; identical to SEQ ID NO: 11707

SEQ ID NO: 44465 - DNA, 201 bp, Homo sapiens
actaaaagtttgtcatgggcttggagaatgcgtactgatgttgggattctgggtctctgcagggtgggctccaacttgccttttttgctatttcttctttycctatctgtcatttcctgactcttcttctctctcctcttctttctcttccccccactcctcttccagttttcagtcctaggaaggctttaattttaagtg

SEQ ID NO: 44466 - DNA, 201 bp, Homo sapiens
agctagattccttctgctttttctttcacgatccccaccccatccctcccaagtacccaaggatgttgcccgtgttgaatacatgtggttgcatcttcttyctccataggataccgtgtatggaaactgctccactcactttaccgtcaagacgaggaagggcaatgtggcaacagaaatatccactgaaagagacctggg

SEQ ID NO: 44467 - DNA, 201 bp, Homo sapiens
tgctggtctcttttacgaatttcaggtttcactgtgagacagaattcatttcacctcagtcccatgagcacttttgtgtgttctaatttctctacgacacyataatgggagaagacaccgatgcaacctgcggaggcctttctgcagacccacctttaactggttttctctctcccaacttgggctggccaggcactagca

SEQ ID NO: 44468 - DNA, 201 bp, Homo sapiens; identical to SEQ ID NO: 11716

SEQ ID NO: 44469 - DNA, 201 bp, Homo sapiens
ctactgttatgaatctaataaaatacaaaatctctcctatacagttttgggaacacacaaaatcgaagatggtacgttagcctctaagactaaaggaacayttgcacaccgtgacttcagtgcagaatatgaagaagatggcaaatatgaaggacttcagtatggagcttttattgaattgaaaccttataccttttgaaa

SEQ ID NO: 44470 - DNA, 201 bp, Homo sapiens; identical to SEQ ID NO: 11720

SEQ ID NO: 44471 - DNA, 201 bp, Homo sapiens
aatacatgtggttgcatcttcttcctccataggataccgtgtatggaaactgctccactcactttaccgtcaagacgaggaagggcaatgtggcaacagawatatccactgaaagagacctggggcagtgtgatcgcttcaagcccatccgcacaggcatcagcccacttgctctcatcaaaggcatggtaagtcccatgt

SEQ ID NO: 44472 - DNA, 201 bp, Homo sapiens; identical to SEQ ID NO: 11721

SEQ ID NO: 44473 - DNA, 201 bp, Homo sapiens; identical to SEQ ID NO: 11726

SEQ ID NO: 44474 - DNA, 201 bp, Homo sapiens; identical to SEQ ID NO: 11728

SEQ ID NO: 44475 - DNA, 201 bp, Homo sapiens; identical to SEQ ID NO: 11730

SEQ ID NO: 44476 - DNA, 201 bp, Homo sapiens; identical to SEQ ID NO: 11740

SEQ ID NO: 44477 - DNA, 201 bp, Homo sapiens
ggaattgtcattccttcctttcaagcactgactgcacgctttgaggtagactctcccgtgtataatgccacttggagtgccagtttgaaaaacaaagcagrttatgttgaaacagtcctggattccacatgcagctcaaccgtacagttcctagaatatgaactaaatggtaagaaatatcctgcctcctctcctagatac

SEQ ID NO: 44478 - DNA, 201 bp, Homo sapiens; identical to SEQ ID NO: 11743

SEQ ID NO: 44479 - DNA, 201 bp, Homo sapiens
ggcacggatgtgactgtaagtatttgtattccgtatccatcgtggatcagggaattactgagttttcacaatcatcaaaaagagagaagcattagttaccyttccctagttaggttcctttaattatcattttcatgtgtttctaaaaatctcatgctttaaacttcttgagattataaaactgagatgctttgtttaaac

SEQ ID NO: 44480 - DNA, 201 bp, Homo sapiens
aattcaacaggcattccacaggctttttctgggaacccttacttgatagtgctctaggaaacactggcaagaagattcaataccagcatttgaagaacgaytacagagaaattagacctgtgcttaagaaagagctagcagacaatgccagtgtttgccaggcatgttctgtgttctgaccacaggacagtgataaccatc

SEQ ID NO: 44481 - DNA, 201 bp, Homo sapiens; identical to SEQ ID NO: 11655

SEQ ID NO: 44482 - DNA, 201 bp, Homo sapiens; identical to SEQ ID NO: 11658

SEQ ID NO: 44483 - DNA, 201 bp, Homo sapiens; identical to SEQ ID NO: 11660

SEQ ID NO: 44484 - DNA, 201 bp, Homo sapiens; identical to SEQ ID NO: 11661

SEQ ID NO: 44485 - DNA, 201 bp, Homo sapiens
tatggagcttttattgaattgaaaccttataccttttgaaaactcattgtgattttcttcatctccatacccctttcgtgatagctcatctgtttttctgytttcagggaatgggaaggaaaagcgcacctcaatatcaaaagcccagcgttcaccgatctccatctgcgctaccagaaagacaagaaaggcatctccacc

SEQ ID NO: 44486 - DNA, 201 bp, Homo sapiens; identical to SEQ ID NO: 11663

SEQ ID NO: 44487 - DNA, 201 bp, Homo sapiens
tgtcactgggtaaacaggccaccctgggcacagttccatctacaatgtttgaagtttactttccagcttctgggcatcatttgcaattataatgctgtcayaggcagaaacgagataggctaattaatcgttgtcaatactgatccctatttgccagatgagattttggagcagcatggctgggaataattggtatagact

SEQ ID NO: 44488 - DNA, 201 bp, Homo sapiens; identical to SEQ ID NO: 11668

SEQ ID NO: 44489 - DNA, 201 bp, Homo sapiens
cccgggaggcgccctttggaccttttgcaatcctggcgctcttgcagcctgggcttcctataaatggggtgcgggcgccggccgcgcattcccaccgggasctgcggggctgagtgcccttctcggttgctgccgctgaggagcccgcccagccagccagggccgcgaggccgaggccaggccgcagcccaggagccgccc

SEQ ID NO: 44490 - DNA, 201 bp, Homo sapiens
gcatgttctgtgttctgaccacaggacagtgataaccatctcctcttttgactgcaggaccaggaggttcttcttcagactttccttgatgatgcttctcygggagataagcgactggctgcctatcttatgttgatgaggagtccttcacaggcagatattaacaaaattgtccaaattctaccatgggaacagaatgag

SEQ ID NO: 44491 - DNA, 201 bp, Homo sapiens
aactgcaaggtatggaggatgcaggcaggagggacctagagcccacagctttcccccagccctgttccagcgggcgcccaacacgcgaccttcccggaggktgtgtactgagcaaacgcagaacatcccagaactgttgtaatctgatcaaagcactgggactttgcctctgtttgtaagtcagccacattgctgagatgt

SEQ ID NO: 44492 - DNA, 201 bp, Homo sapiens
ggcttcaaccctgagggcaaagccttgctgaagaaaaccaagaactctgaggagtttgctgcagccatgtccaggtaagtcatgttgtacatgagcacacrcatgtgtgtgtgtccgctgaggtatgaacttgtgtgtttgcaccaggcacggatgtgactgtaagtatttgtattccgtatccatcgtggatcagggaat

SEQ ID NO: 44493 - DNA, 201 bp, Homo sapiens; identical to SEQ ID NO: 11674

SEQ ID NO: 44494 - DNA, 201 bp, Homo sapiens
gaagaaaaccaagaactctgaggagtttgctgcagccatgtccaggtaagtcatgttgtacatgagcacacgcatgtgtgtgtgtccgctgaggtatgaayttgtgtgtttgcaccaggcacggatgtgactgtaagtatttgtattccgtatccatcgtggatcagggaattactgagttttcacaatcatcaaaaagag

SEQ ID NO: 44495 - DNA, 201 bp, Homo sapiens
caaccactcgggtgtccgtatggggaggatgggcaaagagactgatatgggtggagaacagagcagggctggatgagccaagcaaaaaaagttaaaacacrgctggacctggtggctcatgcctgtagtcccagcactttgggaggccgaggagggagaatcacctgaggtcaggagtttgagaccagcctggccaacatg

SEQ ID NO: 44496 - DNA, 201 bp, Homo sapiens
gagtttctctaccttttcctctctttccttccaaaacatagcttctttatttatttatttatttatttgtttgtttatttatttatttatttatttatttwttttttgagatggagtctcgctcttttgcccaggctgcagtgcagtggtgccatctcggctcactgcaagccccgcctcccgggttcatgccattctcct

SEQ ID NO: 44497 - DNA, 201 bp, Homo sapiens
ttcaataagctggttactgagctgagaggcctcagtgatgaagcagtcacatctctcttgccacagctgattgaggtgtccaggtatctaatggttacagytcaactttttataaaactgatggtaactgactgaactttcaaaccttggccaaatggagaatctcagggaccatttggatatcaatccagttaatcaatt

SEQ ID NO: 44498 - DNA, 201 bp, Homo sapiens
ccccttctgagtgatcctgggttagtaaaccgagtgtccctgaaattccactaccgctgattccctacagctgggcagaggcagcgagcgctggctgaagyttccggtgggaaatgggcagtgcctagaagagaaggaaacgatgcatgagaaggttccagatgtctatgaggaacatgacgtgtcctgtccactactctg

SEQ ID NO: 44499 - DNA, 201 bp, Homo sapiens; identical to SEQ ID NO: 11676

SEQ ID NO: 44500 - DNA, 201 bp, Homo sapiens
cttctttctctgagtttatctagtggtacaggactcctgctcccttctaccttgaaggtaaatgcttttaacagaagatacagggactgatcaaaatgctygtctccaatctctttcatagacccgccccttgtcaactctgatcagcagcagccagtcctgtcagtacacactggacgctaagaggaagcatgtggcaga

SEQ ID NO: 44501 - DNA, 201 bp, Homo sapiens
agttatgagtaaataattatgtatttagttgtgagtagatgtacaattactcaatgtcacaaaattttaagtaagaaaagagatacatgtataccctacaygtaaaaaccaaactgtagaaaatctagtgtcattcaagacaaacagctttaaagaaaatggatttttctgtaattattttaggactaacaatgtctttta

SEQ ID NO: 44502 - DNA, 201 bp, Homo sapiens; identical to SEQ ID NO: 11680

SEQ ID NO: 44503 - DNA, 201 bp, Homo sapiens; identical to SEQ ID NO: 11682

SEQ ID NO: 44504 - DNA, 201 bp, Homo sapiens
ccgatctccatctgcgctaccagaaagacaagaaaggcatctccacctcagcagcctccccagccgtaggcaccgtgggcatggatatggatgaagatgaygacttttctaaatggaacttctactacagccctcaggtaaataccacctaatgagtgacacgcccccaagagcgagtggagaattggggcagatacattt

SEQ ID NO: 44505 - DNA, 201 bp, Homo sapiens; identical to SEQ ID NO: 11684

SEQ ID NO: 44506 - DNA, 201 bp, Homo sapiens
tggcgtgaaatactggtgcccgaggttcctcctgccccttaggctcactgacagatcatcccaagcaggcttatcaggttgggtctaattttaaaacagtyattgaggagtcctggccaccccacccctgcttttgtttgatgcttcacctgtgtttgctgggttatggtgtaacacagtaaatcctgtgtgtattttaaa

SEQ ID NO: 44507 - DNA, 201 bp, Homo sapiens
ctaggttttggcatagccactgtctgcccttgcttctgaaacaaacacttgtgcaaatgtgtagcagatctagacccaaagacttagggtcaatgaaatcmagacattttggtagtgattggaaatccatatttacttggggtgcaagagtcaaaggataataacatggtgtgtcagctcaaaatatacttcttcttatct

SEQ ID NO: 44508 - DNA, 201 bp, Homo sapiens
ccatatttacttggggtgcaagagtcaaaggataataacatggtgtgtcagctcaaaatatacttcttcttatctagtctgaaaaagttagtgaaagaagytctgaaagaatctcaacttccaactgtcatggacttcagaaaattctctcggaactatcaactctacaaatctgtttctcttccatcacttgacccagcc

SEQ ID NO: 44509 - DNA, 201 bp, Homo sapiens
ccctgtgctgatactccacaatttccagcttccagtagacaaagatatggttgagatgaagaaagctagagttcctttgacactttccatcttccaggtamtaagaagatgggcctcgcatttgagagcaccaaatccacatcacctccaaagcaggccgaagctgttttgaagactctccaggaactgaaaaaactaacc

SEQ ID NO: 44510 - DNA, 201 bp, Homo sapiens
ggagggctaggagtaggagggaggaagaagggcagggaaagcagtgcatttggaataataagggaaagtctccctggtaaagtgagcataaggagacctawcagaaataagaggagaagccgtgtggtaagactgttaacaggcagagggaccagcaagtgcaaaggccctgaggctgacacactactaccatgtttcaag

SEQ ID NO: 44511 - DNA, 201 bp, Homo sapiens; identical to SEQ ID NO: 11697

SEQ ID NO: 44512 - DNA, 201 bp, Homo sapiens
aacattggaagctctttttgggaagcaaggatttttcccagacagtgtcaacaaagctttgtactgggttaatggtcaagttcctgatggtgtctctaagrtcttagtggaccactttggctataccaaagatgataaacatgagcaggtgtgtatttgtgaagtatcttcttaaggaaagctttgggtctcaatgcaaaa

SEQ ID NO: 44513 - DNA, 201 bp, Homo sapiens
agtagccaacgtaagattctgtttgccttttgatttcttaggttattactttcttccagggtgcatttcttgttaaaacatatttaaaaatgtgtttccasttcaagacaaaatgcttcatcattgtaatcacctcattatttttttatgaaaaacttcaagcttccaccagaatgcactacctcactagctccagtagtg

SEQ ID NO: 44514 - DNA, 201 bp, Homo sapiens
atggacagtgatcagtgactggcaacgaagattcataattttctgttatttatttttaactttcagtgcattgtccagcttaataattaacttgtcaaatyggtatttttgcctaatgttcattgctctttgaggctcatccaagcccattaccttaaaaatctcctgtcattttgtaggcaatgagctcatggcttcaga

SEQ ID NO: 44515 - DNA, 201 bp, Homo sapiens
tctcctgcctcagcctcctgagtagctgggactacaggcacccaccaacgcgcccggctaattttttgtatttttagtagagacggggtttcaccatgttrgccagaatggtcttgatctcctgacctcatgatctgcccgccttggcctcccaaagtgctgggattacaggtgtgagccaccgcacccggcccaaaacat

SEQ ID NO: 44516 - DNA, 201 bp, Homo sapiens
agtgtttgacaggtggaggtaaaagcaaaggggtccaggcataggagtagcacaaagaaaagtgcagagtggctttgggaatggggcaagtacaatattgytgtgaaggtcagaggcagagaactttgaatgactgatgtctgactgtggggatgttatctttgttgttcatttcagcgatggccgggtcaaatatacctt

SEQ ID NO: 44517 - DNA, 201 bp, Homo sapiens
aaagtccttaatttgtgctgaatgttggctttagaagttgatgagtttgatctgtggctgtttctctgaaccatccttgtatctggttttgatcaccacawatggaacttctgtttaatcctgcatatctccattgaaaggacaaaatcattggtgccaactgattttctttaccatagttgtgacacaaaggaagaaaga

SEQ ID NO: 44518 - DNA, 201 bp, Homo sapiens
ctctggaaatgtactgcttaatttaaccaatgtcttttcatttttatgttaggatctggagaaacaacatatgaccacaagaatacgttcacactatcatrtgatgggtctctacgccacaaatttctagattcgaatatcaaattcagtcatgtagaaaaacttggaaacaacccagtctcaaaaggtttactaatattc

SEQ ID NO: 44519 - DNA, 201 bp, Homo sapiens
tacagggactgatcaaaatgctcgtctccaatctctttcatagacccgccccttgtcaactctgatcagcagcagccagtcctgtcagtacacactggacrctaagaggaagcatgtggcagaagccatctgcaaggagcaacacctcttcctgcctttctcctacaagtaggtcatgtgatgcacccctgatttgtcatt

SEQ ID NO: 44520 - DNA, 201 bp, Homo sapiens
aagtccttaatttgtgctgaatgttggctttagaagttgatgagtttgatctgtggctgtttctctgaaccatccttgtatctggttttgatcaccacaawtggaacttctgtttaatcctgcatatctccattgaaaggacaaaatcattggtgccaactgattttctttaccatagttgtgacacaaaggaagaaagaa

SEQ ID NO: 44521 - DNA, 201 bp, Homo sapiens; identical to SEQ ID NO: 11701

SEQ ID NO: 44522 - DNA, 201 bp, Homo sapiens
actctgagctaggtgcaggaaggtttccaaagatgtataaggcatgcttccttccccccagggaattcttggggagaaaaaaaaactttcacaagtgtgtmgttacccagttacacaaagctgaatgtgatacatatcaaagagatgctactaagtagaacagttctttgcctagtggtatcaaaggaagcttcaggacac

SEQ ID NO: 44523 - DNA, 201 bp, Homo sapiens
cattagaggattctggtactttcaccctaagatattttattcagtacaacctgttataagcaaattctccctctgactgtgaagaattcagaatggctagwggcgttattgactacaggcttgctgttaagctagagagagtcagaacagccattgagcactaaatggaggcagcattctgagaaaatactttaacccagg

SEQ ID NO: 44524 - DNA, 201 bp, Homo sapiens; identical to SEQ ID NO: 11703

SEQ ID NO: 44525 - DNA, 201 bp, Homo sapiens; identical to SEQ ID NO: 11704

SEQ ID NO: 44526 - DNA, 201 bp, Homo sapiens; identical to SEQ ID NO: 11705

SEQ ID NO: 44527 - DNA, 201 bp, Homo sapiens
caaacaaatcacaacttggccataatttatgtgttttaatggaattgaattcaacaggcattccacaggctttttctgggaacccttacttgatagtgctstaggaaacactggcaagaagattcaataccagcatttgaagaacgattacagagaaattagacctgtgcttaagaaagagctagcagacaatgccagtgt

SEQ ID NO: 44528 - DNA, 201 bp, Homo sapiens; identical to SEQ ID NO: 11706

SEQ ID NO: 44529 - DNA, 201 bp, Homo sapiens; identical to SEQ ID NO: 11708

SEQ ID NO: 44530 - DNA, 201 bp, Homo sapiens
tgaactgacatatgaaagataaatccctttcagtatatgaaagattctctgatctttatttttaactgctaatgaagttttagtgtactatattgtgtaaytggagtaattgaaaacatgttatttttttttttctctctgtttagtcctctccagataaaaaactcaccatattcaaaactgagttgagggtccgggaat

SEQ ID NO: 44531 - DNA, 201 bp, Homo sapiens; identical to SEQ ID NO: 11709

SEQ ID NO: 44532 - DNA, 201 bp, Homo sapiens; identical to SEQ ID NO: 11712

SEQ ID NO: 44533 - DNA, 201 bp, Homo sapiens; identical to SEQ ID NO: 11711

SEQ ID NO: 44534 - DNA, 201 bp, Homo sapiens; identical to SEQ ID NO: 11710

SEQ ID NO: 44535 - DNA, 201 bp, Homo sapiens; identical to SEQ ID NO: 11713

SEQ ID NO: 44536 - DNA, 201 bp, Homo sapiens; identical to SEQ ID NO: 11714

SEQ ID NO: 44537 - DNA, 201 bp, Homo sapiens; identical to SEQ ID NO: 11715

SEQ ID NO: 44538 - DNA, 201 bp, Homo sapiens; identical to SEQ ID NO: 11718

SEQ ID NO: 44539 - DNA, 201 bp, Homo sapiens
acaaaaattagctgggtgtgatggcacatgccagtagtcctagctactccggaggctgaggcaggagaatcacttgatcccaggaggtggaggttgcagtragctgaggttgcgccattgcactccagcccgggcgaccgagcgagactccatttcaaaaaaagaaaaagaaaaaagaaaaaaagaaaaaaaaagaatcac

SEQ ID NO: 44540 - DNA, 201 bp, Homo sapiens; identical to SEQ ID NO: 11719

SEQ ID NO: 44541 - DNA, 201 bp, Homo sapiens; identical to SEQ ID NO: 11722

SEQ ID NO: 44542 - DNA, 201 bp, Homo sapiens; identical to SEQ ID NO: 11723

SEQ ID NO: 44543 - DNA, 201 bp, Homo sapiens; identical to SEQ ID NO: 11725

SEQ ID NO: 44544 - DNA, 201 bp, Homo sapiens; identical to SEQ ID NO: 11727

SEQ ID NO: 44545 - DNA, 201 bp, Homo sapiens
caagttgtaatggagaaggacatttccgtgaccatcctctctctgggacaggtatgagctcaagctggccattccagaagggaagcaggttttcctttacycggagaaagatgaacctacttacatcctgaacatcaagaggggcatcatttctgccctcctggttcccccagagacagaagaagccaagcaagtgttgtt

SEQ ID NO: 44546 - DNA, 201 bp, Homo sapiens; identical to SEQ ID NO: 11729

SEQ ID NO: 44547 - DNA, 201 bp, Homo sapiens; identical to SEQ ID NO: 11732

SEQ ID NO: 44548 - DNA, 201 bp, Homo sapiens; identical to SEQ ID NO: 11733

SEQ ID NO: 44549 - DNA, 201 bp, Homo sapiens
agccgagccaccttgtatgcgctgagccacgcggtcaacaagtgagtttccacactgtatttctcctcctaggagcagaggaacatcttgcacctctgtgmatctctgtattaaaactgaacccctccttccactttcaaactctgctccttactcttgtgttttttcttgatcatttttggggtaatgacttgaaataag

SEQ ID NO: 44550 - DNA, 201 bp, Homo sapiens; identical to SEQ ID NO: 11734

SEQ ID NO: 44551 - DNA, 201 bp, Homo sapiens
ctctaccttttcctctctttccttccaaaacatagcttctttatttatttatttatttatttgtttgtttatttatttatttatttatttatttattttttgagatggagtctcgctcttttgcccaggctgcagtgcagtggtgccatctcggctcactgcaagccccgcctcccgggttcatgccattctcctgcctca

SEQ ID NO: 44552 - DNA, 201 bp, Homo sapiens
tcccaaagtgctgggattacaggtgtgagccaccgcacccggcccaaaacatagcttcttaccacacatctcttgattctcttatacactcgtccaggtgygaagcagactgaggctaccatgacattcaaatataatcggcagagtatgaccttgtccagtgaagtccaaattccggattttgatgttgacctcggaaca

SEQ ID NO: 44553 - DNA, 201 bp, Homo sapiens; identical to SEQ ID NO: 11735

SEQ ID NO: 44554 - DNA, 201 bp, Homo sapiens
ttgtttaagcacattgattccttggagtttctctaccttttcctctctttccttccaaaacatagcttctttatttatttatttatttatttgtttgtttrtttatttatttatttatttatttattttttgagatggagtctcgctcttttgcccaggctgcagtgcagtggtgccatctcggctcactgcaagccccgc

SEQ ID NO: 44555 - DNA, 201 bp, Homo sapiens
ctttcttctcagccccatcactttacaagccttggttcagtgtggacagcctcagtgctccactcacatcctccagtggctgaaacgtgtgcatgccaacmcccttctgatagatgtggtcacctacctggtggccctgatccccgagccctcagcacagcagctgcgagagatcttcaacatggcgagggatcagcgcag

SEQ ID NO: 44556 - DNA, 201 bp, Homo sapiens
cttctgatagatgtggtcacctacctggtggccctgatccccgagccctcagcacagcagctgcgagagatcttcaacatggcgagggatcagcgcagccragccaccttgtatgcgctgagccacgcggtcaacaagtgagtttccacactgtatttctcctcctaggagcagaggaacatcttgcacctctgtgcatct

SEQ ID NO: 44557 - DNA, 201 bp, Homo sapiens
tctttccctatctgtcatttcctgactcttcttctctctcctcttctttctcttccccccactcctcttccagttttcagtcctaggaaggctttaatttyaagtgtcacaatgtaaatgacaaacagcaagcgtttttgttaaatcctttctggggcatgtgataaagagaaattaacaacagtagacttatttaaccat

SEQ ID NO: 44558 - DNA, 201 bp, Homo sapiens; identical to SEQ ID NO: 11832

SEQ ID NO: 44559 - DNA, 201 bp, Homo sapiens
tgttaggatctggagaaacaacatatgaccacaagaatacgttcacactatcatgtgatgggtctctacgccacaaatttctagattcgaatatcaaattsagtcatgtagaaaaacttggaaacaacccagtctcaaaaggtttactaatattcgatgcatctagttcctggggaccacagatgtctgcttcagttcatt

SEQ ID NO: 44560 - DNA, 201 bp, Homo sapiens
gtcccagctacttgggaggatgaggcaggagaatggcgtgaacccaggaggctgagcttgcagtgagccgagagattgcgccactgcgctccagcctgggygacagagcaagactccatctcaaaaaaaaaaaaaaaaaaaaaaattgaaatgcaaatgtctcgtctttaagtcccaaagccaaggaagcatatgtgctgc

SEQ ID NO: 44561 - DNA, 201 bp, Homo sapiens
aagagaccagtcaagctgctcagtggagggtaattctttcagccaagtctgcctagccagtttgaaagagagaacagagaatgtacctgcagaattttgcyaggctaaacagttgattgagatcattcaggtcctgaggaagcaggagaggagtagaaaggaaagattccgggttacctattttaattctagcctagactt

SEQ ID NO: 44562 - DNA, 201 bp, Homo sapiens
ccaggaataagtatgggatggtagcacaagtgacacagactttgaaacttgaagacacaccaaagatcaacagccgcttctttggtgaaggtaagagtttstgtccacatagttgctggaaaatctactcaagatgtgcctatcatggcttagccacttgctgagccctgttaaatgtctgctgactaacaagtgatacag

SEQ ID NO: 44563 - DNA, 201 bp, Homo sapiens
ttgctctttgaggctcatccaagcccattaccttaaaaatctcctgtcattttgtaggcaatgagctcatggcttcagaaggcatctgggagtcttccttrtacccagactttgcaagaccacctcaatagcctgaaggagttcaacctccagaacatgggattgccagacttccacatcccagaaaacctcttcttaaaa

SEQ ID NO: 44564 - DNA, 201 bp, Homo sapiens
gccgtgggaccaaaccgtgggtgcccttagccaggatagatgatcgtaaactatgtctatgagtgagccctcctcatcgaaggtgttcatttccatctctstcttcaggacagctacagaacagtacacattttagaatgaaaatgaggagtcactggtaactgcggtacctaaaacataatttgctctgtgcatttcatg

SEQ ID NO: 44565 - DNA, 201 bp, Homo sapiens
atcttaaaaagagacacacatgagaataaccaatctcacattccagtcctgtaatcccagtatgtttgggctactgattctctttttaaaagtggcatctytcatttttaaaagagaaaatcctagatagtgactcctattatcatcaagtaatatatatcaaggccccaaggctaccttgtcacattttactctggcata

SEQ ID NO: 44566 - DNA, 201 bp, Homo sapiens
aggaatcccctttgttccagcaggaaacttgatgcctatccagaagcaaagttcacttggccgccctcaccgtggaaacgtgttgccacaccaaatgaacwtccccctcctgctgtcaaagagcagtcagtggccaccgctattgacctgagctctaattaggctggttttataatgaggaaaagagtgcgattctaatta

SEQ ID NO: 44567 - DNA, 201 bp, Homo sapiens
gccctcaccgtggaaacgtgttgccacaccaaatgaacatccccctcctgctgtcaaagagcagtcagtggccaccgctattgacctgagctctaattagkctggttttataatgaggaaaagagtgcgattctaattagtaaatttccatctctttctcaataggtatcctccagtcaaagcaatcagctatcctcatca

SEQ ID NO: 44568 - DNA, 201 bp, Homo sapiens
atcacactggttccattgccaaaaaaataactgtatcataaaactctagtaaaagtgatgatggttaagacaacaagagagcagaacgaggttttatttgstgctaatgacctgcattctctctcttaggtccgtggcactcaggtagttggttctgacatgactgtgacaattcagtttaccaatcctttaaaagaaacc

SEQ ID NO: 44569 - DNA, 201 bp, Homo sapiens
actgggcacaacatatagaaggcaatggcagccatagcttgcgccatgcatagcctggagtagacaaacctaaatgaactttcttccttctcacttctcayggactcatttaggtgaatgccaaagatgacgaaggtgtcctcgttggatcctgggacaatatctatgcctatggcgtccccccatcggcctggactggaa

SEQ ID NO: 44570 - DNA, 201 bp, Homo sapiens
aggctattggtgtgtatcctttggccagaataaccagccaagcatgtttacagtgatgcagggaatcaatccgttctatgactatttccttaactctccarttagttgctatcctgcccagcaaacacagctgagagaagctgcttaataagaaccaaaatactgagctatttgcatacctgaagaactagtgcaattacc

SEQ ID NO: 44571 - DNA, 201 bp, Homo sapiens
attcaggaaaatctcttactacagtgaggtacagtataggtaaaatcttcctgtcttgctatttgatctttattcctttttaagaaaattctggtattgcytgtggctagcagttctttctaagaagactgaactggtaccagactcctcccttgatagtgtaatctactttctgcagccttctgccctctccttgatcct

SEQ ID NO: 44572 - DNA, 201 bp, Homo sapiens
gtggaggtatgaatatgcttctgtttgaattgatgagtgtgaattacttgagggactttcaggtaaacctgtccaatagataatatgagtctgaagcttcrggaggaggtttgggttggacaggagataatttggatatcatacacacgtgggcaagctcactcagaaaaaggtaaatcaagtcagcagtggactgaggct

SEQ ID NO: 44573 - DNA, 201 bp, Homo sapiens
tgggaggccaagatgggaggatcgcttgaggccaggagtttgagacctagtctctaaaaaataaaaattaaaaattagatgggtgtggtggtgcacacctrtactcccagctacttgggaggctgaagtgggagaattgcttgagttcgggagttggaggttacagtgagcaatgattgtgccactgtactccagcctggg

SEQ ID NO: 44574 - DNA, 201 bp, Homo sapiens
tatttgatctttattcctttttaagaaaattctggtattgcctgtggctagcagttctttctaagaagactgaactggtaccagactcctcccttgatagygtaatctactttctgcagccttctgccctctccttgatcctggggtccaccttgtctcagaagaggggaaaccttagagggacagtcactatatgaggtc

SEQ ID NO: 44575 - DNA, 201 bp, Homo sapiens
tctaaaaaataaaaattaaaaattagatgggtgtggtggtgcacacctgtactcccagctacttgggaggctgaagtgggagaattgcttgagttcgggarttggaggttacagtgagcaatgattgtgccactgtactccagcctgggcaacagagcaagactccgtctttgaaaaaagaaaaaaaacaagctcatgtat

SEQ ID NO: 44576 - DNA, 201 bp, Homo sapiens
aggggtgagactgtcgcccaagtgaaaaagatagcagaagataagaaggaaaactgtttccagaaattgtcaaaagacagccaggtgaacaagattgtggyccgaggtggcacaggatgctgggctgaaaattacagcagcatgcacagcacttattgataggagaatgctcagctgtgctcctgagggcccttcagcctg

SEQ ID NO: 44577 - DNA, 201 bp, Homo sapiens
cagaaaatggttaagattaaaactgttcaatgcactgattcaaatatctttgggtggccttgaagctgctcttagcagagggaaagagacatccagccatktgagtgtcctgagggatgccaatgagaatgaatctgcccagaaaacccaagtctagagccccaggatatctccaggagccctcagatttggcttaatcca

SEQ ID NO: 44578 - DNA, 201 bp, Homo sapiens
tgcactgattcaaatatctttgggtggccttgaagctgctcttagcagagggaaagagacatccagccatgtgagtgtcctgagggatgccaatgagaatsaatctgcccagaaaacccaagtctagagccccaggatatctccaggagccctcagatttggcttaatccattctaataatctgtagatagcatatgcaca

SEQ ID NO: 44579 - DNA, 201 bp, Homo sapiens
ttagagggacagtcactatatgaggtctcctactattttgggtgcaaactaagtagtgtgaagcaccttcctgtgatacacctgagagctctttattttckaaatgcacgaggattcacattactttcgaggtcctaagactctggcctgactttggtaaatgattcattccttcttcttgggtacaggagccaatatgtt

SEQ ID NO: 44580 - DNA, 201 bp, Homo sapiens
aaacctctttttttggagtgaacggtcgtagatacatctgaggacccaggtgctcaatgggcattgtccttggcatttctaaatcaccaaggaactttttygcatttacccatatggattttaatttttgaaaaagttcatctatcaaaacaaatcatgattatgtaataataccttgttaccccattcttgtgtcagatt

SEQ ID NO: 44581 - DNA, 201 bp, Homo sapiens
gagcttctgggtctccaaccctatcagcttttatttaaaagtgttattgtctctttctatgattcatatcaggaatgaaatttctcagtttggaacagcakaaaaaggcagaagcctccggtgttccttgcaacctttccaattgtaacgcatatcaattagtaggagctctcggggtgacaactttgggagaatccactg

SEQ ID NO: 44582 - DNA, 201 bp, Homo sapiens
gccctttgtggtatgcactggtaagatataaggcaggagagaaaatagagaactcgaaaaataattatagatcatcctttaaattgtttttccagaacctrgcctccttttatgtcatgtgatttcctccaaagcttcagtatgtgggtatttgtcttctaacttgccaactatgctaagcagctgcagctctgacctccc

SEQ ID NO: 44583 - DNA, 201 bp, Homo sapiens
atctcagcctcaaataatctttatttaaagtactactaaatcaactagattcgcctttagaatattttcaaaacctgtttggccctatgatacgaatccartgttgttgaagaaaggggcatgtcagctccagagatctctagacgactgctctatggacagttaaagactttggcaacagcagacatgtgatgatggcta

SEQ ID NO: 44584 - DNA, 201 bp, Homo sapiens
acagtgatttctgcatttccatctgaggtatggggttcatctcactagggagtgccgcacagtgggcacaagtcagtgggtgcgtgcactgtgcgcgagcygaagcagggcgaggcattgcctcactcaggaagtgcaaggggtcagggagttccctttccgagtcaaagaaaggggtgacggacggcacctggaaaatgg

SEQ ID NO: 44585 - DNA, 201 bp, Homo sapiens
tcatttacattacagctaagaaagatggcactcatgtggtggaaaatgtggatgccacccacattgggaaattaattgtgaccaaacaaattggaggagayggcatgatggatattactgatacttacaaattccaagaaggtaatttactaccactgaatgaagatttatttgcccaagtccattgagtacttattcatt

SEQ ID NO: 44586 - DNA, 201 bp, Homo sapiens
tgaaaattgcatgcccaacctctccacctccttatcctcctccatgtggctcaatttccaaagcagttcctacctcctcacccctaagtggatttacttayggctcttcttgggctccaccctaaccctatcagactataatctatcagagcaaacattctgttttgttctctgatgtatcccatgtacctagatcacagc

SEQ ID NO: 44587 - DNA, 201 bp, Homo sapiens
cgaccatttctgtagggcgtggagtaaaactagggttggtttgaccagcactttcatcatttaatccttaaagacaccctacgatgtagatactgctattrtctcccttctgtagctgaggaatttgaggctttgagaggttgactggttacacaggttcagttacacagtttatgaaaacagagccaagattcagactca

SEQ ID NO: 44588 - DNA, 201 bp, Homo sapiens
attcatataggactgtaattccaggaggaaactagtggcaaaaactgagctgaggctcagaagatcagtcacatagataaggctactatggagggcttggrgacaagctagagttcagttgattaatggttggatgggaatcagcccagctcctgatggccactgggaggctggcggatgcatcccagtggaaggaaccat

SEQ ID NO: 44589 - DNA, 201 bp, Homo sapiens
catatcaggaatgaaatttctcagtttggaacagcagaaaaaggcagaagcctccggtgttccttgcaacctttccaattgtaacgcatatcaattagtargagctctcggggtgacaactttgggagaatccactgatttatattaatgaagagtgttactgtagtccaacagagtaaagtactaaattaccaactctaa

SEQ ID NO: 44590 - DNA, 201 bp, Homo sapiens
attgtagtgggccaaatatgctcatagtttctctttgactgcagaatctttatagaaagaatgatagactatatcctgtgtaatccatcacttaacacccraagaaatagagggttacagtaaaaatatagagaaaaaagccattttcttttcagccaccacattttaaaaaaactaaaacagttaaaactaaaataataa

SEQ ID NO: 44591 - DNA, 201 bp, Homo sapiens
ttctctttgactgcagaatctttatagaaagaatgatagactatatcctgtgtaatccatcacttaacacccgaagaaatagagggttacagtaaaaatayagagaaaaaagccattttcttttcagccaccacattttaaaaaaactaaaacagttaaaactaaaataataaataacaaaagatatatattgcttattta

SEQ ID NO: 44592 - DNA, 201 bp, Homo sapiens
gtccattgagtacttattcattgtcactcagagatgagttccagagaatgcactggcatttgcagcatttggtagcaacagcagaagtataaactttcacrtgtgaaagacacgtcacatatgcaatttttcattgtagttttctttgctagcttgctttgggcagaattctcattcacgtggcttgtaaaatgatttggt

SEQ ID NO: 44593 - DNA, 201 bp, Homo sapiens
agcagaagtataaactttcacgtgtgaaagacacgtcacatatgcaatttttcattgtagttttctttgctagcttgctttgggcagaattctcattcacstggcttgtaaaatgatttggtttaaagtcatacctaatttaacagaatatagaatatgttcttgctcacaagaaccttaattttaaataatcctattaga

SEQ ID NO: 44594 - DNA, 201 bp, Homo sapiens
ctgtgtctgagcacttattaatggttttgactatcactcctactacacatacacctcatagtttaatggtggaagctacagcacctgtccaagtgcacccygccatctgcaaccccctccattgaggtctcttgtgctatatcagactgtatttacacgtgacttctcagtgagacttgcaaaaccccttgccttcacagg

SEQ ID NO: 44595 - DNA, 201 bp, Homo sapiens
tcagatgcaagaatcgttcaggcaaagtgaaacacgtttcctcttccatacagccccctgctgtatccaactttttccttcccagacagtaaacccacaarctttatctgagtgtaccggaaacttctctatctttacaccttggctatccccctagaattccaccttggtcaaggccaacacatgaaaaaagacactgtg

SEQ ID NO: 44596 - DNA, 201 bp, Homo sapiens
aatagaaattaaaataactacttcacatttgtttagtactttaccaattatttccacatacattgttctattacattatcatggaagactacaacgtagayaatacaatattaataggacaatgcaatctctctaactcaggacaattaggtcgaaggccagtttcaattccaaaataatgtcatggtgggtttttgttaa

SEQ ID NO: 44597 - DNA, 201 bp, Homo sapiens
ggcatctaagaaagtaggacagtgtttcccagagtgtgttctctatgaacacctgtcatgtgagattctccttgggggaaaaaagttccatcatcaaatayagttggatcatgctgtgttttgtgtctcttctcatagaggcccaaggcacattaatatataaaaggctatgagtagacacgtagtcaaaaaatgaatctt

SEQ ID NO: 44598 - DNA, 201 bp, Homo sapiens
ctaataatggcatctaagaaagtaggacagtgtttcccagagtgtgttctctatgaacacctgtcatgtgagattctccttgggggaaaaaagttccatcrtcaaatacagttggatcatgctgtgttttgtgtctcttctcatagaggcccaaggcacattaatatataaaaggctatgagtagacacgtagtcaaaaaa

SEQ ID NO: 44599 - DNA, 201 bp, Homo sapiens
ttcttgggtaactactgggctccagacgctgttcttaaagcactttacatggttgcattttcaaccaccaacaaccccacaaggtaaagagtactggcatyactttacagatgagaaaactgaagcacagagaggttctataactcctccaaggccatacagccagcaaatggcggagctgggcttccaaccccagcaggc

SEQ ID NO: 44600 - DNA, 201 bp, Homo sapiens
ggagtcactggtaactgcggtacctaaaacataatttgctctgtgcatttcatgtttgctatttttttgaatcttaaaaagagacacacatgagaataacsaatctcacattccagtcctgtaatcccagtatgtttgggctactgattctctttttaaaagtggcatctctcatttttaaaagagaaaatcctagatagt

SEQ ID NO: 44601 - DNA, 201 bp, Homo sapiens
ttccaggaggaaactagtggcaaaaactgagctgaggctcagaagatcagtcacatagataaggctactatggagggcttggagacaagctagagttcagytgattaatggttggatgggaatcagcccagctcctgatggccactgggaggctggcggatgcatcccagtggaaggaaccatgacccaataagactgtca

SEQ ID NO: 44602 - DNA, 201 bp, Homo sapiens; identical to SEQ ID NO: 11931

SEQ ID NO: 44603 - DNA, 201 bp, Homo sapiens
atagaaagaatgatagactatatcctgtgtaatccatcacttaacacccgaagaaatagagggttacagtaaaaatatagagaaaaaagccattttctttycagccaccacattttaaaaaaactaaaacagttaaaactaaaataataaataacaaaagatatatattgcttatttatcattgagaagttgtataaatat

SEQ ID NO: 44604 - DNA, 201 bp, Homo sapiens; identical to SEQ ID NO: 11932

SEQ ID NO: 44605 - DNA, 201 bp, Homo sapiens
ctgtgtaatccatcacttaacacccgaagaaatagagggttacagtaaaaatatagagaaaaaagccattttcttttcagccaccacattttaaaaaaackaaaacagttaaaactaaaataataaataacaaaagatatatattgcttatttatcattgagaagttgtataaatatgcgtatttatttattattgagaat

SEQ ID NO: 44606 - DNA, 201 bp, Homo sapiens
aaaataatgtcatggtgggtttttgttaacttttattgcatagaatgtttcaaatggcactactgagtttaattctatctcaatcaatgcttagtgtccgstctatgcctgcaattggtttggtgctggcgattccagcagtgagcaggactcagttcctgtcctggtccgagtgacaggattattgtgcagaggggtctt

SEQ ID NO: 44607 - DNA, 201 bp, Homo sapiens
aattctatctcaatcaatgcttagtgtccgctctatgcctgcaattggtttggtgctggcgattccagcagtgagcaggactcagttcctgtcctggtccragtgacaggattattgtgcagaggggtctttggaaacaataagtaggggcatttagtccaactgattcagaaaaagacttgagaagagaagtcgtggacc

SEQ ID NO: 44608 - DNA, 201 bp, Homo sapiens
tgactttgcagaatttataacataggaataatgacggcaccctcctcctggggaggtctgaagcttgtattatagaaacaccccaacaagtgcagtacacrgtgcatccattaatgtgactttctctctggtggattgtatttttgcctgtcattatctctggatctcccccaggtcaagaagaagagagattggccctag

SEQ ID NO: 44609 - DNA, 201 bp, Homo sapiens
gattatacaggaaagttttacttatcactgccttagtttttccccacttatagtaccactgtgattttatgtttttcctgaggcattggcttgttgaagtkatattgcaacagagaatcaaaagatcacttagaaaaagtaacatgttagaaaacatcatgcttagaattaaatgtctaaagtataccagtatagatgata

SEQ ID NO: 44610 - DNA, 201 bp, Homo sapiens
attaatcagcaccctttttctcaccctttgttatcaacatataagcaggctagaaagacagtattttattccaatgtgaaacaaaactgctgatctggagktcttatgttataaattcccacatcataccttcaactatatatatgtcctgaaactagcatattttgagaataaaatgggaaatgacatttaaaggacacc

SEQ ID NO: 44611 - DNA, 201 bp, Homo sapiens
ggagcctcacctcaggggggctacagttttgcacagagcggccccactgttgacgccaacagaggccatggtctgagctccttagctgttcaggagagggmtggggactcaggaacctcagaagggcagagcagggcagagtaattagatcccagggtagcaaatgaaaccccaagtgggcaaatgcaaagtagcagatcc

SEQ ID NO: 44612 - DNA, 201 bp, Homo sapiens
gccaccacattttaaaaaaactaaaacagttaaaactaaaataataaataacaaaagatatatattgcttatttatcattgagaagttgtataaatatgcrtatttatttattattgagaattttataaatatatccacttaatttttatcccagttatggaaggtattatagcaggtggtctcatattcatttttccaca

SEQ ID NO: 44613 - DNA, 201 bp, Homo sapiens
catataaagaattgtaggcctttataaggcctttggtttttattttgagtgagctgaggagcctttagagagttttgagcagaaatgtggcataatctaasttaggttttgaaaagaccactggctgctgtgttgagaagagactaaagaggaagtagggcggaaggttagagactggtaggatgcttctgcaatcactcc

SEQ ID NO: 44614 - DNA, 201 bp, Homo sapiens; identical to SEQ ID NO: 11943

SEQ ID NO: 44615 - DNA, 201 bp, Homo sapiens; identical to SEQ ID NO: 11946

SEQ ID NO: 44616 - DNA, 201 bp, Homo sapiens; identical to SEQ ID NO: 11948

SEQ ID NO: 44617 - DNA, 201 bp, Homo sapiens; identical to SEQ ID NO: 11951

SEQ ID NO: 44618 - DNA, 201 bp, Homo sapiens; identical to SEQ ID NO: 11952

SEQ ID NO: 44619 - DNA, 201 bp, Homo sapiens
tctgtaactgtaaatcccaaagatgcttaacttatatagagttttctcacccctgaatctgttatcacagagtctctgttcctgggttctttgtttgactyagcccctaattattttgatatcactttcaagtattaatagtttggttatgataggtaccatattccctgaagtacttcatgttcgacaatgtgtgtaaaa

SEQ ID NO: 44620 - DNA, 201 bp, Homo sapiens
ggccaacctcttcccatcttccccttcatgttctcctcctcagtctctggtaaccactgttctgctctttgcttctatggtataataatttttttttttttagtgtctacatgtgagtgaaatcatgtagtatttgtctttccatgtctggtttatttcacttaccatgatgcccttcctccaagtctaattcatgttgtt

SEQ ID NO: 44621 - DNA, 201 bp, Homo sapiens
tctcttttccatctgatggtttgcaaatgtttgcaaacagctgtctcatcttccttgaatcttttctacctggggacaaatatctgtcctgactttatttycctctcctctaacatggtttcagctctctctctctctctcccacacattccaatttgtcactactcctcttaaagtgtgacacccagaatggatcccaat

SEQ ID NO: 44622 - DNA, 201 bp, Homo sapiens
tccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttcaa

SEQ ID NO: 44623 - DNA, 201 bp, Homo sapiens
atccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttca

SEQ ID NO: 44624 - DNA, 201 bp, Homo sapiens
tatccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttc

SEQ ID NO: 44625 - DNA, 201 bp, Homo sapiens
caacagccacaaccgttacaccatcacagcttatctctcagccaacatcaccttctacaccggggtcccgaaggcagaattcaagaaggagacgttcgacrtgacgctggagcccttgtcctgtaagctaacaatggtgtggttctttgtgagactcgctgtctggcccctgtcttgctaggtgttaatgcccgttatagc

SEQ ID NO: 44626 - DNA, 201 bp, Homo sapiens
aatgtcatcatttacagactgaatttggtgctgattatgttcaccattactaaaaatattgggaaatgagctatgcttggtgaaacaaagggcattttttwaaaatttggctgattaaatgtagtttagaaacaaaataaacttgcataaacttgcaagtgtttggaaacagtctggtttggtaatagtcactatgtttaa

SEQ ID NO: 44627 - DNA, 201 bp, Homo sapiens
gaccgcctttggaggcagaagagcagttccacccaataactctaatgcagcggaagatgacctgcccacagtggagcttcagggcgtggtgccccggggcrtcaacctgcaaggtatgagcataccccccttccccaccactctgggtccaggcacagccgggccctggcccctcttccctgcaggtaaacatcctctgtc

SEQ ID NO: 44628 - DNA, 201 bp, Homo sapiens
gttgatgagagtggaagataaatgtgggagcctctgtgctcctacttctcaggcccacagctgtagcttctgggggcatctgtggttgcatccatgagacrccttcctgccctggaagcaggaacccaggcttctggcagtgaccctgaggagtgacatctcatgcagcccttatccaggtcttagagcccttccctagtc

SEQ ID NO: 44629 - DNA, 201 bp, Homo sapiens
ctggaatctgtgggataaatgcaaggcctcacttataccctctggggcaactttattgcccataaagggctctccgcatttctttcaaattacaatgctcrtagcttctgcatctcatcatttaagagatgccttattgcagatgcaataaacaacagagaaaataatcttagtgcttttgaaacaacgcaagcacaaaac

SEQ ID NO: 44630 - DNA, 201 bp, Homo sapiens
tacacataaaagtttcttcttgaactaaccttctctaaattgcctgaaggctccctttatttaaggttttatgagagcaagaaaatgaaaaatatgactgygaaaatgaaatgaaaatatgactatgcagatatggaattatgctttcagcaataaggaaaagggagctttgcagattcctaaaataatgtgatgcaaaca

SEQ ID NO: 44631 - DNA, 201 bp, Homo sapiens
cgtcctcaactgatggtttagcgataacttaaaaggtgatgctgcaaatgattctttgctggatttcagaaaataaagaagctattccagcaaaaaaaaaagtttctatttttacctgtattctgtcagggatcacagtatatgtagttttgaagatgaatgttttagagtcagaaagacctggatttatatccaacttcc

SEQ ID NO: 44632 - DNA, 201 bp, Homo sapiens
ttgagatataatgagtgccccaaacaaagtacatgacagtgactggctacactgtgagacttaactgtagtttcatttagtgctgtaaatatcacaaacttcattaaggtggaaaatgggaacagactatgtgttctaattattgctgaaccctgaccattttcccctccatgtccacaaccgagcacgttctctctccag

SEQ ID NO: 44633 - DNA, 201 bp, Homo sapiens
taaattgtagcaaatgcctagagctttcaaaaccattatcagagaggccgggtgcagtggctcacacctgtaatcccagcactttggaaggccaaggtggstggatcacttgaggtcaggagtttgggatgaacctgaccaacatggtgaaaccctgtttctactaaaaataaaaaattagccaggctgtagtggtgcgtg

SEQ ID NO: 44634 - DNA, 201 bp, Homo sapiens
cctgaactcaggaggtggaggttgcagtgagccaagatcgtgccactgcactccagcctgggggacagagcaagacttcatctcaaaaaaaaaaaacactrtagtgttttctttggaaactaaaagctttggcacttttcctattcctagggtagtaaaggtaattttcatggaaaagaatagtcagtgtaaaggactgaa

SEQ ID NO: 44635 - DNA, 201 bp, Homo sapiens
ctcgaacccgggaggcggaggttgcagtgagctgagatcgtgccactgccctccagcctgggtgactgagcgatactccgtctcaaaaaaaaaaaaaaaaraaaagaatggaggctggaaacaaagctgtgtcatctaggaggggcctaggaagaggttttctgcctctgccatctcttgtggggcctctttctcgtcctt

SEQ ID NO: 44636 - DNA, 201 bp, Homo sapiens
tgtggagcatggatctaaatgatccatctcagaaacaggccctctgctggtgcctctcgcccaagttaggaaagtcttttgggggctgtccagaatgaatrgtgtgctttgctttcccattcaaaaagatacacgcgctgacataggccgcttcttaaaacgctgtctcctgtaatctcagcactttgggaggctgaggtt

SEQ ID NO: 44637 - DNA, 201 bp, Homo sapiens
tgcgatgatcttggttcactgcaacctttgcctcctgggttcaagcaatcctcctgcctcagcctcccgagtagctgggattacaggcacatgccaccacrccaggcaaatttttgtatttttagtagagacgggatttcactatgttggccaggctgatctcaaactcctgacctcaggtgatccacccacctcggcctg

SEQ ID NO: 44638 - DNA, 201 bp, Homo sapiens
tggagtgcaatgcgatgatcttggttcactgcaacctttgcctcctgggttcaagcaatcctcctgcctcagcctcccgagtagctgggattacaggcacrtgccaccacgccaggcaaatttttgtatttttagtagagacgggatttcactatgttggccaggctgatctcaaactcctgacctcaggtgatccaccca

SEQ ID NO: 44639 - DNA, 201 bp, Homo sapiens
agaacccactcattctgcaaaagcctccactttctttttttttatttttattttttgagatggaatctcgctctgacacccaggctggagtgcaatgcgaygatcttggttcactgcaacctttgcctcctgggttcaagcaatcctcctgcctcagcctcccgagtagctgggattacaggcacatgccaccacgccagg

SEQ ID NO: 44640 - DNA, 201 bp, Homo sapiens
acttcatccattctatctagagacacgataaactgaccatttgtgctcatctgaggctgtaaccaatagagggccagaacctcactcatctaaacaattawttgcaaggggagccatggaggaagcagggtccaggcttaggtccaaagacagcaatacgagagcgggtcattccaaaaggcaggacctgggggccaaggt

SEQ ID NO: 44641 - DNA, 201 bp, Homo sapiens
caggagatatgtttggaagctgtagagatactccaggctagaagaggaatagaccagagggattttagcccctggaggtatggggctcatttctcttgttscagcttcctctgagcacctgagcaatccttcaacattataggttccaggatgtattaataacaacactttataaattaagccacttaagaaaatgctttt

SEQ ID NO: 44642 - DNA, 201 bp, Homo sapiens
tgagagtggaagataaatgtgggagcctctgtgctcctacttctcaggcccacagctgtagcttctgggggcatctgtggttgcatccatgagacgccttyctgccctggaagcaggaacccaggcttctggcagtgaccctgaggagtgacatctcatgcagcccttatccaggtcttagagcccttccctagtctctgg

SEQ ID NO: 44643 - DNA, 201 bp, Homo sapiens
gagcctccaccaaggagatggtggaggtatgaatatgcttctgtttgaattgatgagtgtgaattacttgagggactttcaggtaaacctgtccaatagayaatatgagtctgaagcttcgggaggaggtttgggttggacaggagataatttggatatcatacacacgtgggcaagctcactcagaaaaaggtaaatcaa

SEQ ID NO: 44644 - DNA, 201 bp, Homo sapiens
gtgagggtaggtagtccttgcttctcgtgaatcctttgctgtgagtcatttggaaagccaatgactgctgtgcagcattcagaatggcagtgtttcttggrtaactactgggctccagacgctgttcttaaagcactttacatggttgcattttcaaccaccaacaaccccacaaggtaaagagtactggcatcactttac

SEQ ID NO: 44645 - DNA, 201 bp, Homo sapiens
ctacctatgagtcctgagggactctgagcaaggaaagcctgcttaccccaggggaccctaggaggggacaccttcagccctgctcccatagctgactctcsatcccctcgtggctactttcacagaggattgtggccgtgggaccaaaccgtgggtgcccttagccaggatagatgatcgtaaactatgtctatgagtgag

SEQ ID NO: 44646 - DNA, 201 bp, Homo sapiens
gggagaacccactcattctgcaaaagcctccactttctttttttttatttttattttttgagatggaatctcgctctgacacccaggctggagtgcaatgmgatgatcttggttcactgcaacctttgcctcctgggttcaagcaatcctcctgcctcagcctcccgagtagctgggattacaggcacatgccaccacgcc

SEQ ID NO: 44647 - DNA, 201 bp, Homo sapiens
agggatgtgaaggacctcttcaaggagaactacaaaccactgctcaaggaaataaaagaggatacaaacaaatggaagaatattccatgctcatgggtagsaagaatcaatatcgtgaaaatggccatactgcccaaggtaatttacagattcaatgccatccccatcaagctaccagtgactttcttcacagaattggaa

SEQ ID NO: 44648 - DNA, 201 bp, Homo sapiens
ccaacttacaagggatgtgaaggacctcttcaaggagaactacaaaccactgctcaaggaaataaaagaggatacaaacaaatggaagaatattccatgckcatgggtaggaagaatcaatatcgtgaaaatggccatactgcccaaggtaatttacagattcaatgccatccccatcaagctaccagtgactttcttcac

SEQ ID NO: 44649 - DNA, 201 bp, Homo sapiens
acctaggaatccaacttacaagggatgtgaaggacctcttcaaggagaactacaaaccactgctcaaggaaataaaagaggatacaaacaaatggaagaayattccatgctcatgggtaggaagaatcaatatcgtgaaaatggccatactgcccaaggtaatttacagattcaatgccatccccatcaagctaccagtga

SEQ ID NO: 44650 - DNA, 201 bp, Homo sapiens
ttcagcaaagtctcaggatacaaaatcaatgtacaaaaatcacaagcattcttatacaccaacaacagacaaacagagagccaaatcatgagtgaactccyattcacaattgcttcaaagagaataaaatacctaggaatccaacttacaagggatgtgaaggacctcttcaaggagaactacaaaccactgctcaaggaa

SEQ ID NO: 44651 - DNA, 201 bp, Homo sapiens
atatctagaaaaccccattgtctcagcccaaaagctccttaagctgataagcaacttcagcaaagtctcaggatacaaaatcaatgtacaaaaatcacaarcattcttatacaccaacaacagacaaacagagagccaaatcatgagtgaactcccattcacaattgcttcaaagagaataaaatacctaggaatccaact

SEQ ID NO: 44652 - DNA, 201 bp, Homo sapiens
gggccaatattcaacattcttaaagaaaagaattttcaacccagaatttcatattcagccaaactaagcttcataagtgaaggagaaataaaatactttayagacaagcaaatgctgagagattttgtcaccaccaggcctgccctaaaagagctcctgaaggaagcgctaaacatggaaaggaacaaccggtaccagccg

SEQ ID NO: 44653 - DNA, 201 bp, Homo sapiens
aacagcggatctctcggcagaaactctacaagccagaagagagtgggggccaatattcaacattcttaaagaaaagaattttcaacccagaatttcatatycagccaaactaagcttcataagtgaaggagaaataaaatactttacagacaagcaaatgctgagagattttgtcaccaccaggcctgccctaaaagagct

SEQ ID NO: 44654 - DNA, 201 bp, Homo sapiens
aaaagcaaggctcaagacctacgtgaagaatgcagaagcctcaggagccgatgcgatcaactggaagaaagggtatcagcgatggaaaatgaaatgaaagmaatgaagcaagatgggaagtttagagaaaaaagaataaaaagaaaccagaaaagcctccaagaaatatgggactatgtgaaaagaccaaatctacgtctc

SEQ ID NO: 44655 - DNA, 201 bp, Homo sapiens
gtaggtctttaagggtccccaggtgattgtgatatagagccatgactgagaactcttcaatcagaagtcctggaagcaaggcacagcacttacgcatctgyaaagagacttccaaatagaagtgctgcccaagacagaggctttcccagcctcttggtcttcaaggtccagagcaagctgctgcagatccatcgcaggtgt

SEQ ID NO: 44656 - DNA, 201 bp, Homo sapiens
aaaactctttcaagaatgaacaaaacctggggtcgcctatggctctgcccccctacttaatgccaacatcaaatacctgttgcgtctacttcctgcttccrctggcacccctccacttaccttcccccgagagtcagtcaaagacaccatcatgcctcccttgagcacttcagcaccctctgactggtttccttgctccac

SEQ ID NO: 44657 - DNA, 201 bp, Homo sapiens
agtgaataagttttgctcttgaaggttctcctgcttacaatcaaagtaatttgcagacttgcctgatttgtatgtttcttcaagtcaagaataattctaakggattactcctgtcccttcagctataagataacagagtgagaacaaaaatggcttgtgaaatcaacctaacagagtatttcttctctcttctcataggtc

SEQ ID NO: 44658 - DNA, 201 bp, Homo sapiens
caagtgtttggaaacagtctggtttggtaatagtcactatgtttaaaccctgatgcagatgatgctgtgtatctggacaatgagaaagaaagagaagagtwtgtcctgaatgacatcggggtaattttttatggagaggtcaatgacatcaagaccagaagctggagctatggtcaggtgagccacttaaaatttgttatt

SEQ ID NO: 44659 - DNA, 201 bp, Homo sapiens
atggaatctggtggtcacagggtactttcttggctccggatgccttgctttgacttccatatgggatctccctgtgttccttacccactgctccagtaccygtgttatcctgcctacctggctttgtgaacagcttccctgactccggagaattacatgcccagtgctcaggcttccccgcctgcatttctaatgtcctgc

SEQ ID NO: 44660 - DNA, 201 bp, Homo sapiens
tgaaaagcaaggctcaagacctacgtgaagaatgcagaagcctcaggagccgatgcgatcaactggaagaaagggtatcagcgatggaaaatgaaatgaawgaaatgaagcaagatgggaagtttagagaaaaaagaataaaaagaaaccagaaaagcctccaagaaatatgggactatgtgaaaagaccaaatctacgtc

SEQ ID NO: 44661 - DNA, 201 bp, Homo sapiens
actctagaaagaagagcgcctctcctcctccaaaggaacgcagttcctcaccagcaaaggaacaaagctggacggagaacgactttgacgagctgagagamgaaggcttcagacgatcaaattactctgagctacgggaggacattcaaaccaaaggcaaagaagttgaaaactttgaaaaaaatttagaagaatgtataa

SEQ ID NO: 44662 - DNA, 201 bp, Homo sapiens
gggaaaaaacagagcagaaaaactggaaactctagaaagaagagcgcctctcctcctccaaaggaacgcagttcctcaccagcaaaggaacaaagctggayggagaacgactttgacgagctgagagaagaaggcttcagacgatcaaattactctgagctacgggaggacattcaaaccaaaggcaaagaagttgaaaac

SEQ ID NO: 44663 - DNA, 201 bp, Homo sapiens
actgcctcctcaagtgggtccctgacccctgacccccgagcagcctaactgggaggcaccccccagcaggggaacactgacaccttacacagcagggtatwccaacagacctgcagctgagggtcctgtctgttagaaggaaaactaacaaacagaaaggacatccacaccaaaaacccatctgtacatcaccatcatcaa

SEQ ID NO: 44664 - DNA, 201 bp, Homo sapiens
gaaggggcagactgcctcctcaagtgggtccctgacccctgacccccgagcagcctaactgggaggcaccccccagcaggggaacactgacaccttacacrgcagggtattccaacagacctgcagctgagggtcctgtctgttagaaggaaaactaacaaacagaaaggacatccacaccaaaaacccatctgtacatca

SEQ ID NO: 44665 - DNA, 201 bp, Homo sapiens
atgcagctggagatctgagaaggggcagactgcctcctcaagtgggtccctgacccctgacccccgagcagcctaactgggaggcaccccccagcaggggmacactgacaccttacacagcagggtattccaacagacctgcagctgagggtcctgtctgttagaaggaaaactaacaaacagaaaggacatccacaccaa

SEQ ID NO: 44666 - DNA, 201 bp, Homo sapiens
cattgcctcactcgggaagcacaaggggtcagggagttccctttcctagtcaaagaaaggggtgacggatggcacctggaaaatcgggtcactcacacccraatactgcgcttttccgacgggcttaaaaaacggcgcaccacgagattatatcccgcacctggctcggagggtcctacgcccacggagtctcgctgattg

SEQ ID NO: 44667 - DNA, 201 bp, Homo sapiens
atgagtgacgcagaagactggtgatttctgcatttccatctgaggtaccgggttcatctcactagggagtgccagacagtgggcacaggtcagtgggtgcrcgcaccgtgcgcgagccaaagcagggtgaggcattgcctcactcgggaagcacaaggggtcagggagttccctttcctagtcaaagaaaggggtgacgga

SEQ ID NO: 44668 - DNA, 201 bp, Homo sapiens
cagcaatccaggtaagacaaaatccacatacacacacccaaccatggtcttaccctggcctttgcaatctatgtcctgccatcccacaccatcacctgtggccagggagggagggttgagttgccaaaggaggaaggggagcctggaggctactctaagagaggaatacagcccacctacagggttgatgggaatgcctgg

SEQ ID NO: 44669 - DNA, 201 bp, Homo sapiens
ctgttggatttggaggctggcaagctgtggacagcaccccccaggaaaatagcgatggtaaaactgtgtcctccctctgggaacttgcttcattgctgatytttgttttgcttttatgcttgcatttgatgtgtgggaaccacgcccattgggaggcaacatctgaagtgtgcttcctgggcacatgtacagtattagcta

SEQ ID NO: 44670 - DNA, 201 bp, Homo sapiens
gtcaggaagaaagtcccctacaagaagggttttttcactctgtgtttattaaatgctggtgatgtgtttagctgtggtctgtcctttcctgtagttttacratgccttggaataccagcaagaattgttaccaattatttctctgcccatgataatgatgccaatttgcaaatggacatcttcctggaagaagatgggaac

SEQ ID NO: 44671 - DNA, 201 bp, Homo sapiens
gtgttttctaaggaactaccactgctggaatgaagcatggatgacaaggcctgaccttcctgttggatttggaggctggcaagctgtggacagcacccccyaggaaaatagcgatggtaaaactgtgtcctccctctgggaacttgcttcattgctgatctttgttttgcttttatgcttgcatttgatgtgtgggaacca

SEQ ID NO: 44672 - DNA, 201 bp, Homo sapiens
tacagagtcaccctcagtgccatgaatcttgcagtatctggacagaattggagatgacaaactcacaccgcccttcctctgtgcaatgcaggcatgtatcrgtgtggccccgcctcggttcaagccatcaagcacggccatgtctgcttccaatttgatgcaccttttgtttttgcagaggtaagcaggaagctggaggaa

SEQ ID NO: 44673 - DNA, 201 bp, Homo sapiens
cagccagaaacagaatgagagtggcaatcgttttattgataagaccctgggtgaacagggctgaaaatcaagaaaggaaaatgggaacgggaggcccgtgrcagctgccactgttgtttggggcattaagatcaagtcctttaaggagggggacccttgaatctctaccagactccagtttggacttccaaggttgttctg

SEQ ID NO: 44674 - DNA, 201 bp, Homo sapiens
tgataatgatgccaatttgcaaatggacatcttcctggaagaagatgggaacgtgaattccaaactcaccaaggattcagtgtggtgagtttgattgacartggcattggctgatgtcacattatagtaatgttacacatttaccacaagatagactcaatctgatgtttctgttctattttgaggaccattcaacagcac

SEQ ID NO: 44675 - DNA, 201 bp, Homo sapiens
cctcttcctcctggcagtaggtcacatagccacagttagcccaaaagaagtccagggaagcaagcgatgggcatggtggcatggcattgtcttctctcctrtgagaggtaggacttatcacaaggacagaggagggagaaaaatggttgcttcttagacagtttattatctcagcctcaaataatctttatttaaagtact

SEQ ID NO: 44676 - DNA, 201 bp, Homo sapiens
gtgtcactcaatccacgagagttgtgtgtttcaagaggaaagcatgaccaatgttattaaatataactaggagatgcagtgagataggaacttcccactggagtcaacagttgggggacactggttgaactcgggtagattccaaattttaatggtctaaaagtcaaggagatgtgaggaaatgggtgtagtcaatttgga

SEQ ID NO: 44677 - DNA, 201 bp, Homo sapiens
cggggtttcaccaagttcgccaggatggtctcgatctcctgacctcgtgatctgcctgccttggcctcccaaggtgctaggattacaggcgtgagccaccragcccggccgtcctccatacattttttatctttgagcttgtcatttactgagtcttcacaatgtgccaacagtgtgctctgtgtttgcattagttttatg

SEQ ID NO: 44678 - DNA, 201 bp, Homo sapiens
ctgtcaccaggctgaagtgcagtggcacaatctcagctcactgtaacctccatatcccagattcaagcgattctcctgcctcagcctcccaagtagctggractacaggcacccgccaccacacccagctaatttttgtatttttagtagagacagggtttcatcatgttggcaaggctggtcttgatgtcttgaccttgt

SEQ ID NO: 44679 - DNA, 201 bp, Homo sapiens
ctggtgtgtagtgggtacatagtgaaattaatatctcttgaaccaatcaaaaatgggctgcactcagagaaagatgggagcatgggcaaacagctgacatygaagggcgtctaggcacggaacccgtggtagttgaacctgaaattcatcagtgtcataaacaaagactgctgtaactacctcaccacattattaaatctt

SEQ ID NO: 44680 - DNA, 201 bp, Homo sapiens
aacagacttccctgcattgcattacatgctagcccctgccctatcttttcttctgtcttacaacctagatcacttttttttttttttttttagacagggtytcactctgtcttccaggatggagtgcagtggtgcaatcatggctcactgcagccttgatctcccgggctcaagtgatcctcccactcagcccctcaagta

SEQ ID NO: 44681 - DNA, 201 bp, Homo sapiens
cagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaaa

SEQ ID NO: 44682 - DNA, 201 bp, Homo sapiens
ccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaa

SEQ ID NO: 44683 - DNA, 201 bp, Homo sapiens
cccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaa

SEQ ID NO: 44684 - DNA, 201 bp, Homo sapiens
acccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaa

SEQ ID NO: 44685 - DNA, 201 bp, Homo sapiens
gaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaa

SEQ ID NO: 44686 - DNA, 201 bp, Homo sapiens
ggaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacacta

SEQ ID NO: 44687 - DNA, 201 bp, Homo sapiens
tgcttgacaggtctcagtttctgtgacttctactaacaaagagtgtgacccaacaagataacccattccatggtcaggtagctctaacagtaaggaaacakgtttttctaccatttgatcctgccaatgatcctaattctgccatctggactgacagaaagtaaggcccatctcttttccatctgatggtttgcaaatgtt

SEQ ID NO: 44688 - DNA, 201 bp, Homo sapiens
gatgaatggtctccaatgaacagataacgttcaaccagtagagatggatggagagaccccttcagatactaggaagaaaatgttagcaagggctagagggraggtggacggcagtatgtagagcagtgagaagcgtgccttggctggggtggaggctgggagcagggatgagtaagggtaacctgaaaaagatagcttgag

SEQ ID NO: 44689 - DNA, 201 bp, Homo sapiens
ctgtcacaaggatgtgtcactgtagggctttctcacttacgaagtgggtattgattctttgcaggatcctgtgtggtaagtagggcagccattactcatgsacttttacaagttaggacacagggtaaggacagctttcagtgacaaagccacagctagaactccggtctgctgacttcaaatctagacattttctacttt

SEQ ID NO: 44690 - DNA, 201 bp, Homo sapiens
agaggacaggtctgtgcggctgtccatccagtcttcccccaaatgtattgtggggaaattccgcatgtatgttgctgtctggactccctatggcgtacttygaaccagtcgaaacccagaaacagacacgtacattctcttcaatccttggtgtgaaggtaagaggcagacatttagttttctcatttaaaaattcaccta

SEQ ID NO: 44691 - DNA, 201 bp, Homo sapiens
catttgaccagtagttttcatgatgcctctccagtgatcaccagaaatctctgcccaaatggctcaagagacttggcagaggaaggccgagggttgatgakagtggaagataaatgtgggagcctctgtgctcctacttctcaggcccacagctgtagcttctgggggcatctgtggttgcatccatgagacgccttcctg

SEQ ID NO: 44692 - DNA, 201 bp, Homo sapiens
caaagcagctactccattctgtattcccactagcaatacacaaaagttccaacttcatattcttgcaaataacttttattttctgttttttttttttttttaattattattgtagccatcctaatgggtgtgaagtggtatttcatggtgggattaattttcatttctctaatgaccaatgacgttgaacatctttttgtg

SEQ ID NO: 44693 - DNA, 201 bp, Homo sapiens
actgtattcctctagcctgggtgacagagtgagacttggtctcaaaaataaataaataaaaataattaacatccttattaaaatatgcttcacggcctggygaggtggctcacacctgtaatcccagcaatttaggaggctgaggcaggtggatcacaaggtcaggagatcaagaccatcctggctaacacagtaaaaatc

SEQ ID NO: 44694 - DNA, 201 bp, Homo sapiens
atcaggagtttgagaacagcctgaccaacacggtgataacctgtctctactaaaaatacaaaaaaattagctgggcgtggtggtgcatgcctgtaatcccygctacttgggaggctgaggcaggagaatcacttgaacctgggagacagaggttgcagtaagccaagatcatgccactgtattcctctagcctgggtgaca

SEQ ID NO: 44695 - DNA, 201 bp, Homo sapiens
atcccagcactttgggaggccgatgcaggaggatcacttgagatcaggagtttgagaacagcctgaccaacacggtgataacctgtctctactaaaaatasaaaaaaattagctgggcgtggtggtgcatgcctgtaatccccgctacttgggaggctgaggcaggagaatcacttgaacctgggagacagaggttgcagt

SEQ ID NO: 44696 - DNA, 201 bp, Homo sapiens
agaacctgaattacaaacccaagggggctgaccccagagcccactctttttaaaatgacatccttattgactgggcgtggtggctcacacctataatcccwgcactttgggaggccgatgcaggaggatcacttgagatcaggagtttgagaacagcctgaccaacacggtgataacctgtctctactaaaaatacaaaaa

SEQ ID NO: 44697 - DNA, 201 bp, Homo sapiens
caatgccctgatttaagtgctgacatgtattaatttacttctacctcttaacagcatgttaaggtaattactgttagtggcacggtaacttaaccaaggtyccagccaataagtggcagaacctgaattacaaacccaagggggctgaccccagagcccactctttttaaaatgacatccttattgactgggcgtggtggc

SEQ ID NO: 44698 - DNA, 201 bp, Homo sapiens
aaattcagaatgtagaccaaattgcttaaagatgcttaagggtttgtaaaaatatcccatgatgcattgcagttgccaattctggacagttatcagagatkcttattttcaaacattttcttgttaaccatatttctggccaagttggttttaggaaaatcacctggagttagaccatgagccttagcattagaggactga

SEQ ID NO: 44699 - DNA, 201 bp, Homo sapiens
gatctttgttggtttaaagtctgttttatcagagactaggattgcaacccctgcctttttttgttttccatttgcttggtagatcttcctccatccttttrttttgagcctatgtgtgtctctgcacgtgagatgggtttcctgaatacagcacactgaagggtcttgactctttatccaatttgccagtctgtgtctttt

SEQ ID NO: 44700 - DNA, 201 bp, Homo sapiens
atatgcggtgtttggttttttgttcttgtgatagtttactgagaatgatgatttccaatttcatccatgtccctacaaaggacatgaactcatcattttttatggctgcatagtattccatggtgtatatgtgccacatattcttaatccagtctatcatttgtggacatttgggttggttccaagtctttgctattgtga

SEQ ID NO: 44701 - DNA, 201 bp, Homo sapiens
gagtgttatgttccccttcctgtgtccatatgttctcattgttcaattcccacctatgagtgagaatatgcggtgtttggttttttgttcttgtgatagtwtactgagaatgatgatttccaatttcatccatgtccctacaaaggacatgaactcatcattttttatggctgcatagtattccatggtgtatatgtgcca

SEQ ID NO: 44702 - DNA, 201 bp, Homo sapiens
tgtgctcctgagggcccttcagcctgctttgcattcataggcaatttatcctccttaatcactaaatcattaatggggatcaatagcaatgccacatcagwgaaggcaggggtgcatgcggggagaataattgcttgcttagtttttagtttagtggtgctaaccgggcttcgggtccattctgggaggaaacccttctcc

SEQ ID NO: 44703 - DNA, 201 bp, Homo sapiens
ccaaaaactcattgcaattgttaaaaatgacaaaaagatagttatttggcattctccatatctcttccttaaaaacacacagacacacacacacacacacmgacagacacacagacacacacacacagcctttgtagctaagtgcagttcaaagttatctttcccagctccttgattcaggtacctcccatcatcaaataa

SEQ ID NO: 44704 - DNA, 201 bp, Homo sapiens
ggttcctagtgataaaaatcaatcattccttataatagcaaccaccaaaaaaaggtcatagttttagctgctgcatatgcctatactagttcctctctacyttgatatattaatattacagttaatagcagaagtattggagccaagcgttctctgggtcagtgccctgggactaatagagctaacatttatttagtattt

SEQ ID NO: 44705 - DNA, 201 bp, Homo sapiens
tgtctggtgtcctgggaggcagggagggcatttggattaagtttaatcagtaggtacatatggcaagaaaggtattcagataatttgttatctattaaaaygaactaaaatgaatctgtggtgtcacccaccaatgcatgtcacaggagcaaattctggccaagacagcaaattccaccaaggacctactctgtaaattcc

SEQ ID NO: 44706 - DNA, 201 bp, Homo sapiens
ttctgaaggagaaaataaaaaggcaagccaagtcattaatcttaaaattgtcagctgaattattttcaatgagccctgatgtctggtgtcctgggaggcakggagggcatttggattaagtttaatcagtaggtacatatggcaagaaaggtattcagataatttgttatctattaaaatgaactaaaatgaatctgtggt

SEQ ID NO: 44707 - DNA, 201 bp, Homo sapiens
ggtgaacagggctgaaaatcaagaaaggaaaatgggaacgggaggcccgtggcagctgccactgttgtttggggcattaagatcaagtcctttaaggaggrggacccttgaatctctaccagactccagtttggacttccaaggttgttctgttgaaggaggtgggtagtctttggttaaaaatgctaaactattctgaag

SEQ ID NO: 44708 - DNA, 201 bp, Homo sapiens
attgataagaccctgggtgaacagggctgaaaatcaagaaaggaaaatgggaacgggaggcccgtggcagctgccactgttgtttggggcattaagatcargtcctttaaggagggggacccttgaatctctaccagactccagtttggacttccaaggttgttctgttgaaggaggtgggtagtctttggttaaaaatgc

SEQ ID NO: 44709 - DNA, 201 bp, Homo sapiens
gggataatgtgaattagtgttcagccagaaacagaatgagagtggcaatcgttttattgataagaccctgggtgaacagggctgaaaatcaagaaaggaaratgggaacgggaggcccgtggcagctgccactgttgtttggggcattaagatcaagtcctttaaggagggggacccttgaatctctaccagactccagtt

SEQ ID NO: 44710 - DNA, 201 bp, Homo sapiens
gaggaacaggtgccctaaagtcaagcctcactttcttgaaattatgagtaaggcagagtcttgaccaagtcgtgtctgggataatgtgaattagtgttcakccagaaacagaatgagagtggcaatcgttttattgataagaccctgggtgaacagggctgaaaatcaagaaaggaaaatgggaacgggaggcccgtggca

SEQ ID NO: 44711 - DNA, 201 bp, Homo sapiens
ctaaaataataaataacaaaagatatatattgcttatttatcattgagaagttgtataaatatgcgtatttatttattattgagaattttataaatatatmcacttaatttttatcccagttatggaaggtattatagcaggtggtctcatattcatttttccacatttctcaatgcccctgagcaattagagatcagaac

SEQ ID NO: 44712 - DNA, 201 bp, Homo sapiens
ggcatgtgccactatgcccagctagtttttgtatttttagtagagatggggtttcaccatgttggccaggctggtcttgaattcctgacctcaagcaatcyatctgcctcatcctctcaaagggctgggattacatgcctggccaaaaagatcagcattttgattatatttattactttctagaatttaaaatataaatta

SEQ ID NO: 44713 - DNA, 201 bp, Homo sapiens
gtctacccagctctggagtgacactgggcattgtctgcacagaatcctgtgatgtgagccatctctgggtccctctcagccaccggaatagcgcctattcyggtggaggtggcagggggtacaatggacactgttagggttcttagctttggtgtttaatgctctatttttgtgctggttggctccctgccaggaggtggt

SEQ ID NO: 44714 - DNA, 201 bp, Homo sapiens
acacaggccacttcaaattgtgcttgacaggtctcagtttctgtgacttctactaacaaagagtgtgacccaacaagataacccattccatggtcaggtarctctaacagtaaggaaacaggtttttctaccatttgatcctgccaatgatcctaattctgccatctggactgacagaaagtaaggcccatctcttttcca

SEQ ID NO: 44715 - DNA, 201 bp, Homo sapiens
aagaggctgaagatagggttccaatcccttctagattgtagggtttctgctgagaaatttgctgttcatctgataggttttcttttataggttacctgatscttctgtctcacagctcttaagattcttttctttgtcttaactttggataacctaatgacaatgtgcctaggcaaagatctttctgcaatgaatttcctg

SEQ ID NO: 44716 - DNA, 201 bp, Homo sapiens
ttagcagttcttgtagtggtggcttggtaatggtgaattatctcagcatttgtttgtctgaaaaaggctgtatctttctttcatatatgatgcttagtttygctggatacaaaattcttggctgataattgttttgtttgaagaggctgaagatagggttccaatcccttctagattgtagggtttctgctgagaaatttg

SEQ ID NO: 44717 - DNA, 201 bp, Homo sapiens
gttgaaatgtgaggtaccattacattcatcatgctctttgttgcctgtgtactttggtttttttgttttttgtttttgctttttaacttgtatttttgttycataggtcctgtgtgatttatgctttaaagaagttctgttttgatgtgtttccaggatttgcttcaagatttagagctccttttagcagttcttgtagtg

SEQ ID NO: 44718 - DNA, 201 bp, Homo sapiens
ttcagttctgtatcttttaaatatagcatttaggccatttacattcaatgttagtgttgaaatgtgaggtaccattacattcatcatgctctttgttgccygtgtactttggtttttttgttttttgtttttgctttttaacttgtatttttgtttcataggtcctgtgtgatttatgctttaaagaagttctgttttgat

SEQ ID NO: 44719 - DNA, 201 bp, Homo sapiens
ccattcttcagttctgtatcttttaaatatagcatttaggccatttacattcaatgttagtgttgaaatgtgaggtaccattacattcatcatgctctttsttgcctgtgtactttggtttttttgttttttgtttttgctttttaacttgtatttttgtttcataggtcctgtgtgatttatgctttaaagaagttctgt

SEQ ID NO: 44720 - DNA, 201 bp, Homo sapiens
aggttatttggattttctctctttttggttaattttgctaatgatctatcaattttatttatctttttaaataaccagctttttgtttcatttatcttttrtatttttgtttgtttcaattttgtttagttctgctctgatcttggttatttcttttctcctgctgggttagggttttgtttgttcttgtttctccagttc

SEQ ID NO: 44721 - DNA, 201 bp, Homo sapiens
agtccttggggttttcaaggtaaacaatcatatcgtcagcaaacagtgacagtttgacttcctctttacctatttggatgtcctttatttctttctcttawcttattgctctggctaggacttccagtactatgttgaagaggagtggtgacagtgggactccttgtcttattccagttctcagaggaaatggctttcaac

SEQ ID NO: 44722 - DNA, 201 bp, Homo sapiens
cccgggttcataccattttcctgcctcagcctcctgggtagctggggactacaggcgcccgccaccaggcctggctaatttattgtatttttagtagaggyggggtttcaccaagttcgccaggatggtctcgatctcctgacctcgtgatctgcctgccttggcctcccaaggtgctaggattacaggcgtgagccaccg

SEQ ID NO: 44723 - DNA, 201 bp, Homo sapiens
gtaacagttttattaagaaaaattttaattacaaagcaatatctaacccatcctttggtttataaagcagcttaaacctctttttttggagtgaacggtcrtagatacatctgaggacccaggtgctcaatgggcattgtccttggcatttctaaatcaccaaggaactttttcgcatttacccatatggattttaatttt

SEQ ID NO: 44724 - DNA, 201 bp, Homo sapiens
gttcaacctggcttataaagaaaggtattttcaaagtgatgcaaagaatactgcaaggggtgtgcccaattcaaagaaatagcttctttttttttttttttaagtgttagcctagggtactgctaattagaaaagagtgttatcatttcatcaaaggaagggccactgagcttttacatagaaagattttatcagctgcaa

SEQ ID NO: 44725 - DNA, 201 bp, Homo sapiens
atctcattagttcaacctggcttataaagaaaggtattttcaaagtgatgcaaagaatactgcaaggggtgtgcccaattcaaagaaatagcttctttttktttttttttaagtgttagcctagggtactgctaattagaaaagagtgttatcatttcatcaaaggaagggccactgagcttttacatagaaagattttat

SEQ ID NO: 44726 - DNA, 201 bp, Homo sapiens
gtgagccacttaaaatttgttattgtcaaggacatttttacttcatattttttgtcacatgtatccctacaggatcccatatatcgatattagacaagcayaatttcctgctttttaggatctgagactccaaggcagagagcataggagtagggactcataaagacaactgcgtaatttatcagctgaaaccacatatct

SEQ ID NO: 44727 - DNA, 201 bp, Homo sapiens
aaatgtcatcatttacagactgaatttggtgctgattatgttcaccattactaaaaatattgggaaatgagctatgcttggtgaaacaaagggcattttttaaaaatttggctgattaaatgtagtttagaaacaaaataaacttgcataaacttgcaagtgtttggaaacagtctggtttggtaatagtcactatgttta

SEQ ID NO: 44728 - DNA, 201 bp, Homo sapiens
gactcatttaggtgaatgccaaagatgacgaaggtgtcctcgttggatcctgggacaatatctatgcctatggcgtccccccatcggcctggactggaagsgttgacattctattggaataccggagctctgagaatccagtccggtatggccaatgctgggtttttgctggtgtctttaacacatgtaagtatccaactg

SEQ ID NO: 44729 - DNA, 201 bp, Homo sapiens
tttttttggaggaaggggcaaaaatatttcataagtcacgccattgcttcctaggacattcatcctggcagaagatacatatatttaggtttgtcaatagyatctggttcacgttttatcagtctcatccacccgttacgaagttctcttcttaacgaattatttctgcctcaattcgttacttcattagggattgcaaga

SEQ ID NO: 44730 - DNA, 201 bp, Homo sapiens
ttggctattttctctctctctctctctctttttttttttttttttttttgggacagattctagctctgttgcccagcctggagtgcagtagtgctatctcrgcctcctgggctcaagcgattctcctgcctcagcctcccgagtagctaggattacaggcacacaccaccatgcctggcttatatttttatttttagtaga

SEQ ID NO: 44731 - DNA, 201 bp, Homo sapiens
atttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcctgcctcagcctcccgagtagct

SEQ ID NO: 44732 - DNA, 201 bp, Homo sapiens
tgttcttcacagctggctcttcctatagacatgtgggaccccctgctgcaggcctgtcccagctgcttggtggaagcagcttttgctacccttctgggctrttgcgcaggtttcatttatgagctcaaccctgaaccttccctgacagcagcaaggcctgtgtgcgtacctaattatgaagtgacggcctgtccctgtgaa

SEQ ID NO: 44733 - DNA, 201 bp, Homo sapiens
aatttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcctgcctcagcctcccgagtagc

SEQ ID NO: 44734 - DNA, 201 bp, Homo sapiens
gtcctaacttttggagcaaactcctcataaagcagcatgttctcccatgcttgaagcttagtctggaatctttgggttagagggaatgactgtttggttcrtggctgtatctcacttaaaacagtgcctagggccaggcacagtggctcacgcctgtaatcccagcacattgggaggccaaggcgggtggatctcttgagg

SEQ ID NO: 44735 - DNA, 201 bp, Homo sapiens
aaattggggtccaaagtttaatttacctttgggcaagtccttcaatctttcttctttttcaacatattagtttttggctattttctctctctctctctctytttttttttttttttttttttgggacagattctagctctgttgcccagcctggagtgcagtagtgctatctcggcctcctgggctcaagcgattctcctg

SEQ ID NO: 44736 - DNA, 201 bp, Homo sapiens
gacagagagagcacaggagacacaccctgacatctcccctcctcctgcttccaatcctctctttggccgaacctacctcgaagtcagagagcagaggagcrtgggaacatggcttcctgtggaacctgacagaagattctaggggtgcaggcaataggtctgagaacagccagtctgtcaataggtggagttgctgagaca

SEQ ID NO: 44737 - DNA, 201 bp, Homo sapiens
taaggattgttattaagaagttatttatcattattgttgctacgatttgaaagtagagggggtcgctgtttgtacttacatggcttcctccagagggaatkcccgaattctcagacagctcatttaaagcttccaaaatgacaaatattccacaggtatctgctgcgtcctctcctgtcctgattcctgacttcacatttc

SEQ ID NO: 44738 - DNA, 201 bp, Homo sapiens
acatcccaccccaacacacatatacaaaagccaccccatacaggtgtttctcgtctcctctctccgcaaaggacagtgctgttggtctgtcctgagatttyagcctacaggaatttctgaagccatattcaaggtgggggggcaggaatcagccactttcatattttgcttgtttccctggaaaaccacaagctgttataa

SEQ ID NO: 44739 - DNA, 201 bp, Homo sapiens
tcactctgtgtaggaagaatgctttgcatgctttgttccctctctgcattcaagtctctgctctggtcacctcttcaaagaggccttcgctcacccaactscacctaaaatatcaccatctgccctgttgttttcatcctccaaccttagtgtgtactccatttctcccttctagaatatgagctccatgaaggtagaagc

SEQ ID NO: 44740 - DNA, 201 bp, Homo sapiens
tacaataaaactgaacataaattcctacaagattccatggcttcccttccacttcatcccttgtttatttccctccagccatactgagatttttctcttcrgaaagcatccacacatcctcttgtgtcagcacttttagacatactgctccttttgctaggaaagctcccctcactatctttcactctgtgtaggaagaat

SEQ ID NO: 44741 - DNA, 201 bp, Homo sapiens
attataattactcctttctcacccactgcagaggcgtgtctgacagagggtacaatttgttgctttggcatgggctgcgctccaggggctgagccattttkaagagatgtttgagttgatgaaaagtgtatgaggaatcttttctcaagggtgcctgcagtgggaccccatggggagtgtcatatgagtcgatatgactca

SEQ ID NO: 44742 - DNA, 201 bp, Homo sapiens
aatgttaatatttagaaagcaaaacgaacatcaaaattcagacagcaagatcaggaatttgaaacacacaaaagaccagtgttcatctcatcgtacctgcygtggcagtttacagaagcctttggagaccaagcttactggacttggaattttatcccctcgttttcactttgggatttgaagatttccacaaacctccca

SEQ ID NO: 44743 - DNA, 201 bp, Homo sapiens
gaatgcatactggtaaccattgcactctagtactccaggaggaacaaatagttattattaatgtacaccaggcattgtactggggggaattctaaggttcragtctttaagaaacgtatttctagatgccaggtgacagggcacaaacacactgaacatgaaataacaacaatacttgtcaggtgggccatgtagagagca

SEQ ID NO: 44744 - DNA, 201 bp, Homo sapiens
aataaaatcgaggcaaagagtgattaagtgactttctcacaaccatctagctaataaatagcagtgctaagatttgaagccaggcagatacctgaatgcayactggtaaccattgcactctagtactccaggaggaacaaatagttattattaatgtacaccaggcattgtactggggggaattctaaggttcaagtcttt

SEQ ID NO: 44745 - DNA, 201 bp, Homo sapiens
ataaattggggtccaaagtttaatttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcc

SEQ ID NO: 44746 - DNA, 201 bp, Homo sapiens
tttatctgatggaaaagtctcattatagaaataaaaaataataaaagcataaaaagagctcaaagatctacaaattagagacactaacaattaacattttsttgtaatgtcatccatttaaagtattttcagtgcttttcatttttaattggcaattaattgaatatattgttcttttcaaataaacacacatgtacattt

SEQ ID NO: 44747 - DNA, 201 bp, Homo sapiens
tatgatgaaccgctccccccaacacacacacaagcacatacactgtagcccagcagtcccctgcagttttatgcttgtgtgtgtgttaatgcataacaaargattcagcgctatggcctggtaactggaaagtaggtcaaaagagaggggtgagactgtcgcccaagtgaaaaagatagcagaagataagaaggaaaactg

SEQ ID NO: 44748 - DNA, 201 bp, Homo sapiens
atatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcctca

SEQ ID NO: 44749 - DNA, 201 bp, Homo sapiens
tcacctggagggtcaccacgcttggagcacatcagaatcacctggagggtcaccacgcttggagcacatcagaatcacctggagggtcaccacgcttggarcacatcagaatcacctggagggcttgttcagccacttctgtgcagcaccctcaggttgagtaggtctgaggcctggcctgagaatttgcatttctaacca

SEQ ID NO: 44750 - DNA, 201 bp, Homo sapiens
tatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcctc

SEQ ID NO: 44751 - DNA, 201 bp, Homo sapiens
cagtgatggaagcagcgagaaccagtccgatctgggcatgtgctgaaggtggagcccgcctgattggctgagagactggatatgtggtgtgagagaaggarggtatggaggaagccaaatgagtgatgaatgtgaaatgtgtgccacatggtagaatcttagtaaatggtaacttccaacatgtttacatttggggaaact

SEQ ID NO: 44752 - DNA, 201 bp, Homo sapiens
gtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcct

SEQ ID NO: 44753 - DNA, 201 bp, Homo sapiens
cacacacaccccggggttcttgattcattcccctaacctttatttagtgcttgcaagtccaggttctgttttatgctggagacacagcaatgcctattctkactgaatttctgatctcatgggggaaccaaacaaacaagtgaatctatagtatagttatatgggtaatagaaaaatacaaagcaggttaaggaaaacggg

SEQ ID NO: 44754 - DNA, 201 bp, Homo sapiens
ttgcaaatagacaattctggatgtaagcgatgactgtgtcacctaccagctgtgtttcctgagcaaggtacttaagcactctgagctgtctctcctcatcygcaaaggggaaaaacagcacacacaccccggggttcttgattcattcccctaacctttatttagtgcttgcaagtccaggttctgttttatgctggagac

SEQ ID NO: 44755 - DNA, 201 bp, Homo sapiens
agctctccatcaccttccggaacaacagccacaaccgttacaccatcacagcttatctctcagccaacatcaccttctacaccggggtcccgaaggcagarttcaagaaggagacgttcgacgtgacgctggagcccttgtcctgtaagctaacaatggtgtggttctttgtgagactcgctgtctggcccctgtcttgct

SEQ ID NO: 44756 - DNA, 201 bp, Homo sapiens
ggcatgggtgttgggggcaatggcaattgagtgagatagggaagaacggggcaggagccctcaagggtcagctcagcaaacagcaagtgggacaggcccargtggaaggagagatgaggaagacaggtcttattggggggcaggtattcacaaatcagagagaaaagttacattgcaggaggtggaatggcaagaggcaat

SEQ ID NO: 44757 - DNA, 201 bp, Homo sapiens
agcaggaagctggaggaaagtgctgtttttctccccaacctcttaacacatgaaagagtaagctaaaagttgttgtttctaagttttccaggtacatagcrtatgcttcgtgttgacaaaggtaactaggcattattccaacttccaggctattaatgctaaatgcagttcttgtttaacatttttctttccttgatgttt

SEQ ID NO: 44758 - DNA, 201 bp, Homo sapiens
aaatcagcaatgaagttgggaacactggtctttacagagtcaccctcagtgccatgaatcttgcagtatctggacagaattggagatgacaaactcacacygcccttcctctgtgcaatgcaggcatgtatcggtgtggccccgcctcggttcaagccatcaagcacggccatgtctgcttccaatttgatgcaccttttg

SEQ ID NO: 44759 - DNA, 201 bp, Homo sapiens
taaatcagcaatgaagttgggaacactggtctttacagagtcaccctcagtgccatgaatcttgcagtatctggacagaattggagatgacaaactcacaycgcccttcctctgtgcaatgcaggcatgtatcggtgtggccccgcctcggttcaagccatcaagcacggccatgtctgcttccaatttgatgcacctttt

SEQ ID NO: 44760 - DNA, 201 bp, Homo sapiens
catggggacattttacaggtgactaatagcagctaatctcttattaactatatagataggtggttaaaatttaaagcattttagaagagtaacataggccytctgacttcctaaatgcatggtgggcatggccaaaatgcacaggcaatgtccaaattctccagttaaacttgacatatgttcataatgtccaaaaacaaa

SEQ ID NO: 44761 - DNA, 201 bp, Homo sapiens
cattgaagggcgtctaggcacggaacccgtggtagttgaacctgaaattcatcagtgtcataaacaaagactgctgtaactacctcaccacattattaaayctttctttattactatatgaacattttctatagtgctgaggggttaatgtgctctcatttgattctgtactgtcatataatttcaggtcttttcaaggac

SEQ ID NO: 44762 - DNA, 201 bp, Homo sapiens
atttagatcttcttcttaaattattccaatggctttttatagcctaagaataaagcatgaatgtttaatttgatatcaaaggatttcacaatcttatcctyacctatatcataggtcagtgttgaagagtgtggatttcagagctctatcactaactagctgtgacctcagcaaggttcttaaccttcctgggtttcagct

SEQ ID NO: 44763 - DNA, 201 bp, Homo sapiens
ggtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcc

SEQ ID NO: 44764 - DNA, 201 bp, Homo sapiens
gcagggtcgcctttttaatgtcttgccagagcccagcatccttggggactgggggatgcaagttttggtagaaccttctgccatggcatgggtgttggggrcaatggcaattgagtgagatagggaagaacggggcaggagccctcaagggtcagctcagcaaacagcaagtgggacaggcccaagtggaaggagagatga

SEQ ID NO: 44765 - DNA, 201 bp, Homo sapiens
cccttcatctccaccacaaccactttgcaaaccctgcacaaaacattttcctaaaagcagcacacacacctcgaactgcattagaacttaggtgcaccacygcctgtcaacagatgtccctcaaaaaactgccctccgtgtcagatgagtttgggaaaccttgtgtaaagaaaggcaaagaggtgtccttgctgctgggct

SEQ ID NO: 44766 - DNA, 201 bp, Homo sapiens
gctgtgaagttgcttgtggctggcttcaaggcttcttctcccattcacctcaccttggccagctcagctcctctctgatgtgttcctgatgctcgaatttscctcctgcattttgcctcaatgcatctctggcccgcatccaaagtgatcatcattaatgttctcttctcatggatctattggccagatgatttctgctaa

SEQ ID NO: 44767 - DNA, 201 bp, Homo sapiens
cctgcacccatggcaggctgtgaagttgcttgtggctggcttcaaggcttcttctcccattcacctcaccttggccagctcagctcctctctgatgtgttmctgatgctcgaatttccctcctgcattttgcctcaatgcatctctggcccgcatccaaagtgatcatcattaatgttctcttctcatggatctattggcc

SEQ ID NO: 44768 - DNA, 201 bp, Homo sapiens
atatagtgcctgacacataataagtgtccaataaaagtttcccctattactagtaattctgttattcctgccatactactgctattagtttgggctatgawtagttttctcctggaaaaatacttgctctagcttcccaattccacctcacctcctcaggccctccttccctcagtctagcccctgccttgctgccaaagt

SEQ ID NO: 44769 - DNA, 201 bp, Homo sapiens
tttcctgtagttttacgatgccttggaataccagcaagaattgttaccaattatttctctgcccatgataatgatgccaatttgcaaatggacatcttccyggaagaagatgggaacgtgaattccaaactcaccaaggattcagtgtggtgagtttgattgacaatggcattggctgatgtcacattatagtaatgttac

SEQ ID NO: 44770 - DNA, 201 bp, Homo sapiens
atccacatagatggttgtaagcgacgactcatcctgcttcggggctggagtttgaccccaagtggatagtttcttaatcaagggtggcatacacatttcaractggaactttggaagtgaccaagtagaatgttgttttgagaagaacaccaagactgcatctgaatgtggcgggtagaaggattgatggccgccattggc

SEQ ID NO: 44771 - DNA, 201 bp, Homo sapiens
tggaatccatgaagtgctaaggagtgcagaatttattttaaatagtttagacagtctccctgctcttatttacaaaagtaatttgcactacaaagaagaarcttgctgaattgagaacacttgtgcatagtctcagaaagtcagaatttttgttatctgaactagtgaattttcactgtattttttaaatgcttcattttc

SEQ ID NO: 44772 - DNA, 201 bp, Homo sapiens
ataatgtcatggtgggtttttgttaacttttattgcatagaatgtttcaaatggcactactgagtttaattctatctcaatcaatgcttagtgtccgctcyatgcctgcaattggtttggtgctggcgattccagcagtgagcaggactcagttcctgtcctggtccgagtgacaggattattgtgcagaggggtctttgg

SEQ ID NO: 44773 - DNA, 201 bp, Homo sapiens
caagcgatgggcatggtggcatggcattgtcttctctcctgtgagaggtaggacttatcacaaggacagaggagggagaaaaatggttgcttcttagacartttattatctcagcctcaaataatctttatttaaagtactactaaatcaactagattcgcctttagaatattttcaaaacctgtttggccctatgatacg

SEQ ID NO: 44774 - DNA, 201 bp, Homo sapiens
tgggtttctgcattgatgatcaacgtgtttatttttaagcatctctgtgaagtgactaataatggcatctaagaaagtaggacagtgtttcccagagtgtrttctctatgaacacctgtcatgtgagattctccttgggggaaaaaagttccatcatcaaatacagttggatcatgctgtgttttgtgtctcttctcatag

SEQ ID NO: 44775 - DNA, 201 bp, Homo sapiens
acatgttggctatagttaattatactatactatatatttcaaaattgccaggagagtaaatttcaaatgtttgcaccacaaaaataaatatgggaggtaakcgatatgttattaacttaattatcctgcaatgtgatttgattttatatatatatgtaaaatcatcactttgtaccctataatatatacaattatacaatt

SEQ ID NO: 44776 - DNA, 201 bp, Homo sapiens
gaatcagttggtattttccaacctggagaatcagtagatgaaattaggaaaagtctgtacggaaggaataagtgtttgagatcaaatatacaacatgttgkctatagttaattatactatactatatatttcaaaattgccaggagagtaaatttcaaatgtttgcaccacaaaaataaatatgggaggtaatcgatatgt

SEQ ID NO: 44777 - DNA, 201 bp, Homo sapiens
gggagaaaattatacaaaattatgcaaaaggtagtgggagtcatttaaaattctgctctgcatgtgattttgaaacactaatatgccatggatgtctttcytgcctagtcaatatagatctgcatttttatggctgaatagcattctattctgtttcaaaatacttgatcacatgttggacagttaggctgcttccatgct

SEQ ID NO: 44778 - DNA, 201 bp, Homo sapiens
aaataaataaatagtcctcagtgtttcggagggaacctaatacatgtttattatgcagtattttaaatgttgcagaaaaaataccaaagtaagaagtatcyattttctaactactcagaacatctgtaacatttccttaacccttctgtaatatgtctctttgtgtgtcgtatgcatgtttttaatgctgcataccaaagt

SEQ ID NO: 44779 - DNA, 201 bp, Homo sapiens
acacgtaatcacaccatggggaaaaatgaaaggagaagaaaaaaagaaagctggataatcagcccctaattttctaaaaattgctattaacaaagctgctktacaattctcttgataaatatccaagaaatctgttcttggaagcttaagaagagagtggaaaggctgtactctcaggactaaggaaggactcactcccta

SEQ ID NO: 44780 - DNA, 201 bp, Homo sapiens
gaatgatatttcattgtgtggataaaccaggttttatttatccattcatcagttgtacatttgggttgtttccatttttggctttcatgaataatgttgtwatgaacattcaggtaaaagtttttatgtgaacatatgttttttatttctcatgggcatatatttagagtggaatttctgggttgtatggtaactctatgt

SEQ ID NO: 44781 - DNA, 201 bp, Homo sapiens
gctgaccccagagcccactctttttaaaatgacatccttattgactgggcgtggtggctcacacctataatcccagcactttgggaggccgatgcaggagkatcacttgagatcaggagtttgagaacagcctgaccaacacggtgataacctgtctctactaaaaatacaaaaaaattagctgggcgtggtggtgcatgc

SEQ ID NO: 44782 - DNA, 201 bp, Homo sapiens
gttggaaaaaacattatttgccaccttcaaagaataagagtagctcatgttcacaaaaatacttttttttgcaatgccctgatttaagtgctgacatgtaytaatttacttctacctcttaacagcatgttaaggtaattactgttagtggcacggtaacttaaccaaggtcccagccaataagtggcagaacctgaatta

SEQ ID NO: 44783 - DNA, 201 bp, Homo sapiens
ttcttgttaaccatatttctggccaagttggttttaggaaaatcacctggagttagaccatgagccttagcattagaggactgagaatatacactgaaggyacacaatagtgttggaaaaaacattatttgccaccttcaaagaataagagtagctcatgttcacaaaaatacttttttttgcaatgccctgatttaagtg

SEQ ID NO: 44784 - DNA, 201 bp, Homo sapiens; identical to SEQ ID NO: 11938

SEQ ID NO: 44785 - DNA, 201 bp, Homo sapiens
atattccagatgctgagcctgggaacaaggtctatcccaagggagttggcaaaagctaattcgagtgtcagggcctcagcaaaggcagctgggggattcayataggactgtaattccaggaggaaactagtggcaaaaactgagctgaggctcagaagatcagtcacatagataaggctactatggagggcttggagacaa

SEQ ID NO: 44786 - DNA, 201 bp, Homo sapiens
ccaatttggtggttgaaataggaatttgaattacagaacatgaagattctcaaagtcaaatggcagcaggcagggctatattccagatgctgagcctgggmacaaggtctatcccaagggagttggcaaaagctaattcgagtgtcagggcctcagcaaaggcagctgggggattcatataggactgtaattccaggagga

SEQ ID NO: 44787 - DNA, 201 bp, Homo sapiens
ttgggcttaaactttaagtttctcaaataggacagaagctaaggtctagacgcacagaggacaaaccatgggcagttgcagtttattgtaataataatctyatttgcctgcgtgcattcaagatgataaatggccggtatctcctgatggctcagcacgttactgagaatcgtttatcacaacatccatccccagaaaata

SEQ ID NO: 44788 - DNA, 201 bp, Homo sapiens
tttgggtttcaacaaatgaatgtgtgaggaccacaaacatttagtccgtaacagtcctcaatctctctttttaagttttttttactgacacattgtaattstacatatttatgtggggcaatttgatgtttcgatacatatatatgttgtataatgatcaaatcggagtatttagtgtatccatcaccccatgcatttatc

SEQ ID NO: 44789 - DNA, 201 bp, Homo sapiens
ggctagatttctctttcctatcttgtgaagaatactaatatcaagaaactgtgcacaaagctcaatcaagcctaggtagctaaggttggaaaagagtaacrtcacaaatggaattaaagattttcatcttcttcctcctacatcccagctggggggattaaggtaggtctgtgtaaggagagtgaggccctcagtaaaggg

SEQ ID NO: 44790 - DNA, 201 bp, Homo sapiens
tattgagcacctactacgttccaaacatcatgcaagctgctgggtatacaaagttaaacaaaactccatctctgtcttcacaaagtttccccccaaccctwcctaagtttgcctgagctagaataaacatggccaggaaggtctcttttctttaggaaacatctggaaatatgtatgtaatctgccaatggcaacttagca

SEQ ID NO: 44791 - DNA, 201 bp, Homo sapiens
aaagacttcaagctctccatcaccttccggaacaacagccacaaccgttacaccatcacagcttatctctcagccaacatcaccttctacaccggggtccygaaggcagaattcaagaaggagacgttcgacgtgacgctggagcccttgtcctgtaagctaacaatggtgtggttctttgtgagactcgctgtctggccc

SEQ ID NO: 44792 - DNA, 201 bp, Homo sapiens
tagtcagcatcaggtgacagccttatgatttctttctgattcactcaaaaaacctagcacgatgctggtttcatgtatatcccacaaaattacgccttacrtttactccaaaagaggctttaagtgatgtaggaagcactgaaagaaaagtaaaataaaatcaaggtagaaaagacaccttaacaagtacctagcttccat

SEQ ID NO: 44793 - DNA, 201 bp, Homo sapiens
gcatttaagcaggctcaaatatctgctgtgttaaaaacaaaaattacaaaaatctttttcaccactgtctcttcctcctcgcctccttgccgtcctggagygctgcctggacttgcgtcctgctgtgttccttctccactccttccgcgcacactctgtcctgatttctgctaccagcacttccttgaagttgttctcaag

SEQ ID NO: 44794 - DNA, 201 bp, Homo sapiens
gtcctcatgttcacattcctgccttggttagccatctaagtggtgcacttcttaaagccagggaccaggtagtcagcatcaggtgacagccttatgatttmtttctgattcactcaaaaaacctagcacgatgctggtttcatgtatatcccacaaaattacgccttacatttactccaaaagaggctttaagtgatgtag

SEQ ID NO: 44795 - DNA, 201 bp, Homo sapiens
tttattgagtatgtattgtaaatatccacttgtaggttaatactagatggactgtaccatactccttagaatgttttctatgttgatttttgtttctccartaattgctttaatctctggcaatgcaaactcatttaacacttgcttttatatattgcattcatatatactccaaagacaaacaaatgctttatcagaatt

SEQ ID NO: 44796 - DNA, 201 bp, Homo sapiens; identical to SEQ ID NO: 11960

SEQ ID NO: 44797 - DNA, 201 bp, Homo sapiens
agaacaattgtgttcccccacaaggcatcattaggcaaggatggtccaacctcaatacggtttctttacatccctgtgtttcagctacatccgtggtctcytgtattgtttatctatgtcacttgcaaaaaactaggcttgaatacagttttttaaaagtgatgcttttaaatataagcggtaatcaacttatgaaggaac

SEQ ID NO: 44798 - DNA, 201 bp, Homo sapiens; identical to SEQ ID NO: 11961

SEQ ID NO: 44799 - DNA, 201 bp, Homo sapiens
cagtggggaacacatgaccagaggaaatgagagaagattggaatatattctaaggccttaaaaagatgtcaagaacaattgtgttcccccacaaggcatcmttaggcaaggatggtccaacctcaatacggtttctttacatccctgtgtttcagctacatccgtggtctcctgtattgtttatctatgtcacttgcaaaa

SEQ ID NO: 44800 - DNA, 201 bp, Homo sapiens
ctcttgtcctccatacatttttttttttttttttttttttgagacggagtctcactctgtcgcccaggctggagtgcagtggcatgatctcggctcactgmaagctctgcctcccgggttcataccattttcctgcctcagcctcctgggtagctggggactacaggcgcccgccaccaggcctggctaatttattgtatt

SEQ ID NO: 44801 - DNA, 201 bp, Homo sapiens
attttagagcagaaattaaccagctttcacacctgggacactgccctaatcagtgtataatcctaattctcattatgtcctcagtactcatatggtgtttyacacattgtaggtgcatttttgaaattgagattgttcttctatacattattttatttttatttttatttatttttattattatactttaagttttagggt

SEQ ID NO: 44802 - DNA, 201 bp, Homo sapiens
atgaggacaaagggatggggctttgttcctccatagtgatcagtcactggatgtgagccacccctggaatgaggtgtgaccctggatgaggcagttttctyctgctaaggcaactcccaaggaggcctgaaccaccaaggactattttctgtcatcactcccagcagctgaggataagcctgtcggtcatttccgaaggtg

SEQ ID NO: 44803 - DNA, 201 bp, Homo sapiens
gtgtcctcctctcagcttttccccaccggaatgcacccacccacagggggagcagtgtctgatctattttatttttgttgttttgtcagcatgtaacagtrtgcagggcatagagcaagcactgaataaacagaattgcttggaaaaaatttttaatgcataaaaactccatgctgcaatgggtggtcttaatctataaac

SEQ ID NO: 44804 - DNA, 201 bp, Homo sapiens
gggcagagtaattagatcccagggtagcaaatgaaaccccaagtgggcaaatgcaaagtagcagatcccagaaggagcaatttcggccgcctgtccccagygtgctgatgagttctgaattatgtgtaacctctggggggaaggcagctatgaatcactggacagtttaatgaagacgcttgctcaatgtttagctgcagt

SEQ ID NO: 44805 - DNA, 201 bp, Homo sapiens
agaggtaggcctgatgctgatttaattattattggtcactggtaagaagcaggggctgcctgagcatagggctggtgaggaagggtgagggtgagggtgarggtggaggctaaacaggggctgaggtgggggtgggaatgatttgctgggcatcagctgacctctgtgaggtcagtgcggtgtagactggcgacacatggc

SEQ ID NO: 44806 - DNA, 201 bp, Homo sapiens
gctgtgtggctttgagaaaatgacttcacctctctgagcttcattttcttcatcagtagaatgaaagtaatcttagtagttaccatttcccgatggagtgrctataatgattaaatcaggtcatccaggtagagtgcttaccatagaggtaggcctgatgctgatttaattattattggtcactggtaagaagcaggggct

SEQ ID NO: 44807 - DNA, 201 bp, Homo sapiens; identical to SEQ ID NO: 11971

SEQ ID NO: 44808 - DNA, 201 bp, Homo sapiens
gcacatcagaatcacctggagggtcaccacgcttggagcacatcagaatcacctggagggtcaccacgcttggagcacatcagaatcacctggagggtcasccacgcttggagcacatcagaatcacctggagggtcaccacgcttggagcacatcagaatcacctggagggtcaccacgcttggagcacatcagaatcac

SEQ ID NO: 44809 - DNA, 201 bp, Homo sapiens
aatccatctgaaagtgctgagatgacaggcatgagccaccgcacctgactgacttcaggttttacctgttggcatacttctggggtcttgcgtccctactyctgtgattcttcccttaagtggtgtgtctgcgtgtgcagtggcctgctagcgcttagaagcggagcatgcacagtgcgtttactagtgttgtactcgtga

SEQ ID NO: 44810 - DNA, 201 bp, Homo sapiens
cttgcgtccctactcctgtgattcttcccttaagtggtgtgtctgcgtgtgcagtggcctgctagcgcttagaagcggagcatgcacagtgcgtttactastgttgtactcgtgaccacttgatgcattttttccttaccagttgagtgtccctggaggaaggccacatactggttaaattccgccattttggctcttagt

SEQ ID NO: 44811 - DNA, 201 bp, Homo sapiens
attggagtggagcaaagtggagtgaatcgggagaaaggatggataaggccagtcccttcttggacacagatgtcctgcccacacactggcttaaggtactrttagtagttactgcaacacgtaagtctaggcagacaagtagatagacagagagctagctgctcttagtcagtttgagctgctgtaacagaaatgccatag

SEQ ID NO: 44812 - DNA, 201 bp, Homo sapiens
tatttgggaggcctcaggctcaaaataggttaaatctccagatggtttgtttattgttaatgtctgacattggagtggagcaaagtggagtgaatcgggaraaaggatggataaggccagtcccttcttggacacagatgtcctgcccacacactggcttaaggtactgttagtagttactgcaacacgtaagtctaggca

SEQ ID NO: 44813 - DNA, 201 bp, Homo sapiens
tcaggcaaagtgaaacacgtttcctcttccatacagccccctgctgtatccaactttttccttcccagacagtaaacccacaagctttatctgagtgtacyggaaacttctctatctttacaccttggctatccccctagaattccaccttggtcaaggccaacacatgaaaaaagacactgtgtgtcttagacaaaagat

SEQ ID NO: 44814 - DNA, 201 bp, Homo sapiens
attcatttggtatacatagctcctaaacaaacaaacaagtcttatagccacctggcattttgcggcacattgcgtttatgttggaaaagcatatggttctraagtgtgtggcatacagtaaacacagcttaaggtatagtaataataagagcattctacatagatcgccccataaaagtgtcagcccattttaaagacaag

SEQ ID NO: 44815 - DNA, 201 bp, Homo sapiens
tgccgttttatgagcatttttcattccaaacctttcttgcaagggaagaactattattcttatcttattcccaagttacttagagcttatacagatccatycatttggtatacatagctcctaaacaaacaaacaagtcttatagccacctggcattttgcggcacattgcgtttatgttggaaaagcatatggttctaaa

SEQ ID NO: 44816 - DNA, 201 bp, Homo sapiens
ccatatattttctcccatattatatagtggctaaaggaacatggaatagtaatggctgtgttgtcatctggaagatccagacatccagtaaattccatttytgagccattgacttaatttaataaatatttactggacattggtattgaagtactaagtattggagttaaaagtgggctgaaatataaggtgaataagaca

SEQ ID NO: 44817 - DNA, 201 bp, Homo sapiens
caagggtcctcttctctgggcaatgtccttcctctttacgtccattcttaaaaacgcctcatttccatatattttctcccatattatatagtggctaaagraacatggaatagtaatggctgtgttgtcatctggaagatccagacatccagtaaattccatttttgagccattgacttaatttaataaatatttactgga

SEQ ID NO: 44818 - DNA, 201 bp, Homo sapiens
gatcagatcaggaagattttattcttgactgtagcataagtaagcaagggtcctcttctctgggcaatgtccttcctctttacgtccattcttaaaaacgsctcatttccatatattttctcccatattatatagtggctaaaggaacatggaatagtaatggctgtgttgtcatctggaagatccagacatccagtaaat

SEQ ID NO: 44819 - DNA, 201 bp, Homo sapiens
gtgctggactccctgcctggcacacgatccatgctgtctaggtgcacctgctgttgttgctaccatgaccatcgtctgcccctctcctagttcccctgaayccagctctccaccactgccctccaggagatgcggatttaaatgtaacaaagtttagggagttggctgaaagtttcgtttttcttatagacttaagaaatc

SEQ ID NO: 44820 - DNA, 201 bp, Homo sapiens
tttaagtgtgtttgtgtataattattgcagctaatacaaatcaacaagagctccttggtattatctaatgaaccatctttaatctaattttcccaatgtcyaaaaattatctttttagttagtttatttggattaaggtctgtagattaaatttggttggtatgtcacttaaatcttttcctctagagtaatcctcttcat

SEQ ID NO: 44821 - DNA, 201 bp, Homo sapiens
actgaggattgctggttaaagtgctggactccctgcctggcacacgatccatgctgtctaggtgcacctgctgttgttgctaccatgaccatcgtctgccyctctcctagttcccctgaatccagctctccaccactgccctccaggagatgcggatttaaatgtaacaaagtttagggagttggctgaaagtttcgtttt

SEQ ID NO: 44822 - DNA, 201 bp, Homo sapiens
tattttacctgtacatattttagcgtgtagctttttaaaaatagacatatatacagtatacatagatacatatgtacatatgtgtgtatgtatgtgtttawgtgtgtttgtgtataattattgcagctaatacaaatcaacaagagctccttggtattatctaatgaaccatctttaatctaattttcccaatgtccaaaa

SEQ ID NO: 44823 - DNA, 201 bp, Homo sapiens
tgccccagtggctggccctctgccatttgtaggccatctcagggatgacagctcacgtgattaaagggctaaatgaagccctttttggtggggaaagaggsggcttggactcaaggcagtgcccagtcagaacccgagctccaccatggatagcagtgacagaatcactttaccccaccccccatcacattactgtttcct

SEQ ID NO: 44824 - DNA, 201 bp, Homo sapiens
tgagactgtcgcccaagtgaaaaagatagcagaagataagaaggaaaactgtttccagaaattgtcaaaagacagccaggtgaacaagattgtggcccgakgtggcacaggatgctgggctgaaaattacagcagcatgcacagcacttattgataggagaatgctcagctgtgctcctgagggcccttcagcctgctttg

SEQ ID NO: 44825 - DNA, 201 bp, Homo sapiens
cagaagcctctgtagtagcattttaggtagagtattaagatctgatttttttctactttttagattactatagcagaagtgtggaagataaattggaggamcgagattttgttagggacattagtaagagactcaagggggaaaaaaatctcactaataaatgataggataaatggatgctgcatgagtttgtatgatttt

SEQ ID NO: 44826 - DNA, 201 bp, Homo sapiens
ctttggagggagtgactgatggcaagaatagttgaaagaatcctccagaaagtgctatttgaggcgggtctcaaaaaacgaatagaaattgacccaggggratggaaattgtatacattctagaaaaaaaaaaatagaaaagttcagtggagcatgacattttggaagcacactgatgtctttgtatgacttgataagaag

SEQ ID NO: 44827 - DNA, 201 bp, Homo sapiens
gtcacacagctggaatttcttagaggcaatatgtttccatcaacccaagtacatcaaagcggtcagaaaaagagggatgcccagtgtcctaagatgactgygctatttctgttactttggggtatttttaaagaaaaagcagacacttggcctcaccagtgcaaacacccatgcaccttagaagttataggtggtccagga

SEQ ID NO: 44828 - DNA, 201 bp, Homo sapiens
gggccttctctctctctcacctctgagcctgcagcctcgacaaatcatgaaaggcaaggaggggagtggtaatcacaggttttactaacctgtggctgagrctgtgaaagcttgggagcagcttctggtgttaatttgctgttactttgacatgggcccctgcttttttgatacccagttgagggtgaaatcccaagctgt

SEQ ID NO: 44829 - DNA, 201 bp, Homo sapiens
tgtcacaggagcaaattctggccaagacagcaaattccaccaaggacctactctgtaaattcctaacttcctattagtgggtttttaaaattgtattttcrggaacatagtcccattcatgggactaaaataatactacgttgatgatcaaacgcttagaaacgaaacaattagaaccctgttgggattctactctagttg

SEQ ID NO: 44830 - DNA, 201 bp, Homo sapiens
tttaaatccaaagatgtttttgaaatgtttcttaatgcaggaaaaaatatattggacacacttgagaatgaaatcagggacaccatgtaaagtattctgawgtattgctacaccttcaatatctaaattgattgaggcagggcctctgggaagaaagtgaaaaattcagtctgtcttccacatgttttgtctataccagtg

SEQ ID NO: 44831 - DNA, 201 bp, Homo sapiens
tcattaataaagaatttttacctagctaacattttttaaatcaaaaacaaagggaggggttggaggctggagggaggtcatttaaaaaaatgattacaaawcctatttgttttagctcaaagtctcaacagtctaagacttggtgatctaaatttaaaaaaaaaaagtcatgagttttgttttgttttattttcccatagt

SEQ ID NO: 44832 - DNA, 201 bp, Homo sapiens
ctgcagttttatgcttgtgtgtgtgttaatgcataacaaaggattcagcgctatggcctggtaactggaaagtaggtcaaaagagaggggtgagactgtcrcccaagtgaaaaagatagcagaagataagaaggaaaactgtttccagaaattgtcaaaagacagccaggtgaacaagattgtggcccgaggtggcacagg

SEQ ID NO: 44833 - DNA, 201 bp, Homo sapiens
atatgagattttatctgtttgcttgtttgtttttacataaatgatgcagaaataactgactctccaactggaagaaagtttaaaaattgaccctcatcttrtcccatatacagtagtaaatctcagatggaatgagtattaatgtaaaaaagacaattttttgaggaaatttaacagacttaactaaaaactggaaactct

SEQ ID NO: 44834 - DNA, 201 bp, Homo sapiens
atatttagtaggacataatagagaatccagaaatggatttcagtatatgagttaatatgattgttggtttcatgaagtaagaagaccatatgagattttawctgtttgcttgtttgtttttacataaatgatgcagaaataactgactctccaactggaagaaagtttaaaaattgaccctcatcttgtcccatatacagt

SEQ ID NO: 44835 - DNA, 201 bp, Homo sapiens
ctaaatttcaatttcacgtaaacagaatgggattaataatcatgtctacccccaagaccatagggctgtagagaagattaaataaggtagtgtaagtaaaytgatgaacagaatgcctgcattactaagtaaacactaactaaataaatgtaagttacttgttattattgttgtcattaaccagagtcaggatcacgtgtt

SEQ ID NO: 44836 - DNA, 201 bp, Homo sapiens
tacaaagggaaaaagaagctctgggccaggcatggtgacttatgcctgtaattccaactctttggaaggctgaggcaggagaatcacttgagcccaggagktcaagactagcctgggcaacatagggagaccctggctctacaaaaaaaataaatttaattagccgagcatacacctgtagtcctagctactcgggagcct

SEQ ID NO: 44837 - DNA, 201 bp, Homo sapiens
tatctaagtggaaaaaagttaacaaatttcactgtaatcagaaattagaaagaaatgcctgctatcatcattccctttttaaaaagaagtactttaaaggytttagtaaatgaacaatgtaagagatacatctgctataaatgctggaaactaagaagtaaaactatatatttgctaatactatgattgtgtatgtagaaa

SEQ ID NO: 44838 - DNA, 201 bp, Homo sapiens
tgtaatgtcaatgtaaacattgttgaaatggcaccagtttttggaaaagctcctggactccccacctaaactcttctgactgtaattaaacatgatcaacrttacaccaagagaggtagattcagcagtgcccagaaaaaaactggcaagatgccttgaaactgttacctcttggcctttgttttactatgtaaacacaaa

SEQ ID NO: 44839 - DNA, 201 bp, Homo sapiens
tgcttctaaacgaatgtgcacacaaatcacccagtgatcttgttaaaatgcaaattcttattcaagagttctgggaggggcctgagattctgaattcctamcaagctcccagggaatgccaatattgctgatccatgaatgcctcaagtagcaaggctccacaccattgtaatgtcaatgtaaacattgttgaaatggcac

SEQ ID NO: 44840 - DNA, 201 bp, Homo sapiens
gtcttattcttactcaaatatacatttcctatatgtttgttgactatataagtgattattgaacaactacagagcatccagtctttgctaacacttggtaraactcagaaagacggagattttttttctttgttcccaatgaattgataaaccagcggggaagacagacttctctacaactagacacagcaagtcaaaaag

SEQ ID NO: 44841 - DNA, 201 bp, Homo sapiens
tttcttgaccatctctctccaggcataaggtcttattcttactcaaatatacatttcctatatgtttgttgactatataagtgattattgaacaactacakagcatccagtctttgctaacacttggtaaaactcagaaagacggagattttttttctttgttcccaatgaattgataaaccagcggggaagacagacttc

SEQ ID NO: 44842 - DNA, 201 bp, Homo sapiens
tctgtcttttttctttttgagttggagtctcgctctggtgcccatgccggagtgcagtggcgtgatctcagctcactgcaacctctgcctcccaggttcawgtgattctcttgcctcagcctcctgagtagctgggattacaggtgcccgccaccaggcctagctaatttattttttgtatttttagtagaaacgggattt

SEQ ID NO: 44843 - DNA, 201 bp, Homo sapiens
ctgacctcaagcaatctatctgcctcatcctctcaaagggctgggattacatgcctggccaaaaagatcagcattttgattatatttattactttctagawtttaaaatataaattagaaatctcaggtttttgttgactagctggtaagatggttaaggttaggagctgagccatgttgcctctctgctttactccatag

SEQ ID NO: 44844 - DNA, 201 bp, Homo sapiens
gtatcccatgtacctagatcacagcctggcatgtcataggccctcaataaatattggttgaattaaattgcaaatgtaaacgctttagaagacaacatttrtctggacatggttgtgtgcgtttattcttaaaagtgacttataatctcataaatctgtatgaaatgaacatagatacagcacatgcatataacaggaaac

SEQ ID NO: 44845 - DNA, 201 bp, Homo sapiens
actttctctctggtggattgtatttttgcctgtcattatctctggatctcccccaggtcaagaagaagagagattggccctagaaactgccctgatgtacrgagctaaaaagcccctcaacacagaaggtgtcatgaaatcaaggtccaacgttgacatggactttgaagtggaaaatgctgtgctgggaaaagacttcaa

SEQ ID NO: 44846 - DNA, 201 bp, Homo sapiens
acctagatcacagcctggcatgtcataggccctcaataaatattggttgaattaaattgcaaatgtaaacgctttagaagacaacatttgtctggacatgsttgtgtgcgtttattcttaaaagtgacttataatctcataaatctgtatgaaatgaacatagatacagcacatgcatataacaggaaacatttcttgcga

SEQ ID NO: 44847 - DNA, 201 bp, Homo sapiens
atttcaagatcccatctgtgacaggtataatcattctctgaagaatattttacaacctagggagacaataatttacattttgttcatattagacaaaaagyaggaggacagggaggcagttgctcctccggagatttttttcttttctttaacagtccattttccgatatgtttggaattaggctaaattgtgttaggtag

SEQ ID NO: 44848 - DNA, 201 bp, Homo sapiens
cctggcaccagtgatcctgccctagaaaacctccttcttcttaagggaataactattattatagtctgatcgagctgatacaaatatagcccttgtgttgygaggcttatgtgagaatatatgtgaattatggttgtcagctggggctggttctttgtaatcaacaggggtgcctcaaataaatgaattacaggatccacc

SEQ ID NO: 44849 - DNA, 201 bp, Homo sapiens
aacatcgtacctggcacaggacagctctgcaacaaagatgcatccagcccgatatgtcagtagtgttgatgctgagaagccctgatctagatcatgattastgtttttgccacagccttcaaaccaggcttctctctccacaccccatgtgccagccagcctaaaagtaacttctggttcatgttctagtttgcctgtcat

SEQ ID NO: 44850 - DNA, 201 bp, Homo sapiens
gctactatcagatatacttttgaaggggcttatgcccatccttatatagcataccatggagaagacagatggctccaaaatattttttccagaaagaatawagtgatcatagcaaacacttttgccaataatgtctctgtggcagctccatcttcttcagtttagagagcttttgtaaatgctatctttattttgtatttt

SEQ ID NO: 44851 - DNA, 201 bp, Homo sapiens
tactggtatgggaagggttcttaatctagggttcatgggcccctagaaaaccatgtatggacttcataggtctatagtgcatcccctaaaaatacatgccyatattgtatatatcttgtatttgtcactgtgtatgtctgtgtagaggaaaggtcagtagctactatcagatatacttttgaaggggcttatgcccatcct

SEQ ID NO: 44852 - DNA, 201 bp, Homo sapiens
gaggcttcatgtagagccagtctactggtatgggaagggttcttaatctagggttcatgggcccctagaaaaccatgtatggacttcataggtctatagtrcatcccctaaaaatacatgcccatattgtatatatcttgtatttgtcactgtgtatgtctgtgtagaggaaaggtcagtagctactatcagatatacttt

SEQ ID NO: 44853 - DNA, 201 bp, Homo sapiens
catcagtgacctggaagggtgtatttcactttccacagcgtaggaggcttcatgtagagccagtctactggtatgggaagggttcttaatctagggttcaygggcccctagaaaaccatgtatggacttcataggtctatagtgcatcccctaaaaatacatgcccatattgtatatatcttgtatttgtcactgtgtatg

SEQ ID NO: 44854 - DNA, 201 bp, Homo sapiens
atactaagcattccttctcactgtcatcagtgacctggaagggtgtatttcactttccacagcgtaggaggcttcatgtagagccagtctactggtatggraagggttcttaatctagggttcatgggcccctagaaaaccatgtatggacttcataggtctatagtgcatcccctaaaaatacatgcccatattgtatat

SEQ ID NO: 44855 - DNA, 201 bp, Homo sapiens
aatactggaagcaaactgattaggcatgacatatgaaattacctgagaaggtttaatgtcctgaacatattcagatctgaagcctatctatgatggcccarttgcatgggccagtttctcaaatactaagcattccttctcactgtcatcagtgacctggaagggtgtatttcactttccacagcgtaggaggcttcatgt

SEQ ID NO: 44856 - DNA, 201 bp, Homo sapiens
atcaacacataacgtgaaaacactatgtgttggcagcattttcctcaaaagaagcaaggagagggagacacctccagttacatttcccaagcagaacacastgatgtcgagcattgggtaggtttttacatttagtttggtttgagtgtctaaggctcattatcatcagtagtcagggacaggaagtttacattctcggtg

SEQ ID NO: 44857 - DNA, 201 bp, Homo sapiens
ggtaccatagcatggtgcatcactgaaatcaacacataacgtgaaaacactatgtgttggcagcattttcctcaaaagaagcaaggagagggagacacctycagttacatttcccaagcagaacacagtgatgtcgagcattgggtaggtttttacatttagtttggtttgagtgtctaaggctcattatcatcagtagtc

SEQ ID NO: 44858 - DNA, 201 bp, Homo sapiens
cttgacaccatgggttgcattgtagagagaggtgggtacaggcacagttgtgtgatttcctagtgtcatatgtcaacagtggcaggagctggaatgacatscagcccctgaattaccctgtgctctaagactggtctgtatagtgccaaatattgataacttgggcccacccaaggagaaaatctcatataaataaaagta

SEQ ID NO: 44859 - DNA, 201 bp, Homo sapiens
tagcaatggaaagggcggatttctacagtcctcaaagagatgatttgcttttgaatacttgtgtttctctcctcttagttgctatcatccatgatttctgygcctttttgattgtttcttttttggtggtggcattttgtttttgtagctggtaacctggtatttctaagagttatttggtgacttattcccacttggtct

SEQ ID NO: 44860 - DNA, 201 bp, Homo sapiens
gccatgtgcaagctccagtcttgacaccatgggttgcattgtagagagaggtgggtacaggcacagttgtgtgatttcctagtgtcatatgtcaacagtgkcaggagctggaatgacatccagcccctgaattaccctgtgctctaagactggtctgtatagtgccaaatattgataacttgggcccacccaaggagaaaa

SEQ ID NO: 44861 - DNA, 201 bp, Homo sapiens
gttggcatcagacagtccaggttttgacttttgaactggcccattagtagctaaggaaagctgaggatagtttctgtgtcactgaaaacaatcacacttayctcatggaaatcttagtgtcctttctccagacctgctccctctctttcctgcatttgagggatgagatctacttttagaattacagagggaggaggcatt

SEQ ID NO: 44862 - DNA, 201 bp, Homo sapiens
tgatttgacacttttgaacattacaaggcagtaatttttagaatgcccctccatttgggtttgactgatgtttcctcacttgatgttaaaatcaagtcacrtatctttcacaggaagattgcagaaatgatgctgtgttcttcttggtgcctcctacctggttgcacataacttttacagatcccattactgatgatgtta

SEQ ID NO: 44863 - DNA, 201 bp, Homo sapiens
acggggattgtggtcttaataagaccagaggacttaggagaaaggcagcttggaatagagaggtctagagaattaaacatctttagctcacagcataatgsaaagaaagtgcccttcaggggaacatgtatacaacagggttctgagaagaggtaaaaataaaactgcatcctgcactttctgcttgccgtaatgctgcag

SEQ ID NO: 44864 - DNA, 201 bp, Homo sapiens
cttcctctgcatgcagtttcttttccctatatttatgctcaaacttgcatcattcttgtctctagacgttctatttgctgtaataaatgaaattcttctcmatctaaggttagtttgatctcacttctgaactacaatttgaggccaatgtaccacattctatctactcttcagtactctgcaagagattggagtgaggac

SEQ ID NO: 44865 - DNA, 201 bp, Homo sapiens
cctgtgctaagaaagaggaccagaggagttgattgctaagctccttttcaacaggaacatttgtgctcctccagctcattcttgggctggtttatcacggrgattgtggtcttaataagaccagaggacttaggagaaaggcagcttggaatagagaggtctagagaattaaacatctttagctcacagcataatggaaag

SEQ ID NO: 44866 - DNA, 201 bp, Homo sapiens
ctgctgtgggggatgggggtgagatttctaggtcactggagctgtgtacctaagaggattatggctgcctctgctgagtcatgcaggttgtcagggaagtkgggggaagctggcagtcacaggagtcacccagctgccatgcaaaccaaagggccagtctcactcccaccgtgcccccctcaacagccctaagtccatttc

SEQ ID NO: 44867 - DNA, 201 bp, Homo sapiens
aaaaaaaaaaagaatgtgttttaagggttttgctttatcagatgcataatataaatcaacagtgagttaagagtatccaagacactgacaatatcttgatktgaaataatagactgtttattttaaaagatgtaatggtctcttttttttttttttacagaaaaaccacaactagagtaatgtacttaattccagaaaata

SEQ ID NO: 44868 - DNA, 201 bp, Homo sapiens
cttggtaatggtgaattatctcagcatttgtttgtctgaaaaaggctgtatctttctttcatatatgatgcttagtttcgctggatacaaaattcttggcygataattgttttgtttgaagaggctgaagatagggttccaatcccttctagattgtagggtttctgctgagaaatttgctgttcatctgataggttttct

SEQ ID NO: 44869 - DNA, 201 bp, Homo sapiens
accgtggctcccactagtacatttcagccaaccatcatctttcaatttcttaagcaactatgcactctcttgcctcagtcttcacctatccttctttctcygcctgaagcattcctctccacccccctttccacatggacaactgactcctcttttgctcactgcttatgtctcacttccttcagagaaattccttatttt

SEQ ID NO: 44870 - DNA, 201 bp, Homo sapiens
tccctgtgaaggtctcaggagagaggcttcccaagctgtgaagtgctcaaaccacagcagaaaatagaatttaattgcaccactgataataaaccggatgkatgaaggaaactgataactttcatcttttaggcactattaatttgcaggattatttgttagttatcttctgggtttacttaaagagcagtttaattcccc

SEQ ID NO: 44871 - DNA, 201 bp, Homo sapiens
tgatgtgtgattttcacatacataacatactttctctattgagaaatgtcttgccccaaactgtgcagcttgtaacgtgtagataactatttcttagcctrtactctttcaactattttgtgctgcattttggtgaaaatagacagcctatttcatcattttgaagcaacatttatatagaatgtcatttcagatttttgc

SEQ ID NO: 44872 - DNA, 201 bp, Homo sapiens
tatgatgctacgagagcccctaatgaggagatcactctgaaatccacaaagccttgttttcagctttttattacactttattgctgcaaagaaggagaagraggacctccctccacaagcaagctgcctaatagctgtaaatgcaaacactttttgctattattaaatatagatcggggtgttatgaatgtcatcaggatt

SEQ ID NO: 44873 - DNA, 201 bp, Homo sapiens
tttcacatgaatcactatttgcccatgtttgccactatttctcctatgttttatttttgaagctttataatttgaacttttacattgtggtctatgatccrtcttgagttaccttttggtgttgtgtgaggtagggatcaaatcttattttttccaaatttatccatttgttccaccagcatttgttgaaaagactgttgg

SEQ ID NO: 44874 - DNA, 201 bp, Homo sapiens
tgctggtagcactgggggtgggtcatgagttgcctggccccactaattcacacacaatgttctatttcccctggatttgtcctctgtctgtcctctctccmggtcacatgagctccttggatacagatataatgccttttacatgtcctgtctgattcaatccttctctttcaggtgggggcagtggggggacgatgaact

SEQ ID NO: 44875 - DNA, 201 bp, Homo sapiens
tgatcctacagataaacagaaaataaagttattttccctttgtccatcttttcctccccctctttttgtcccagtatttagaaagatttttttctttccaygcatgaaaaagacagtaatgacataactacttttatatcttgccaagcagctcctcaaggggttaactataaaaccatgttttgttcattttctttcaat

SEQ ID NO: 44876 - DNA, 201 bp, Homo sapiens
ggaagcgctaaacatggaaaggaacaaccagtaccagccactgcaaaatcatgccaaaatgtaaagaccatcaagactaggaagaaactccatcaactaaygagcaaaatcaccagctaacatcataatgacaggatcaaattcacacataacaatattaactttgaatgtaaatggactaaatgctccaattaaaagaca

SEQ ID NO: 44877 - DNA, 201 bp, Homo sapiens
ttctttgctttttggaaaagagatgaggcagctccagtctgtgtctcccttggctttccccagacaccgtaaatgatattggcagcatcccagccctaccrctcatagagcgaaaacctattcctccttctcctgccacgtttaataaactttatctagaacaatttcttgtgcagtggcaaaacacagcacttacataac

SEQ ID NO: 44878 - DNA, 201 bp, Homo sapiens
cagacaagcaaatgctaagagattttgtcaccaccaggcctgccctaaaagagctcctgaaggaagcgctaaacatggaaaggaacaaccagtaccagccrctgcaaaatcatgccaaaatgtaaagaccatcaagactaggaagaaactccatcaactaatgagcaaaatcaccagctaacatcataatgacaggatcaa

SEQ ID NO: 44879 - DNA, 201 bp, Homo sapiens
actgaagaacttggagtctgatgttcaaaggcaggaagcatccagcatgggagaaagatgtaggctgggaggctaggcccatctctccttttcaagttttkctgcctgctttatattcactggaagctgattagcttgtgcccaccagattaagggtggatctgccttccccagcccactgactcaaatgttaatctcttt

SEQ ID NO: 44880 - DNA, 201 bp, Homo sapiens
ataaggaaaagggagctttgcagattcctaaaataatgtgatgcaaacagatattttctccccaaatagtcattgttctcagcattttgtaggtaccatarcatggtgcatcactgaaatcaacacataacgtgaaaacactatgtgttggcagcattttcctcaaaagaagcaaggagagggagacacctccagttacat

SEQ ID NO: 44881 - DNA, 201 bp, Homo sapiens
catatgcttagtggaagatatcttgtgatttctaaaaaagtaatttctttccaaaaagtttatataagagaaagagagtatgtgtgtgttagtaactttcytgtttaccaaagaatcagagtagcagctcattatcatgaattagtataaaggacaggaatgtcaatatcagtaagtgatatgtaacttgaaaaagcatac

SEQ ID NO: 44882 - DNA, 201 bp, Homo sapiens
ggatttcagaaaataaagaagctattccagcaaaaaaaaaagtttctatttttacctgtattctgtcagggatcacagtatatgtagttttgaagatgaawgttttagagtcagaaagacctggatttatatccaacttccgccagattcctaactctgtaggctttttatttatcttctaaatttcaatttcacgtaaac

SEQ ID NO: 44883 - DNA, 201 bp, Homo sapiens
cttagccaggatagatgatcgtaaactatgtctatgagtgagccctcctcatcgaaggtgttcatttccatctctctcttcaggacagctacagaacagtrcacattttagaatgaaaatgaggagtcactggtaactgcggtacctaaaacataatttgctctgtgcatttcatgtttgctatttttttgaatcttaaaa

SEQ ID NO: 44884 - DNA, 201 bp, Homo sapiens
aggagtgcagttgctctgttttaacctgagctaaccagcacttacacagagcctggggtgctcctcttgcaaagacagtgtacatggggcctgtgaaagakgcttaacccacagaaatcgacttcaacaagcagaatatctgcatgaccagcactgattggtggggaattgtatagataacacaagatccatgggaagtat

SEQ ID NO: 44885 - DNA, 201 bp, Homo sapiens
gagtagtgaagaaaagttgcacctacaggcagctaggggcagcaggaagcgagctgtccacatgacagatgtctcttggaaaccatggagccgagcacagytgccattagctgtcagcatggaggtgacagtgaaggccaactcaggaatgggacagaatcagatgccacgagaggaaagactaaaacccagtccacgaaa

SEQ ID NO: 44886 - DNA, 201 bp, Homo sapiens
aagatagactcaatctgatgtttctgttctattttgaggaccattcaacagcacaggcagaaaactctgattgtcaaagaatgttctagcaaatgattagwaatgttactgaagagacagtttgggttcctagtgataaaaatcaatcattccttataatagcaaccaccaaaaaaaggtcatagttttagctgctgcata

SEQ ID NO: 44887 - DNA, 201 bp, Homo sapiens
agggcatagagcaagcactgaataaacagaattgcttggaaaaaatttttaatgcataaaaactccatgctgcaatgggtggtcttaatctataaacaaasctttttcaaagcacattttagagcagaaattaaccagctttcacacctgggacactgccctaatcagtgtataatcctaattctcattatgtcctcagta

SEQ ID NO: 44888 - DNA, 201 bp, Homo sapiens
ttcccttgagatgtatgcatttatttttaaccctggccttttgctaatatcgaaccacaatgccatcattaatccccattaatactttgctctgactatgmcttttgggaactaactcatgactaaacttttttaaccaatcgatgttcgatgtactctttagcattgtaaaaaaatcttgaacttcagctagtaaatcaa

SEQ ID NO: 44889 - DNA, 201 bp, Homo sapiens
gaggtttttaaaaaaatactgaagagacctgaaattgcatgaatgctgagaagacccactattagcaagcaggagcttgaagctgcaagaggaagagtacrtaagagtcacagcaaagccccggagaacaaggcaacgcagaagcctggtttggagatgcagagggaggagggacctttccaacttcagtaacaagaagaa

SEQ ID NO: 44890 - DNA, 201 bp, Homo sapiens
attataactcagacctgtgcttctaaacgaatgtgcacacaaatcacccagtgatcttgttaaaatgcaaattcttattcaagagttctgggaggggcctsagattctgaattcctaacaagctcccagggaatgccaatattgctgatccatgaatgcctcaagtagcaaggctccacaccattgtaatgtcaatgtaaa

SEQ ID NO: 44891 - DNA, 201 bp, Homo sapiens
gagaaaagaaaaaaaagagaagcaattagaaaaaatgaagaaacttgcccacagttatacttctccctttaaattgcattgcttgattgctgctttctttycaatgcatttctgatgtgacagttcccaccaggaaaattgccagagaaagctaaggagaatgcttaactttgtgccatccgaacacttacttccctcaca

SEQ ID NO: 44892 - DNA, 201 bp, Homo sapiens
gccaggaactaggcttggacaggggaagcaaattcatttcctgtttgtggcaaacggagtctggatgatgataagactttttccatctaaactgccttgtkaacccagtaaacaaagcaaaaatcaatatgctagattcatcaatgcttgctggaacacactccatggcaagggacatttcctaggcaaaatggacaatgg

SEQ ID NO: 44893 - DNA, 201 bp, Homo sapiens
ggagggggagaatttgggtgttaaggggtagaggtcctgacctgagacattttgagcaatatttccatttccgtcatacccttgtttatatacacaaaatrttcaatggttttcaaaaacactttcacctctattagctcctttaaaccttagaatacctctgtgaatctttccaaaatctgttccgttttaataatttta

SEQ ID NO: 44894 - DNA, 201 bp, Homo sapiens
aaatacgttacagacaagcaaatgctaagagattttgtcaccaccaggcctgccctaaaagagctcctgaaggaagcgctaaacatggaaaggaacaaccrgtaccagccactgcaaaatcatgccaaaatgtaaagaccatcaagactaggaagaaactccatcaactaatgagcaaaatcaccagctaacatcataatg

SEQ ID NO: 44895 - DNA, 201 bp, Homo sapiens
aacagacttaactaaaaactggaaactctgacactgtagaagaaagcaagaaccatgtacagttatgtgccacatagcaacatttcagtcaatgacagatyatgcataggtgatcttatgagattctgatggagctgaaaaattcctgttacatagtgatgtcatagctatcataatagaatagtgagattacttattttt

SEQ ID NO: 44896 - DNA, 201 bp, Homo sapiens
catttttttcagtggccactcttccagttagcaagctgctcttgtaatactgactgagaaatgcagagaggcaagaagaggaaaaggggggaaatggcggstttttcatttctaatagttctgtagcagtgagtcctgcccatcactgtgtgtgatatatacagtgttctaaggtatactgagtgtatataacgcccttaa

SEQ ID NO: 44897 - DNA, 201 bp, Homo sapiens
gattgtcgtgagcatctagtgagcagtgtctgtgatcaagtctgacccacagcacgtgaccaataagtgttcattgactgggaatgtgcaacttatcataycccagcaaggtcaggaaagcactccagggaatacttgttcctatgaggaatatgtacgacctgtagcccccataaatctgacatctgaacaaaatgctgc

SEQ ID NO: 44898 - DNA, 201 bp, Homo sapiens
ggacgtggattaaatgggatgtccaggacccatgcagtcctggattatatcaatgtacccaacatggagagccagatgttggtacagagaagtagacccartctggctgaagagtagattatttctgaagaaatgttaaactgggtggtatttcaaacaatcaaagactgaaaaaaagaaatacttatattaccaatttcc

SEQ ID NO: 44899 - DNA, 201 bp, Homo sapiens
gtcagaaacttccaggaccgcctttggaggcagaagagcagttccacccaataactctaatgcagcggaagatgacctgcccacagtggagcttcagggcktggtgccccggggcgtcaacctgcaaggtatgagcataccccccttccccaccactctgggtccaggcacagccgggccctggcccctcttccctgcagg

SEQ ID NO: 44900 - DNA, 201 bp, Homo sapiens
tgaggtacagtataggtaaaatcttcctgtcttgctatttgatctttattcctttttaagaaaattctggtattgcctgtggctagcagttctttctaagragactgaactggtaccagactcctcccttgatagtgtaatctactttctgcagccttctgccctctccttgatcctggggtccaccttgtctcagaagag

SEQ ID NO: 44901 - DNA, 201 bp, Homo sapiens
taatgacctgcattctctctcttaggtccgtggcactcaggtagttggttctgacatgactgtgacaattcagtttaccaatcctttaaaagaaaccctgygaaatgtctgggtacacctggatggtcctggagtaacaagaccaatgaagaagatgttccggtaaaccttgggttggggagaccgggcaggcagtgcagg

SEQ ID NO: 44902 - DNA, 201 bp, Homo sapiens
cagaataaccagccaagcatgtttacagtgatgcagggaatcaatccgttctatgactatttccttaactctccagttagttgctatcctgcccagcaaayacagctgagagaagctgcttaataagaaccaaaatactgagctatttgcatacctgaagaactagtgcaattacccattactgcatccatcctgtcagtt

SEQ ID NO: 44903 - DNA, 201 bp, Homo sapiens
cctttgggtaggcaccctggagcacagtcacttgattgtatcttctgccactcaaagaggctattggtgtgtatcctttggccagaataaccagccaagcrtgtttacagtgatgcagggaatcaatccgttctatgactatttccttaactctccagttagttgctatcctgcccagcaaacacagctgagagaagctgc

SEQ ID NO: 44904 - DNA, 201 bp, Homo sapiens
tcctcagtgacatgcaacctttgactatactgcctactgcctgatgcccttgtcttgggtccccaatttctagcctttagcctggtgattctatttatggyccaaatatgacaatctatagatagctaacaaggggaaaagtcatcaaggtgggcagcaaggaggtctggaaaagtgtcccaagcccagtcagggcactct

SEQ ID NO: 44905 - DNA, 201 bp, Homo sapiens
ctaataaatgagggttgtgatttatctagcaacaggggaacagctcagcattaacaattaaaaggtctgtagaggacagagctttttttccttactcttcyccttagctgattgagttcagccctatgctataaatagcccttgtaattaatggctatctgtttgaaaatcagttatcaggaccacagtttaggagccttt

SEQ ID NO: 44906 - DNA, 201 bp, Homo sapiens
gtgggggccaatattcaacattcttaaagaaaagaattttcaaccccgaatttcatatccagccaaactaagcttcataagtgaaggagaaataaaatackttacagacaagcaaatgctaagagattttgtcaccaccaggcctgccctaaaagagctcctgaaggaagcgctaaacatggaaaggaacaaccagtacca

SEQ ID NO: 44907 - DNA, 201 bp, Homo sapiens
gttgctatcatccatgatttctgtgcctttttgattgtttcttttttggtggtggcattttgtttttgtagctggtaacctggtatttctaagagttattyggtgacttattcccacttggtctcagcacactccctttccatcctaagactgttagcacaagttttgcttccttttccaaagcaactgtattcacacttc

SEQ ID NO: 44908 - DNA, 201 bp, Homo sapiens
tactccagaagcatgttgtaaggattaatgagggaataactggaagctctttgaactgcttcgtgatagttccttcctaataagatgacccaattaccagscttattttcaatattgcaactatgtaggaaagctaaattcttatggtattccttaaggaaggataaccttcataaaatgctactataacagcagccagag

SEQ ID NO: 44909 - DNA, 201 bp, Homo sapiens
gctgggaaaagacttcaagctctccatcaccttccggaacaacagccacaaccgttacaccatcacagcttatctctcagccaacatcaccttctacaccrgggtcccgaaggcagaattcaagaaggagacgttcgacgtgacgctggagcccttgtcctgtaagctaacaatggtgtggttctttgtgagactcgctgt

SEQ ID NO: 44910 - DNA, 201 bp, Homo sapiens
tgatttatttagccaacacttactgagcacctcctaatgactgggccctgctctagtgctggagatgtgtagaagaataagaccaacagagctcccaaagkagatttatgcactctacaaatgcatgatggaattgcaagatgaaaacagaaaaactcttatggatctagataaagaagctttagaataaaaagtagcatt

SEQ ID NO: 44911 - DNA, 201 bp, Homo sapiens
gacacggtaccttttgactgtatagtgagaacttaagtttcaaatgaaggctccgagaacataaaaaaccatgaatcttaaagagaaacaaacaagcaaargtttaataagaacttccttgctagatgtcctcatgatttatttagccaacacttactgagcacctcctaatgactgggccctgctctagtgctggagatg

SEQ ID NO: 44912 - DNA, 201 bp, Homo sapiens
aaacctaaatgaactttcttccttctcacttctcacggactcatttaggtgaatgccaaagatgacgaaggtgtcctcgttggatcctgggacaatatctrtgcctatggcgtccccccatcggcctggactggaagcgttgacattctattggaataccggagctctgagaatccagtccggtatggccaatgctgggtt

SEQ ID NO: 44913 - DNA, 201 bp, Homo sapiens
gatccagttcaatatgttatttcaagagaaaaactcccccactttgtgatttgggcttaaactttaagtttctcaaataggacagaagctaaggtctagamgcacagaggacaaaccatgggcagttgcagtttattgtaataataatcttatttgcctgcgtgcattcaagatgataaatggccggtatctcctgatggc

SEQ ID NO: 44914 - DNA, 201 bp, Homo sapiens
ggggtagggaaacttggagaaaagtaaagcagaccctgtctcaagtcttgatgccaggcctgtgtgtgttttctcctactagtcaagaaagaggcggtgcwgatccaagccggcgagtacatgggtcagctgctggaacaagcgtccctgcacttctttgtcacagctcgcatcaatgagaccagggatgttctggccaag

SEQ ID NO: 44915 - DNA, 201 bp, Homo sapiens
attctgttttgttctctgatgtatcccatgtacctagatcacagcctggcatgtcataggccctcaataaatattggttgaattaaattgcaaatgtaaaygctttagaagacaacatttgtctggacatggttgtgtgcgtttattcttaaaagtgacttataatctcataaatctgtatgaaatgaacatagatacagc

SEQ ID NO: 44916 - DNA, 201 bp, Homo sapiens
actcacccagccaggcgtgcacctggggctccccccttctcccccttagcactgtgtctcccgacagcgcgccacactgttctgcacccctggcaatgccrcagcctaccttcggtatttctcactagaggatggctctcgcagccttctccctatcattaaccctttttcgctcttctccctcccttcccccgtcagctc

SEQ ID NO: 44917 - DNA, 201 bp, Homo sapiens
tacatacacgggtagattcaagggctgtttaagaggtaggatagaaaatatttgctcaaggatcggatttgatgattgagggagagaaacaaggaagcctsaagaatgatgcccatgtgtctggtgtaccacctgcgtgcaaagtgatggtattcattgaggtagggaactcctgagatgcaccaggttttccaggaaagt

SEQ ID NO: 44918 - DNA, 201 bp, Homo sapiens
aatgacttttaggggtttttgaaatttttttctaattttgtaggtattatgggagggcaatttagtgtagccttaatgaagttgaataatgcctcctgtaygtagtcctggacttgtattgtctacttgaccaccagtgactcaagaccaagacactttattctgccactggtcaaaccctgagatcatgagagggtgtta

SEQ ID NO: 44919 - DNA, 201 bp, Homo sapiens
gtgtgtggctgactcatgggcaatgaaataaattttgttgaatcagtggtattggggacctcacctctatccccaatactttggacaacccattaagcttsctcatgtcttttccatttgactacagtctggaacattatttctttaaactctcaacctctctgtgtagcttttaatcttccccttcttagccaagtttta

SEQ ID NO: 44920 - DNA, 201 bp, Homo sapiens
cattttgattatatttattactttctagaatttaaaatataaattagaaatctcaggtttttgttgactagctggtaagatggttaaggttaggagctgakccatgttgcctctctgctttactccatagtcctcatgttttgttgggaccatgttttgaagtttattgcattatgctgataatgacttttaggggttttt

SEQ ID NO: 44921 - DNA, 201 bp, Homo sapiens
ggtagacagtttgaaagctgtcactttgaaagagcgagctgccaagtttctagctaccgtatttaaaaaaaaaaaaaaaaaaaaggcggcttagcaatgarctgttccattttgccaggaactaggcttggacaggggaagcaaattcatttcctgtttgtggcaaacggagtctggatgatgataagactttttccatct

SEQ ID NO: 44922 - DNA, 201 bp, Homo sapiens
gggtccagcttgtataggccttgtcagtttcagcttgcaatttatccaaaaagcaaagagaagtagccatataagggctttgtgcaaataatttgatttcrgattttagccctgaaatgctcattctgactgcactgtagagaatggactggaaaggggtacatacacgggtagattcaagggctgtttaagaggtaggat

SEQ ID NO: 44923 - DNA, 201 bp, Homo sapiens
catccagcagggagttttcatggaatctggtggtcacagggtactttcttggctccggatgccttgctttgacttccatatgggatctccctgtgttcctyacccactgctccagtacccgtgttatcctgcctacctggctttgtgaacagcttccctgactccggagaattacatgcccagtgctcaggcttccccgcc

SEQ ID NO: 44924 - DNA, 201 bp, Homo sapiens
atatcatatataaatatattgtttataatatgtaaacaatatatacataaataatatataaaaactatatattatatatgtaaacaatatatttttaaaamccaaactcatgggtttatagttttttcatagtgaaaacaaacaaatatatagtttgcttatatctattatatataaacagtatataatatataaagatat

SEQ ID NO: 44925 - DNA, 201 bp, Homo sapiens
agtccattttccgatatgtttggaattaggctaaattgtgttaggtagacagtttgaaagctgtcactttgaaagagcgagctgccaagtttctagctacmgtatttaaaaaaaaaaaaaaaaaaaaggcggcttagcaatgagctgttccattttgccaggaactaggcttggacaggggaagcaaattcatttcctgtt

SEQ ID NO: 44926 - DNA, 201 bp, Homo sapiens
aacatggtaaagccccatctctactaaaaatacaaaaattaggcgggcatggtggcatgcacctgtagttccagctacttgggaggctgaggcagaagaaycacttgaacccgggaggtggaggttgcactccagcctttgcaacagagcaagacttcatctgaaagatagaaagatgaaagaaagaaagaaagaaagaaa

SEQ ID NO: 44927 - DNA, 201 bp, Homo sapiens
caaaatccaggtcttgttcagctggaaaaaaccagcagcgtccagacatgactgggttttttgtttgtttgtttgagatgtgaagttttgcatgtaaatcraatagagtttgccagaaaattcattgcctgaacaaatatggtctgctccttgggtattgccaagtaggagaaagatggtttgtctggagagactgcagag

SEQ ID NO: 44928 - DNA, 201 bp, Homo sapiens
gagttttggctgggatggctggaactgtgcatcattgcgctgggcatccagcagggagttttcatggaatctggtggtcacagggtactttcttggctccrgatgccttgctttgacttccatatgggatctccctgtgttccttacccactgctccagtacccgtgttatcctgcctacctggctttgtgaacagcttcc

SEQ ID NO: 44929 - DNA, 201 bp, Homo sapiens
ttagcgacacaagcgggggcgaatgtcatttctcaggagttttggctgggatggctggaactgtgcatcattgcgctgggcatccagcagggagttttcayggaatctggtggtcacagggtactttcttggctccggatgccttgctttgacttccatatgggatctccctgtgttccttacccactgctccagtacccg

SEQ ID NO: 44930 - DNA, 201 bp, Homo sapiens
accaaatacttggttgacctgtgggtggctgactcatgggcaatgaaataaattttgttttatacgtataactttatatatatgtaactttatatatatawaaaaagtttgcttatatataatatatatacacatatcatatataaatatattgtttataatatgtaaacaatatatacataaataatatataaaaactat

SEQ ID NO: 44931 - DNA, 201 bp, Homo sapiens
ttgtgttccagaatctctacctcttttaaggtgcagatactttttcactcgtttctccacagcaggtgtttccaccattctgttcagaacaataaaaagakcagcttttttttttttttttttttttgagacaggatctcactctgttgcccaggctggagtgcagtggtacaatcagctcactgcaacctctgcctcccc

SEQ ID NO: 44932 - DNA, 201 bp, Homo sapiens
atgtacatcagcatcatagaattctgaaactactgatgcaacagaatcataaaatgtttaatgagacatatcaatttaattctgctgcttggaacttaaaragccagagttcgtcagcattttgctaacaaatgtcatcatttacagactgaatttggtgctgattatgttcaccattactaaaaatattgggaaatgagc

SEQ ID NO: 44933 - DNA, 201 bp, Homo sapiens
tctcacgtgtcccagatttgttttaaaaatcattttcaattcatctagttttctattaatgttaaaaggttggaaattatattttaattagtgttagagaygtacatcagcatcatagaattctgaaactactgatgcaacagaatcataaaatgtttaatgagacatatcaatttaattctgctgcttggaacttaaaga

SEQ ID NO: 44934 - DNA, 201 bp, Homo sapiens
attaaaaggagatgacctactgcttccctcctgccagtgatgggccacaaaacagacatgacacgtgggccttctcacgtgtcccagatttgttttaaaartcattttcaattcatctagttttctattaatgttaaaaggttggaaattatattttaattagtgttagagatgtacatcagcatcatagaattctgaaac

SEQ ID NO: 44935 - DNA, 201 bp, Homo sapiens
actcccggctaattttttgtatttttagtagagacagggtttcaccgtgttagccaggatggtctcgatctcctgatctcgtgatctgcccctctcgcctyccaaagtactggaattacaggcatgagccaccgcgcccggcccccaagacgcacttttaagagattatacaggaaagttttacttatcactgccttagtt

SEQ ID NO: 44936 - DNA, 201 bp, Homo sapiens
ccaatgtccaaaaattatctttttagttagtttatttggattaaggtctgtagattaaatttggttggtatgtcacttaaatcttttcctctagagtaatyctcttcatctgtttcttcatgccacaaacttatggctgaaactgagtcattttttatgtagaactttccatattctgaattttgctgattccatcccccg

SEQ ID NO: 44937 - DNA, 201 bp, Homo sapiens
cccgggttcaagcggttctcctgcctcagcctcccgagtagctgggactacaggcgcccaccaccactcccggctaattttttgtatttttagtagagacwgggtttcaccgtgttagccaggatggtctcgatctcctgatctcgtgatctgcccctctcgcctcccaaagtactggaattacaggcatgagccaccgcg

SEQ ID NO: 44938 - DNA, 201 bp, Homo sapiens
tccttattttttgccttagcattttcaagtaaattctagtaatcatattattttacctgtacatattttagcgtgtagctttttaaaaatagacatatatrcagtatacatagatacatatgtacatatgtgtgtatgtatgtgtttaagtgtgtttgtgtataattattgcagctaatacaaatcaacaagagctccttg

SEQ ID NO: 44939 - DNA, 201 bp, Homo sapiens
ctgcaagctccacctcccgggttcaagcggttctcctgcctcagcctcccgagtagctgggactacaggcgcccaccaccactcccggctaattttttgtwtttttagtagagacagggtttcaccgtgttagccaggatggtctcgatctcctgatctcgtgatctgcccctctcgcctcccaaagtactggaattacag

SEQ ID NO: 44940 - DNA, 201 bp, Homo sapiens; identical to SEQ ID NO: 11934

SEQ ID NO: 44941 - DNA, 201 bp, Homo sapiens
ggcacaatcagaataccttatcccacaagttagcagacctgggcatgtagagagtactttaaatggagagttatattgttttgtgtttccttccacaaagsaaccagagatgctgttcctggaggaaacttatttagaggtagggacatttgatagggaagagagcatgagagagatggagattctggcttctgtccatgc

SEQ ID NO: 44942 - DNA, 201 bp, Homo sapiens
ttacttaaagagcagtttaattccccagggcacaatcagaataccttatcccacaagttagcagacctgggcatgtagagagtactttaaatggagagttrtattgttttgtgtttccttccacaaaggaaccagagatgctgttcctggaggaaacttatttagaggtagggacatttgatagggaagagagcatgagag

SEQ ID NO: 44943 - DNA, 201 bp, Homo sapiens
cctgtcccagctgcttggtggaagcagcttttgctacccttctgggctattgcgcaggtttcatttatgagctcaaccctgaaccttccctgacagcagcraggcctgtgtgcgtacctaattatgaagtgacggcctgtccctgtgaaggtctcaggagagaggcttcccaagctgtgaagtgctcaaaccacagcagaa

SEQ ID NO: 44944 - DNA, 201 bp, Homo sapiens
aaaatatacagcttgatgatgattttgtatgtgcgtgtgccttgcaaccacaagccagatgaagaaatggaggatttccaacacccctagaaggttccctsttgccttttacagccaataaccccctagactatcaccaagatagtaacttttctgacttttatcaccataggtttgttttgcccatttgaccagtagttt

SEQ ID NO: 44945 - DNA, 201 bp, Homo sapiens
cgtgctaaccatccctgagatcatcatcaaggtcagtcttagcgtctcatcctggaacagagacaaaggcacgcagacttagtgttcatgtgtgcatatgygtgcttgtatgtgtgtgtgtgtgtgaatgaatgtcctgctcaaaaaaaaaaaaaaaaaaaataccagtgctaggatcctcttgttctttgaaagaagtaa

SEQ ID NO: 44946 - DNA, 201 bp, Homo sapiens
ttaacttatttcaagatcccatctgtgacaggtataatcattctctgaagaatattttacaacctagggagacaataatttacattttgttcatattagasaaaaagtaggaggacagggaggcagttgctcctccggagatttttttcttttctttaacagtccattttccgatatgtttggaattaggctaaattgtgt

SEQ ID NO: 44947 - DNA, 201 bp, Homo sapiens
tgctgaaggtggagcccgcctgattggctgagagactggatatgtggtgtgagagaaggaaggtatggaggaagccaaatgagtgatgaatgtgaaatgtktgccacatggtagaatcttagtaaatggtaacttccaacatgtttacatttggggaaactgaagctcgagagatgagtcgatgtgttcaagcccccacac

SEQ ID NO: 44948 - DNA, 201 bp, Homo sapiens
cactgcaagctccacctcccgggttcaagcggttctcctgcctcagcctcccgagtagctgggactacaggcgcccaccaccactcccggctaattttttktatttttagtagagacagggtttcaccgtgttagccaggatggtctcgatctcctgatctcgtgatctgcccctctcgcctcccaaagtactggaattac

SEQ ID NO: 44949 - DNA, 201 bp, Homo sapiens
ggtacccaaaagaaatgtgagaaagagttatttttcctgtttttttttaaataaataaaccagtttctcatggatagcatttatgcttatagttcaataayaatattaccaaaaattgcatggagaattcagttcactagggaattcctagtatataaacctaaacatttaacttatttcaagatcccatctgtgacaggt

SEQ ID NO: 44950 - DNA, 201 bp, Homo sapiens
aatgttcacatccaattggaaacattttgtatgtgttcattttgtatttcagttttatatcttttgacaaagttaatttttcttataaatattttcagatraactcaaaagcagaaagagtagcacaatgaatatctacttatatgactctcagagttaatggttatcaagattttgccacatttgctttatctatccctt

SEQ ID NO: 44951 - DNA, 201 bp, Homo sapiens
agacagactttttttgtttttgttttgagacggagtccggctctgtcgccaggctggagtgcagtggcgcgatctcggctcactgcaagctccacctcccrggttcaagcggttctcctgcctcagcctcccgagtagctgggactacaggcgcccaccaccactcccggctaattttttgtatttttagtagagacaggg

SEQ ID NO: 44952 - DNA, 201 bp, Homo sapiens
gggactaaaagatgaaagagaagatataagcctgggaaaagatggcaggcatcacaccataccaggccttggggatcttgctttcctcctgcagataatgsgggacttgagaaggattctaattagcagaaatacataatcagaattatgctttacaaagtggtagggagggctgggcacggtggctcatgcttgtaaccc

SEQ ID NO: 44953 - DNA, 201 bp, Homo sapiens
aaatataatcatgcagtatgtactccttgtgaggcttcttttatgcttccttactgtattctgagcttcatccatgctgttttttgtttcagtagttcatwcctctttattgctgagtagtagtgtttcattgtatggatgaatcactatttgcccatgtatttacttgtggatggacatttaggccattttccgtttttg

SEQ ID NO: 44954 - DNA, 201 bp, Homo sapiens
tgaatgagcatgcaaagttccaaaacttctgagtagaagtttggttgggttcacattggtcatatagactaatttgggtagaatttatatctttacattastgaatgttcacatccaattggaaacattttgtatgtgttcattttgtatttcagttttatatcttttgacaaagttaatttttcttataaatattttcag

SEQ ID NO: 44955 - DNA, 201 bp, Homo sapiens
cagccttgactatcaacattcaattctcacctgccccaccccacaacaccgtaactactgagtttcttttgcaaaaccctagcatgtcatgaagcacaatytgacatccaccacaccacttccacctgtgattaagtctggtcaccaccacactgtagctggggatttgtggttcacaaaacctggaaacgattttctaca

SEQ ID NO: 44956 - DNA, 201 bp, Homo sapiens
gccctgcctggctgttttctttcacattgttttttccagataagcttttgaatgagcatgcaaagttccaaaacttctgagtagaagtttggttgggttcmcattggtcatatagactaatttgggtagaatttatatctttacattactgaatgttcacatccaattggaaacattttgtatgtgttcattttgtatttc

SEQ ID NO: 44957 - DNA, 201 bp, Homo sapiens
ggaaatacatgcacagagaagcaggggtggcacaacataggaaatctgcccatataatcctatgcacaaattaaaggaaaaaattaggcaatcaaatcagyagtcacagaaaggtacatggtaaaattcagcatccagttttaggaagagtttaaggggaaaaatttagaaaaaaaacacctcaatgataataaagattgc

SEQ ID NO: 44958 - DNA, 201 bp, Homo sapiens
gctaatgacctgcattctctctcttaggtccgtggcactcaggtagttggttctgacatgactgtgacaattcagtttaccaatcctttaaaagaaacccygcgaaatgtctgggtacacctggatggtcctggagtaacaagaccaatgaagaagatgttccggtaaaccttgggttggggagaccgggcaggcagtgca

SEQ ID NO: 44959 - DNA, 201 bp, Homo sapiens
ttaccttctctgggtcgggaggacagtgggaatgtcagagggtgactgaaatccaccccaaattttcttggcccactcttttcttttttaactacccttcyattcccaccagaggaacagtaaaataaatgaggtcattattcttcactacatgcctcttgtaaattgttagtcagcctgcaagggtggttatttacgagg

SEQ ID NO: 44960 - DNA, 201 bp, Homo sapiens
tcagtaggctcagcatttgtttttacatgtttgttataaatccttaccttctctgggtcgggaggacagtgggaatgtcagagggtgactgaaatccaccscaaattttcttggcccactcttttcttttttaactacccttccattcccaccagaggaacagtaaaataaatgaggtcattattcttcactacatgcctc

SEQ ID NO: 44961 - DNA, 201 bp, Homo sapiens
tagtcattgttatttcgaggataccagtcctggcgaactactctactttatactgaaggggctaaaaggaaagaagcaaactcaactgactattgaggaamcatttgcttgtgcttcatagattgattccattccagtgttactagataggcaagcaacgtctctggagtggctatatgaaaccattttaggaaggcagtg

SEQ ID NO: 44962 - DNA, 201 bp, Homo sapiens
tcagccctttaggatatgcacagcttcatgcaccttgggttcccttcataccctctttctttcccctgtctcctcctgttacatccttccctttttcctcytcctgctctgcatttttccctctctcatacgtccattcctttaattcagatatttttgaggcctgttctataccagctctacaccatgcagcagtggtat

SEQ ID NO: 44963 - DNA, 201 bp, Homo sapiens
ttccttgtagagtctcttatatgcttcaaagtgtgctcatagtcagtatctccctagattgtgtgtttggaaggtgtaatccttatctcattcagcctttygtggtgcctggaattgagtcaatgttcagtaaatgtttgctgaactgaactgataatcaccattctgagaggcaaggagacgattattagactcagattt

SEQ ID NO: 44964 - DNA, 201 bp, Homo sapiens
ctagtttctctttgtttttctttctccaaatagtttgaagatggcatcctggacacttgcctgtatgtgatggacagagcacaaatggacctctctggaakagggaatcccatcaaagtcagccgtgtggggtctgcaatggtaagcagcaattactgatacctaaaatctgttacacctgtcatttgcctcagtatatat

SEQ ID NO: 44965 - DNA, 201 bp, Homo sapiens
attccttcttaagcattctaaaatggcacactcatcagcataagcttactcacacactgtgtgtacttttacgcacccagaagtcagaaatcactgcctarcagaagccagtgcaaaagagaagcagacaggaagcagttaacctaatgtgtctgtggtggcagctggctaagcggaagctgttaattattgaataagcac

SEQ ID NO: 44966 - DNA, 201 bp, Homo sapiens
gagtttgagaccagcctgccctacatggcaaaaacttgtctctactaaaaatacaaaaagttagccaggcatggtggtgggtgcctgtaatcccagctacytgggaggctgaggcaggaaaattgcttgaacccaggaggcagaggttgcagtgagctgagactatgccactgcactccagcctgggtggcaagagtgaaa

SEQ ID NO: 44967 - DNA, 201 bp, Homo sapiens
tcacccagtggccactagtggcctctaagaggccttgtatccgcggttaccaatctgcggatgatgactttggctccaggaacaccagccccaagttaaaytcttgtctccatttttttcagtggccactcttccagttagcaagctgctcttgtaatactgactgagaaatgcagagaggcaagaagaggaaaagggggg

SEQ ID NO: 44968 - DNA, 201 bp, Homo sapiens
gtaatactgactgagaaatgcagagaggcaagaagaggaaaaggggggaaatggcgggtttttcatttctaatagttctgtagcagtgagtcctgcccatyactgtgtgtgatatatacagtgttctaaggtatactgagtgtatataacgcccttaagtcatggctttggtaacatttggttaagaattattttggtaaa

SEQ ID NO: 44969 - DNA, 201 bp, Homo sapiens
ttggcaattgctggagacacttttggttgtgatggctggggtgcggggctgctcctggcatgcagtgggtagacaccagggatgttgcttaacatcgtacmtggcacaggacagctctgcaacaaagatgcatccagcccgatatgtcagtagtgttgatgctgagaagccctgatctagatcatgattactgtttttgcc

SEQ ID NO: 44970 - DNA, 201 bp, Homo sapiens
ttaggaagttatttaagagccaactgtcttgtctttcccgagtccgtttgaggaagtccccgaggcgcacagagcaagcccacgcgagggcacctctggasgggagcgcctgcaggtaagccaccgcccctgcaccctatgagccagggcccgctgcgtccaccttctgcacctcggtttcctggttgaaccagcaagcgg

SEQ ID NO: 44971 - DNA, 201 bp, Homo sapiens
aacaagagagcagaacgaggttttatttgctgctaatgacctgcattctctctcttaggtccgtggcactcaggtagttggttctgacatgactgtgacarttcagtttaccaatcctttaaaagaaaccctgcgaaatgtctgggtacacctggatggtcctggagtaacaagaccaatgaagaagatgttccggtaaac

SEQ ID NO: 44972 - DNA, 201 bp, Homo sapiens
caccttctacaccggggtcccgaaggcagaattcaagaaggagacgttcgacgtgacgctggagcccttgtcctgtaagctaacaatggtgtggttctttstgagactcgctgtctggcccctgtcttgctaggtgttaatgcccgttatagctttatatcaaagttaaagttccctccaagatctcagaagtgtgagcct

SEQ ID NO: 44973 - DNA, 201 bp, Homo sapiens
tcttgtctttcccgagtccgtttgaggaagtccccgaggcgcacagagcaagcccacgcgagggcacctctggaggggagcgcctgcaggtaagccaccgmccctgcaccctatgagccagggcccgctgcgtccaccttctgcacctcggtttcctggttgaaccagcaagcggcttgctctgggccctgtggcgccggt

SEQ ID NO: 44974 - DNA, 201 bp, Homo sapiens
ttcaaatggcactactgagtttaattctatctcaatcaatgcttagtgtccgctctatgcctgcaattggtttggtgctggcgattccagcagtgagcagractcagttcctgtcctggtccgagtgacaggattattgtgcagaggggtctttggaaacaataagtaggggcatttagtccaactgattcagaaaaagac

SEQ ID NO: 44975 - DNA, 201 bp, Homo sapiens
gtcttgctcttcctctctgtctgtctctcatgcatacatacacactgtcctgtggatgcacgtctaggtgttagtggcagcaaatgtactggagtcccacrgcaccaaagtatgttagcagcagtgaatccacatggatctacagcagcctcaattcttgcctcctcataaggcaggagagactggggcaagttttagagc

SEQ ID NO: 44976 - DNA, 201 bp, Homo sapiens
aagagagcagaacgaggttttatttgctgctaatgacctgcattctctctcttaggtccgtggcactcaggtagttggttctgacatgactgtgacaattsagtttaccaatcctttaaaagaaaccctgcgaaatgtctgggtacacctggatggtcctggagtaacaagaccaatgaagaagatgttccggtaaacctt

SEQ ID NO: 44977 - DNA, 201 bp, Homo sapiens
actgactgagaaatgcagagaggcaagaagaggaaaaggggggaaatggcgggtttttcatttctaatagttctgtagcagtgagtcctgcccatcactgygtgtgatatatacagtgttctaaggtatactgagtgtatataacgcccttaagtcatggctttggtaacatttggttaagaattattttggtaaaatctg

SEQ ID NO: 44978 - DNA, 201 bp, Homo sapiens
cgaaatgtctgggtacacctggatggtcctggagtaacaagaccaatgaagaagatgttccggtaaaccttgggttggggagaccgggcaggcagtgcagrgctgtgggaagctttctctgtgtgtgtcttttccaaacatagatctgctccccagtgaaaatgtcttggaagctgcctcctccttgccgaccatttctgt

SEQ ID NO: 44979 - DNA, 201 bp, Homo sapiens
aaagtcatttctatgattctaaaatgacccagggaattcaatgatgaatgagaggtacagactcaaagcaattctctaatgtattcaaagtaaacaatacyataaggtcaccttattcaccagggattttcatttctgttcattgaagatttttaaaaaattgacagatatattggaagccagtgggaaaatagaatttat

SEQ ID NO: 44980 - DNA, 201 bp, Homo sapiens
aatgcagagaggcaagaagaggaaaaggggggaaatggcgggtttttcatttctaatagttctgtagcagtgagtcctgcccatcactgtgtgtgatatayacagtgttctaaggtatactgagtgtatataacgcccttaagtcatggctttggtaacatttggttaagaattattttggtaaaatctgtattttaaaat

SEQ ID NO: 44981 - DNA, 201 bp, Homo sapiens
ggagagatgggacactaacaaggtggaccaccacactgacaagtatgaaaacaacaagctgattgtccgcagagggcagtctttctatgtgcagattgacytcagtcgtccatatgaccccagaagggatctcttcagggtggaatacgtcattggtgagtgccatgtgcaagctccagtcttgacaccatgggttgcatt

SEQ ID NO: 44982 - DNA, 201 bp, Homo sapiens
tattgtctctttctatgattcatatcaggaatgaaatttctcagtttggaacagcagaaaaaggcagaagcctccggtgttccttgcaacctttccaattrtaacgcatatcaattagtaggagctctcggggtgacaactttgggagaatccactgatttatattaatgaagagtgttactgtagtccaacagagtaaag

SEQ ID NO: 44983 - DNA, 201 bp, Homo sapiens
aaataaatcaatttaatttaatatgaagaaatcaatatgttcccaatatcttggatgcttttaacagcaaataaataaatatgacctgcttgtattttatyattaaattcatccttagccaatttgctttgtatttatataaggtctttttagcccctttcatacagaatggagtaagtaaccaagactggtgtcctcaga

SEQ ID NO: 44984 - DNA, 201 bp, Homo sapiens
taggctaaattgtgttaggtagacagtttgaaagctgtcactttgaaagagcgagctgccaagtttctagctaccgtatttaaaaaaaaaaaaaaaaaaaaggcggcttagcaatgagctgttccattttgccaggaactaggcttggacaggggaagcaaattcatttcctgtttgtggcaaacggagtctggatgatga

SEQ ID NO: 44985 - DNA, 201 bp, Homo sapiens
agcagcctgcggtcccagctacttgggaagctgaggcaggaggattgcttgggcccaggagttcgaggcagccccgccagcctgtctctaagaagaaagaragacaataagcaataactttaaaactcaagaggcagggccgggcccagtggctcacgcctgtaatcccagcacttcgggagaccaaggcaggcagatcat

SEQ ID NO: 44986 - DNA, 201 bp, Homo sapiens
ggcacctttctcaagactttctgtagcacctagatgttgaagcgaaggtcaaaggagaattttttaaagacaagagagagtgggtgttattttatggtgayggagaggaaccaggaaagagagtttgcagtccagagagaggacggtggttcacagccttggctgcacgttgcaatcatctgggaagctttgaaactatgg

SEQ ID NO: 44987 - DNA, 201 bp, Homo sapiens
gaaggtggaggttacaatgagctgagatggcacccctgcactccagcctgggcaacagagcaagactccgtctccaaacaaaacaaaacaaacaaaaaaaataaaaaaaatggtgcctggcaccttgtaggcactgaaaaactctttcaagaatgaacaaaacctggggtcgcctatggctctgcccccctacttaatgcc

SEQ ID NO: 44988 - DNA, 201 bp, Homo sapiens
tgatcttgaaaaggacggtttcactaaagtgatagagacagaagccagggagatggtcatgggctgtgttgtaaacaggaggcgagaaagtagagacggcrggagatggcacctttctcaagactttctgtagcacctagatgttgaagcgaaggtcaaaggagaattttttaaagacaagagagagtgggtgttatttta

SEQ ID NO: 44989 - DNA, 201 bp, Homo sapiens
gttttcagttcatggaaaggattggaggaaggtgggacaaaaaccagagaccaatttggaagctgtggtctaggacaaagatgatgataaactaaacatgstggtaccagtggagatgagaaggggttagattggagatctattttgtatttagaacaaaaattgcacagggattcaagatgagaagtaaagaaatgggag

SEQ ID NO: 44990 - DNA, 201 bp, Homo sapiens
agtaacttatgtaaccacctccttagaatgttctctctctgacaatatgcctaccaaagactcttttaaagatctttgaaattagtaattagggaggttamaatggagcactgtttgcttgtcttaatgtggaatcctctacatgctttatagaaaacaaatgaagtgaataagttttgctcttgaaggttctcctgctta

SEQ ID NO: 44991 - DNA, 201 bp, Homo sapiens
aacctctttttttggagtgaacggtcgtagatacatctgaggacccaggtgctcaatgggcattgtccttggcatttctaaatcaccaaggaactttttcrcatttacccatatggattttaatttttgaaaaagttcatctatcaaaacaaatcatgattatgtaataataccttgttaccccattcttgtgtcagattt

SEQ ID NO: 44992 - DNA, 201 bp, Homo sapiens
gagctgaaaccagatatggtccttactctcagatcatattaccttagagggccactatcaacacgttattgccaataacacaataattatgtaagattgarttgccatttcctagaaaagaagagagccccaagggaatggagcccagatgaggcaaattattgaaaatggggaataagtgaagaaaggtatcaatcagag

SEQ ID NO: 44993 - DNA, 201 bp, Homo sapiens
ggagcaaagagaacaggcttccctgtccccagttctgtctccacttctgcctagctatgtgatgtgcacacatgacgccctcaccaagcctcagtttcccrtctgtaaaaatttcctcacagaggttttgtaaggaccccaagaaataaaacttatttcctgtcactttatttgcatcactatgtgaactgccttggcaac

SEQ ID NO: 44994 - DNA, 201 bp, Homo sapiens
gtctatgcctgttcctgcctcccgactgataggatctggcagcaactatgggcagagaatttcccccaaggagatgcagctgcttctgcaaaggctgccgytactgcagataaaggctcgttattcactgtgacacacctacatgtaccacctccatccatatttgctccagtgggtcaaggcattaccagtggaggatct

SEQ ID NO: 44995 - DNA, 201 bp, Homo sapiens
gaccctcatgcaggttctctccacctggtcttccttctcttcactcactcagttgttacctcctttgatccacatttctggctcacacaactcttatccayggcagcatattttctcaatgtcccttttcctcatattcctttggactttccagttttattcttctcttgtctcctttcatctccctagatcccttttgcc

SEQ ID NO: 44996 - DNA, 201 bp, Homo sapiens
gaggctgaggcaggagaatcgcttgaacctgggaggtggaggttgcagtgagccgagattgtgccattgcactccagcctgggcgacaagaccaagactcygtttcaaaaaaaaaaaaaaaaaaaagtgtaaggagaaaatggagaacaggagatatgtttggaagctgtagagatactccaggctagaagaggaatagac

SEQ ID NO: 44997 - DNA, 201 bp, Homo sapiens; identical to SEQ ID NO: 44808

SEQ ID NO: 44998 - DNA, 201 bp, Homo sapiens
acagtggtgtgatctcagctcactgcaacctcttcctcctaggttcaagcgattctggtgcctcagcctccagagtagctgggaccacagttgcacaccaytacgcccagctaattttatgtatttttggtagaggcagagtttcaccatgttgtccaggctggtttcgcactcctaacctcaagttatccacccacctca

SEQ ID NO: 44999 - DNA, 201 bp, Homo sapiens
gtacattaatcttgtatccagaaactttgctgaattcttttatcagtcctaggagctttctggaggagtccttggggttttcaaggtaaacaatcatatcrtcagcaaacagtgacagtttgacttcctctttacctatttggatgtcctttatttctttctcttaacttattgctctggctaggacttccagtactatgt

SEQ ID NO: 45000 - DNA, 201 bp, Homo sapiens
tgtgtgatatatacagtgttctaaggtatactgagtgtatataacgcccttaagtcatggctttggtaacatttggttaagaattattttggtaaaatctrtattttaaaatgtataaactcatgtaagtttcctctcatacacaccatgatattcaagaaaaaaaaatgaaatatttgaggtaggcacggaaatcccaga

SEQ ID NO: 45001 - DNA, 201 bp, Homo sapiens
caaagcctagagccccatgagttgtgagaattaaatgtaacttcttgctactcaaagtgtggtccatgagccagctgcatcagcattccccaggagtttgwaaaaaatgtagaatctcatgtcccaccccacaccctctgaatcaaaatccatgttttgacaagatcccaagcagactggagtgtacaggagagtttgtgg

SEQ ID NO: 45002 - DNA, 201 bp, Homo sapiens
agctttgttacaagctggctagagggaacttaagatcccagggaaattccatttttccttgagaccccctaagtccaaatcaatacactaagaagaaacgraaaaaatcctaagagtttaagtaggaagaatttttatcaaggtctgtgtgggaggaaattggggcataagttcctctgtggtcaggcattgagctaggta

SEQ ID NO: 45003 - DNA, 201 bp, Homo sapiens
aaaaaggtcatagttttagctgctgcatatgcctatactagttcctctctaccttgatatattaatattacagttaatagcagaagtattggagccaagcrttctctgggtcagtgccctgggactaatagagctaacatttatttagtatttactatgcatcggtcttggtgtatgcatgatcttatccagttcttttta

SEQ ID NO: 45004 - DNA, 201 bp, Homo sapiens
ccagctgaattgctttccccttagccacaatatctcaatcaacacaagtaacgtactttccttgggacattcacctttcttcagattcagaaccagagagsaaaaaagaaatcaccccttcttccttctgcctttactttctagtagaagttatacttaaaaaaaaaaaacaatttgccaggcatggtggctcacacctgt

SEQ ID NO: 45005 - DNA, 201 bp, Homo sapiens
ccgcccagaagcgagggctcctgcccgccgcactcacccagccaggcgtgcacctggggctccccccttctcccccttagcactgtgtctcccgacagcgygccacactgttctgcacccctggcaatgccgcagcctaccttcggtatttctcactagaggatggctctcgcagccttctccctatcattaacccttttt

SEQ ID NO: 45006 - DNA, 201 bp, Homo sapiens
cttcatgcagttcacccagtggccactagtggcctctaagaggccttgtatccgcggttaccaatctgcggatgatgactttggctccaggaacaccagcmccaagttaaactcttgtctccatttttttcagtggccactcttccagttagcaagctgctcttgtaatactgactgagaaatgcagagaggcaagaagag

SEQ ID NO: 45007 - DNA, 201 bp, Homo sapiens
tatctcctggttaccttttgcatttcagatttatatttaattgttctaaaagcaggttttctggcactatatatcaagttttctccaagtcactaagggaygaaatttgctaagcgactaaaccttggaaagaacactcatttttaaaatgccatcttcatgcagttcacccagtggccactagtggcctctaagaggcct

SEQ ID NO: 45008 - DNA, 201 bp, Homo sapiens
gtttcttaatgtcacgagcgttcacctgttcaaggagagatgggacactaacaaggtggaccaccacactgacaagtatgaaaacaacaagctgattgtcygcagagggcagtctttctatgtgcagattgacttcagtcgtccatatgaccccagaagggatctcttcagggtggaatacgtcattggtgagtgccatgt

SEQ ID NO: 45009 - DNA, 201 bp, Homo sapiens
atcagtcattatttacttggcagacatatgtgtccacaacccaagtgacattctgggatatccattagaggcactggcataggaatatgaatgtccagtgrctgtagaatgaatgaacgaacagtcaatcacttgtgaattgaatgactcatagctctagtggcattataatttattattaataacaagctacagatttca

SEQ ID NO: 45010 - DNA, 201 bp, Homo sapiens; identical to SEQ ID NO: 11939

SEQ ID NO: 45011 - DNA, 201 bp, Homo sapiens
tcccagctactcgggaggctgaggcaggagaatcgcttgaacctgggaggtggaggttgcagtgagccgagattgtgccattgcactccagcctgggcgayaagaccaagactctgtttcaaaaaaaaaaaaaaaaaaaagtgtaaggagaaaatggagaacaggagatatgtttggaagctgtagagatactccaggcta

SEQ ID NO: 45012 - DNA, 201 bp, Homo sapiens
aggtgggcagatcaccagatcaggagttcgagaccagcctggccaacatggtgaaaccctgtctctactaaaaatacaaaaattagcctggtgtggtggtkggcgcctgtaatcccagctactcgggaggctgaggcaggagaatcgcttgaacctgggaggtggaggttgcagtgagccgagattgtgccattgcactcc

SEQ ID NO: 45013 - DNA, 201 bp, Homo sapiens
gggaggccgaggtgggcagatcaccagatcaggagttcgagaccagcctggccaacatggtgaaaccctgtctctactaaaaatacaaaaattagcctggkgtggtggtgggcgcctgtaatcccagctactcgggaggctgaggcaggagaatcgcttgaacctgggaggtggaggttgcagtgagccgagattgtgcca

SEQ ID NO: 45014 - DNA, 201 bp, Homo sapiens
cagtaattaaccatgctattatttgaagaaaccctttctccatggtggaaattatatacaaacagctagtcaccaaaagcactgaagaaaaatgtagtagrgggttatttgctcttctgggggcttgtttgttttgcaattcagaaaactaaggttgacacaactgaagtttattccataggatctcaacatttacagtta

SEQ ID NO: 45015 - DNA, 201 bp, Homo sapiens
aatgaatgatttgactttattagtatgaaaagatgtgcctagagagcccacaagaaaatgttctgaagttgtggactcttagccagaaccctgttgcaggkcgacagagctgtgtgtgttttctcaggggctgggcccaggcctcacaggtaaaacagaggctggtgcagagttgttctgaattcctctcaaacacctccc

SEQ ID NO: 45016 - DNA, 201 bp, Homo sapiens
tttctgttaagcagctggttagatctacagactctgtcagattcagctccaagtggcattttttttttggaggaaggggcaaaaatatttcataagtcacrccattgcttcctaggacattcatcctggcagaagatacatatatttaggtttgtcaatagtatctggttcacgttttatcagtctcatccacccgttacg

SEQ ID NO: 45017 - DNA, 201 bp, Homo sapiens
aaaaaaaaaaaaaaaaaagtgtaaggagaaaatggagaacaggagatatgtttggaagctgtagagatactccaggctagaagaggaatagaccagagggrttttagcccctggaggtatggggctcatttctcttgttccagcttcctctgagcacctgagcaatccttcaacattataggttccaggatgtattaataa

SEQ ID NO: 45018 - DNA, 201 bp, Homo sapiens
gccggcggatcacctgaggtcaggagttcaagaccagcctggccaacatggtgaaaccccgtctctattaaattttttaaaaatacaaaaattagcggggyatggtggtgagtgcctgcaatcccagctactcaggaggatgaggtggggaggattgcttgaacccaggaggcagaggttgcagtgagccgagatcgcgcc

SEQ ID NO: 45019 - DNA, 201 bp, Homo sapiens
cccacccagcaagtctacccagctctggagtgacactgggcattgtctgcacagaatcctgtgatgtgagccatctctgggtccctctcagccaccggaayagcgcctattccggtggaggtggcagggggtacaatggacactgttagggttcttagctttggtgtttaatgctctatttttgtgctggttggctccctg

SEQ ID NO: 45020 - DNA, 201 bp, Homo sapiens
atatgaagaaatcaatatgttcccaatatcttggatgcttttaacagcaaataaataaatatgacctgcttgtattttatcattaaattcatccttagccwatttgctttgtatttatataaggtctttttagcccctttcatacagaatggagtaagtaaccaagactggtgtcctcagagtaacaatgacccacattcc

SEQ ID NO: 45021 - DNA, 201 bp, Homo sapiens
accaaatgaacatccccctcctgctgtcaaagagcagtcagtggccaccgctattgacctgagctctaattaggctggttttataatgaggaaaagagtgygattctaattagtaaatttccatctctttctcaataggtatcctccagtcaaagcaatcagctatcctcatcacactggttccattgccaaaaaaataac

SEQ ID NO: 45022 - DNA, 201 bp, Homo sapiens
actgaaggggctaaaaggaaagaagcaaactcaactgactattgaggaaccatttgcttgtgcttcatagattgattccattccagtgttactagataggmaagcaacgtctctggagtggctatatgaaaccattttaggaaggcagtgcgtttggatccttccagaataaaaagctcagactctaaaaatgccattcct

SEQ ID NO: 45023 - DNA, 201 bp, Homo sapiens
ggtaacatttggttaagaattattttggtaaaatctgtattttaaaatgtataaactcatgtaagtttcctctcatacacaccatgatattcaagaaaaaraaatgaaatatttgaggtaggcacggaaatcccagaggtgggaccagccattcagtggtagcgtttgacatctttgcatgattttaggcatctttaatgt

SEQ ID NO: 45024 - DNA, 201 bp, Homo sapiens
tcatttaacagttctattgtattgaattaaaactggaaagcaagcctggccctatttaaaaactgggttctagtagtttttcaggctaatggggtcttatrcctttctaagaatctcctccatcccaccactccttgtcagaattaaatcaaccaattaatgataaacctcctctttgtgcagagtaaacctctctggatt

SEQ ID NO: 45025 - DNA, 201 bp, Homo sapiens; identical to SEQ ID NO: 11965

SEQ ID NO: 45026 - DNA, 201 bp, Homo sapiens
cgtggttgtcttttctccagcatgttgttagtgctccacatgtctctggaaccatctctctactctggtggcctctataatggggactcttcacctcttgkgggtgtgcctggtttttgaaaatagccaagtctccaggagtcatgactgggtaatccaggggatcaagggggaaccttcactgggcccagaaacaaagtc

SEQ ID NO: 45027 - DNA, 201 bp, Homo sapiens; identical to SEQ ID NO: 11968

SEQ ID NO: 45028 - DNA, 201 bp, Homo sapiens
gggagtggggccaagtgagaacagcctgctagactggaaccccgccggcttggctccccactcctgcgcgcctccccactcctgcgcatcgcctgcctccrtcccaatttggagctgaactcgagccacttctcctccttagacccgcccagaagcgagggctcctgcccgccgcactcacccagccaggcgtgcacctgg

SEQ ID NO: 45029 - DNA, 201 bp, Homo sapiens
caggcttggggaatgggaaatgttggcaaccctgacttcttaagcctattgatagccctattgaaaattgcatgcccaacctctccacctccttatcctcytccatgtggctcaatttccaaagcagttcctacctcctcacccctaagtggatttacttatggctcttcttgggctccaccctaaccctatcagactata

SEQ ID NO: 45030 - DNA, 201 bp, Homo sapiens
atttctctccagagcagcctggtgagctggcaaggcaagctgcttccccagcctcttgcctctgcctgatccctagaaacctgttccgggtacagcagccrgcagctgacctcctctcagccctgtcagtggtgacaaggtccaggtgccagcactggtttggtgatacagacatcattcccctgggccatggcagggaca

SEQ ID NO: 45031 - DNA, 201 bp, Homo sapiens
tgcttccccagcctcttgcctctgcctgatccctagaaacctgttccgggtacagcagccggcagctgacctcctctcagccctgtcagtggtgacaaggyccaggtgccagcactggtttggtgatacagacatcattcccctgggccatggcagggacattcagactcatgtccccgagtggcattgagcagggagtct

SEQ ID NO: 45032 - DNA, 201 bp, Homo sapiens
cctacaagaagggttttttcactctgtgtttattaaatgctggtgatgtgtttagctgtggtctgtcctttcctgtagttttacgatgccttggaataccmgcaagaattgttaccaattatttctctgcccatgataatgatgccaatttgcaaatggacatcttcctggaagaagatgggaacgtgaattccaaactca

SEQ ID NO: 45033 - DNA, 201 bp, Homo sapiens
ttcaatattttcttcatgttcagtcaggatattaattcctagcttgctatgccagagtggtaaaagggggtagggcttcattttcaaaatgaacccagcaragggaacccagaagtgctcagaaagggctttctgctaactaatgatggcaaacgtggtctgtgtgatggggtggcatctactttctgaaaatttttaatt

SEQ ID NO: 45034 - DNA, 201 bp, Homo sapiens
tggaaaccattgcccctctgagatatctgtggtatacatcagcatattaaagtctcacatgaatgcttcagtaaagaatcctgatcagctttggttaggcyagcattttccacactggtttaaacatggagctctaattcttccaatacctgtcaatatcccataaaactagcactatgccatgatggactgactctaacc

SEQ ID NO: 45035 - DNA, 201 bp, Homo sapiens
ctcggttcaagccatcaagcacggccatgtctgcttccaatttgatgcaccttttgtttttgcagaggtaagcaggaagctggaggaaagtgctgtttttytccccaacctcttaacacatgaaagagtaagctaaaagttgttgtttctaagttttccaggtacatagcgtatgcttcgtgttgacaaaggtaactaggc

SEQ ID NO: 45036 - DNA, 201 bp, Homo sapiens
tggtgtcagccactctataagataggtacttcattcccatattaaagataagaaaactgaggctcagatagattaaataacttttctgaggctgcacaatwagtaagtagtgaagcatttccaaaaacatattctgaaaaatgcagatctccaaagaaaaaagtttccatagtcatttacatttggaaaccattgcccctc

SEQ ID NO: 45037 - DNA, 201 bp, Homo sapiens
caataataataaacatttattaagaatgtacttggtgtcagccactctataagataggtacttcattcccatattaaagataagaaaactgaggctcagakagattaaataacttttctgaggctgcacaataagtaagtagtgaagcatttccaaaaacatattctgaaaaatgcagatctccaaagaaaaaagtttcca

SEQ ID NO: 45038 - DNA, 201 bp, Homo sapiens; identical to SEQ ID NO: 44808

SEQ ID NO: 45039 - DNA, 201 bp, Homo sapiens
tttattttgctactatcttatcagatgcagcctatttttttggcatctcctacttggctataaaataatccagtcatttattcaaatagcatacaaaactytggaattattttagctttccttcttaacctcccttatgcatcttgccaaaaataccttcccaaaattatcataaatccagccacttctacaatctctatc

SEQ ID NO: 45040 - DNA, 201 bp, Homo sapiens
tgttccggtaaaccttgggttggggagaccgggcaggcagtgcagggctgtgggaagctttctctgtgtgtgtcttttccaaacatagatctgctccccartgaaaatgtcttggaagctgcctcctccttgccgaccatttctgtagggcgtggagtaaaactagggttggtttgaccagcactttcatcatttaatcct

SEQ ID NO: 45041 - DNA, 201 bp, Homo sapiens
aggctgagacatgagaattgcttgaacccgggaggcagaagttgcagtgagctgaaattgcaccactgaactccagcctgagcaacagagcaggactctgyctcaaaaaaaaaaaaaaaaaaaaaaaagaatgtgttttaagggttttgctttatcagatgcataatataaatcaacagtgagttaagagtatccaagaca

SEQ ID NO: 45042 - DNA, 201 bp, Homo sapiens
gggaggctgaggcagggggattacctgaggtcaggagttcaagaccagcctgaccaatatagtgaaaccccatctctactaaaacaaaaacaaaaacaaamaaattagccaggcatggtggtgtgagcctgtagtcttagcaacttgagaggctgagacatgagaattgcttgaacccgggaggcagaagttgcagtgagc

SEQ ID NO: 45043 - DNA, 201 bp, Homo sapiens
actgagattataaaggtagcaagagcctctgtaaagaaatcatatcccattagccaaaagaaatccagtggtcaaacatagtcctctagaaatagtcagargaagtcattttattattgttattactggaaacagctagaggcaaaaggcatcttcttcgaggccttccaccttgccacttcatccattctatctagagac

SEQ ID NO: 45044 - DNA, 201 bp, Homo sapiens
agtcttggtgccctcatccataatacggttacaatatatacctcacaggcttgttgttgtgaggttcaaactaaatcctttataaaatgtccctgaaacaytgtaggtatgcaacaaatgttggctatctcccccttagtagaaatccgacttcatgtgcactcagaacattctgtgagaaagtaaaattgctctctttaa

SEQ ID NO: 45045 - DNA, 201 bp, Homo sapiens
tccaatacatctctttttgaaggggtagtaagattattctaaatacatatgcctctcctacatataccatctttaatgattgaaagagaaagatagaaaaytcatcctccatgtgtatgaagataaaacctctatatgtgaagtcaatgctgctatacatttatttcgggattaattggagattgtctaaagttgcagtta

SEQ ID NO: 45046 - DNA, 201 bp, Homo sapiens
catacatacacactgtcctgtggatgcacgtctaggtgttagtggcagcaaatgtactggagtcccacagcaccaaagtatgttagcagcagtgaatccayatggatctacagcagcctcaattcttgcctcctcataaggcaggagagactggggcaagttttagagcaggagtgaaagtttattcaaaagctttagaac

SEQ ID NO: 45047 - DNA, 201 bp, Homo sapiens
aggggtagtaagattattctaaatacatatgcctctcctacatataccatctttaatgattgaaagagaaagatagaaaattcatcctccatgtgtatgargataaaacctctatatgtgaagtcaatgctgctatacatttatttcgggattaattggagattgtctaaagttgcagttagttatttgtggagctattaa

SEQ ID NO: 45048 - DNA, 201 bp, Homo sapiens
gaaatttctgccataataaataaatacataaataaataaataaattcaggttgatatttacaagatcaaatgaaagctttctctgggaaaaaaaattaaarcataccaacaagggcacaggctcccttagaggatatgtgctaagtaaagaagctctgacattttctttgtagaattgcttcatgaataatagtctatctt

SEQ ID NO: 45049 - DNA, 201 bp, Homo sapiens
gctgtcccttgggacatgaagttgagtaagttagtccctggcctcaagaaactctcagtgtagaagacaaaataaataaaagatcattgcaattcagtgtrataaagactgtgactgtgatttatgcaaattgcagtgaaataacagaaatcaatgtctagcggtgtggtggagtggggaagaggatgaggagggcttcct

SEQ ID NO: 45050 - DNA, 201 bp, Homo sapiens
gaggaagtccccgaggcgcacagagcaagcccacgcgagggcacctctggaggggagcgcctgcaggtaagccaccgcccctgcaccctatgagccagggmccgctgcgtccaccttctgcacctcggtttcctggttgaaccagcaagcggcttgctctgggccctgtggcgccggtcacaggcagctccacttgcccaa

SEQ ID NO: 45051 - DNA, 201 bp, Homo sapiens
ctccatccatcttccacgaacagagatttgcaaatttagatcttcttcttaaattattccaatggctttttatagcctaagaataaagcatgaatgtttartttgatatcaaaggatttcacaatcttatccttacctatatcataggtcagtgttgaagagtgtggatttcagagctctatcactaactagctgtgacct

SEQ ID NO: 45052 - DNA, 201 bp, Homo sapiens
gaagacaaaataaataaaagatcattgcaattcagtgtaataaagactgtgactgtgatttatgcaaattgcagtgaaataacagaaatcaatgtctagcrgtgtggtggagtggggaagaggatgaggagggcttcctgatgcaaggatattggagccgagacttagaggatgagtatgagtgttcctgacaggcaagcg

SEQ ID NO: 45053 - DNA, 201 bp, Homo sapiens
ccctctgaccaaaggggacgggtggggacttcctggcactgcagggccccttgcctggtactcccagcaactggttgcggtggggagggcagatctagggrtggggatggggaggagaagtgggaatgggaaattgggagtcagaggggcaagtgggagagaagggcgcacctgccgggataacaggccagatgaagtaaa

SEQ ID NO: 45054 - DNA, 201 bp, Homo sapiens
tgtggtggagtggggaagaggatgaggagggcttcctgatgcaaggatattggagccgagacttagaggatgagtatgagtgttcctgacaggcaagcgcrtggaaaagtgtttgcagtagagggaacagtatattgcaagtgaggagggactaaaagatgaaagagaagatataagcctgggaaaagatggcaggcatca

SEQ ID NO: 45055 - DNA, 201 bp, Homo sapiens
agcagccggcagctgacctcctctcagccctgtcagtggtgacaaggtccaggtgccagcactggtttggtgatacagacatcattcccctgggccatggsagggacattcagactcatgtccccgagtggcattgagcagggagtcttttttgtcaataacattcatgcaccaaaatctaattttactcctaagggtgtt

SEQ ID NO: 45056 - DNA, 201 bp, Homo sapiens
actcatgtccccgagtggcattgagcagggagtcttttttgtcaataacattcatgcaccaaaatctaattttactcctaagggtgttctgtgctgggttycactggggataaacacctatttgctgggataggtgagcatggtcatgctggagctgtgtggtcgattcccctcattagaaggagaccaatgcctgaaagc

SEQ ID NO: 45057 - DNA, 201 bp, Homo sapiens
agacacaatggagtactatacagcccttagaagaaggaaaattctgccattctcaacaagggtagaactggagagcactatgctaactgaaataagccagrcacagaaagatgaatactgtatgatctcacttatatgtggaatctgaaaaagtcaatctcagaaacacagtagaaagttgtttaccagaggctggggctt

SEQ ID NO: 45058 - DNA, 201 bp, Homo sapiens
agtggcattgagcagggagtcttttttgtcaataacattcatgcaccaaaatctaattttactcctaagggtgttctgtgctgggtttcactggggataarcacctatttgctgggataggtgagcatggtcatgctggagctgtgtggtcgattcccctcattagaaggagaccaatgcctgaaagcccagattgatgca

SEQ ID NO: 45059 - DNA, 201 bp, Homo sapiens
cagcctagctccacagtctatgctcttactatgctcttctacttctcttaataataataacaacaacaataataataaacatttattaagaatgtacttgstgtcagccactctataagataggtacttcattcccatattaaagataagaaaactgaggctcagatagattaaataacttttctgaggctgcacaataag

SEQ ID NO: 45060 - DNA, 201 bp, Homo sapiens
aaaatggcatgcttccctgggaaggctggaaggccactgctaaaaagcttcccagggacattctttaccttgtgacttccattgctcagattccagcctcrcaccatgccttctcagatacctgactacttaatgattggtcctaagggccaatccaaatgctcagtgctattatgattattattgccatcaatttctgag

SEQ ID NO: 45061 - DNA, 201 bp, Homo sapiens
aaattcaaagcaagcctgtctgctcagaagacaaggagtataaaatggcatgcttccctgggaaggctggaaggccactgctaaaaagcttcccagggacmttctttaccttgtgacttccattgctcagattccagcctcgcaccatgccttctcagatacctgactacttaatgattggtcctaagggccaatccaaat

SEQ ID NO: 45062 - DNA, 201 bp, Homo sapiens; identical to SEQ ID NO: 44808

SEQ ID NO: 45063 - DNA, 201 bp, Homo sapiens
ccatggcctaggtgagacacttcttatttgacaagggatcctatgtggaatgggggccttggacttcagcaccccacatgttccattttgggatgatcccrgcccaaatcaaagccaccattaaaacccattggtccttctttgccatgaaaatcacatcttttccatggcatttcttttacaacagcaaaagaactgttt

SEQ ID NO: 45064 - DNA, 201 bp, Homo sapiens
taagtccctatgaggcactcctacaaataaccccacaggccctaaacagagttaatacaaaatagcgaaggtagatcttgcccttggtaaccctgtcctcwttcaggtccctgctccaaattacttccccttttcctgacaccatttgttcctttggtgccttactcaaatatcccatcaccctgagactgttcttcctgg

SEQ ID NO: 45065 - DNA, 201 bp, Homo sapiens
atctggacagaattggagatgacaaactcacaccgcccttcctctgtgcaatgcaggcatgtatcggtgtggccccgcctcggttcaagccatcaagcacrgccatgtctgcttccaatttgatgcaccttttgtttttgcagaggtaagcaggaagctggaggaaagtgctgtttttctccccaacctcttaacacatga

SEQ ID NO: 45066 - DNA, 201 bp, Homo sapiens
agtccttgcaatgaaagacactggccagggaagctggttggacacacacacatacttgcacattcacaagtatctttcattaaaaggagatgacctactgsttccctcctgccagtgatgggccacaaaacagacatgacacgtgggccttctcacgtgtcccagatttgttttaaaaatcattttcaattcatctagttt

SEQ ID NO: 45067 - DNA, 201 bp, Homo sapiens
ccaggcctgggaataagtaccagactgatgatagacggggaggatgatcctcctgaaattctagccacagggaagaaaagtccttgcaatgaaagacactrgccagggaagctggttggacacacacacatacttgcacattcacaagtatctttcattaaaaggagatgacctactgcttccctcctgccagtgatgggc

SEQ ID NO: 45068 - DNA, 201 bp, Homo sapiens
cgaactgggtggagcccaccacagctcaaggaggccagcctgcctctgtaggctccacctcagggcacagacaaacaaaaagacagcagtaacctctgcasacttaaatgtccctgtctgacagctttgaagagagcagtggttctcccagcacacagctggagatctgagaacaggcagactgcctcctcaagtgggtcc

SEQ ID NO: 45069 - DNA, 201 bp, Homo sapiens
cctcctgccagtgatgggccacaaaacagacatgacacgtgggccttctcacgtgtcccagatttgttttaaaaatcattttcaattcatctagttttctrttaatgttaaaaggttggaaattatattttaattagtgttagagatgtacatcagcatcatagaattctgaaactactgatgcaacagaatcataaaatg

SEQ ID NO: 45070 - DNA, 201 bp, Homo sapiens
tgacaggcaagcgcatggaaaagtgtttgcagtagagggaacagtatattgcaagtgaggagggactaaaagatgaaagagaagatataagcctgggaaargatggcaggcatcacaccataccaggccttggggatcttgctttcctcctgcagataatgggggacttgagaaggattctaattagcagaaatacataat

SEQ ID NO: 45071 - DNA, 201 bp, Homo sapiens
aacgttgacatggactttgaagtggaaaatgctgtgctgggaaaagacttcaagctctccatcaccttccggaacaacagccacaaccgttacaccatcayagcttatctctcagccaacatcaccttctacaccggggtcccgaaggcagaattcaagaaggagacgttcgacgtgacgctggagcccttgtcctgtaag

SEQ ID NO: 45072 - DNA, 201 bp, Homo sapiens
taatatgattgttggtttcatgaagtaagaagaccatatgagattttatctgtttgcttgtttgtttttacataaatgatgcagaaataactgactctccractggaagaaagtttaaaaattgaccctcatcttgtcccatatacagtagtaaatctcagatggaatgagtattaatgtaaaaaagacaattttttgagg

SEQ ID NO: 45073 - DNA, 201 bp, Homo sapiens
ggcattgagcagggagtcttttttgtcaataacattcatgcaccaaaatctaattttactcctaagggtgttctgtgctgggtttcactggggataaacamctatttgctgggataggtgagcatggtcatgctggagctgtgtggtcgattcccctcattagaaggagaccaatgcctgaaagcccagattgatgcagct

SEQ ID NO: 45074 - DNA, 201 bp, Homo sapiens
cattgagcagggagtcttttttgtcaataacattcatgcaccaaaatctaattttactcctaagggtgttctgtgctgggtttcactggggataaacaccyatttgctgggataggtgagcatggtcatgctggagctgtgtggtcgattcccctcattagaaggagaccaatgcctgaaagcccagattgatgcagctct

SEQ ID NO: 45075 - DNA, 201 bp, Homo sapiens
tctgtgctgggtttcactggggataaacacctatttgctgggataggtgagcatggtcatgctggagctgtgtggtcgattcccctcattagaaggagacsaatgcctgaaagcccagattgatgcagctctccatatagcaaagggaaaggggaagtgcagtttatccagcaagccagacacttgcccaggtgttgtgga

SEQ ID NO: 45076 - DNA, 201 bp, Homo sapiens
tttttttttaaaaagaagacagatgtttcctgcgaatcaagaggagaaatgctttctatttacctgtggaaattcaaagcaagcctgtctgctcagaagayaaggagtataaaatggcatgcttccctgggaaggctggaaggccactgctaaaaagcttcccagggacattctttaccttgtgacttccattgctcagat

SEQ ID NO: 45077 - DNA, 201 bp, Homo sapiens
ccaggcactatagcaagataattaagacatggtccagtcttcaaggggattacaatcccatggctaaaaaatcacctatataaagataatacaaagagacratgatacttttttttttttaaaaagaagacagatgtttcctgcgaatcaagaggagaaatgctttctatttacctgtggaaattcaaagcaagcctgtct

SEQ ID NO: 45078 - DNA, 201 bp, Homo sapiens
aacaaaactgctgatctggaggtcttatgttataaattcccacatcataccttcaactatatatatgtcctgaaactagcatattttgagaataaaatggkaaatgacatttaaaggacacctatggttaatcctacagtaaatgagataatttattttgaaatgaatgatcaactctacgctccaaattttcacgtaaaa

SEQ ID NO: 45079 - DNA, 201 bp, Homo sapiens
agcgagtgaatgactaagaagccaaacaaacgacatggtgaggcaacccaggaattaggaacagtagaaaactgccaccacaccaggagctggaggcacayggaggaggaggtcccatcagaacccagaaggcatcagcaggtgctggagccatggaggagactcagactctcacctcaagacagagagagcacaggagac

SEQ ID NO: 45080 - DNA, 201 bp, Homo sapiens
gaatcaaaagatcacttagaaaaagtaacatgttagaaaacatcatgcttagaattaaatgtctaaagtataccagtatagatgatataatttaaaacaaytgatactatcagctgtcataagaaccaaatacttggttgacctgtgggtggctgactcatgggcaatgaaataaattttgttttatacgtataactttat

SEQ ID NO: 45081 - DNA, 201 bp, Homo sapiens
aaagatcacttagaaaaagtaacatgttagaaaacatcatgcttagaattaaatgtctaaagtataccagtatagatgatataatttaaaacaattgataytatcagctgtcataagaaccaaatacttggttgacctgtgggtggctgactcatgggcaatgaaataaattttgttttatacgtataactttatatatat

SEQ ID NO: 45082 - DNA, 201 bp, Homo sapiens
atataaaaagtttgcttatatataatatatatacacatatcatatataaatatattgtttataatatgtaaacaatatatacataaataatatataaaaastatatattatatatgtaaacaatatatttttaaaacccaaactcatgggtttatagttttttcatagtgaaaacaaacaaatatatagtttgcttatatc

SEQ ID NO: 45083 - DNA, 201 bp, Homo sapiens
ggaaaaactataaacccatgagctggggttttgtctttttttttttgacttaggttttctattctcaaaggcattaatcagcaccctttttctcacccttygttatcaacatataagcaggctagaaagacagtattttattccaatgtgaaacaaaactgctgatctggaggtcttatgttataaattcccacatcatac

SEQ ID NO: 45084 - DNA, 201 bp, Homo sapiens
gggttttgtctttttttttttgacttaggttttctattctcaaaggcattaatcagcaccctttttctcaccctttgttatcaacatataagcaggctagraagacagtattttattccaatgtgaaacaaaactgctgatctggaggtcttatgttataaattcccacatcataccttcaactatatatatgtcctgaaa

SEQ ID NO: 45085 - DNA, 201 bp, Homo sapiens
ttgacttaggttttctattctcaaaggcattaatcagcaccctttttctcaccctttgttatcaacatataagcaggctagaaagacagtattttattccratgtgaaacaaaactgctgatctggaggtcttatgttataaattcccacatcataccttcaactatatatatgtcctgaaactagcatattttgagaata

SEQ ID NO: 45086 - DNA, 201 bp, Homo sapiens
cttttctgaggctgcacaataagtaagtagtgaagcatttccaaaaacatattctgaaaaatgcagatctccaaagaaaaaagtttccatagtcatttacrtttggaaaccattgcccctctgagatatctgtggtatacatcagcatattaaagtctcacatgaatgcttcagtaaagaatcctgatcagctttggttag

SEQ ID NO: 45087 - DNA, 201 bp, Homo sapiens
tcccagaaccgttattagagttgtcaatctgatgtctcgtcatccctgaatactttagtgtgtactacctatgagcaaagacattcttctgtgcaaccatmaaaataaggaaattaacactgatatttgatggtagtctaatctttagaacacatttgagtttttctacttgttcagtaatgtaccttatagcaacagaag

SEQ ID NO: 45088 - DNA, 201 bp, Homo sapiens
atgtaatatcagtatattccttccattggtgctggtaaacggagaactgatgaaacccatttctaaggactttggtgtttagctatttttaaaaaaaaaaytttaaagcccctgtgctaagaaagaggaccagaggagttgattgctaagctccttttcaacaggaacatttgtgctcctccagctcattcttgggctggt

SEQ ID NO: 45089 - DNA, 201 bp, Homo sapiens
aagttttccaggtacatagcgtatgcttcgtgttgacaaaggtaactaggcattattccaacttccaggctattaatgctaaatgcagttcttgtttaacrtttttctttccttgatgttttgggattccctactcccaaaagtaaatgctttactaacattagcttagttctctgcacccattaagtatcaactgctcca

SEQ ID NO: 45090 - DNA, 201 bp, Homo sapiens
acatcaagaccagaagctggagctatggtcaggtgagccacttaaaatttgttattgtcaaggacatttttacttcatattttttgtcacatgtatccctrcaggatcccatatatcgatattagacaagcacaatttcctgctttttaggatctgagactccaaggcagagagcataggagtagggactcataaagacaa

SEQ ID NO: 45091 - DNA, 201 bp, Homo sapiens
tacttcatattttttgtcacatgtatccctacaggatcccatatatcgatattagacaagcacaatttcctgctttttaggatctgagactccaaggcagwgagcataggagtagggactcataaagacaactgcgtaatttatcagctgaaaccacatatctctgggtattacagtgttacagaaatgagagattccatg

SEQ ID NO: 45092 - DNA, 201 bp, Homo sapiens
tgcataggtgatcttatgagattctgatggagctgaaaaattcctgttacatagtgatgtcatagctatcataatagaatagtgagattacttatttttttaaatgtactgtagcctaagtttatagtgtttataaagtctacagtagcatgcagtaatgacctaggccttcgcattcactcaccactcacccagggctac

SEQ ID NO: 45093 - DNA, 201 bp, Homo sapiens
tcctgctttttaggatctgagactccaaggcagagagcataggagtagggactcataaagacaactgcgtaatttatcagctgaaaccacatatctctggktattacagtgttacagaaatgagagattccatgaataatgtggcattctattgagaaatgctttggccacttagaacagtgaaatctcattagttcaacc

SEQ ID NO: 45094 - DNA, 201 bp, Homo sapiens
aggccttcgcattcactcaccactcacccagggctacttctggtcctgcacgttccattcatggtaagtgtcctatgcaggtgtaccattttttacttttyatattgtatttttactgtactttttctatgtttatatataaatgtttctatgtttatatataaatacttaccattgtgttacaattgcctgcagtgctgt

SEQ ID NO: 45095 - DNA, 201 bp, Homo sapiens
attcaggataggagaggagatgatcagaagagagaggatgagaaccggggttatggctgcagttgtagacatggacaggagtgacagggtttgagaaatayttaggaggcaaaatctgcaggacttgtgttggggagtctgtgaggggtggaagggaggagggtcaaggtcgacttccaggtggctggcttatgtgactat

SEQ ID NO: 45096 - DNA, 201 bp, Homo sapiens
tatagcaaagggaaaggggaagtgcagtttatccagcaagccagacacttgcccaggtgttgtggactggtgtcattgtgttactgtcacactagatgatwtgatatcaaatagtgaaatcagggaggtatccagtaccatccaagtttgggaaaagaagttcacagaacagaagggcatcttcagtcaggtggtagagtt

SEQ ID NO: 45097 - DNA, 201 bp, Homo sapiens
atatttaattgttctaaaagcaggttttctggcactatatatcaagttttctccaagtcactaagggacgaaatttgctaagcgactaaaccttggaaagmacactcatttttaaaatgccatcttcatgcagttcacccagtggccactagtggcctctaagaggccttgtatccgcggttaccaatctgcggatgatga

SEQ ID NO: 45098 - DNA, 201 bp, Homo sapiens
aaagagtgctttcagatgtacttctctagttttttgctattccccaaagtgcatccttacataattagctttaaaattcctttcatcccttatttttttttaaatctatcattaacacgtagatttttatctctaagtttatttttactaaacttgcatctttttaaatacgacgtattctgaatctaaatcagtatttag

SEQ ID NO: 45099 - DNA, 201 bp, Homo sapiens
tctgagaaggggcagactgcctcctcaagtgggtccctgacccctgacccccgagcagcctaactgggaggcaccccccagcaggggaacactgacacctyacacagcagggtattccaacagacctgcagctgagggtcctgtctgttagaaggaaaactaacaaacagaaaggacatccacaccaaaaacccatctgta

SEQ ID NO: 45100 - DNA, 201 bp, Homo sapiens
gtggaaaatgggaacagactatgtgttctaattattgctgaaccctgaccattttcccctccatgtccacaaccgagcacgttctctctccagcctcctgyactctctgtggctccatcgcactctcgtcaccaagattcacccctgcccacacccacacccttcatggggaggccggggatgggaaccaggaggtgggct

SEQ ID NO: 45101 - DNA, 201 bp, Homo sapiens
tggaaaatgggaacagactatgtgttctaattattgctgaaccctgaccattttcccctccatgtccacaaccgagcacgttctctctccagcctcctgcrctctctgtggctccatcgcactctcgtcaccaagattcacccctgcccacacccacacccttcatggggaggccggggatgggaaccaggaggtgggctt

SEQ ID NO: 45102 - DNA, 201 bp, Homo sapiens
taaagttagttgattattttcttcaacccttgtttttcttgttcatagagtttcttaatgtcacgagcgttcacctgttcaaggagagatgggacactaamaaggtggaccaccacactgacaagtatgaaaacaacaagctgattgtccgcagagggcagtctttctatgtgcagattgacttcagtcgtccatatgacc

SEQ ID NO: 45103 - DNA, 201 bp, Homo sapiens
attctctttttaaaagtggcatctctcatttttaaaagagaaaatcctagatagtgactcctattatcatcaagtaatatatatcaaggccccaaggctamcttgtcacattttactctggcatagaaatctaattccttctctataaagtcaaaaagagagaggtgagttatagatgttttctaatttagtttagggtca

SEQ ID NO: 45104 - DNA, 201 bp, Homo sapiens
tcttaggtccgtggcactcaggtagttggttctgacatgactgtgacaattcagtttaccaatcctttaaaagaaaccctgcgaaatgtctgggtacaccyggatggtcctggagtaacaagaccaatgaagaagatgttccggtaaaccttgggttggggagaccgggcaggcagtgcagggctgtgggaagctttctct

SEQ ID NO: 45105 - DNA, 201 bp, Homo sapiens
aaggctaccttgtcacattttactctggcatagaaatctaattccttctctataaagtcaaaaagagagaggtgagttatagatgttttctaatttagttyagggtcaacttataatcctcgtcctcaactgatggtttagcgataacttaaaaggtgatgctgcaaatgattctttgctggatttcagaaaataaagaag

SEQ ID NO: 45106 - DNA, 201 bp, Homo sapiens
ataaatatgcgtatttatttattattgagaattttataaatatatccacttaatttttatcccagttatggaaggtattatagcaggtggtctcatattcrtttttccacatttctcaatgcccctgagcaattagagatcagaacataatgaacaatctttccctctccagtttcccctctggtttttaatccacccaac

SEQ ID NO: 45107 - DNA, 201 bp, Homo sapiens
caatctttccctctccagtttcccctctggtttttaatccacccaacatccaatctgtagaggaaagcatatgagaacagaattattctcttcagtgtcaygcatcatttttcagaggcatttgcctctctagacccagacgatattacaattaattcagtgaatatttttaaaaatacatttatttcagtatgtcttcat

SEQ ID NO: 45108 - DNA, 201 bp, Homo sapiens
gtacagactcaaagcaattctctaatgtattcaaagtaaacaataccataaggtcaccttattcaccagggattttcatttctgttcattgaagatttttwaaaaattgacagatatattggaagccagtgggaaaatagaatttatctaacagaaagtatcttcatagccacttttgagaaattgcataaatccattcca

SEQ ID NO: 45109 - DNA, 201 bp, Homo sapiens
ttggaggctggagggaggtcatttaaaaaaatgattacaaaacctatttgttttagctcaaagtctcaacagtctaagacttggtgatctaaatttaaaamaaaaaagtcatgagttttgttttgttttattttcccatagtatcaaacaggataagattattttcttagccatttaaatataacccagggaagaaggaat

SEQ ID NO: 45110 - DNA, 201 bp, Homo sapiens
tcaacagtctaagacttggtgatctaaatttaaaaaaaaaaagtcatgagttttgttttgttttattttcccatagtatcaaacaggataagattattttyttagccatttaaatataacccagggaagaaggaatacatatttcttgggagcaatgaaaatcaaaagtatagtcccctagaagcactggtctctgaagtt

SEQ ID NO: 45111 - DNA, 201 bp, Homo sapiens
cttataaagaaaggtattttcaaagtgatgcaaagaatactgcaaggggtgtgcccaattcaaagaaatagcttctttttttttttttttaagtgttagcstagggtactgctaattagaaaagagtgttatcatttcatcaaaggaagggccactgagcttttacatagaaagattttatcagctgcaagttgattgtct

SEQ ID NO: 45112 - DNA, 201 bp, Homo sapiens
taattgttctaaaagcaggttttctggcactatatatcaagttttctccaagtcactaagggacgaaatttgctaagcgactaaaccttggaaagaacackcatttttaaaatgccatcttcatgcagttcacccagtggccactagtggcctctaagaggccttgtatccgcggttaccaatctgcggatgatgactttg

SEQ ID NO: 45113 - DNA, 201 bp, Homo sapiens
gcttctttttttttttttttaagtgttagcctagggtactgctaattagaaaagagtgttatcatttcatcaaaggaagggccactgagcttttacatagraagattttatcagctgcaagttgattgtctagacacaaagtagcaaatggcatttctttaagatgttcagtcattcaaactatttcagtttggtatcttt

SEQ ID NO: 45114 - DNA, 201 bp, Homo sapiens
acacgtgcatggaggttccctgtatggagccatgttttccatccagattgggccaaggatagctgatgggcagtcatggatgttgatggatgggttttccmagggtagctggattgtggtctcgtaaccatgccgactcctggggctgagaagggctatttagtgaaatgaaatactactctgtcacaacttcctcactca

SEQ ID NO: 45115 - DNA, 201 bp, Homo sapiens
tcagaagagagaggatgagaaccggggttatggctgcagttgtagacatggacaggagtgacagggtttgagaaatatttaggaggcaaaatctgcaggayttgtgttggggagtctgtgaggggtggaagggaggagggtcaaggtcgacttccaggtggctggcttatgtgactatgatgacagatgctagcacttcca

SEQ ID NO: 45116 - DNA, 201 bp, Homo sapiens
tggacaggagtgacagggtttgagaaatatttaggaggcaaaatctgcaggacttgtgttggggagtctgtgaggggtggaagggaggagggtcaaggtcracttccaggtggctggcttatgtgactatgatgacagatgctagcacttccaaatgagataaagaatgcctggaattccagagggaaaaaatcgagtgtg

SEQ ID NO: 45117 - DNA, 201 bp, Homo sapiens
accagaagctggagctatggtcaggtgagccacttaaaatttgttattgtcaaggacatttttacttcatattttttgtcacatgtatccctacaggatcycatatatcgatattagacaagcacaatttcctgctttttaggatctgagactccaaggcagagagcataggagtagggactcataaagacaactgcgtaa

SEQ ID NO: 45118 - DNA, 201 bp, Homo sapiens
acatttttacttcatattttttgtcacatgtatccctacaggatcccatatatcgatattagacaagcacaatttcctgctttttaggatctgagactccwaggcagagagcataggagtagggactcataaagacaactgcgtaatttatcagctgaaaccacatatctctgggtattacagtgttacagaaatgagaga

SEQ ID NO: 45119 - DNA, 201 bp, Homo sapiens
tgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaag

SEQ ID NO: 45120 - DNA, 201 bp, Homo sapiens
ttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaa

SEQ ID NO: 45121 - DNA, 201 bp, Homo sapiens
cttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaa

SEQ ID NO: 45122 - DNA, 201 bp, Homo sapiens
ttagcgataacttaaaaggtgatgctgcaaatgattctttgctggatttcagaaaataaagaagctattccagcaaaaaaaaaagtttctatttttacctstattctgtcagggatcacagtatatgtagttttgaagatgaatgttttagagtcagaaagacctggatttatatccaacttccgccagattcctaactct

SEQ ID NO: 45123 - DNA, 201 bp, Homo sapiens
tgcaaatgattctttgctggatttcagaaaataaagaagctattccagcaaaaaaaaaagtttctatttttacctgtattctgtcagggatcacagtatakgtagttttgaagatgaatgttttagagtcagaaagacctggatttatatccaacttccgccagattcctaactctgtaggctttttatttatcttctaaa

SEQ ID NO: 45124 - DNA, 201 bp, Homo sapiens
agacagaaaggacccaagttctccccatgcctacaatttcactatcccagtgtaattccttccggctcacaacaagataaaatagtgaacaccttacatcygttcgtgtctttggcataaaaaggttatccaatctatgcctgaaaacaggctttggcggtaaatcaagaaaaggcagaaacacacagtggggaagtcaca

SEQ ID NO: 45125 - DNA, 201 bp, Homo sapiens
aggagggtcaaggtcgacttccaggtggctggcttatgtgactatgatgacagatgctagcacttccaaatgagataaagaatgcctggaattccagaggraaaaaatcgagtgtggaaaatgctaatggaggtagtagcttcattgataactcattggcactgttgctgtgcagaggtgctgtatgcctcccatttaatt

SEQ ID NO: 45126 - DNA, 201 bp, Homo sapiens
atttcatcaaaggaagggccactgagcttttacatagaaagattttatcagctgcaagttgattgtctagacacaaagtagcaaatggcatttctttaagrtgttcagtcattcaaactatttcagtttggtatctttaacaatggagcaaatgaatgatattttaccaattttccataaatgaatgcatgtcctgtgatt

SEQ ID NO: 45127 - DNA, 201 bp, Homo sapiens
tagcgacacaagcgggggcgaatgtcatttctcaggagttttggctgggatggctggaactgtgcatcattgcgctgggcatccagcagggagttttcatrgaatctggtggtcacagggtactttcttggctccggatgccttgctttgacttccatatgggatctccctgtgttccttacccactgctccagtacccgt

SEQ ID NO: 45128 - DNA, 201 bp, Homo sapiens
tgttccttacccactgctccagtacccgtgttatcctgcctacctggctttgtgaacagcttccctgactccggagaattacatgcccagtgctcaggctyccccgcctgcatttctaatgtcctgccaagctacaagctagttggcaccccctgttcttggattcctgcctgactccctggtttcaagccatcccctcct

SEQ ID NO: 45129 - DNA, 201 bp, Homo sapiens
taggagtcctactcacacttgtgctgctgcaagtgagaaacttgaccgtcaccttcaatttcaatgttggcaacaacaacaaaagcagccacacacaacayctgtgaatgcccagaccttaactgcagtttgggatggagggtgagagcaggaaggatgcactctgtggtcaccacgcttggagcacatcagaatcacctg

SEQ ID NO: 45130 - DNA, 201 bp, Homo sapiens
gaggcagagcttgcagtgagccaagattgcaccactgcactccagcctgggcaacagtgcaagactccatctcaaaacaaaacaaaataaaacaaacaaamaaaaaaacagtaggtaagctacatttggcccgcagactatagttttctaaccattgctctaaaggatgaatggagattacattgatcattaacaactcag

SEQ ID NO: 45131 - DNA, 201 bp, Homo sapiens
caatgccgcagcctaccttcggtatttctcactagaggatggctctcgcagccttctccctatcattaaccctttttcgctcttctccctcccttcccccstcagctcaccaatgactgtaaatatatttatctatacttatggatacccattcacaccttatgcatccaaacactcctgtctccttctcagaccagacac

SEQ ID NO: 45132 - DNA, 201 bp, Homo sapiens
tgggttcaagcaatcctcctgcctcagcctcccgagtagctgggattacaggcacatgccaccacgccaggcaaatttttgtatttttagtagagacgggrtttcactatgttggccaggctgatctcaaactcctgacctcaggtgatccacccacctcggcctgccaaagtgctggaattataggcgtcagccaccgca

SEQ ID NO: 45133 - DNA, 201 bp, Homo sapiens
cttttctccagcatgttgttagtgctccacatgtctctggaaccatctctctactctggtggcctctataatggggactcttcacctcttgtgggtgtgcmtggtttttgaaaatagccaagtctccaggagtcatgactgggtaatccaggggatcaagggggaaccttcactgggcccagaaacaaagtcccccttcat

SEQ ID NO: 45134 - DNA, 201 bp, Homo sapiens
attgctacaaaggaatatgctttttctaaataggaactatattaaaaagttcaaaataaatatttcagttttggttaacttttcttccccaccctgtcggyacctagtaagttctgtttcgttagtcagcagaaaatggttaagattaaaactgttcaatgcactgattcaaatatctttgggtggccttgaagctgctct

SEQ ID NO: 45135 - DNA, 201 bp, Homo sapiens
tccaaatgagataaagaatgcctggaattccagagggaaaaaatcgagtgtggaaaatgctaatggaggtagtagcttcattgataactcattggcactgktgctgtgcagaggtgctgtatgcctcccatttaattgttcaagcagccctctgggcattggactatggccatctccatttttcccatgagataatggttg

SEQ ID NO: 45136 - DNA, 201 bp, Homo sapiens
aaaggattaagtaatttacccaggtcacacctggaaagtgctgggacctcaatttggacccaagcagcctcttctacttacaatgcttactacctccaccragggagcctccaccaaggagatggtggaggtatgaatatgcttctgtttgaattgatgagtgtgaattacttgagggactttcaggtaaacctgtccaat

SEQ ID NO: 45137 - DNA, 201 bp, Homo sapiens
ccttacccactgctccagtacccgtgttatcctgcctacctggctttgtgaacagcttccctgactccggagaattacatgcccagtgctcaggcttcccygcctgcatttctaatgtcctgccaagctacaagctagttggcaccccctgttcttggattcctgcctgactccctggtttcaagccatcccctcctcagt

SEQ ID NO: 45138 - DNA, 201 bp, Homo sapiens
taaataggaactatattaaaaagttcaaaataaatatttcagttttggttaacttttcttccccaccctgtcggtacctagtaagttctgtttcgttagtsagcagaaaatggttaagattaaaactgttcaatgcactgattcaaatatctttgggtggccttgaagctgctcttagcagagggaaagagacatccagcc

SEQ ID NO: 45139 - DNA, 201 bp, Homo sapiens
cttctacttacaatgcttactacctccaccaagggagcctccaccaaggagatggtggaggtatgaatatgcttctgtttgaattgatgagtgtgaattasttgagggactttcaggtaaacctgtccaatagataatatgagtctgaagcttcgggaggaggtttgggttggacaggagataatttggatatcatacaca

SEQ ID NO: 45140 - DNA, 201 bp, Homo sapiens
ctgcctactgcctgatgcccttgtcttgggtccccaatttctagcctttagcctggtgattctatttatggcccaaatatgacaatctatagatagctaamaaggggaaaagtcatcaaggtgggcagcaaggaggtctggaaaagtgtcccaagcccagtcagggcactcttcgccagcttgcctttgggtaggcaccct

SEQ ID NO: 45141 - DNA, 201 bp, Homo sapiens
ttatggcccaaatatgacaatctatagatagctaacaaggggaaaagtcatcaaggtgggcagcaaggaggtctggaaaagtgtcccaagcccagtcaggkcactcttcgccagcttgcctttgggtaggcaccctggagcacagtcacttgattgtatcttctgccactcaaagaggctattggtgtgtatcctttggcc

SEQ ID NO: 45142 - DNA, 201 bp, Homo sapiens
ctcatcacccctctgtcctcgtcccacagatcctcagccacagaaagccaccctcaagtctggggatgaccccagctcctgtgcccacctctttgggtctrccccctggcccctccagctacctgcttcctggcagcctccctctggggggctgcggttcgaccccccccacccccaccgggctggctgccacgtctgaca

SEQ ID NO: 45143 - DNA, 201 bp, Homo sapiens
cacatttccaacagccacccactctccctcacctccgaccagtacaaggcctacctgcaggacttggtggagggcatggatttccagggccctggggagasctgagccctcgctcctcatggtgtgcctccaacccccctgttccccaccacctcaaccaataaactggttcctgctatgatcacttgtgcgtgtctggtg

SEQ ID NO: 45144 - DNA, 201 bp, Homo sapiens; identical to SEQ ID NO: 12006

SEQ ID NO: 45145 - DNA, 201 bp, Homo sapiens; identical to SEQ ID NO: 11994

SEQ ID NO: 45146 - DNA, 201 bp, Homo sapiens
gtgcacgtcccctcttcccctccacctccctttactcatcacccctctgtcctcgtcccacagatcctcagccacagaaagccaccctcaagtctggggaygaccccagctcctgtgcccacctctttgggtctgccccctggcccctccagctacctgcttcctggcagcctccctctggggggctgcggttcgaccccc

SEQ ID NO: 45147 - DNA, 201 bp, Homo sapiens
gcgagtgcaaccaggacgtgattcgttttaattggttacaatttaaactgaaataaccttacatgactaatggctgcaattggacaatgcagcctcagacrggactgaatgccaaccagcttctccagattcactgagcatccttgggagcatgggccccctactctgggcctgttatgaatgctgaggcttgggggcttg

SEQ ID NO: 45148 - DNA, 201 bp, Homo sapiens
cctcaagtctggggatgaccccagctcctgtgcccacctctttgggtctgccccctggcccctccagctacctgcttcctggcagcctccctctggggggstgcggttcgaccccccccacccccaccgggctggctgccacgtctgacaagagagagggcagcagcagctctgagggccgtggggacacagataaggtga

SEQ ID NO: 45149 - DNA, 201 bp, Homo sapiens
ggaggctgaggtgggcagatgacaagttcaggagttcgagaccagcctggtcaacatagtgaaaccccatctctactaaagatacaaaaaaatagtcgggygtggtggcacgtgcctgtaatcccagctactcgggaggctgaggcaggagaattgcttgaacccaggaggcggagattgcagtgagctgagatcgcacca

SEQ ID NO: 45150 - DNA, 201 bp, Homo sapiens; identical to SEQ ID NO: 11989

SEQ ID NO: 45151 - DNA, 201 bp, Homo sapiens; identical to SEQ ID NO: 11990

SEQ ID NO: 45152 - DNA, 201 bp, Homo sapiens; identical to SEQ ID NO: 11992

SEQ ID NO: 45153 - DNA, 201 bp, Homo sapiens
ccttgcagagttagaacttgccagggaaagagggtggtgttaggactcgggagacagggttagggccccaggagcaggatctaagtcgtcctcccccaccrtcctgacaccactgttgccccaggcctgggccgaggccactggtgcatatgttcccgggagggataagccagacctgccaacctggaagaggaatttccg

SEQ ID NO: 45154 - DNA, 201 bp, Homo sapiens
gcatatgttcccgggagggataagccagacctgccaacctggaagaggaatttccgctctgccctcaaccgcaaagaagggttgcgtttagcagaggaccrgagcaaggaccctcacgacccacataaaatctacgagtttgtgaactcaggtctgccagcttggggttcgtgtgggaggctggggccccaagggttcctg

SEQ ID NO: 45155 - DNA, 201 bp, Homo sapiens
ctcaggggtaatgtttcatgaaatctttaatgaaattggggagaggggcacaaacagaagggaggggcactggggacaggcttgggggcaagggaggtggrcacggggcagggcagggcagggggctctcctcttccctgcagcaaccctcccccagtcatcccactgacgggggagggaggtggggaggtggagccataa

SEQ ID NO: 45156 - DNA, 201 bp, Homo sapiens; identical to SEQ ID NO: 11993

SEQ ID NO: 45157 - DNA, 201 bp, Homo sapiens
cgttctctccccggcctgtgtctgcccctctctccgggtgcccaccttgtggacggccttcctcaggatgtccttgtactcctccttggtgatgtccttcytctgatagtatggcttgatggccagcttcacctcctccaccgcccgctcctgcgtgtgcagcttcttcagatactggtggggtggcgacagcgggggaag

SEQ ID NO: 45158 - DNA, 201 bp, Homo sapiens
aggctccctcctaactcttgctcctggtctcagtctgtctcctctctttatatctggctctattctctgtctttggggttttggagagaggtcctcagcgsgggagggagggagttggggaaagagactgcttgcaggggatctctggtggggtcagtctctgaagtcctcctctccagaagccctgcccaagaagagcca

SEQ ID NO: 45159 - DNA, 201 bp, Homo sapiens; identical to SEQ ID NO: 12009

SEQ ID NO: 45160 - DNA, 201 bp, Homo sapiens
caggggcatggctagattaactcagttacagtagagattggccctgattggctgttgaggcaagggcctggcatggcttagggactcacgttccaggccastatcccgggggtagtttggcagagaccctggagtctggcttgattggctaatatggatgaggggtggcctagaaccttagcatctagaacgatcctgaac

SEQ ID NO: 45161 - DNA, 201 bp, Homo sapiens
gagagaggtcctcagcgggggagggagggagttggggaaagagactgcttgcaggggatctctggtggggtcagtctctgaagtcctcctctccagaagcyctgcccaagaagagccaacagacttcctgagccgccttcgaagatgtcttccctgctccctggggcgaggagcagccccctctgagtcccctcggccttg

SEQ ID NO: 45162 - DNA, 201 bp, Homo sapiens
aactcttcactctctctggatctctgtctaatcccactccagtgtcctgaccctcctcgagctcaacctttcctcctcctgctaggaccctgccccctcayccctgtgcccttctgtctgggtctctgtccccttgtctgggtgtctgtcaccctccgctctctggttcctcgccttcccgtctctaatctcacagggctg

SEQ ID NO: 45163 - DNA, 201 bp, Homo sapiens
caccagacacgcacaagtgatcatagcaggaaccagtttattggttgaggtggtggggaacaggggggttggaggcacaccatgaggagcgagggctcagstctccccagggccctggaaatccatgccctccaccaagtcctgcaggtaggccttgtactggtcggaggtgagggagagtgggtggctgttggaaatgtg

SEQ ID NO: 45164 - DNA, 201 bp, Homo sapiens; identical to SEQ ID NO: 12011

SEQ ID NO: 45165 - DNA, 201 bp, Homo sapiens; identical to SEQ ID NO: 12014

SEQ ID NO: 45166 - DNA, 201 bp, Homo sapiens; identical to SEQ ID NO: 12012

SEQ ID NO: 45167 - DNA, 201 bp, Homo sapiens
ggtcagcctgggcaacacggtgaaaccccatttctactaaaatacaaaaaattagccaggtatggcggcgtgcgcctgtagtcccagctactcatgaggcygaggcaggagaattgcgagactccgtttcccaaaatcaatacataaataaataataaataaaatgggaatcattgccacctgccaaggtagttgggggaa

SEQ ID NO: 45168 - DNA, 201 bp, Homo sapiens; identical to SEQ ID NO: 12013

SEQ ID NO: 45169 - DNA, 201 bp, Homo sapiens
tccagtgtcctgaccctcctcgagctcaacctttcctcctcctgctaggaccctgccccctcatccctgtgcccttctgtctgggtctctgtccccttgtstgggtgtctgtcaccctccgctctctggttcctcgccttcccgtctctaatctcacagggctgatgtggacgctgctgtatggggggaacacctgccctg

SEQ ID NO: 45170 - DNA, 201 bp, Homo sapiens
caggaacccttggggccccagcctcccacacgaaccccaagctggcagacctgagttcacaaactcgtagattttatgtgggtcgtgagggtccttgctcyggtcctctgctaaacgcaacccttctttgcggttgagggcagagcggaaattcctcttccaggttggcaggtctggcttatccctcccgggaacatatgc

SEQ ID NO: 45171 - DNA, 201 bp, Homo sapiens
tcaaatcccaagactctcttccccatctctgactctgtcccccaactcttcactctctctggatctctgtctaatcccactccagtgtcctgaccctcctygagctcaacctttcctcctcctgctaggaccctgccccctcatccctgtgcccttctgtctgggtctctgtccccttgtctgggtgtctgtcaccctccg

SEQ ID NO: 45172 - DNA, 201 bp, Homo sapiens
ccagcatgcagagtgttggaatctggatttgtacacaaagccacgactctgaattgttcaaatcccaagactctcttccccatctctgactctgtcccccractcttcactctctctggatctctgtctaatcccactccagtgtcctgaccctcctcgagctcaacctttcctcctcctgctaggaccctgccccctcat

SEQ ID NO: 45173 - DNA, 201 bp, Homo sapiens
gaggcacaccatgaggagcgagggctcaggtctccccagggccctggaaatccatgccctccaccaagtcctgcaggtaggccttgtactggtcggaggtragggagagtgggtggctgttggaaatgtgcaggtccacagtattctccagggaggaggcaccccctacccgggccatttctaccaaggccctgaggcacg

SEQ ID NO: 45174 - DNA, 201 bp, Homo sapiens
agtcttcctattccactcagggctgtggggtggtggttgccctacctgtttttgccaaaaataaattgtttaaaacttttcttattaaaaacgttacaaartattcaattgtctgttcttacacttgggaactaaagttttaaggagaggagatttggttcagagatttctgtggcttacgcaaattgaggaaagaaccag

SEQ ID NO: 45175 - DNA, 201 bp, Homo sapiens
gatttggaacgaaccttgagaagagacaggctttcttaaggaagggcagagttgggccaatttaaccaaacctcaaggggttagaaggctaaaggattcamgttcaccatttactgagcagttcatcggtggggaatgtaggcatctggctgggtagtgagggttggggataagacggaaggagggggatttgactgaatg

SEQ ID NO: 45176 - DNA, 201 bp, Homo sapiens
aataggaactactaaaagattcggtagtactaccaggattagttctataatgtggagaacggattggaagacataagatggaaggcagggggatactttasaaggttactatattacactgttctgggtgaaagatgatgctagctgagactaaggtaatggcaagggagatggagagaggtggatagatttgagagcctc

SEQ ID NO: 45177 - DNA, 201 bp, Homo sapiens
cttcctcctctcactggcagtcagcgacctcctgctggctgtggcttgcatgcccttcaccctcctgcccaatctcatgggcacattcatctttggcaccrtcatctgcaaggcggtttcctacctcatgggtgggtgagacaaccaccccacccccacttgccactctccccgcctaaagctcttgtggatgtaggggtc

SEQ ID NO: 45178 - DNA, 201 bp, Homo sapiens
tgattgtagccacgtggctgctgtccggactactcatggtgccctaccccgtgtacactgtcgtgcaaccagtggggcctcgtgtgctgcagtgcgtgcaycgctggcccagtgcgcgggtccgccagacctggtgagcttgcccataaactatcctaggaattcctttctcacccctattagatgcttacgaccattgcc

SEQ ID NO: 45179 - DNA, 201 bp, Homo sapiens
atgtggattcccccattcacccagccactacccacagtcagttggatgtgatccctgcttatcatagagacaagggtattactttgatgtctgtgtgcatsggtgaacagatcaaacctgccagtagaatgcagaatttaaggcatcagcagcttcagtgttctgtggagtttttccttagaaagtcttggttttcatttt

SEQ ID NO: 45180 - DNA, 201 bp, Homo sapiens; identical to SEQ ID NO: 12042

SEQ ID NO: 45181 - DNA, 201 bp, Homo sapiens; identical to SEQ ID NO: 12044

SEQ ID NO: 45182 - DNA, 201 bp, Homo sapiens
caatcagcactgaaaataccatcaggcctaatctcatacctctgaccaacaggctgttctgcactgaaaaggttcttcatccctttccagttaaggaccgwggccctgccctctccttccttacccaaactgttcaagaaataataaattgtttggcttcctcctgaacttcctttctggattcttctggggcaggtgagg

SEQ ID NO: 45183 - DNA, 201 bp, Homo sapiens
ccagacctggtgagcttgcccataaactatcctaggaattcctttctcacccctattagatgcttacgaccattgcccagaatcttcctccagcttcccgsagaattaccacgccaactcctattctgcatccaccaccctggagttccagtttggggcccctccccagttctctctcccttcccagcggcacccccaaat

SEQ ID NO: 45184 - DNA, 201 bp, Homo sapiens; identical to SEQ ID NO: 12051

SEQ ID NO: 45185 - DNA, 201 bp, Homo sapiens
atcacagacacaatggaagtcccatgaaagggtctaaactgtgggcaccaaaagaacttcacagaggctagaaccttagagctgggtcttgaagttcagtrggcagaaaaggaaggagtgggattctaggtgaaggagcaatgttaagcagaaggaaatttttctaaactcaagaagggaaagttggaataaattgtaatc

SEQ ID NO: 45186 - DNA, 201 bp, Homo sapiens
cacagagctcagagtttaatgggcgagacagaaaagcaggggattgcagcacaaagtggaagagccttgacagggaaaagatagtgggaacacaagtagarcacctctagcccagcccagcctccttgagaattaaagttggcctcttgaggaaatgagctacaaagtcaaaaaaattagggaggctggctctaagcttcc

SEQ ID NO: 45187 - DNA, 201 bp, Homo sapiens
ccattgcccagaatcttcctccagcttcccgcagaattaccacgccaactcctattctgcatccaccaccctggagttccagtttggggcccctccccagktctctctcccttcccagcggcacccccaaatcctactcctacttcaggtacctggccacagccctagaaacactagtccttggctttttctccatctgtg

SEQ ID NO: 45188 - DNA, 201 bp, Homo sapiens
aaaaatcacagacacaatggaagtcccatgaaagggtctaaactgtgggcaccaaaagaacttcacagaggctagaaccttagagctgggtcttgaagttsagtgggcagaaaaggaaggagtgggattctaggtgaaggagcaatgttaagcagaaggaaatttttctaaactcaagaagggaaagttggaataaattgt

SEQ ID NO: 45189 - DNA, 201 bp, Homo sapiens; identical to SEQ ID NO: 12052

SEQ ID NO: 45190 - DNA, 201 bp, Homo sapiens
ccttagagctgggtcttgaagttcagtgggcagaaaaggaaggagtgggattctaggtgaaggagcaatgttaagcagaaggaaatttttctaaactcaaraagggaaagttggaataaattgtaatccaagtatttatttaccccacgaaataatctatgctttctcagccgagttgttacacactcacacttggattct

SEQ ID NO: 45191 - DNA, 201 bp, Homo sapiens
atctaggaggctctgtcccctgccctctctaccttccagctctaatccctctcatgctgaggccataggtgtgagtaattcagtcctgttcaatccaattygattttatctaaatctgcttggctgtgatgtggtggtccaaagattaatccatcttttaatagacaatgacacaaaagaatggggtcagcctcccagccc

SEQ ID NO: 45192 - DNA, 201 bp, Homo sapiens
catgtctggcccagattaacatcttaatttagttaacatgttaacatctaacatctgtactcaaatactacccatacatacttggatattacttctgctcrgtcagcaatttctatcattatttggatattccactactcacaagtagacctctgaatgtaatctatgcttcctgaagatgttacctacaaaatgttatct

SEQ ID NO: 45193 - DNA, 201 bp, Homo sapiens
acctctcccttttcttacccagaattggagctggccattagaatcactctttacgcagtgatcttcctgatgagcgttggaggaaatatgctcatcatcgkggtcctgggactgagccgccgcctgaggactgtcaccaatgccttcctcctctcactggcagtcagcgacctcctgctggctgtggcttgcatgcccttc

SEQ ID NO: 45194 - DNA, 201 bp, Homo sapiens; identical to SEQ ID NO: 12035

SEQ ID NO: 45195 - DNA, 201 bp, Homo sapiens
cacacacacacacacacacacatatacatatgggagagccagccaagtgaacgggcagaagaggcagaaagcatcccaaataaaaggacaagatgtataaraagctcaaagtttgaattcatggcacttttatccactgtgacatagttttgagtgactagaacatatatcttaagaagggaataatgaacaggctggaga

SEQ ID NO: 45196 - DNA, 201 bp, Homo sapiens
attctgtcattcagccaatatttattgaaccagagattgtgctaggcagtgggaatgtaagttgaacaaaaccgacacaattcctacttcacagagctcaragtttaatgggcgagacagaaaagcaggggattgcagcacaaagtggaagagccttgacagggaaaagatagtgggaacacaagtagagcacctctagcc

SEQ ID NO: 45197 - DNA, 201 bp, Homo sapiens
cttcacagagctcagagtttaatgggcgagacagaaaagcaggggattgcagcacaaagtggaagagccttgacagggaaaagatagtgggaacacaagtrgagcacctctagcccagcccagcctccttgagaattaaagttggcctcttgaggaaatgagctacaaagtcaaaaaaattagggaggctggctctaagct

SEQ ID NO: 45198 - DNA, 201 bp, Homo sapiens; identical to SEQ ID NO: 12037

SEQ ID NO: 45199 - DNA, 201 bp, Homo sapiens
ttttgagtgactagaacatatatcttaagaagggaataatgaacaggctggagaccagcctagagggtttgcagagagcctgctaggcctgaccatggaayatggactttatcgcaagggcaataggaactactaaaagattcggtagtactaccaggattagttctataatgtggagaacggattggaagacataagatg

SEQ ID NO: 45200 - DNA, 201 bp, Homo sapiens; identical to SEQ ID NO: 12039

SEQ ID NO: 45201 - DNA, 201 bp, Homo sapiens
caataacattactaggtgatagaaacttttcagctccattataatcttttgttgttgttattttgggttttgtttgagacagagtctcactctgttgtgcrggctggagtgcagtggcactatcatagctcattgcagccttgaactcctgggttcaagcaatctttctgcctcaaactcctgagtagctatgactatagg

SEQ ID NO: 45202 - DNA, 201 bp, Homo sapiens
gccaaccttctccttctcttttgcctgcgctgggccggcgttagaattatatcccatcctcaccttactctggtttatccttgtcagtgcttgccaccacycccaactgccctcaacactcaagtcagaagcttcctcccgggagcccttttccctggcaaggcttccctggagccaaatctcggccccggccccaccccc

SEQ ID NO: 45203 - DNA, 201 bp, Homo sapiens; identical to SEQ ID NO: 12043

SEQ ID NO: 45204 - DNA, 201 bp, Homo sapiens; identical to SEQ ID NO: 12049

SEQ ID NO: 45205 - DNA, 201 bp, Homo sapiens
atattccactactcacaagtagacctctgaatgtaatctatgcttcctgaagatgttacctacaaaatgttatctacagagagttggatattaacccttgytctttcaaatgttactacagtgactcagatattatctaaacttaaatgtaagccatattcaatcggatattacctataagcatgtagatgttaccattct

SEQ ID NO: 45206 - DNA, 201 bp, Homo sapiens
ttctataggttttgacaaatgtataatggcatgtatccatcattacagtatcacacagaatagtttcactgccctaaaaatcccctgtacttcatctattyatccctcgctctgcctctccaaactcctggctctaaaattgcttttaattagaatttttcacatttctgaactgttcaacagcaaagacgtgtggagaca

SEQ ID NO: 45207 - DNA, 201 bp, Homo sapiens
catcagctggatgaatgaatgagaaattgcttttcatgcttcacagtactgtaccaatttgaggtgtggcgaattgcatcaataattagttgaagaaagayatccagggcagatgtaagcaagataatggaactagaaagattaaagaggtggaggctgggggtgggaggacaatggatttggagaagaaacagtgagtcc

SEQ ID NO: 45208 - DNA, 201 bp, Homo sapiens
ctggagtgcagtggcactatcatagctcattgcagccttgaactcctgggttcaagcaatctttctgcctcaaactcctgagtagctatgactataggcaygtatcaccacacccagctaattttttatgttttgtagagacgggactttgctatgttgctcaggctgatctcaagctcctggcctcaggtgatcctcccg

SEQ ID NO: 45209 - DNA, 201 bp, Homo sapiens
cttaaaggacctgcctgagtctgttttatagttaacttttttaaaaaaataagtaagagtatactctaaaataatgattgaaagtataatgtagtaaatayatcaaccagtcacacagtcatttattatcactatcaagtattatgtacatcattgtatgtgctaggcttttatatgactgacagcacagtaggtttgttt

SEQ ID NO: 45210 - DNA, 201 bp, Homo sapiens
taaaacaaaaaacacattgtatggctatacaaaaatattttctttttttatactcttatcctataagcatttttctgtttttaactttagaaaaaaaaaaacctttctgttaaaaccaagacacaaacacacacattgggctacacagggtcaggataaatattgccatcttccacctctacatcttgtcccactggaagg

SEQ ID NO: 45211 - DNA, 201 bp, Homo sapiens
gctctggctaagtcagtgatgagtggtgagtgaaagtaaaggcctaggacattactgtacactactgtagactttataaacactggatacttaggctacaytaaatgtatttaataataaattaaacttagcatactgtaactttttactttataaactttttgactcttttgtaataacacagtgtaaaacaaaaaacac

SEQ ID NO: 45212 - DNA, 201 bp, Homo sapiens
gtaacacaatgttatgtatttgtgtatctaaacatagaaaaggtacagtgaaaatacagcataaaagataaaccatcatacacctgtatagggcacgtacygttaatggaacttgcaggagtagatgttgctctggctaagtcagtgatgagtggtgagtgaaagtaaaggcctaggacattactgtacactactgtagac

SEQ ID NO: 45213 - DNA, 201 bp, Homo sapiens
aacagagtactgcaggaacaaacagtaggaggcaaagcacattagggatcagggacttggcttctattctgattcagccccttatcaggtgtgtggtcttragcaaagaatgttactgctgagttcggtttggaagtttttgtaaatagcacttatttgatgcctacaatttctaaataaattggtttttgttatgagaaa

SEQ ID NO: 45214 - DNA, 201 bp, Homo sapiens; identical to SEQ ID NO: 12069

SEQ ID NO: 45215 - DNA, 201 bp, Homo sapiens
gcaaaggttgcggtgagccaagatcatgccattgcactccagcctgggcaacaagagcaaaactccatctcaaaaacaaaaacaaaaacaaacaaacaaamaaaaaacatggaggtagtatgatgaataacagagtactgcaggaacaaacagtaggaggcaaagcacattagggatcagggacttggcttctattctgat

SEQ ID NO: 45216 - DNA, 201 bp, Homo sapiens
ctgaggtcgggagttcgagaccagccttaccaatatggagaaacccatctctactaaaaatacaaaattagccgggcgtggtggtgcatgcctgtaattcyagctactcaggaggctgaggcaggagaatcgcttgaacccaggaggcaaaggttgcggtgagccaagatcatgccattgcactccagcctgggcaacaag

SEQ ID NO: 45217 - DNA, 201 bp, Homo sapiens
gggaggccaaagcaggtgatcacctgaggtcgggagttcgagaccagccttaccaatatggagaaacccatctctactaaaaatacaaaattagccgggcrtggtggtgcatgcctgtaattctagctactcaggaggctgaggcaggagaatcgcttgaacccaggaggcaaaggttgcggtgagccaagatcatgccat

SEQ ID NO: 45218 - DNA, 201 bp, Homo sapiens
ctactcaggaggctgaggcaggagaatcgcttgaacccaggaggcaaaggttgcggtgagccaagatcatgccattgcactccagcctgggcaacaagagyaaaactccatctcaaaaacaaaaacaaaaacaaacaaacaaacaaaaaacatggaggtagtatgatgaataacagagtactgcaggaacaaacagtagga

SEQ ID NO: 45219 - DNA, 201 bp, Homo sapiens
acatactaatacagtgaaaaatgccatggttgagtatagagagagggagaaagaggcatttagattgagatttgattaagaaggaggcagtatgggccaggcgtagtggctcaaacctgtaatcccagcactttgggaggccaaagcaggtgatcacctgaggtcgggagttcgagaccagccttaccaatatggagaaac

SEQ ID NO: 45220 - DNA, 201 bp, Homo sapiens; identical to SEQ ID NO: 12036

SEQ ID NO: 45221 - DNA, 201 bp, Homo sapiens
catacatactaatacagtgaaaaatgccatggttgagtatagagagagggagaaagaggcatttagattgagatttgattaagaaggaggcagtatgggccaggcgtagtggctcaaacctgtaatcccagcactttgggaggccaaagcaggtgatcacctgaggtcgggagttcgagaccagccttaccaatatggaga

SEQ ID NO: 45222 - DNA, 201 bp, Homo sapiens
gttttgacaaatgtataatggcatgtatccatcattacagtatcacacagaatagtttcactgccctaaaaatcccctgtacttcatctattcatccctcrctctgcctctccaaactcctggctctaaaattgcttttaattagaatttttcacatttctgaactgttcaacagcaaagacgtgtggagacagtggtggc

SEQ ID NO: 45223 - DNA, 201 bp, Homo sapiens
tgcatataaaaaacaaaagttatgcatctgaaatcataacctctcactgacccccacaaggaccttccaacatgtgtctccaaaaagacagaggcaaagargaagaagaaagggcatgctggagcacctctgcagagatgacggatggatgaggagggggaaagcaggtgcacttctgtcttgaaagacagaatcatccaa

SEQ ID NO: 45224 - DNA, 201 bp, Homo sapiens
aaattttgtcacctataagccttctgtaatccttccttacagagagaggcccagcttctaaaggaaatatagatggtttgcatataaaaaacaaaagttaygcatctgaaatcataacctctcactgacccccacaaggaccttccaacatgtgtctccaaaaagacagaggcaaagaagaagaagaaagggcatgctgga

SEQ ID NO: 45225 - DNA, 201 bp, Homo sapiens
gctaaagctgaaccggagcgtgcagggaaccggacccgggccgggggcttccctgtgccgcccgggggcgcctctcctcaacagcagcagtgtgggcaacytcagctgcgagccccctcgcattcgcggagccgggacacgaggtgggtgcctccctcagccccccccacaagctatttctcactgtaccccagaacacta

SEQ ID NO: 45226 - DNA, 201 bp, Homo sapiens
ttggaacccattgagtttaaatgttagtggggcatccaggtgaggttacctagtaagctgttgaatccaggggtctggaacttacaggagaggtctgaggyggaaatacagacttgaagaaggtctttgcctacaggatgtagaagccccgagaatagttaaaatcataaaattttgtatagaatgagaagaaaataggtc

SEQ ID NO: 45227 - DNA, 201 bp, Homo sapiens
aaaattacagagtgcccatacacacacaaccacacatatacacagaatttaccctattattaacagcttacattagtgtggtacatgtgtcacaatttatragccagtatcaatacattattctctaaattctagagtttacattagggttcactttttgtgttgtatggttctataggttttgacaaatgtataatggca

SEQ ID NO: 45228 - DNA, 201 bp, Homo sapiens
actaaaagattcggtagtactaccaggattagttctataatgtggagaacggattggaagacataagatggaaggcagggggatactttagaaggttactrtattacactgttctgggtgaaagatgatgctagctgagactaaggtaatggcaagggagatggagagaggtggatagatttgagagcctcttctggaaat

SEQ ID NO: 45229 - DNA, 201 bp, Homo sapiens
gagtggtgagtgaaagtaaaggcctaggacattactgtacactactgtagactttataaacactggatacttaggctacactaaatgtatttaataataarttaaacttagcatactgtaactttttactttataaactttttgactcttttgtaataacacagtgtaaaacaaaaaacacattgtatggctatacaaaaa

SEQ ID NO: 45230 - DNA, 201 bp, Homo sapiens
acagagtgcccatacacacacaaccacacatatacacagaatttaccctattattaacagcttacattagtgtggtacatgtgtcacaatttataagccartatcaatacattattctctaaattctagagtttacattagggttcactttttgtgttgtatggttctataggttttgacaaatgtataatggcatgtatc

SEQ ID NO: 45231 - DNA, 201 bp, Homo sapiens
ttcacagtactgtaccaatttgaggtgtggcgaattgcatcaataattagttgaagaaagacatccagggcagatgtaagcaagataatggaactagaaasattaaagaggtggaggctgggggtgggaggacaatggatttggagaagaaacagtgagtccaagataaaccaccagctcttttctgagtccaaggacctc

SEQ ID NO: 45232 - DNA, 201 bp, Homo sapiens
tagagatagggtttttccatgttgcccaggctggtctctaaatccttggcttaagagatctgcccacctcagccttccaaagtgctgggattacagatatragccaccatgtctggcccagattaacatcttaatttagttaacatgttaacatctaacatctgtactcaaatactacccatacatacttggatattactt

SEQ ID NO: 45233 - DNA, 201 bp, Homo sapiens; identical to SEQ ID NO: 12046

SEQ ID NO: 45234 - DNA, 201 bp, Homo sapiens
atactcagataatacccacaaaagcttaaatattacttacattcactcaggtgctcagttatttcatttactcagattaacatctttttttttttttttttgaggcagtctccctctgttgcccaggctggggtgcagtagcatgatcatggctcattgcagtcttgacctccgcaggctcaagtgatcctcccacctcaa

SEQ ID NO: 45235 - DNA, 201 bp, Homo sapiens; identical to SEQ ID NO: 12047

SEQ ID NO: 45236 - DNA, 201 bp, Homo sapiens
catactcagataatacccacaaaagcttaaatattacttacattcactcaggtgctcagttatttcatttactcagattaacatctttttttttttttttttgaggcagtctccctctgttgcccaggctggggtgcagtagcatgatcatggctcattgcagtcttgacctccgcaggctcaagtgatcctcccacctca

SEQ ID NO: 45237 - DNA, 201 bp, Homo sapiens
acatactcagataatacccacaaaagcttaaatattacttacattcactcaggtgctcagttatttcatttactcagattaacatctttttttttttttttttgaggcagtctccctctgttgcccaggctggggtgcagtagcatgatcatggctcattgcagtcttgacctccgcaggctcaagtgatcctcccacctc

SEQ ID NO: 45238 - DNA, 201 bp, Homo sapiens
gtgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacga

SEQ ID NO: 45239 - DNA, 201 bp, Homo sapiens
ttgagggcttggttgttagtgtcagtttatggctgttcatctggactcttatgagcttaggaacatcatgacacatctaaagttggtgtatgcaagtcacwttgttgtaatagatggtgttttaattttgggacagatttattatcagacctttcagttaaaacctatttctatgatgtcctcaaggctaagattgttcca

SEQ ID NO: 45240 - DNA, 201 bp, Homo sapiens
atgagttctgtcatgattcactattctagaacttgcatgacctttactgtgttagctctttgaatgttcttgaaattttagactttctttgtaaacaaatratatgtccttatcattgtataaaagctgttatgtgcaacagtgtggagattccttgtctgatttaataaaatacttaaacactgagttgtcatttcttta

SEQ ID NO: 45241 - DNA, 201 bp, Homo sapiens
aggcaggcggatcacctgaggtcaggagttcgagaccagcctggccaacatggtgaaaccccgtctctactaaaaataccaaaattagccgggtgtggtgrcgagtacctgtaatcccagctactcaggaggctgaggtaggagaatcacttgaacccgggaggcagaggttgcagtgagccaagatggcgccattgccct

SEQ ID NO: 45242 - DNA, 201 bp, Homo sapiens
atactttaaaactacttagaatttgatgaaaaccagtattttcaaggcttacctgaaaatattaacagattaacagggatagattacaaatgaaattctgwgttcagctctggaactttgtctctttaggatttatgattggctacttgggctattgtaaaggggtagaaccaaaaactgagtgtgagagactggcaggaa

SEQ ID NO: 45243 - DNA, 201 bp, Homo sapiens
ttataggcaagagctacttactacacctggccatggatcttcttgtgtcaactttgagaccaaatttactgcagtgcttaaaatgttttaagaagttatayacatgtgctggatgtggtagctcacgcctgtaatcctgtagcaggacaagccgcagacaaatcccctcagacaccgagttaaagaaggaagggctttatt

SEQ ID NO: 45244 - DNA, 201 bp, Homo sapiens
agttagtgggtgcagtgcaccagcatggcacatgtatacatatgtaactaacctgcacaatgtgcacatgtaccctaaaatttaaagtataattaaaaaawaaataaataaataaataaaaaagaaaatatttgcctaatgggattagaggctgtatattggagtgagtaaagttagaaacaggtcagatagcagacattg

SEQ ID NO: 45245 - DNA, 201 bp, Homo sapiens
aagaatcgcttgaacccagggggcagaggttgcagtgagccgagatcgtgccattgcactctagcctgggcaacagagcaagatcgtctaacaacaacaamaaaaaaaccaaggctgaatttcttgagtgattgagcagtggctatctattggacagtccagctgaacagtattttcctcaggctgggtgcagtaactcac

SEQ ID NO: 45246 - DNA, 201 bp, Homo sapiens
ggtcacttgagctaggagcttaaggctgtggggagccatgattgcatcaccacgctccagcctgggtgacagagtgacctcgtctcaaggctgcagggagycatgattgcatcactgcactccagcctgggtgacagagagaggcctcgtctcaaggctgcggggagctgtgattgcatcactgcactctagcctgggtga

SEQ ID NO: 45247 - DNA, 201 bp, Homo sapiens
aggagcttaaggctgtggggagccatgattgcatcaccacgctccagcctgggtgacagagtgacctcgtctcaaggctgcagggagccatgattgcatcrctgcactccagcctgggtgacagagagaggcctcgtctcaaggctgcggggagctgtgattgcatcactgcactctagcctgggtgacagagtgacctcg

SEQ ID NO: 45248 - DNA, 201 bp, Homo sapiens
aggctgtggggagccatgattgcatcaccacgctccagcctgggtgacagagtgacctcgtctcaaggctgcagggagccatgattgcatcactgcactcyagcctgggtgacagagagaggcctcgtctcaaggctgcggggagctgtgattgcatcactgcactctagcctgggtgacagagtgacctcgtctcaaggc

SEQ ID NO: 45249 - DNA, 201 bp, Homo sapiens
ttaaggcctttaacttaacttaggactttgattacagagatgtattttgctttgacaaaagttaaggttaatgtcttaaatttccagagatgataacacartttctataacccagtaacccatttaacttcgcttagattatcaattttcagccttgaacaggccacttagtttctctaataactggcctcttcatctgta

SEQ ID NO: 45250 - DNA, 201 bp, Homo sapiens
gtggcgctatctcggctccccgcaacccccacctcctgggttcaagtgattctcctgcctcagcctcctgagcaactgggattacaagtgtgggccaccaygcctggctaatttttgtatttttagtagagatggggtttcaccatgttggccaggctgatcttgaactcctgacttcaagtgatctgcccacctcagcct

SEQ ID NO: 45251 - DNA, 201 bp, Homo sapiens; identical to SEQ ID NO: 12077

SEQ ID NO: 45252 - DNA, 201 bp, Homo sapiens; identical to SEQ ID NO: 12079

SEQ ID NO: 45253 - DNA, 201 bp, Homo sapiens; identical to SEQ ID NO: 12081

SEQ ID NO: 45254 - DNA, 201 bp, Homo sapiens; identical to SEQ ID NO: 12082

SEQ ID NO: 45255 - DNA, 201 bp, Homo sapiens; identical to SEQ ID NO: 12083

SEQ ID NO: 45256 - DNA, 201 bp, Homo sapiens
atacctttcgtccctgcatttaaaggctttcacttatattaatctggataaagcggttcttggtaagtatccctttcattagctgtgtatgaattcaggtraacttttttgagatggagttttgctcttgtcgcccaggctggagtgcaatggcacgatctcggctcactgcaacctctgtctcccagattcaagcgattc

SEQ ID NO: 45257 - DNA, 201 bp, Homo sapiens
aaactaattgtaactgttgaaaatggaacttaccaggtggaaataactaaatcctgaagtaccttgaaccaaaatgttttcccctatagggacattttccyccaaaaggagaattgaactggaaacaatatagtacataggattatataattatgttcaatttcttaatgagaatggttttcttacatgctgggctcaaat

SEQ ID NO: 45258 - DNA, 201 bp, Homo sapiens
ctccatgttggccaggctggtcttgaactcctgacctcaggtgatccacccatctcagcctcccaaagtgctaggattacaggtgtgagccaccccgcccrgcagtatgtgtcacttttgtctactcagaacatagtggttcgtacttataattgcagcactttgggaggccaaggtgggaggattgtttgaggccaggag

SEQ ID NO: 45259 - DNA, 201 bp, Homo sapiens; identical to SEQ ID NO: 12084

SEQ ID NO: 45260 - DNA, 201 bp, Homo sapiens
cacccatctcagcctcccaaagtgctaggattacaggtgtgagccaccccgcccagcagtatgtgtcacttttgtctactcagaacatagtggttcgtacytataattgcagcactttgggaggccaaggtgggaggattgtttgaggccaggagttcaagaccagcctgggcaacatagggtgaccttgtctctacaaaa

SEQ ID NO: 45261 - DNA, 201 bp, Homo sapiens
gtgtgttgttttcgtaggtggagtatcacttcctctctccctacgtatctccaaaagagtctcctttccgacatgtcttctggggctccggctctcacacrctgccagctttactggagaacttgaaactgcgtaaacaaaataacggtgcttttaatgaaacgctgttcagaaaccagttggctctagctacttggacta

SEQ ID NO: 45262 - DNA, 201 bp, Homo sapiens
tgagccaccgtgcccggcctaactgctctgatatttttaaaaaaggtgacttggattaaagtatgcaaactcaaggagtagtacgagcccacttgagtgargttagcttagttgctaaagagcttgataccaaaattacttttgtttacttgatgaatgggatagttgttgcacagggccactgatctagattactgtctt

SEQ ID NO: 45263 - DNA, 201 bp, Homo sapiens
gttccccccgccccccggccctgaattttgggttacaatatgcttctcaagaaaactcagagttaagataatttttgtcatcgattttgcaaggttatatrtagcatagcatccttcagtttcctttggatgttcttatcaagtaatggtggctgtaaacctagcctgtgttgaagattgttagatagacagcagtttggc

SEQ ID NO: 45264 - DNA, 201 bp, Homo sapiens
cgtgagccaccgtgcccggcctaactgctctgatatttttaaaaaaggtgacttggattaaagtatgcaaactcaaggagtagtacgagcccacttgagtsaagttagcttagttgctaaagagcttgataccaaaattacttttgtttacttgatgaatgggatagttgttgcacagggccactgatctagattactgtc

SEQ ID NO: 45265 - DNA, 201 bp, Homo sapiens
tttttgacagagtttcacgcttgttgcccaggctgtagtgcaatggtgtgatctcggctccctgcaacctccacctcccccaggttcaagtgattctcctscctcagcctccccagtagctgggattacaggcatgcgccaccatgcccggctaattttgtatttttttggtagagatgggatttctccatgtttggtcag

SEQ ID NO: 45266 - DNA, 201 bp, Homo sapiens
atggagtctcgctttgtcacccaggctggagtgcagtggcgccatcccagctcactgcaagctccgcctcccgggttcatgccattctcctgcctcagcckcccgagtagctgggactacaggtgcccgccaccacacccggctaattttttgtatttttagtagagacggggtttcactgtgccagccaagatggtctcg

SEQ ID NO: 45267 - DNA, 201 bp, Homo sapiens
tagtggtttttttttttttgaatttttagtgagaggggatttcaccatgttggtcaggcttgtctcaaacttctgaccataaatgatctgtgtgcctcggcccccccccagagtgctgggattacaggcatgagccactgtgtctggtctattctctcttttctgtcttctatcttatgcttagtcagaatttctgcttat

SEQ ID NO: 45268 - DNA, 201 bp, Homo sapiens
tttggcaacccttggggaataaaaacctattattttcttaaggacaaagtatcctgaagcaaaaaaacccaaacaaagaaacaaaaaactttaacaagcaytacaggtaattctgatggactaaagttttaggaccataagtctggactatattgaggtgagaagaaactaaactatgccatatagaatggtacttagaga

SEQ ID NO: 45269 - DNA, 201 bp, Homo sapiens
cttctcttctagggatacctttcgtccctgcatttaaaggctttcacttatattaatctggataaagcggttcttggtaagtatccctttcattagctgtktatgaattcaggtaaacttttttgagatggagttttgctcttgtcgcccaggctggagtgcaatggcacgatctcggctcactgcaacctctgtctccca

SEQ ID NO: 45270 - DNA, 201 bp, Homo sapiens
gtatttgggaatagggcattgcaatgggaatgcctgtgctatagtcaactatgtacatattcagaggagtaaaggaaaacaagtttttaaggacaaatgaygaggattacaaaattactttgaggtaattattcttggctaccaagatcaataacaaggatgacaccagtccaaggttgacaggcagttgctaggcagatt

SEQ ID NO: 45271 - DNA, 201 bp, Homo sapiens
gaactccaagaatgaaattgtgaaagggtgactactggcccctgctatgtactcaaaatcttatttgcagatctcctatcttgctctttgtaggttacttwaaaaaaaattattcctattcttttattcttttacctggggtctcaaaaaaagattttgttagttttttttttcttttttggctcagaaaaaaaagatttt

SEQ ID NO: 45272 - DNA, 201 bp, Homo sapiens
ggaatacggtggcgtgctctcatctcaccgcagcttcatccccctaccatagcctcctgagtagctgggactataagcacgcagcaccacacccagctaatttttttttttttttttttaagagatggagtctcaccatgtctcccaggccggtctgttcttagatttttatttatttacttatttattttgagatggagt

SEQ ID NO: 45273 - DNA, 201 bp, Homo sapiens
aacagctattgaaattttgttctgtttattcatttattcattttttgagacagagtttcactctgttgcccaggctggagtgcagtggtgtgatctcactyagctcactgcaacctctgcctcccgacttcaagcaattctcctgcctcagcctcctgagtagctgggattacaggcacccacaaccacacccggccaatt

SEQ ID NO: 45274 - DNA, 201 bp, Homo sapiens
taggagttataaatttacctgtaaaatgtaaatgatcatgagatattttggttttcaaccctctaatgacacagtcaacatgcattgtcttctctctctamtcactttccccatgtcctgttttattttttctttatagtactgctagcagctgacattatctatgcctttgtttccattagaatgtgagccagatgaaga

SEQ ID NO: 45275 - DNA, 201 bp, Homo sapiens
ataaggtggatcatagtccctaagcaatctatttgaaagcagtagcatacctctctactcatgtactgaggcctaacagctattgaaattttgttctgttkattcatttattcattttttgagacagagtttcactctgttgcccaggctggagtgcagtggtgtgatctcacttagctcactgcaacctctgcctcccga

SEQ ID NO: 45276 - DNA, 201 bp, Homo sapiens
tgccagtccctggagttaactttaaatgcaatcaaacagccaacacttactaagaaataagtccttggacttaagtagtcagtaaatttaattagtagtgyaggaaaaaagtagctctactagtaaggtaaaattaatattctcatgtgaatttttaattcccagagtttttagtcagatttgaagtaaggctcttttatc

SEQ ID NO: 45277 - DNA, 201 bp, Homo sapiens
aatttctattttatatttatttatttattttatttgtaatgggctttctggcaaaaactagaaagcatgctagacaaattctaaaagagctgtaacacttktccatagagttttactatctttgcacatacatgcctctgtgcaaagaataaatttatcttttcctttttgcaagcttcctacacttacagtggtactata

SEQ ID NO: 45278 - DNA, 201 bp, Homo sapiens
ttgctaatgggggaggctgcacatgtgtgggggcagtggatttatgggacctctaggtacctttctcttaattttgctgctgaacctaaaactggtctgawttttttttttttttttttttttttttttgagatggagtctcgctttgtcacccaggctggagtgcagtggcgccatcccagctcactgcaagctccgcct

SEQ ID NO: 45279 - DNA, 201 bp, Homo sapiens
agacagggtttctccatgttggtcaggctccatgaggtcagagctcctgacctcaggtgatctgcctccctcagcctcccaaagtgctgggattacaggcrtgagccaccgcgcccagcctatgtgtcagttttattgggaggtaataaggccctaggaaattcttgttaaaaattgaccattatgactagaaaatctatt

SEQ ID NO: 45280 - DNA, 201 bp, Homo sapiens
cagcacagctagcaggattccatctcgtagtgatctgcgcatctaaaagtcaaatattctattaaacgaaactgataagcagggtgaggtggtgcataccygtagccccagctacttctgctgaggcaggaggattgctggagtccagcccaggcaacatagcaaaatcccatctctaaataaattaataaaactaatatt

SEQ ID NO: 45281 - DNA, 201 bp, Homo sapiens
tttgtatttttagtagagccggggttttaccatgttggccaggctggtcttgaactcctgacctcaggtgatccacccacctcggcctcccaaagtgctgrgatcacaggcatgagccaccacgcccggcatcttatgtctttcttgaaactaattgtaactgttgaaaatggaacttaccaggtggaaataactaaatcc

SEQ ID NO: 45282 - DNA, 201 bp, Homo sapiens
cacctacaaatcgtaaccaacctgtgaagccagcgtcccatcttatccttatgtagtaggggagtaataatgtttcaacctatatttatgtaagtaagccsccttaggagcagctattatttgggtaacacagaggaattagataggggaagcacaagattttttttttattttgacagtctcactctgttgcccaggcag

SEQ ID NO: 45283 - DNA, 201 bp, Homo sapiens
caagggtggaactgtcgtcactgttacctcgatggcgaagccagaatgtgaggctcttgctcttagaactcacgtgagtaccatagcctcgcgttgtcttrcaggacacagattatccttatttgggtaccaccatggacacctataaggaactgattgagaggattcctgagttgaacaaagtggcacgagcagctgcag

SEQ ID NO: 45284 - DNA, 201 bp, Homo sapiens
tatggacactggtttttaaagcttgaatttaaaaagaattttttgtaataggttttagagctttttctttttcttttttattatttttttgagatggagtytcactctgtcacccaggctggagtgcagtggtgccatctcggctcactgcaacctccacctcccgggttcaagcgattctcctgcctcagcctccccagt

SEQ ID NO: 45285 - DNA, 201 bp, Homo sapiens
gttagaagcaagggtggaactgtcgtcactgttacctcgatggcgaagccagaatgtgaggctcttgctcttagaactcacgtgagtaccatagcctcgcrttgtcttgcaggacacagattatccttatttgggtaccaccatggacacctataaggaactgattgagaggattcctgagttgaacaaagtggcacgagc

SEQ ID NO: 45286 - DNA, 201 bp, Homo sapiens
actggtttttaaagcttgaatttaaaaagaattttttgtaataggttttagagctttttctttttcttttttattatttttttgagatggagtctcactcygtcacccaggctggagtgcagtggtgccatctcggctcactgcaacctccacctcccgggttcaagcgattctcctgcctcagcctccccagtagctggg

SEQ ID NO: 45287 - DNA, 201 bp, Homo sapiens
gctgaggtgggcagatcacttgaggccaggagtgagaccagcctgggtaacgtgcctagactatatctctacaaaaaattttttaaattaagtggcccagkggccagctgtagtcccaactccttgggaggctgaggcaggggggtcacttgagctaggagcttaaggctgtggggagccatgattgcatcaccacgctcc

SEQ ID NO: 45288 - DNA, 201 bp, Homo sapiens
tgatttggatgtggacatatttatcatttcctgttattacaggatggagatctagtttcaggcctttatgaaagcatttatctcctgtatgacataggttytctgatcctgtttctttaacataattggatagtgaaaatatattctacttgatagtctcaaatgaagaacatctgtatataaggagtatatgaaatacca

SEQ ID NO: 45289 - DNA, 201 bp, Homo sapiens
gctgacattatctatgcctttgtttccattagaatgtgagccagatgaagaatcatgggttagttctatttactgccatgttgcagagctttggagaatgsctgacatacatagtagtatttgctaaacaaatgcatatcctccctgtggggacagatgtaaatatccatcttggctggggcctagtcttagcttgattcg

SEQ ID NO: 45290 - DNA, 201 bp, Homo sapiens
taggggagtaataatgtttcaacctatatttatgtaagtaagcccccttaggagcagctattatttgggtaacacagaggaattagataggggaagcacargattttttttttattttgacagtctcactctgttgcccaggcaggagtgcagtggcatgatcctggctcactgcaacctccacctcctgggttcaaggaa

SEQ ID NO: 45291 - DNA, 201 bp, Homo sapiens
ccctgaattttgggttacaatatgcttctcaagaaaactcagagttaagataatttttgtcatcgattttgcaaggttatatatagcatagcatccttcartttcctttggatgttcttatcaagtaatggtggctgtaaacctagcctgtgttgaagattgttagatagacagcagtttggctaactccgccctaaggcg

SEQ ID NO: 45292 - DNA, 201 bp, Homo sapiens
tagttagagaagtgttttaaaatattgcttaattaatggtttccaattggctgcctgcagatcaaagtaagacgcaaatggttcaccactagagagtaagkttttttttgtttttattttgttttgttttgttttgtttttttttgagacaggacttgtgctctgttgcccaggctggagtgcagtggcgtgatctcggct

SEQ ID NO: 45293 - DNA, 201 bp, Homo sapiens
tagagatgggtaggttgttctgttaaagaacattgaagatttttgttcaacttcaagctttctgtattgagggcttggttgttagtgtcagtttatggctrttcatctggactcttatgagcttaggaacatcatgacacatctaaagttggtgtatgcaagtcactttgttgtaatagatggtgttttaattttgggaca

SEQ ID NO: 45294 - DNA, 201 bp, Homo sapiens
actagcccttgactgggcccagggaagaatgttggtttgaaaggagaacaccctaaggaatatatagcaagttatagtaatggcccaataacaagcatatrcctaaacgagcttttcctaaacattcccgtgcctgttcttcatcatgcctttttccgcaacacagtttggtggagaaccattgtcatatacccggttcag

SEQ ID NO: 45295 - DNA, 201 bp, Homo sapiens
cggtgatcatagttgataagaacggtagacttgtttacctggtggagaatcctgggggttatgtggcgtatagtaaggctgcaacagttactgtaagtaargcaaaacagtgcatgagactcttccctattgaatcattcaaaactcatcttttctgttcttaggagttataaatttacctgtaaaatgtaaatgatcatg

SEQ ID NO: 45296 - DNA, 201 bp, Homo sapiens
gtaattcacatcctgttacgttgtggcatcactgatagaaatattggataatgaaacttctagaagagtttgaatgttcactggcagcagaaaattgacaraagggtttgaatgttatttaaagtgcagctgtacattcaacaggaatggggtaaaaaagaaagtgcagatgtagctgatgagctgagaatagtgaaatgt

SEQ ID NO: 45297 - DNA, 201 bp, Homo sapiens
catgggataaaagcatgaaagacataggaggccaaaaatcttgattttattccaatagctctgacctaaaagttgtaaagttttttagaactcatgtcttwtttaggccttggcctccttttatctcttacttgggttgcctgtcttaggtttgatctataacactcttctgtctcaagattttagagctgttccgatacc

SEQ ID NO: 45298 - DNA, 201 bp, Homo sapiens
taaccatttggcctttagcataatgtccaggatgtattctcatttcgtatgatcagatcttcattttctgagctttatatgttttcttttaggttgcaaaygctgaaagcttaaatgcaattggtgtgttgatatacatggaccagactaaatttcccattgttaacgcagaactttcattctttggacatgtgagttatt

SEQ ID NO: 45299 - DNA, 201 bp, Homo sapiens
attcctggcatagcttctgctcaagtacttctgtgctgaagcacgatgcctatagcagcccattcagttagtagagagaatctgttagaattcatattggrataaaatcctattccccgaaacatccatttgtctggatttttcttctaagcaatacggtatgattccagttaccttgtctatagattgagaagccttgct

SEQ ID NO: 45300 - DNA, 201 bp, Homo sapiens
caatttctatatcaggacagcaactgggccagcaaagtgtaagttgagaaaagtgaatgaacaaactaatagaaaagcagagattctacctactacattasgtagaatctaaatctgtccttgcattgaacttacttacacctaaagatattcagctaaagaatttattttggatggggggactagcacgatagaacagtc

SEQ ID NO: 45301 - DNA, 201 bp, Homo sapiens
gggtttcagcccagcagaagcattatctttgccagttggagtgctggagactttggatcggttggtgccactgaatggctagaggtattctttatcatcchttcccatattggacacgagcttgtgggcttaggctgttgtccagaagtgatgtttttataggtttgattttaccacttttgcctttgcgtttagtctcag

SEQ ID NO: 45302 - DNA, 201 bp, Homo sapiens
ttgtatttttagtagaggtgggatggtctcgaacttttgacctcaggtgatcagcccgcctgggcctcccaaagtgctgggattacaggcgtgagccaccrcatgcggcccaaaggcttttaaaataaaaatcaagcttaagatttagaggtaaatttcctcaagccaaataatgcaagacatactaaatgtaagctattg

SEQ ID NO: 45303 - DNA, 201 bp, Homo sapiens
gaaacttctagaagagtttgaatgttcactggcagcagaaaattgacaaaagggtttgaatgttatttaaagtgcagctgtacattcaacaggaatggggyaaaaaagaaagtgcagatgtagctgatgagctgagaatagtgaaatgtctacatgggggaaaaaaggaaagagttacaattaaacctctctaggttagtt

SEQ ID NO: 45304 - DNA, 201 bp, Homo sapiens
tgggttcaagtgattctcctgccttagcctccagagcagctgggattacaggcgcacgccaccacgcccagctaatttttgtatttttagtagaggtgggrtggtctcgaacttttgacctcaggtgatcagcccgcctgggcctcccaaagtgctgggattacaggcgtgagccaccgcatgcggcccaaaggcttttaa

SEQ ID NO: 45305 - DNA, 201 bp, Homo sapiens
ctagtgcttcttaatttctgtgatactcacccattaacccctaggccagtcagtatccagagacaatgtctccctctggtggaggctggaatacggtggcrtgctctcatctcaccgcagcttcatccccctaccatagcctcctgagtagctgggactataagcacgcagcaccacacccagctaatttttttttttttt

SEQ ID NO: 45306 - DNA, 201 bp, Homo sapiens
caaaaaaaaaaaaaaaaaaaaaaagtctgatcggcattcttaaatttgggacattttacatttgaagtgaactgttgttttactacaaaagtcacagggcygtgtaaattgccttgtgtgttgttttcgtaggtggagtatcacttcctctctccctacgtatctccaaaagagtctcctttccgacatgtcttctggggc

SEQ ID NO: 45307 - DNA, 201 bp, Homo sapiens
aactgaaactatactggtaggggaaaaggtagaacttctctggggagtctcctttttcttaaaaaattaataggcccttgatgttttccccatctttgtarcttattgcttgctgtcattctctggctctgatttttcttcttaacctcttgtaacgttgtactaagctctgctttgctgacaaggacatcagtagctttt

SEQ ID NO: 45308 - DNA, 201 bp, Homo sapiens
gttagagaagacaagacttgtcatgtttagctaaagaggggaaggggcctgtaaaaaactgaaactatactggtaggggaaaaggtagaacttctctgggkagtctcctttttcttaaaaaattaataggcccttgatgttttccccatctttgtagcttattgcttgctgtcattctctggctctgatttttcttcttaa

SEQ ID NO: 45309 - DNA, 201 bp, Homo sapiens
  misc_feature (1)...(201): n = A,T,C or G, or insertion/deletion polymorphism (see Tables 1-2)
gagggaggagccaggagaggacttccctgcagcacgtcgcttatattgggatgacctgaagagaaagttgtcggagaaactggacagcacagacttcaccngcaccatcaagtgagtgccagctgctgtgcaagtatctagacaagtaattcaagaattatgataggccacggggaaacaataatggtgacactgtgggga

SEQ ID NO: 45310 - DNA, 201 bp, Homo sapiens
cgtgcaccaccacacctggctaatttttgtatttttagtagagacggggtttcaccatgttggtcaggctggtctctaactcctgacctcgtgatctgccygcctcagcctcccagagtgctgggattacaggcatgagccactttcccgtccactttatgcctttttaagtgccactaggaagacaatcatgagtagatt

SEQ ID NO: 45311 - DNA, 201 bp, Homo sapiens; identical to SEQ ID NO: 12076

SEQ ID NO: 45312 - DNA, 201 bp, Homo sapiens
ccttcggttccccgggctccgggcgggccccgttctcactgcggaaagggacaaagctgtccccgattcggttactagcgtgttacaggcattaattagawacgggtttctgtaaacttacccttcggctctggtacaacctgatcttgccatgctctgcctgttcgccttgtgtgtggattctgttttctcaaggcagaa

SEQ ID NO: 45313 - DNA, 201 bp, Homo sapiens
ttttcttttaggttgcaaatgctgaaagcttaaatgcaattggtgtgttgatatacatggaccagactaaatttcccattgttaacgcagaactttcattmtttggacatgtgagttatttcttgagtaaatcaccgttttgagttccttgagttgttcttggattcctgtattagcagaaatagcactgtgtcttcctta

SEQ ID NO: 45314 - DNA, 201 bp, Homo sapiens
ttaatctggataaagcggttcttggtaagtatccctttcattagctgtgtatgaattcaggtaaacttttttgagatggagttttgctcttgtcgcccagrctggagtgcaatggcacgatctcggctcactgcaacctctgtctcccagattcaagcgattctcctgccttagcctcctgagtagctgggattacaggtg

SEQ ID NO: 45315 - DNA, 201 bp, Homo sapiens
agtgtattaatattcttttatatattagaagaacttcattttgagtccatcttggtatgtattccaaatataaactacgtaagtatgtctggcagaaaggsatagttagagaagtgttttaaaatattgcttaattaatggtttccaattggctgcctgcagatcaaagtaagacgcaaatggttcaccactagagagtaa

SEQ ID NO: 45316 - DNA, 201 bp, Homo sapiens
aagcattatctttgccagttggagtgctggagactttggatcggttggtgccactgaatggctagaggtattctttatcatcccttcccatattggacacragcttgtgggcttaggctgttgtccagaagtgatgtttttataggtttgattttaccacttttgcctttgcgtttagtctcagtagagtccagaattgaa

SEQ ID NO: 45317 - DNA, 201 bp, Homo sapiens
cgagcttgtgggcttaggctgttgtccagaagtgatgtttttataggtttgattttaccacttttgcctttgcgtttagtctcagtagagtccagaattgmaaatgaatccctaatgctactgtatgtgataaataaacagatttatacttattagtgttttcccttctcttctagggatacctttcgtccctgcatttaa

SEQ ID NO: 45318 - DNA, 201 bp, Homo sapiens
tgacttaatttttgttgaatcaacctgagataaaaaacactgatatgtaaaccgtagtcagtaacaaaaaataggaattgagaataaattttatagcagcrttatttaagggatacttgcctattgaaccatatgagatgagggctccaatcttaaagaatatgttgtttatttaggaatatataacaaaatgccatgagg

SEQ ID NO: 45319 - DNA, 201 bp, Homo sapiens
ttccacttacctaatcagaagtgcttaagtgaaagctatttctctgtataactcagttttacgcatatacagaattcagctaaaagcatgttttataaaarggaaaattaatagccaaacatacacaaggaactagagtggaacatatcaaaagacagtggtgatttctgcatttttaaaaaaagtggcagggctcacacc

SEQ ID NO: 45320 - DNA, 201 bp, Homo sapiens
cgaggcagaggccagtgcgcccatcgcgcggctcctcggggcacctgctgccttggcgccttttcccttggccttcgcctcgcccgcagcgccctccgcakagggccccgcccgctgcgcgcgcatccccgccccccgggcgatctgtcagagcacctcgcgagcgtacgtgcctcaggaagtgacgcacagcccccctgg

SEQ ID NO: 45321 - DNA, 201 bp, Homo sapiens
gctaccagggtggaggaaggcgccgaggcagaggccagtgcgcccatcgcgcggctcctcggggcacctgctgccttggcgccttttcccttggccttcgyctcgcccgcagcgccctccgcatagggccccgcccgctgcgcgcgcatccccgccccccgggcgatctgtcagagcacctcgcgagcgtacgtgcctcag

SEQ ID NO: 45322 - DNA, 201 bp, Homo sapiens
aggactgcttgagccctggaggttgtgagatgtgactcgtgccactccagcctgagtgacagtgagactcaaaaaagtggttgtcttagatgggtttttgktatttttcttttcttttttttttttttttttgagacggagtctcttgtcaccctggctggagtgcagtggcgtgatctcagctcactgcaacctccgcct

SEQ ID NO: 45323 - DNA, 201 bp, Homo sapiens
tagcgtgttacaggcattaattagatacgggtttctgtaaacttacccttcggctctggtacaacctgatcttgccatgctctgcctgttcgccttgtgtrtggattctgttttctcaaggcagaatccgactgaacgccgcaggtgttcacattaagaatattgctagcagttctcactacaagacgggagccataggag

SEQ ID NO: 45324 - DNA, 201 bp, Homo sapiens
atcctattccccgaaacatccatttgtctggatttttcttctaagcaatacggtatgattccagttaccttgtctatagattgagaagccttgcttcttaygatggtttccagagaaaccatttatggttgtggctcgctcctctggatatcctccctgtaacgttagtgtctctctttaaaaacagagcccagttccatt

SEQ ID NO: 45325 - DNA, 201 bp, Homo sapiens; identical to SEQ ID NO: 12074

SEQ ID NO: 45326 - DNA, 201 bp, Homo sapiens
taatacagagtacattaatggagaaaaagatacagtgagggaagtgggagggatggagggcagtgtgatacatgtaacctcaaaaggtgctgtcacaaatrtagtttctctgcaaactcttcttgtaacttaaatttgtgaatttttattttattttagaattatttttttaaaaatccaatgtttggatttacctctgaa

SEQ ID NO: 45327 - DNA, 201 bp, Homo sapiens
catagcttctgctcaagtacttctgtgctgaagcacgatgcctatagcagcccattcagttagtagagagaatctgttagaattcatattgggataaaatcctattccccgaaacatccatttgtctggatttttcttctaagcaatacggtatgattccagttaccttgtctatagattgagaagccttgcttcttatga

SEQ ID NO: 45328 - DNA, 201 bp, Homo sapiens
attttgacagtctcactctgttgcccaggcaggagtgcagtggcatgatcctggctcactgcaacctccacctcctgggttcaaggaattctgcctcggcyttccaaagtgctgggattacaggcgtgagccaccgcacccagctgaggaatattttttataactgagctaagaatgtgtactatccttgttagtggtgac

SEQ ID NO: 45329 - DNA, 201 bp, Homo sapiens
ctacaggtaattctgatggactaaagttttaggaccataagtctggactatattgaggtgagaagaaactaaactatgccatatagaatggtacttagagrgtaattcacatcctgttacgttgtggcatcactgatagaaatattggataatgaaacttctagaagagtttgaatgttcactggcagcagaaaattgaca

SEQ ID NO: 45330 - DNA, 201 bp, Homo sapiens
ataataaaccttttgccaggctatacagtctctcttttagctgttcaactctgtgggagcaagaaaacaggcacagactgtgcgtagtgaatgggcatgcrggctgtagtttgccagtccctggagttaactttaaatgcaatcaaacagccaacacttactaagaaataagtccttggacttaagtagtcagtaaattta

SEQ ID NO: 45331 - DNA, 201 bp, Homo sapiens
atggtttccaattggctgcctgcagatcaaagtaagacgcaaatggttcaccactagagagtaagtttttttttgtttttattttgttttgttttgttttktttttttttgagacaggacttgtgctctgttgcccaggctggagtgcagtggcgtgatctcggctcactgcagcctccgcctcccaggttcaagcgattc

SEQ ID NO: 45332 - DNA, 201 bp, Homo sapiens
atctgcctgcctcggcctgggattacagatgtgggccactgtgcctggccagataaactactttgaagtggaagaaagcttttttttttttttgagacagrgtctcactgtattgcccaggctagagtgcagtggccaatcttggctcactgcagccttgacctcctgggctcaggtgatcctcccacttcagccacctgg

SEQ ID NO: 45333 - DNA, 201 bp, Homo sapiens
ggagaccttgtctcaaaaaaaaaaaaaaatttacaaaaagggagagactgactgagaagaccagtgtgaactagcccttgactgggcccagggaagaatgytggtttgaaaggagaacaccctaaggaatatatagcaagttatagtaatggcccaataacaagcatatacctaaacgagcttttcctaaacattcccgtg

SEQ ID NO: 45334 - DNA, 201 bp, Homo sapiens
gggcgcagtggtgcacgcctgtaatcccagcacttgggaggccaaggcaggcggatcacctgaggtcaggagttcgagaccagcctggccaacatggtgamaccccgtctctactaaaaataccaaaattagccgggtgtggtggcgagtacctgtaatcccagctactcaggaggctgaggtaggagaatcacttgaacc

SEQ ID NO: 45335 - DNA, 201 bp, Homo sapiens; identical to SEQ ID NO: 12101

SEQ ID NO: 45336 - DNA, 201 bp, Homo sapiens; identical to SEQ ID NO: 12090

SEQ ID NO: 45337 - DNA, 201 bp, Homo sapiens
gaatgaacaaactaatagaaaagcagagattctacctactacattaggtagaatctaaatctgtccttgcattgaacttacttacacctaaagatattcarctaaagaatttattttggatggggggactagcacgatagaacagtctattctttaaaacactttctaaagacacattctttgtctttgcagtgagaaact

SEQ ID NO: 45338 - DNA, 201 bp, Homo sapiens
aattattcctattcttttattcttttacctggggtctcaaaaaaagattttgttagttttttttttcttttttggctcagaaaaaaaagattttggaatcygctatcttggaattagaccttctgattcatcttaagtgggataccttccatccttgtctgtgtataacctttcctcaggtaaagctaacttttttctctt

SEQ ID NO: 45339 - DNA, 201 bp, Homo sapiens
taaatctgtccttgcattgaacttacttacacctaaagatattcagctaaagaatttattttggatggggggactagcacgatagaacagtctattctttraaacactttctaaagacacattctttgtctttgcagtgagaaactcactttagacaatgctgctttccctttccttgcatattctggaatcccagcagtt

SEQ ID NO: 45340 - DNA, 201 bp, Homo sapiens
gcaagggtggaactgtcgtcactgttacctcgatggcgaagccagaatgtgaggctcttgctcttagaactcacgtgagtaccatagcctcgcgttgtctygcaggacacagattatccttatttgggtaccaccatggacacctataaggaactgattgagaggattcctgagttgaacaaagtggcacgagcagctgca

SEQ ID NO: 45341 - DNA, 201 bp, Homo sapiens
cattcagttagtagagagaatctgttagaattcatattgggataaaatcctattccccgaaacatccatttgtctggatttttcttctaagcaatacggtrtgattccagttaccttgtctatagattgagaagccttgcttcttatgatggtttccagagaaaccatttatggttgtggctcgctcctctggatatcctc

SEQ ID NO: 45342 - DNA, 201 bp, Homo sapiens; identical to SEQ ID NO: 12087

SEQ ID NO: 45343 - DNA, 201 bp, Homo sapiens
gtcaactttgagaccaaatttactgcagtgcttaaaatgttttaagaagttatacacatgtgctggatgtggtagctcacgcctgtaatcctgtagcaggrcaagccgcagacaaatcccctcagacaccgagttaaagaaggaagggctttatttggctgggagctttggcaagactcacgtctccaaaaactgagctcc

SEQ ID NO: 45344 - DNA, 201 bp, Homo sapiens
cacacaggatgccaggccaaggtggagcaagcggtggagacagagccggagcccgagctgcgccagcagaccgagtggcagagcggccagcgctgggaacyggcactgggtcgcttttgggattacctgcgctgggtgcagacactgtctgagcaggtgcaggaggagctgctcagctcccaggtcacccaggaactgagg

SEQ ID NO: 45345 - DNA, 201 bp, Homo sapiens
agtctcaggagagctactcggggtcgggcttggggagaggaggagcgggggtgaggcaagcagcaggggactggacctgggaagggctgggcagcagagamgacccgacccgctagaaggtggggtggggagagcagctggactgggatgtaagccatagcaggactccacgagttgtcactatcatttatcgagcaccta

SEQ ID NO: 45346 - DNA, 201 bp, Homo sapiens
gccggggtgagcctagagggcttcctggaggtggagtctagcctggcactcagggtgggtggaaactgatcgtcattttgcccacaggaatcctcgtagcycactacctccagagcatcacgccttgcctggccctgggtggagagctggtctaccaccggcggcctggagaggagggcactgtcatgtctctagctggga

SEQ ID NO: 45347 - DNA, 201 bp, Homo sapiens
tgagcaggtgcaggaggagctgctcagctcccaggtcacccaggaactgaggtgagtgtccccatcctggcccttgaccctcctggtgggcggctataccyccccaggtccaggtttcattctgcccctgtcgctaagtcttggggggcctgggtctctgctggttctagcttcctcttcccatttctgactcctggcttt

SEQ ID NO: 45348 - DNA, 201 bp, Homo sapiens
tggccaggctggtctggaactcctgacctcaggtgatctgcccgtttcgatctcccaaagtgctgggattacaggcgtgagccaccgcacctggctgggarttagaggtttctaatgcattgcaggcagatagtgaataccagacacggggcagctgtgatctttattctccatcacccccacacagccctgcctggggca

SEQ ID NO: 45349 - DNA, 201 bp, Homo sapiens; identical to SEQ ID NO: 12122

SEQ ID NO: 45350 - DNA, 201 bp, Homo sapiens; identical to SEQ ID NO: 12124

SEQ ID NO: 45351 - DNA, 201 bp, Homo sapiens
tctgaggcttctgtgctgcttcctggctctgaacagcgatttgacgctctctgggcctcggtttcccccatccttgagataggagttagaagttgttttgwtgttgttgtttgttgttgttgttttgtttttttgagatgaagtctcgctctgtcgcccaggctggagtgcagtggcgggatctcggctcactgcaagctc

SEQ ID NO: 45352 - DNA, 201 bp, Homo sapiens
gaggcttctgtgctgcttcctggctctgaacagcgatttgacgctctctgggcctcggtttcccccatccttgagataggagttagaagttgttttgttgktgttgtttgttgttgttgttttgtttttttgagatgaagtctcgctctgtcgcccaggctggagtgcagtggcgggatctcggctcactgcaagctccgc

SEQ ID NO: 45353 - DNA, 201 bp, Homo sapiens
ggggagccctataattggacaagtctgggatccttgagtcctactcagccccagcggaggtgaaggacgtccttccccaggagccggtgagaagcgcagtygggggcacggggatgagctcaggggcctctagaaagagctgggaccctgggaagccctggcctccaggtagtctcaggagagctactcggggtcgggctt

SEQ ID NO: 45354 - DNA, 201 bp, Homo sapiens
cggaggtgaaggacgtccttccccaggagccggtgagaagcgcagtcgggggcacggggatgagctcaggggcctctagaaagagctgggaccctgggaasccctggcctccaggtagtctcaggagagctactcggggtcgggcttggggagaggaggagcgggggtgaggcaagcagcaggggactggacctgggaagg

SEQ ID NO: 45355 - DNA, 201 bp, Homo sapiens
cactgcagcctccacctcctggactcaagtgataagtgatcctcccgcctcagcctttccagtagctgagactacaggcgcataccactaggattaatttggggggggggtggtgtgtgtggagatggggtctggctttgttggccaggctgatgtggaattcctgggctcaagcgatactcccaccttggcctcctgagt

SEQ ID NO: 45356 - DNA, 201 bp, Homo sapiens; identical to SEQ ID NO: 12123

SEQ ID NO: 45357 - DNA, 201 bp, Homo sapiens
ttttgctgtgaggctacaagaattgctggaagacaacatttttatttcgtggaaatttgtgttgtgtttctccttggttgttaatgctttgcatttacatrgtgaacatcttattatcagagctggcctgtgaggagggtagtgggggggcattgatgttcccgtttctgagtgaggagacctatgtcggggccttggtga

SEQ ID NO: 45358 - DNA, 201 bp, Homo sapiens
attgaaaagaataaaagctgacaatgtaacaaattttttaaactttaaatttaatagttttaaagaattttcttggtgtgttcctgcagtaaacattttawaaaaaaaataattatttattctgatataatgaacttccttttttattgctgtctttttcttttttaatgaaaatatggtgattgattttttttaatgccc

SEQ ID NO: 45359 - DNA, 201 bp, Homo sapiens
tggacaaaatttggagcatatgtctttctttttacctgatttctccagaatttgaaaactatttgggagtattcttaactaatagcaatatagttatttgyctaagtgcagtaagaatcttttcttttgtaataggacacaattaaagaaactgcttattttatgaaggctttgactagaatggtgtgctttcagatacaa

SEQ ID NO: 45360 - DNA, 201 bp, Homo sapiens
cataagattaaaactttatggcaaacaaatttgtcccactatgatttgtctttggtaaaaatggaagctagagagagaatttgtttcaaaaactatgatayaccagttattagattctagtctcgtctgttgtttttgagtttcttctgcaatttaggcagaccctgcttattcctgagaatcaaccagtgatctatggct

SEQ ID NO: 45361 - DNA, 201 bp, Homo sapiens
ccattggatccagcaatcccattactgggtatataaccaaaggaatataaatcattctaccataaagacatgcatacgtatgttcactgcagcactattcaacgatagcaaagacatggaatcatcctaaatgcccattgacagtagactggataaagaacatctggcacatatacaccatggaatactatgtgttgataa

SEQ ID NO: 45362 - DNA, 201 bp, Homo sapiens
cctcctgatggcttgctcagagagcctgttttcattgcccactttatatgtcagtaaataatcttccctggcagtgggtccaccatgtctggatgcacacrgggaaatctggtggggtctggccagtgaaaaacactcctcaggttttgcaggaaaagcagtgaacccttcttttaagctcgagaatgctttaaagatgca

SEQ ID NO: 45363 - DNA, 201 bp, Homo sapiens
gaggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaatt

SEQ ID NO: 45364 - DNA, 201 bp, Homo sapiens
tgttttcattgcccactttatatgtcagtaaataatcttccctggcagtgggtccaccatgtctggatgcacacagggaaatctggtggggtctggccagkgaaaaacactcctcaggttttgcaggaaaagcagtgaacccttcttttaagctcgagaatgctttaaagatgcatcattggcaagccttgccaaagaaat

SEQ ID NO: 45365 - DNA, 201 bp, Homo sapiens
aggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaattt

SEQ ID NO: 45366 - DNA, 201 bp, Homo sapiens
ggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaattta

SEQ ID NO: 45367 - DNA, 201 bp, Homo sapiens
gagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaatttag

SEQ ID NO: 45368 - DNA, 201 bp, Homo sapiens
tggtgcactgggactttggtaattcaccagttacctgtcctggtcatttatagaaaccgaggtatgaaattcgctggagggtcattgaatcaatcagcccrgatggacatgaatatatttatgtggacccgatgcagctgccttatgactcaagatgggagtttccaagagatggactagtgcttggtaagttccatgggg

SEQ ID NO: 45369 - DNA, 201 bp, Homo sapiens
cctgggcataggccgaactaactttgagaggaacttagtttatagtttgactttgaaaaaaagacaataatagccctttgccaaaacaaaccctctttttscctgggaactagactgcctttgcgggactaacgaattagctacaagattagaaagtatggtttaggggtcactgttgtaaaacctgaggtcagtgcttga

SEQ ID NO: 45370 - DNA, 201 bp, Homo sapiens
ttccctgtgggctcaattccttttttgacacgatgacttggaggagtcattatgattactccaaacaggaaagacactcgcccagctgtccgcccgcagaragctggctacggtgcagaaagctgaggaggcgtctggagtttttgggtgttaatgattctgcctgcccacaggtcgggtcttggggtctggagcgtttgg

SEQ ID NO: 45371 - DNA, 201 bp, Homo sapiens
ctcctttctcccgtctgtgttttctttcccttgcaagtgttattcgacaaaagcaattatgctaatttccttccctgtgggctcaattccttttttgacasgatgacttggaggagtcattatgattactccaaacaggaaagacactcgcccagctgtccgcccgcagagagctggctacggtgcagaaagctgaggagg

SEQ ID NO: 45372 - DNA, 201 bp, Homo sapiens
gtctcatatgttctgggacacgagctattccattctgacttctttctgcctcttgcagttccttcatccattctggacttggtcgatgatcaccatggctyaactgggggacagacggtgaggtgcacagctgaaggcacgccgcttcctgatattgagtggatgatatgcaaagatattaagaagtatggaaaacagatg

SEQ ID NO: 45373 - DNA, 201 bp, Homo sapiens
agcaaaatctgttgccagtccagtcatagccattcatggctctttattaaaaaaaaaaaaaaaaaaaaaaaaagcttttttggtatcttatttttttctgygccatatggtctgcaggacaattcatggcttttctgttcttcattttcatacccatctcctaacggcttttgtccccataggccccatttacatcatcac

SEQ ID NO: 45374 - DNA, 201 bp, Homo sapiens
acagggataaatctcaaaacaccaaaactgtgaaaatgctgctaaccatgtgggtctgtctaaactggagtgttacttgtacaactggtttcagcccctcsggagtgttttgaatgccatgtagatgagttgtgaactcatattccactttgtagtctcatatgttctgggacacgagctattccattctgacttctttct

SEQ ID NO: 45375 - DNA, 201 bp, Homo sapiens
caccaagactaaggaccctcatggagtccattgcactgtccaccacctccaccagaacaagcactggtatacatggctgagagacccatagatggttcacrtcacaggactctgtgcagacaacccccagtaccagcccagagctgggtagactaattgggtggctagacccagaagagagaaaacaaccactgcagttta

SEQ ID NO: 45376 - DNA, 201 bp, Homo sapiens
tgaaaaacaatctgactctgattgaaaatctcactgagatcaccactgatgtggaaaagattcaggaaataaggtaaagaaactctctgcccaagtatgcytttttttagtgtgcatcagaggcggactgaggtttgtgtgtgtcttacaacccagacccaaagtcagtctagaaaatgtaacaatctgagttaagagatg

SEQ ID NO: 45377 - DNA, 201 bp, Homo sapiens
ggtagaaggaattgtatgcccaagccacatgaccacacggctcaagttccaaccaaggcttgtgagttgaaaaactgagaaagaataatgacagacttaaygtagtgaattcttcaaactttaagtgtaatggacttacaggtccatgggagcacagccccactgtcttagatgtggctcttcaggatgtgcgggctcctg

SEQ ID NO: 45378 - DNA, 201 bp, Homo sapiens
tatactcactctgggtgttgggactttccagtggtttaatatgatacttaaagtatttagagggaagtgtatagggatggtaagtgaacctggcagcccaygtggtctctaaatgcaggtctgcacaaccagttctgtgacatgtttccaggtttgtggcctgtaaattgaaaagaataaaagctgacaatgtaacaaatt

SEQ ID NO: 45379 - DNA, 201 bp, Homo sapiens
aaggagatgatgacactgaattttcttgaaaaaaccagtgcttcaaggctataggatctgaaaggttttctaacagtgttctatcatgccaagtgtttcarcaatgcactgagcgtttgttagtcctggtgttttattgtttggcttttaggtggcaccccttaccccggcatgatggtggattctactttctacaataag

SEQ ID NO: 45380 - DNA, 201 bp, Homo sapiens
ctctttaccattggtggccccttcttcatgttctatgtctctggggatagttgacatgactctccttcaactaagtcccacatcttccaggtagtttggaratatgtacagttaaataatggtaagttctgagtgtctctattcatttttgaggtttggttgttaacacttgattaaatatgttcaatgaatgtttataga

SEQ ID NO: 45381 - DNA, 201 bp, Homo sapiens
tttaaatggtaatttattacattctttatccttcagcagtatagcacaaacaccttatatgtgtcattaactgtccttttaaaaaatgggctgggtgtggwggctcatgcctgtaatcccagtactttgggaggctgaggcaggagagtcacttgaggccaggagtttgagatcagcctgggcaatgtatcaagactccgt

SEQ ID NO: 45382 - DNA, 201 bp, Homo sapiens
atatgcctaattgttgtacaccatctcacaatcaagccttgtgagattttccaaattttatcttgatcaaactggtttgcaaattatttttcagggttttyttaaaaaaaaaaaaaaaaacccaaactttataagatcctggctatcctgtggatttttaggcccttgtatttgttcttttttatagcaacatcagagctg

SEQ ID NO: 45383 - DNA, 201 bp, Homo sapiens
tatgattgaagaaaagatttgggtgaaatctagtgttcttccctgcaaagggggttgttctcacggattcttatggtgccatgtttctcagaatttgtagyttcagttacttatatttgcacacctgactttagatgagctccagaatagcagttactaattaaggatgagcatttagagtagataaaagtggcaggaaca

SEQ ID NO: 45384 - DNA, 201 bp, Homo sapiens
gtatttctgggaggttctgggttactctagagtaggcgaggaatccctaggctccaccagctagctttatttttgtagagatggagtcttgccatgttgcycaggctggtctcctgggttcaagctatcttcccaccttggcctctcaaagtactgggattacaggtgtgagccactgcacctggcctccaccagcttact

SEQ ID NO: 45385 - DNA, 201 bp, Homo sapiens
gctcaggctggtctcctgggttcaagctatcttcccaccttggcctctcaaagtactgggattacaggtgtgagccactgcacctggcctccaccagcttrcttagcacctgcttctcaatctgagaagagagaagcagatgaccttagattgttctggagagttttgctacaagttttccttatagacattgtacagtgg

SEQ ID NO: 45386 - DNA, 201 bp, Homo sapiens
ttgggagggatggaacaccctgtggctttgcagggtttagcccctgcagctgctctcaggggctgttgtcgagtgcctgtggtttttcctggtgcagagtrcaggctgttggtggatatattattcatggaggatggtggccctcccctcgtagcttcacgaggcagtgccccagtggagactctgtgtggggacttcaac

SEQ ID NO: 45387 - DNA, 201 bp, Homo sapiens
ttttgcaaggatagcaccaaggggatggtgctaaaccatttgtgagaaattcacccccatgatccagtcacctcccaccaggccccacctccaatactggrgattacacttcaacatgagatttgggtggggacacatatccaaactatatcattgcgtgtgtgtgtgtgtgtgtataatttttaaaccagatatatgttt

SEQ ID NO: 45388 - DNA, 201 bp, Homo sapiens
accccacatttcccctctgcagtgccctagtagaggttctctgtgagggctccaatcctgcagcatgcttctgtctggacaccctggttttttaatatatmctccgaaatctaggcagaggctcccaagcctcaactcttaacactctgtacacccacaggctaacaccacatggaagcggccaaggtttatggctgtcac

SEQ ID NO: 45389 - DNA, 201 bp, Homo sapiens
tttacagtaaaaataaaacttaaattgaagagtacaattgtttaaacaattggaacttacttagctactgcttgttgaaacaaaatcctttttttaaaagstatcgaagcaaattaaagctgatccgtgctaaggaagaagacagtggccattatactattgtagctcaaaatgaagatgctgtgaagagctatacttttg

SEQ ID NO: 45390 - DNA, 201 bp, Homo sapiens
gaaaatctcactgagatcaccactgatgtggaaaagattcaggaaataaggtaaagaaactctctgcccaagtatgcctttttttagtgtgcatcagaggyggactgaggtttgtgtgtgtcttacaacccagacccaaagtcagtctagaaaatgtaacaatctgagttaagagatgcttgaaatcacatccctttaatg

SEQ ID NO: 45391 - DNA, 201 bp, Homo sapiens
atgatccagtcacctcccaccaggccccacctccaatactggggattacacttcaacatgagatttgggtggggacacatatccaaactatatcattgcgygtgtgtgtgtgtgtgtataatttttaaaccagatatatgtttctgcatatctctttcctttctttcattctttctttctttttttttttttttttttttg

SEQ ID NO: 45392 - DNA, 201 bp, Homo sapiens
tccaatcctgcagcatgcttctgtctggacaccctggttttttaatatatactccgaaatctaggcagaggctcccaagcctcaactcttaacactctgtrcacccacaggctaacaccacatggaagcggccaaggtttatggctgtcacaagctgaagcagcagcccaagctgcacctgaactcctttgagccacggct

SEQ ID NO: 45393 - DNA, 201 bp, Homo sapiens
cagaaagtacaatgaattcacttcataataaattacttggtggacaccaaatgggtgctaaattgattgggtagaaggaattgtatgcccaagccacatgrccacacggctcaagttccaaccaaggcttgtgagttgaaaaactgagaaagaataatgacagacttaatgtagtgaattcttcaaactttaagtgtaatg

SEQ ID NO: 45394 - DNA, 201 bp, Homo sapiens
acatatccaaactatatcattgcgtgtgtgtgtgtgtgtgtataatttttaaaccagatatatgtttctgcatatctctttcctttctttcattctttctwtctttttttttttttttttttttgagacagagtctcactctgtcacccaggctgcagtgcagtggtgtgatctcggctcactgcaactcattgcaacctc

SEQ ID NO: 45395 - DNA, 201 bp, Homo sapiens
ccagtggctgggcttcatggcggtgctccacgagaccctagtagcaatgatgaatgaaaaccctccccttcccgtggggctttcctttcatcttatatgtrcagtacctgtaagcactattctccagatgtttgagtatcagaagttagtgtgcagttagaagactcagggcatccatggccattacatcactaatttgag

SEQ ID NO: 45396 - DNA, 201 bp, Homo sapiens
tttgagtgcacttaaatccatgcgaaattggcttttaccagcggactggaaggaacaacctcagctgttatctgtggcaccagctggttttttgtggaatrggaagcattgttcaaaggaacaaatgtaatttcttggaaccaggcaggatatgtaaatgaatgaaacaactttctgctgaggtgttgagaggaaaactca

SEQ ID NO: 45397 - DNA, 201 bp, Homo sapiens
ttaaccctcagttggtcaaagatgctctgactggtggaaatgtgttggtgggaagagattgaagttattgttgaaaatagggtcttttcacatccaatgtkagacctctccaatgtttaaggatcatgaaggctttgggtattatccacccaatagaaggcctcactgcctctctatgggacccatccaagccctggaaag

SEQ ID NO: 45398 - DNA, 201 bp, Homo sapiens
tggtacattccgctttctaaaatgtcagttgtccatgctgctcgggatccatatgtggtaatcattatttaatggaaactcttccctgtacagagaaaggkttcattgaaatcaaacccaccttcagccagttggaagctgtcaacctgcatgaagtcaaacattttgttgtagaggtgcgggcctacccacctcccagga

SEQ ID NO: 45399 - DNA, 201 bp, Homo sapiens
aatagggtcttttcacatccaatgttagacctctccaatgtttaaggatcatgaaggctttgggtattatccacccaatagaaggcctcactgcctctctrtgggacccatccaagccctggaaaggcaacgtgatggggaccagaaggattctcagttgtagctactgacttggagaaggggctactggtatcttagcac

SEQ ID NO: 45400 - DNA, 201 bp, Homo sapiens
atttctgtccatggtacattccgctttctaaaatgtcagttgtccatgctgctcgggatccatatgtggtaatcattatttaatggaaactcttccctgtrcagagaaaggtttcattgaaatcaaacccaccttcagccagttggaagctgtcaacctgcatgaagtcaaacattttgttgtagaggtgcgggcctaccc

SEQ ID NO: 45401 - DNA, 201 bp, Homo sapiens; identical to SEQ ID NO: 12128

SEQ ID NO: 45402 - DNA, 201 bp, Homo sapiens
cgtcttactgtttgaaccttgaattttaacctgggacatgtttgactaaaatgatgctgttaatattttctgttgtgcaaaacacaaagagaactaggctycagggttgtttctatttgctaatgctgtttctgttgacttttgacttttctagtttcccagagctatggggacttcccatccggcgttcctggtcttagg

SEQ ID NO: 45403 - DNA, 201 bp, Homo sapiens; identical to SEQ ID NO: 12129

SEQ ID NO: 45404 - DNA, 201 bp, Homo sapiens
taaagtcaggtgttgcttctagagattcggtgcctgttttttaaaacatcaatagatttcaaggggtcagtacactgccttggcagcagattgcccaggtktgagtgccagctccaccacttacttaatttggatttggggctagatacttgactgttctgcccctctgtctccctgattgtagtgggaggtgataatagt

SEQ ID NO: 45405 - DNA, 201 bp, Homo sapiens
atgagctccagaatagcagttactaattaaggatgagcatttagagtagataaaagtggcaggaacagcaagactcactcccagagagcctcactacaggwctaataggtgaggaaattccccatgtttcccatttttcttcattacctccctgtggggcaagcactgccattattcatgagtaaactgtctgagttatag

SEQ ID NO: 45406 - DNA, 201 bp, Homo sapiens; identical to SEQ ID NO: 12138

SEQ ID NO: 45407 - DNA, 201 bp, Homo sapiens
ttggccctatacttaggccctttttctctctagatgtaataatgaaacttcctggactattttggccaacaatgtctcaaacatcatcacggagatccacycccgagacaggagtaccgtggagggccgtgtgactttcgccaaagtggaggagaccatcgccgtgcgatgcctggctaagaatctccttggagctgagaa

SEQ ID NO: 45408 - DNA, 201 bp, Homo sapiens
gctgaagctggtggctcccagtgagttcctcaacagtcaggacaactcatcagctgagccgcatctgccccaggcggaactttgaatcccagataggggtyatatagaaatgaaggtcccaaggcagaaattcagttacgaatgctcttaaaggcatgtgggactttgttttattttgttttgttttttgagacagagttt

SEQ ID NO: 45409 - DNA, 201 bp, Homo sapiens
aggacaactcatcagctgagccgcatctgccccaggcggaactttgaatcccagataggggtcatatagaaatgaaggtcccaaggcagaaattcagttaygaatgctcttaaaggcatgtgggactttgttttattttgttttgttttttgagacagagttttgctctgtggcccaggctggagtgcaatggcacaatat

SEQ ID NO: 45410 - DNA, 201 bp, Homo sapiens
ctgagccgcatctgccccaggcggaactttgaatcccagataggggtcatatagaaatgaaggtcccaaggcagaaattcagttacgaatgctcttaaagkcatgtgggactttgttttattttgttttgttttttgagacagagttttgctctgtggcccaggctggagtgcaatggcacaatattggctcactgcaacc

SEQ ID NO: 45411 - DNA, 201 bp, Homo sapiens
cccttcttcactttctctattgctcctcctttcatgcttgtacctgcttttccatgccctgtttagcctggcttgggatccagcaggttctccaagggttyctgcaagaaccccggctgggtgcccaggtctgagcctggtatgtgcctcagtatcacaaaggcctcctgtaaatgacacacattgttggaagtttcagaa

SEQ ID NO: 45412 - DNA, 201 bp, Homo sapiens
atggggaccagaaggattctcagttgtagctactgacttggagaaggggctactggtatcttagcacctaatggcagaagctctttaccattggtggcccyttcttcatgttctatgtctctggggatagttgacatgactctccttcaactaagtcccacatcttccaggtagtttggaaatatgtacagttaaataatg

SEQ ID NO: 45413 - DNA, 201 bp, Homo sapiens
cttcttcatgttctatgtctctggggatagttgacatgactctccttcaactaagtcccacatcttccaggtagtttggaaatatgtacagttaaataatrgtaagttctgagtgtctctattcatttttgaggtttggttgttaacacttgattaaatatgttcaatgaatgtttatagagttatgaaaaaattcacctg

SEQ ID NO: 45414 - DNA, 201 bp, Homo sapiens; identical to SEQ ID NO: 12134

SEQ ID NO: 45415 - DNA, 201 bp, Homo sapiens
ataagcctctcctgccattgtcttaaatagtcattgaactggggaaaaagtgaagagaggcgggactgggtcctttgacgctataccctacctgtgaattkgaatcacctgcagagatttaaaaactgctgatctacaagcctcacccaaaacaacaaattagaatccctgggggtggtggccaactgctccctggctgat

SEQ ID NO: 45416 - DNA, 201 bp, Homo sapiens
aaaatctcactgagatcaccactgatgtggaaaagattcaggaaataaggtaaagaaactctctgcccaagtatgcctttttttagtgtgcatcagaggcrgactgaggtttgtgtgtgtcttacaacccagacccaaagtcagtctagaaaatgtaacaatctgagttaagagatgcttgaaatcacatccctttaatga

SEQ ID NO: 45417 - DNA, 201 bp, Homo sapiens
agcaaaatcatggaatcaacctaaatgcccatcaatgatagactggataaagaaaatgtgatacatatacaccatggaatacgatgcagccgtaaaaaggwatgagatcatgtcctttgcagggacatggatggagctggaagccgttaccgtcagcaaactaacacaggaacagaaaaccaaacaccacatgttctcact

SEQ ID NO: 45418 - DNA, 201 bp, Homo sapiens
taaacaataccttatgtccttcaaggcaaggaattggatcagatgatatcatgaggcctcttaaggttttaagctgtgattagaacccaagagtcagaagrtacatctcacagcacccagctaaccagccctatacttttgtcagaaatcatctcagaaagacaaagtcagtcctgtatttcaagccttcaggaggaagaa

SEQ ID NO: 45419 - DNA, 201 bp, Homo sapiens
agcctcctgagtagctgggattacaggcatgtgccaccatgcctggctaatttttttttttttgtatttttagtagagatgggggtttcaccatgtttgtsaggctggtctcgaactcctgacctcaagtgattcacctaccttggcctcccaaagtgctgggattacaggtgtgagtcatcacacccagcctataacttt

SEQ ID NO: 45420 - DNA, 201 bp, Homo sapiens
gatcttggggccccattgattctttcatctttcaggcgtcttactgtttgaaccttgaattttaacctgggacatgtttgactaaaatgatgctgttaatrttttctgttgtgcaaaacacaaagagaactaggctccagggttgtttctatttgctaatgctgtttctgttgacttttgacttttctagtttcccagagc

SEQ ID NO: 45421 - DNA, 201 bp, Homo sapiens
aatcccgtgcttgaaaaataatcaaacaaaaagagaatgcattgtaagaagcctcactgtactcctgtccccagctgcccagttctcccctcctccccacrgggaaacatcttcattagtttcattaggttcttatgaaaccttccagagtttctttaagcaaaatacaagcaagtaggactgtcatatcctgcagaccgc

SEQ ID NO: 45422 - DNA, 201 bp, Homo sapiens
catgatcttggggccccattgattctttcatctttcaggcgtcttactgtttgaaccttgaattttaacctgggacatgtttgactaaaatgatgctgttmatattttctgttgtgcaaaacacaaagagaactaggctccagggttgtttctatttgctaatgctgtttctgttgacttttgacttttctagtttcccag

SEQ ID NO: 45423 - DNA, 201 bp, Homo sapiens
ccgccatgatcttggggccccattgattctttcatctttcaggcgtcttactgtttgaaccttgaattttaacctgggacatgtttgactaaaatgatgckgttaatattttctgttgtgcaaaacacaaagagaactaggctccagggttgtttctatttgctaatgctgtttctgttgacttttgacttttctagtttc

SEQ ID NO: 45424 - DNA, 201 bp, Homo sapiens
cccgcttttgccttttattccgcactctgatttttggggggatcgtttgttcccgctcattttctacaaacattacggtatcctgttagcattccgaacarggggctgttcatatatttgccttcaatgatttcctgaagggacatgtggaagtaatagcgagcggtgcagtcacccaagctgaagatgcacgagagcggg

SEQ ID NO: 45425 - DNA, 201 bp, Homo sapiens
accaacctggagtcctaattaaacttaaggtttgagctggtctctgaagtcaaggagatgatgacactgaattttcttgaaaaaaccagtgcttcaaggcyataggatctgaaaggttttctaacagtgttctatcatgccaagtgtttcagcaatgcactgagcgtttgttagtcctggtgttttattgtttggctttta

SEQ ID NO: 45426 - DNA, 201 bp, Homo sapiens
ttgaccaacctggagtcctaattaaacttaaggtttgagctggtctctgaagtcaaggagatgatgacactgaattttcttgaaaaaaccagtgcttcaasgctataggatctgaaaggttttctaacagtgttctatcatgccaagtgtttcagcaatgcactgagcgtttgttagtcctggtgttttattgtttggctt

SEQ ID NO: 45427 - DNA, 201 bp, Homo sapiens
cccactctgcccaggtctggttcctggagcatcagcgccccctttccctcgccggcaggatcgtttcctcccgacactggcctctcgccttgggcgcaggrtttggggctcagctgtcaattccaaggaattcgtagggttcgacccacgcggcgggagggaacggagggagaatcaaaaggcatcctcccccacgacgcg

SEQ ID NO: 45428 - DNA, 201 bp, Homo sapiens
aggcatatcacatggccagagcaggagcaagtgagagagagagagagagagagagagagagagagagaggtgccatacagttttaaacaggcagatcttgyaagaagtcactcacttttgcaaggatagcaccaaggggatggtgctaaaccatttgtgagaaattcacccccatgatccagtcacctcccaccaggcccc

SEQ ID NO: 45429 - DNA, 201 bp, Homo sapiens
tggtttccatttctgagttacttcacttagaataatagtctctaatcccatccaggttgctgcaaaagccattaattcattcctttttatagctgagttayatatatatatatatatatgcacacctacacatacatatgtatagatacactgcagtttctttatccactccttgattgatgggcatttggggttggttcc

SEQ ID NO: 45430 - DNA, 201 bp, Homo sapiens
aaatcacctttgcaaaaattgtaactgaggaaattatgacagtgaatgagatatgacctaaccaactccattttgctttagcctccaagttgtccttgttccttcctgggcataggccgaactaactttgagaggaacttagtttatagtttgactttgaaaaaaagacaataatagccctttgccaaaacaaaccctctt

SEQ ID NO: 45431 - DNA, 201 bp, Homo sapiens
attagccagtgagagttatcggaaccagtacttcctctcccctcccatattgttaaaaatagtttacattgcttcccaggctgggctggtggagttggcaygagatgtcagaggaacctgagtcatgctcaggcccaagccctgttggcaggcagaccactgctttctggccttccgtgactatctgaaaaaaatcgtgaa

SEQ ID NO: 45432 - DNA, 201 bp, Homo sapiens
ttgcaggggtgatgctatatcagctacagatggcttgatcctgagtcatttcttccttttccatgcagtgtgtccaccgtgatctggctgctcgcaacgtyctcctggcacaaggaaaaattgtgaagatctgtgactttggcctggccagagacatcatgcatgattcgaactatgtgtcgaaaggcagtgtacgtcctc

SEQ ID NO: 45433 - DNA, 201 bp, Homo sapiens
caaaccctctttttgcctgggaactagactgcctttgcgggactaacgaattagctacaagattagaaagtatggtttaggggtcactgttgtaaaacctraggtcagtgcttgagatattttggagaccctgtatttcgatgcaccagctgacaccacccaggtcaataaactggctcatctgatcttggggcccctacc

SEQ ID NO: 45434 - DNA, 201 bp, Homo sapiens
taaactgtctgagttatagataagtaatgacatgaaacttcacaaacacgctgagcacagtggctcacgcctgtaatcccagcactttgggaagccgacgygggtgaatcacgaggtcaggagttcgagatcagcctgaccaacatggtgaaaccctgtctgtactaaaaatacaagaaattagctggccatgatggtggg

SEQ ID NO: 45435 - DNA, 201 bp, Homo sapiens
ccgaattgtgctaagacctcaggatgtgcgcaaggagtgcctggaagaacttgccactcactccatcttcctgggtgggaggcaagcatggatggggcccmtatcaggtccctaccgccccgcgtccgaaaagccgcgggctgggcggtgtgggaaatggctttttggctccgaggccaaattgctcaatgttttggaccg

SEQ ID NO: 45436 - DNA, 201 bp, Homo sapiens
ccagcaggttctccaagggttcctgcaagaaccccggctgggtgcccaggtctgagcctggtatgtgcctcagtatcacaaaggcctcctgtaaatgacayacattgttggaagtttcagaaattctaggtcaaaatggcactgaaatattaaggtatttaccccaacccaagcaacttttctaaaagttgtagagagtgt

SEQ ID NO: 45437 - DNA, 201 bp, Homo sapiens
tgggcaagggtttggggcgctctggagcggtttgttgggtcagtgaggtgccagggagagcgggtgcctgccgggcagtgtgctcgggttgcacgccctakcgcgggggcgacagcggcggcgcgggcgggcggtctggaataatgacaaacacatttggccctgagtgaagaagtcgtcgtcgcctcgcattccagcaac

SEQ ID NO: 45438 - DNA, 201 bp, Homo sapiens
atagaaacttaatatattcataaggaatgtggcccaatatcaggcaaaacaagagttaacagcatggactaaactaataaaagaccaaaacaatcttttartgactttttgcttaaaacattgcatatcctttctgttttgcttttcagagtcaagaaaacttttcctttggaaagtatttactgcttttaacaattgaaa

SEQ ID NO: 45439 - DNA, 201 bp, Homo sapiens
agcctcatataagaagaaatctatgttaggtaaaagtgtctatactcactctgggtgttgggactttccagtggtttaatatgatacttaaagtatttagrgggaagtgtatagggatggtaagtgaacctggcagcccacgtggtctctaaatgcaggtctgcacaaccagttctgtgacatgtttccaggtttgtggcc

SEQ ID NO: 45440 - DNA, 201 bp, Homo sapiens
aagcaggctgatactacacagtatgtccccatgctagaaaggaaagaggtttctaaatattccgacatccagagatcactctatgatcgtccagcctcatrtaagaagaaatctatgttaggtaaaagtgtctatactcactctgggtgttgggactttccagtggtttaatatgatacttaaagtatttagagggaagtg

SEQ ID NO: 45441 - DNA, 201 bp, Homo sapiens
gtcctccgcagtgcatctcaccggacaaacatccccggagccacaggaggggaggaaggggctctccgggcgtgcgcacctccccagccgccgcgctgtcycatccccgacccctaatctggtcaacctggaccccggcactgctgaattgcatcccctcttctccctttctcctcggcctcctcctttccacaaccctca

SEQ ID NO: 45442 - DNA, 201 bp, Homo sapiens
gtaagatttctctttctgtttttacagctatgttattttatcttttgaaaacaatggtgactacatggacatgaagcaggctgatactacacagtatgtcyccatgctagaaaggaaagaggtttctaaatattccgacatccagagatcactctatgatcgtccagcctcatataagaagaaatctatgttaggtaaaag

SEQ ID NO: 45443 - DNA, 201 bp, Homo sapiens
gcatcccctcttctccctttctcctcggcctcctcctttccacaaccctcaagatgaggaggccctgcctcgactccccgacaggcgcaaggccgaccagsctcgctttgacgccctggtcaggccctgcttcggagcttgcagttttgggttgacccaagtgcagctggacctcgttcacaagagtgaggggaagccaag

SEQ ID NO: 45444 - DNA, 201 bp, Homo sapiens
gcaaatgaaagtagaggtagaggttgtgttatgatgaatgatctaacagtatatatgttaaagaatgccaaatgcaggttttaattatccaccggtctcaytgcaaaatacagaagagtttaagtcttcttagagagttaggtaaactgaaatcaagcaaggcaccagagtgaaatcacctttgcaaaaattgtaactgag

SEQ ID NO: 45445 - DNA, 201 bp, Homo sapiens
tgtacacccacaggctaacaccacatggaagcggccaaggtttatggctgtcacaagctgaagcagcagcccaagctgcacctgaactcctttgagccacrgctggagctggagtcatagggatgcagggagcagtgtctcgaggctgcacagggcagtggaccctggggctggcccatgagaccattcttccctcctagg

SEQ ID NO: 45446 - DNA, 201 bp, Homo sapiens
caccacatgttctcactcataggtgggagctgaacaacaagaacacatgaacacaggcgggggggaacatcacacatcagagcctgtcagggggtgggggsccgggggagagatagcattaggagaaacacctaatgtaaatgacgagttgatgggtgcagcaaaccaacatggcacatgtatacctatgtaacaaacccg

SEQ ID NO: 45447 - DNA, 201 bp, Homo sapiens
caaaatggcactgaaatattaaggtatttaccccaacccaagcaacttttctaaaagttgtagagagtgtgacctctttattaattgaaacgtgaaaatcrgctctagtttggaagctgagaaaaaatatatatatatgtatttatttctttgttgtttgaattcttaatataaatggtttaaaggaccattgaaaactgc

SEQ ID NO: 45448 - DNA, 201 bp, Homo sapiens
ggtttaaaggaccattgaaaactgcatgcaatcacagaaggttttggcttcaggcagctcccgccatgatcttggggccccattgattctttcatctttcrggcgtcttactgtttgaaccttgaattttaacctgggacatgtttgactaaaatgatgctgttaatattttctgttgtgcaaaacacaaagagaactagg

SEQ ID NO: 45449 - DNA, 201 bp, Homo sapiens
aagtccaagcatgttgtagatgacctatgtaagtcacgataaagtttatacaagagaatttattaaaatttagatgtaattagccataactgaaaggaaawttatttatttatttatttatttatttatttatttatttatgatttattttgagaaggagttttgctcttgttgcccaggctggagtgcaatgtcatgatc

SEQ ID NO: 45450 - DNA, 201 bp, Homo sapiens
gcaatggcaacaaaagccaaaattgacaaatgggatctaattaaactaaagagcttctgcacagtgaaagaaactaccatcagagtgaataggcaacctamaaaatgggagaaaatttttgcaacctactcatctgacaaagggctaatatccagactctacaatgaactttaacaaatttacaggaaaaaaacaaacaac

SEQ ID NO: 45451 - DNA, 201 bp, Homo sapiens
ttacaatttataggccttggcagaatagagatctgagcttgtgcttagtaagaactaggcaatggaaatttgctttcagaaatacatttctgtcttgacartaagttaattggatcattgcaatgatttttttaaatctctttccataacaaattatagttaaggaaaattttacaaagggagaagagaatatgaagaggg

SEQ ID NO: 45452 - DNA, 201 bp, Homo sapiens
actcataggtgggaattgaacaatgagaacaacacggacacaggaaggggaacatcacactctggggactgttgtggggtgggggtagtggggagggatasctttaggagatatacctcgtgctaaatgacgagttaatgggtgcagcacaccagcatggcacatgtatacatatgtaactaacctgcacattgtgcgcat

SEQ ID NO: 45453 - DNA, 201 bp, Homo sapiens
acaatgagaacaacacggacacaggaaggggaacatcacactctggggactgttgtggggtgggggtagtggggagggatacctttaggagatatacctcrtgctaaatgacgagttaatgggtgcagcacaccagcatggcacatgtatacatatgtaactaacctgcacattgtgcgcatgtaccctaaaacttaaagt

SEQ ID NO: 45454 - DNA, 201 bp, Homo sapiens
acggagcccagtcctctctgagttccttgtttgggtgtcttgtttttttaagctttgtgctgcatgggtttattaccagtactctgcatacacagtccaaragagtgaaaagaaatagaaaactataggacgttatccagaatgaccacaaaccttcagttccctttgctgtattgcacttactccatttcaaaaggaatg

SEQ ID NO: 45455 - DNA, 201 bp, Homo sapiens
tatcttccaaataaacactcgatttttcagattcactatcaacatacatttattcttggagagttggaaggaattttctttttccttttaaaaaagttacatatatatatatatatatatatatatatatatttttttttttttggtaacagggtctcactctgttgcccaggctggaatgcagtggcatgatcatcatag

SEQ ID NO: 45456 - DNA, 201 bp, Homo sapiens
atcttccaaataaacactcgatttttcagattcactatcaacatacatttattcttggagagttggaaggaattttctttttccttttaaaaaagttacatatatatatatatatatatatatatatatatttttttttttttggtaacagggtctcactctgttgcccaggctggaatgcagtggcatgatcatcatagc

SEQ ID NO: 45457 - DNA, 201 bp, Homo sapiens
tggtctcgaactcctgacctcaagtgattcacctaccttggcctcccaaagtgctgggattacaggtgtgagtcatcacacccagcctataactttttttwaataggtgatagaatcccgtgcttgaaaaataatcaaacaaaaagagaatgcattgtaagaagcctcactgtactcctgtccccagctgcccagttctcc

SEQ ID NO: 45458 - DNA, 201 bp, Homo sapiens
ttggtttccatttctgagttacttcacttagaataatagtctctaatcccatccaggttgctgcaaaagccattaattcattcctttttatagctgagttwtatatatatatatatatatgcacacctacacatacatatgtatagatacactgcagtttctttatccactccttgattgatgggcatttggggttggttc

SEQ ID NO: 45459 - DNA, 201 bp, Homo sapiens
tacagtccaacaaatgtacatcttccctgaaatatgaagtgatttggttcttctgttcatacttgattgactttaatccttaacacataaacactgctttytatttataggagacagcaatttttttttccaaaccgaagtacatgctatttggcttacaaatatataatcaaagtattgtttcatacagtatgttttttc

SEQ ID NO: 45460 - DNA, 201 bp, Homo sapiens
aggtttgagctggtctctgaagtcaaggagatgatgacactgaattttcttgaaaaaaccagtgcttcaaggctataggatctgaaaggttttctaacagygttctatcatgccaagtgtttcagcaatgcactgagcgtttgttagtcctggtgttttattgtttggcttttaggtggcaccccttaccccggcatgatg

SEQ ID NO: 45461 - DNA, 201 bp, Homo sapiens
ctatcaagttgcccgaggaatggagtttttggcttcaaaaaatgtaagttcaaggaacacagacctttttagacccagatttcagtgagtggagtgtggamggagatgctaggagatagatgttggaaaggccattaataacaggggcctcttacttacctgtctctctccttcatcccctacgcaggtcagggagtctga

SEQ ID NO: 45462 - DNA, 201 bp, Homo sapiens
cctacgacagcagacagggctttaatgggaccttcactgtagggccctatatctgtgaggccaccgtcaaaggaaagaagttccagaccatcccatttaaygtttatgctttaaaaggtacttgtatcatctccttccttctttaaataagagtaacaggcaaaatcataaggtgcgtgtaggatttttttttttttttaa

SEQ ID NO: 45463 - DNA, 201 bp, Homo sapiens
gaagttccagaccatcccatttaatgtttatgctttaaaaggtacttgtatcatctccttccttctttaaataagagtaacaggcaaaatcataaggtgcrtgtaggatttttttttttttttaaatcatcatcactggtgatcctaaattctgatttggggatttaggaccccagctaatacaatgtctgtggctataat

SEQ ID NO: 45464 - DNA, 201 bp, Homo sapiens
tcactatcaacatacatttattcttggagagttggaaggaattttctttttccttttaaaaaagttacatatatatatatatatatatatatatatatatwtttttttttttggtaacagggtctcactctgttgcccaggctggaatgcagtggcatgatcatcatagcttactgcaatctcaactcccttggttcaagc

SEQ ID NO: 45465 - DNA, 201 bp, Homo sapiens
tttttaacaatgaggtggttgaccttcaatggacttaccctggagaagtggtaggtaccctcaaaacgtgcaatggcttggagcagagcaacagggctcaraagacctgcatttgagctcggtctgtcactgatgggcacatcactgagtttctctagaccttagcttcccacctctgggatgaacacatttgattaaatg

SEQ ID NO: 45466 - DNA, 201 bp, Homo sapiens; identical to SEQ ID NO: 12133

SEQ ID NO: 45467 - DNA, 201 bp, Homo sapiens
catgaatatatttatgtggacccgatgcagctgccttatgactcaagatgggagtttccaagagatggactagtgcttggtaagttccatggggtaacctyccaagactcccttttcccttgcacacaactttacaatttataggccttggcagaatagagatctgagcttgtgcttagtaagaactaggcaatggaaatt

SEQ ID NO: 45468 - DNA, 201 bp, Homo sapiens
catatggaaaacagaaggggagagagccaggaggtgtgggtgagagccccgaaggcaagaggatcccaggggctggcccagcacggagctggtagacagcrcgctcacaccagggagggctgcaccctcctttctcccgtctgtgttttctttcccttgcaagtgttattcgacaaaagcaattatgctaatttccttccc

SEQ ID NO: 45469 - DNA, 201 bp, Homo sapiens
ccatgatccagtcacctcccaccaggccccacctccaatactggggattacacttcaacatgagatttgggtggggacacatatccaaactatatcattgygtgtgtgtgtgtgtgtgtataatttttaaaccagatatatgtttctgcatatctctttcctttctttcattctttctttctttttttttttttttttttt

SEQ ID NO: 45470 - DNA, 201 bp, Homo sapiens
attagtagagatagggttttaccatgttggccagactggtctcaaacttctgacctcaggcaatccacccacctcggcctcccaaagtgctgggattataggcataagccaccatgcctggcctatatatctattttctaagatagaatctttgcatagtgatattcatctgtgagatctaaacattctacaaaaaaatta

SEQ ID NO: 45471 - DNA, 201 bp, Homo sapiens
aggcctgggggcagaatcttgccatactgtgcagcccaaatttgaatgccaaaggctttcgtttgtctctggggggccacagtctaggtctagttctgtgyaggagttgtaatatttgctcttctctccctcctccagctcgcagacctctgaagagagtgccattgagacgggttccagcagttccaccttcatcaagag

SEQ ID NO: 45472 - DNA, 201 bp, Homo sapiens
tgggtggagtgagaacctgggagaaggccagccctttatatccaggcagacagctccaagtgccaccatggatcagccagtcttgcaggggtgatgctatatcagctacagatggcttgatcctgagtcatttcttccttttccatgcagtgtgtccaccgtgatctggctgctcgcaacgtcctcctggcacaaggaaaa

SEQ ID NO: 45473 - DNA, 201 bp, Homo sapiens
gctatggggattaaatcaatgaattcatgtaaagtgcttaggacagtgcctggcatatagaaacagcactcaataatgttagctattttatttatttattwatttatttatttatttatttatttattttctttttttttgagacagagtctcactctgtcacccaggctggagtgcagtggcgcaatcttggctcactgc

SEQ ID NO: 45474 - DNA, 201 bp, Homo sapiens
ctatggggattaaatcaatgaattcatgtaaagtgcttaggacagtgcctggcatatagaaacagcactcaataatgttagctattttatttatttatttatttatttatttatttatttatttattttctttttttttgagacagagtctcactctgtcacccaggctggagtgcagtggcgcaatcttggctcactgca

SEQ ID NO: 45475 - DNA, 201 bp, Homo sapiens
ctattttatttatttatttatttatttatttatttatttatttattttctttttttttgagacagagtctcactctgtcacccaggctggagtgcagtggygcaatcttggctcactgcaaacttctgcctcccaggttgaagcaattctcctgccttagcctcccgagtaggtgggattacaggcatgcaccaccatgtt

SEQ ID NO: 45476 - DNA, 201 bp, Homo sapiens
ccaggttgaagcaattctcctgccttagcctcccgagtaggtgggattacaggcatgcaccaccatgttcagctaatttttgtatttttagtagagacagsgtttcaccatgttgcccagactggtctcgaactcctggcctcaagtgatctacctgcctcagcctcccaaagtgctgggatgacaggtgtgagccactgc

SEQ ID NO: 45477 - DNA, 201 bp, Homo sapiens
atcaggcagccagttaaagttcaaattatctcacaaatattatcatactccattaaaaagtgggcagaggacataagcagacacttttcaaaagaagacakacctgcagccaacaagcatatgaaaaaatgctcaacatcactgatcactagagaaatgcaaatcagaaccgtgatgagataccatctcacaccagacaga

SEQ ID NO: 45478 - DNA, 201 bp, Homo sapiens
aattatctcacaaatattatcatactccattaaaaagtgggcagaggacataagcagacacttttcaaaagaagacatacctgcagccaacaagcatatgaaaaaatgctcaacatcactgatcactagagaaatgcaaatcagaaccgtgatgagataccatctcacaccagacagaatggttattattaaaaagtcaaa

SEQ ID NO: 45479 - DNA, 201 bp, Homo sapiens
ctgcctcccaggttcaagcgattctcctgcctcagcctcccgagtaactgggattacaggtgcccgccaccacgccaggctaatttttgtatttttagtasagacggggtttcaccatattggccatgctggtctcgaactcctgacctcaggtgatccgcccacctcggcctcccaaagtgctgggatttacaggcgtaa

SEQ ID NO: 45480 - DNA, 201 bp, Homo sapiens
cgattctcctgcctcagcctcccgagtaactgggattacaggtgcccgccaccacgccaggctaatttttgtatttttagtagagacggggtttcaccatrttggccatgctggtctcgaactcctgacctcaggtgatccgcccacctcggcctcccaaagtgctgggatttacaggcgtaagccaccgcgcccggccag

SEQ ID NO: 45481 - DNA, 201 bp, Homo sapiens
tgaattcttcaaactttaagtgtaatggacttacaggtccatgggagcacagccccactgtcttagatgtggctcttcaggatgtgcgggctcctgctaargatgtgcagggaactggctctgaaaacaagtgaacagtagtcatcatggcagctgacatttgtggagtcctttgtatgtgccaggtgccatgacaaatat

SEQ ID NO: 45482 - DNA, 201 bp, Homo sapiens
ggggtttcaccatattggccatgctggtctcgaactcctgacctcaggtgatccgcccacctcggcctcccaaagtgctgggatttacaggcgtaagccamcgcgcccggccaggaacggttcttaaatgccgagagggcgcatgctagctctcctcagcattcccggtgagccgctacccacggccgtgcggctctcgtg

SEQ ID NO: 45483 - DNA, 201 bp, Homo sapiens
ttaaatgccgagagggcgcatgctagctctcctcagcattcccggtgagccgctacccacggccgtgcggctctcgtgcccataggaggcgctggcgagckcctgtaaccctaaacccctcggcccctttccccccacccgcccggattctcttcccgctctcccccctctctccacacccgcccggccccctctcgggtc

SEQ ID NO: 45484 - DNA, 201 bp, Homo sapiens
gatgctaggagatagatgttggaaaggccattaataacaggggcctcttacttacctgtctctctccttcatcccctacgcaggtcagggagtctgaaatyatcaggcatctactcttctctagagctttctctctgttgggagtgggtggagtgagaacctgggagaaggccagccctttatatccaggcagacagctcc

SEQ ID NO: 45485 - DNA, 201 bp, Homo sapiens
atttagatgtaattagccataactgaaaggaaatttatttatttatttatttatttatttatttatttatttatgatttattttgagaaggagttttgctsttgttgcccaggctggagtgcaatgtcatgatcttggttcactgcagcctccgcatcctgggttcaggcatttctcctgtctcagcctcctgagtagcta

SEQ ID NO: 45486 - DNA, 201 bp, Homo sapiens
ttaacaatgaggtggttgaccttcaatggacttaccctggagaagtggtaggtaccctcaaaacgtgcaatggcttggagcagagcaacagggctcagaaracctgcatttgagctcggtctgtcactgatgggcacatcactgagtttctctagaccttagcttcccacctctgggatgaacacatttgattaaatggcc

SEQ ID NO: 45487 - DNA, 201 bp, Homo sapiens
tcctggtcttaggctgtcttctcacaggtacggagcccagtcctctctgagttccttgtttgggtgtcttgtttttttaagctttgtgctgcatgggtttwttaccagtactctgcatacacagtccaaaagagtgaaaagaaatagaaaactataggacgttatccagaatgaccacaaaccttcagttccctttgctgt

SEQ ID NO: 45488 - DNA, 201 bp, Homo sapiens
tttgtgcgactatttgattaatgctcatttccttgactagatcacctcatgtgaaaggtatggattggttttgcttttacccagttagctcccatgcctayctcagtacctggcacattgtaggtcccccagaatcatcatctactgaaagtggaatgaccacttcagaagggcaccctgggtaagatttctctttctgtt

SEQ ID NO: 45489 - DNA, 201 bp, Homo sapiens
cgagggctataagaaatggaagatgtggaattcttgagcacagatgtgctttgtgttttcttcagtctgtgtccttgcctccattcttattccatgtgggktttttttttttttttttttttttttttgagacagggtctctcgctctattgcccaggttggagtgcagaggctgactgcaacctcaatcccctgggctcc

SEQ ID NO: 45490 - DNA, 201 bp, Homo sapiens
aagtgtctatactcactctgggtgttgggactttccagtggtttaatatgatacttaaagtatttagagggaagtgtatagggatggtaagtgaacctggmagcccacgtggtctctaaatgcaggtctgcacaaccagttctgtgacatgtttccaggtttgtggcctgtaaattgaaaagaataaaagctgacaatgta

SEQ ID NO: 45491 - DNA, 201 bp, Homo sapiens
gaattgatggaagctcattggtttttgagcaaaatctgttgccagtccagtcatagccattcatggctctttattaaaaaaaaaaaaaaaaaaaaaaaaavcttttttggtatcttatttttttctgcgccatatggtctgcaggacaattcatggcttttctgttcttcattttcatacccatctcctaacggcttttgt

SEQ ID NO: 45492 - DNA, 201 bp, Homo sapiens
aattgaaaagaataaaagctgacaatgtaacaaattttttaaactttaaatttaatagttttaaagaattttcttggtgtgttcctgcagtaaacattttwaaaaaaaaataattatttattctgatataatgaacttccttttttattgctgtctttttcttttttaatgaaaatatggtgattgattttttttaatgcc

SEQ ID NO: 45493 - DNA, 201 bp, Homo sapiens; identical to SEQ ID NO: 12142

SEQ ID NO: 45494 - DNA, 201 bp, Homo sapiens
ttcaagacatgagtatcatgattttttaaggtctggatgaagagaccatttggatttactaataaggtaaattccaacttttatggcaataaaaacaacaraaacacttatcagtgtaaagctttgggatcatctatccattaaatgagtttgtcaccacagtgaactaaataccttttatcaacagagactttctaacct

SEQ ID NO: 45495 - DNA, 201 bp, Homo sapiens
ttattgttaatttaaaaaaactctaagttaggattgacaaattatttctctttagtcatttgcttgtatcaccaaagaagcaaacaaacaaacaaacaaamaaagaaaaagatcttggggatggaaatgttataaagaatcttttttacactagcaatgtctagctgaaggcagatgccctaattccttaatgcagatgct

SEQ ID NO: 45496 - DNA, 201 bp, Homo sapiens; identical to SEQ ID NO: 12145

SEQ ID NO: 45497 - DNA, 201 bp, Homo sapiens
aaatgtgctgggattttgcaaactatagtgtgctgttattgttaatttaaaaaaactctaagttaggattgacaaattatttctctttagtcatttgcttstatcaccaaagaagcaaacaaacaaacaaacaaaaaaagaaaaagatcttggggatggaaatgttataaagaatcttttttacactagcaatgtctagct

SEQ ID NO: 45498 - DNA, 201 bp, Homo sapiens
acttttcagccaggatgtaacattggagaagctatccgcgtgattgcagagagaggacttggaggtaaatattatttagaagcgaattaaatgtgactctyatccttaacccttattgacccaatgtcctactcagtagcttcaaagtatgtagttttcatatacacatttggccaaattatgtttctgaagaattctgca

SEQ ID NO: 45499 - DNA, 201 bp, Homo sapiens; identical to SEQ ID NO: 12146

SEQ ID NO: 45500 - DNA, 201 bp, Homo sapiens
ggaatctcagcttctcatttggcactgtttcttgtaagtacaaaatagttagggaacaaacctccgagatgctacctggataatcaaagattcaaaccaasctcttcaagaagggtgagattccaagataatctcaacctgtctccgcagccccacccatgtgtacccataaaatgaattacacagagatcgctataggat

SEQ ID NO: 45501 - DNA, 201 bp, Homo sapiens
aggtacttttcagccaggatgtaacattggagaagctatccgcgtgattgcagagagaggacttggaggtaaatattatttagaagcgaattaaatgtgastcttatccttaacccttattgacccaatgtcctactcagtagcttcaaagtatgtagttttcatatacacatttggccaaattatgtttctgaagaattc

SEQ ID NO: 45502 - DNA, 201 bp, Homo sapiens
gggcatgatcctgtgaccggaagcccgcttacagtcagggtggaggacagacctactcatgaaacaaacacagtgacatatagtgacacagaagcaaatgycaaatatgcttgctccagatgctaaggcacaagatggccaaggatggcggagttcatggagaaagcatcatgagtgttttggccttctgatttgatctcc

SEQ ID NO: 45503 - DNA, 201 bp, Homo sapiens
gattatctcattgtagggctctttattagggataagaaaaaacacagacgctctcactggcttactatccactggcaatagcacagaaataaagcataatyacacacaatgcctgcagatttctctgggaagcctgtttcctcccactctcagctctgtgttttagtagtgtaaatgcacatcagtactaggagaaaagaa

SEQ ID NO: 45504 - DNA, 201 bp, Homo sapiens
gttctttagtagtgatttgtgagattttggtgtgcccattacggaatggaaaaatcaacgaaataagttctatgatgcacctactagacacctactctgcrctagatggtgggggaattaagagcatgggcatgatcctgtgaccggaagcccgcttacagtcagggtggaggacagacctactcatgaaacaaacacagt

SEQ ID NO: 45505 - DNA, 201 bp, Homo sapiens
ccaataagaaagtcaacagaattactggtaagaaagcaatttcgttggtcttatcataagaggtgaaaagactgtcattctgagagagaatcagaacaaaytttgttaaatacccacatgtgtggtgttcttcccggagacatgaccagcacttgattatctcattgtagggctctttattagggataagaaaaaacacag

SEQ ID NO: 45506 - DNA, 201 bp, Homo sapiens
ctatatttggaaaacaatatttatattcattttgtttcttttagttttatttttggcagaactgtaagcaccttcattttctttttcttccaaaggaggartttaactaccctctggacaatgtccatctcttgggatacagccttggagcccatgctgctggcattgcaggaagtctgaccaataagaaagtcaacagaa

SEQ ID NO: 45507 - DNA, 201 bp, Homo sapiens
aaattaaaataagtagaattagttttcagtatttcctatatttggaaaacaatatttatattcattttgtttcttttagttttatttttggcagaactgtmagcaccttcattttctttttcttccaaaggaggagtttaactaccctctggacaatgtccatctcttgggatacagccttggagcccatgctgctggcat

SEQ ID NO: 45508 - DNA, 201 bp, Homo sapiens
ggcatacacacagagagaaagaacccaccactgtttatacatcttctcgacatattcagaaataatctacaaaaggaaatccagccatcctgagtggaaaytgctgcataaggctagtttaagagactcaaattcattttagaaggagccaagcctccttttatgtctctctaagtaaagataccatgactgtagaatagg

SEQ ID NO: 45509 - DNA, 201 bp, Homo sapiens
gagtaagttctttagtagtgatttgtgagattttggtgtgcccattacggaatggaaaaatcaacgaaataagttctatgatgcacctactagacacctamtctgcgctagatggtgggggaattaagagcatgggcatgatcctgtgaccggaagcccgcttacagtcagggtggaggacagacctactcatgaaacaaa

SEQ ID NO: 45510 - DNA, 201 bp, Homo sapiens
attgttgcagcggttctttctacaactcaagcagagccctttctcaaaggcttccttggaactgcacctgtaggccttacttggattttcttcattcaackgagagtcgatgaagagatgaatggagcgctcgtgggagcacttcactagctggtccacatctgggtaaaaaagagacaccaagattgtatctcggcagaa

SEQ ID NO: 45511 - DNA, 201 bp, Homo sapiens
cacaaaattaaaataagtagaattagttttcagtatttcctatatttggaaaacaatatttatattcattttgtttcttttagttttatttttggcagaamtgtaagcaccttcattttctttttcttccaaaggaggagtttaactaccctctggacaatgtccatctcttgggatacagccttggagcccatgctgctg

SEQ ID NO: 45512 - DNA, 201 bp, Homo sapiens
tcataaaatgctatctggccacatgttgtcataccttgaatgtagctgcaaagccaatggaaagattttagatgttactggaacagaagatgttaattagsataaatcttccaaaatgttcagaacataatgttagcttaatgttttactttaataatgttagcttgtgttaaatttatgatttttgtttgtttgtttttt

SEQ ID NO: 45513 - DNA, 201 bp, Homo sapiens
aagactcgttctcagatgccctacaaaggtaggctggagactgttgtaaataaggaaaccaaggagtcctatttcatcatgctcactgcatcacatgtackgattctgtccattggaacagagatgatgactggtgttactaaaccctgagccctggtgtttctgttgatagggggttgcattgatccatttgtctgaggc

SEQ ID NO: 45514 - DNA, 201 bp, Homo sapiens
tctcagatgccctacaaaggtaggctggagactgttgtaaataaggaaaccaaggagtcctatttcatcatgctcactgcatcacatgtactgattctgtmcattggaacagagatgatgactggtgttactaaaccctgagccctggtgtttctgttgatagggggttgcattgatccatttgtctgaggcttctaattc

SEQ ID NO: 45515 - DNA, 201 bp, Homo sapiens
ctgactttattgatctcatagcccagattgttgcagcggttctttctacaactcaagcagagccctttctcaaaggcttccttggaactgcacctgtaggrcttacttggattttcttcattcaacagagagtcgatgaagagatgaatggagcgctcgtgggagcacttcactagctggtccacatctgggtaaaaaaga

SEQ ID NO: 45516 - DNA, 201 bp, Homo sapiens
atagaggttgaggcacctgtgcttcaaggaaaccttaactcttcaaaatcaggcaatgcgtatgaggtaaagagaggactgtgggaccataatcttgaagwcacagacaggcttcactcatccctgcctcctgcaccagtgggttcaaggctctgtcagtgtcccctaggggcacctcaccactcccagcttcttcagctc

SEQ ID NO: 45517 - DNA, 201 bp, Homo sapiens
cttggtttccttatttacaacagtctccagcctacctttgtagggcatctgagaacgagtcttcaggtacattttgctgcttcttttggctctgactttartgatctcatagcccagattgttgcagcggttctttctacaactcaagcagagccctttctcaaaggcttccttggaactgcacctgtaggccttacttgg

SEQ ID NO: 45518 - DNA, 201 bp, Homo sapiens
tcataaatgcacaggactatatccttgggtgattctactctaacaccacatctcacctattttagacatgccaaatgaaacactctttgtgaatttctgcygagatacaatcttggtgtctcttttttacccagatgtggaccagctagtgaagtgctcccacgagcgctccattcatctcttcatcgactctctgttgaa

SEQ ID NO: 45519 - DNA, 201 bp, Homo sapiens
gccctgctcgtgctgactctggccgtgtggctccagagtctgaccgcctcccgcggaggggtggccgccgccgaccgtaagttttgcgcgcaaactccccwccacctgcagacccggcgggtggccactgccacccgaactgaggatgagaagaaggaagttggaaggggcggtggatgcgcccagggactctcccagcct

SEQ ID NO: 45520 - DNA, 201 bp, Homo sapiens
cctgaaatagggcctacaatcataaatgcacaggactatatccttgggtgattctactctaacaccacatctcacctattttagacatgccaaatgaaacrctctttgtgaatttctgccgagatacaatcttggtgtctcttttttacccagatgtggaccagctagtgaagtgctcccacgagcgctccattcatctct

SEQ ID NO: 45521 - DNA, 201 bp, Homo sapiens
tgaaatcacaaacgtacacacacataccctgactaaggagagcttcaagaaaggctggaagacttaggagaggtcaatggtgacaatcttaattcagagtkaaggttgtctctctgtcaactttgctcaacgttggagcatctgttgttctcttgcaatccacattcgttttcgaaaacacttcagaaacaaaaatagcat

SEQ ID NO: 45522 - DNA, 201 bp, Homo sapiens
caatcttagctcactgcaacctctgctttccggttcaagcgattctcctgcctcagcctcctgagtaactgggattacaggcacccgccaccacgcccaamtaatttctgtatttttcttagtagaaacagggtttcaccatgttggccaagctagtctcaaactcctgacctcaggtgattcacccaccaaggcctccca

SEQ ID NO: 45523 - DNA, 201 bp, Homo sapiens
gtgggtgggccgctaccaccaagaatatctcctgaaatagggcctacaatcataaatgcacaggactatatccttgggtgattctactctaacaccacatstcacctattttagacatgccaaatgaaacactctttgtgaatttctgccgagatacaatcttggtgtctcttttttacccagatgtggaccagctagtga

SEQ ID NO: 45524 - DNA, 201 bp, Homo sapiens
ttgcagagagaggacttggaggtaaatattatttagaagcgaattaaatgtgactcttatccttaacccttattgacccaatgtcctactcagtagcttcraagtatgtagttttcatatacacatttggccaaattatgtttctgaagaattctgcaatgttcagcatgaccaccttagagccaggcagacagccatttt

SEQ ID NO: 45525 - DNA, 201 bp, Homo sapiens
ttattacagcttcataaacatactcataaatataagaagcacaaaagtcaaaaattccctgtgaacttgcaactttcactctcttgaaggtgggtgggccrctaccaccaagaatatctcctgaaatagggcctacaatcataaatgcacaggactatatccttgggtgattctactctaacaccacatctcacctatttt

SEQ ID NO: 45526 - DNA, 201 bp, Homo sapiens
taggggcagaaccctcaattgtacataatatcaatgataaaatacaattcatttaacaattaccctcttaagatgtggtttctagaaatacaaattgtccytaacttacagttttccaactttacaattgggctgtaacaccattttaagttgagaagcacgtgatggtttgacttaaaactttttgacattatgatgggt

SEQ ID NO: 45527 - DNA, 201 bp, Homo sapiens
atactttatagacattgggacctacctaggatattctcgttatttttgtgcacgtaatagaacttagagcatattgttactattttcgattgtcctaaaawcttacaaggaattcattcttatggcattgctgattatttctatgttcatttgatataaaagagtgttagtaggggcagaaccctcaattgtacataatat

SEQ ID NO: 45528 - DNA, 201 bp, Homo sapiens
agggtgatcttctgttctagggagaaagtgtctcatttgcagaaaggaaaggcacctgcggtatttgtgaaatgccatgacaagtctctgaataagaagtsaggctggtgagcattctgggctaaagctgactgggcatcctgagcttgcaccctaagggaggcagcttcatgcattcctcttcaccccatcaccagcagc

SEQ ID NO: 45529 - DNA, 201 bp, Homo sapiens
gaagtctttccaagccacaccagtggttccatgtgtgtgcacttccggtttgagtgctagtgagatacttctgtggttctgaattgcctgactatttgggrttgtgatattttcataaagattgatcaacatgttcgaatttcctccccaacagtcttccattaccaagtaaagattcatttttctgggactgagagtgaa

SEQ ID NO: 45530 - DNA, 201 bp, Homo sapiens
tccacctcctgggttcaagcaattctcctgcctcagcctcccaagtagctgggattacacgtgtccgccaccacacctggctaatttcgtatttttagtaragaaagggtttcaccatgttggtcaggctggtcttgaactcctaacctcaggttatccacctgcctcggcctcccaaagtgctgggattataggtgtgag

SEQ ID NO: 45531 - DNA, 201 bp, Homo sapiens
cagcttctcatttggcactgtttcttgtaagtacaaaatagttagggaacaaacctccgagatgctacctggataatcaaagattcaaaccaacctcttcmagaagggtgagattccaagataatctcaacctgtctccgcagccccacccatgtgtacccataaaatgaattacacagagatcgctataggatttaaagc

SEQ ID NO: 45532 - DNA, 201 bp, Homo sapiens
agaagggtgagattccaagataatctcaacctgtctccgcagccccacccatgtgtacccataaaatgaattacacagagatcgctataggatttaaagcktttatactaaatgtgctgggattttgcaaactatagtgtgctgttattgttaatttaaaaaaactctaagttaggattgacaaattatttctctttagtc

SEQ ID NO: 45533 - DNA, 201 bp, Homo sapiens
gctgttattgttaatttaaaaaaactctaagttaggattgacaaattatttctctttagtcatttgcttgtatcaccaaagaagcaaacaaacaaacaaamaaaaaaagaaaaagatcttggggatggaaatgttataaagaatcttttttacactagcaatgtctagctgaaggcagatgccctaattccttaatgcaga

SEQ ID NO: 45534 - DNA, 201 bp, Homo sapiens
ttacacagaggtagatattggagaactactcatgttgaagctcaaatggaagagtgattcatactttagctggtcagactggtggagcagtcccggcttcrccattcagaagatcagagtaaaagcaggagagactcagaaaaagtaattaaatgtatttttcttccttcactttagacccccacctgatgtcaggaccta

SEQ ID NO: 45535 - DNA, 201 bp, Homo sapiens
atcttttatcatctcttggtgaaagcccagtaacataagactgctctaggctgtctgcatgcctgtctatctaaattaactagcttggttgctgaacaccrggttaggctctcaaattaccctctgattctgatgtggcctgagtgtgacagttaattattgggaatatcaaaacaattacccagcatgatcatgtagtat

SEQ ID NO: 45536 - DNA, 201 bp, Homo sapiens
accgggttaggctctcaaattaccctctgattctgatgtggcctgagtgtgacagttaattattgggaatatcaaaacaattacccagcatgatcatgtaktatttaaacagtcctgacagaactgtacctttgtgaacagtgcttttgattgttctacatggcatattcacatccattttcttccacagggtgatcttct

SEQ ID NO: 45537 - DNA, 201 bp, Homo sapiens
actgcatcacctgcagccacatagttcttgattctccaagtgccagcatactccgggacacacagccaacagggctgccccaagcacccatctcaaaaccytcaaagctgccaagcaaacagaatgagagttataggaaactgttctctcttctatctccaaacaactctgtgcctctttcctacctgacctttagggcta

SEQ ID NO: 45538 - DNA, 201 bp, Homo sapiens
ggagaggagaaaaaaaagtggggggcagggagagctgatctctataactaaccaaatttattgcttttttgtttaggcctgaagtttccacaaataagacmtactccttcctaatttacacagaggtagatattggagaactactcatgttgaagctcaaatggaagagtgattcatactttagctggtcagactggtgga

SEQ ID NO: 45539 - DNA, 201 bp, Homo sapiens
aactgttctctcttctatctccaaacaactctgtgcctctttcctacctgacctttagggctaatccatgtggcagctgttagctgcatctttccagagcrtcagtactgagaggacactaagcatgtgaccttcactactcctgttctgaattccaggaatatgcccttttcaaccctccacacatcccctgccagacag

SEQ ID NO: 45540 - DNA, 201 bp, Homo sapiens
ttctaggaaacccaggaaaacatagtaaaaaatggaatataaaatctaaagagaataaagaatagagaatcgtatgtgtgctatgattgtagctaaataaygttcaagtatcaacacaaattgaaaaggaatacatgaaaatgaaaattatatttctgaatgattgacttcaggattttcttttagaattgtattaaatag

SEQ ID NO: 45541 - DNA, 201 bp, Homo sapiens
ggagatatagaagttcaactacctgcttccagaggctgtccctagtatagaatactttaggggctggctttacaaggcagtccttgtggcctcactgatgrctcaatgaaataagttcttttttaaaaaaaattttatttatttccataggttattgggggaacaggtggcgtttggttacatgagtaagttctttagtag

SEQ ID NO: 45542 - DNA, 201 bp, Homo sapiens
tgaatcgtggtttatcaagtcattaaaatcaatctagcctttaaaaactataattctaggaaacccaggaaaacatagtaaaaaatggaatataaaatctraagagaataaagaatagagaatcgtatgtgtgctatgattgtagctaaataatgttcaagtatcaacacaaattgaaaaggaatacatgaaaatgaaaat

SEQ ID NO: 45543 - DNA, 201 bp, Homo sapiens
caaactcctgacctcaggtgattcacccaccaaggcctcccaaagtgctgggattacaggcatgagccaccatgcctggcctccaagaactcttttttccyccatcatcatggttctattttagtcctgctgcctttccttttaacctctccccaggcccatttgctcagggtttttggtagagaccagaggaggggcagg

SEQ ID NO: 45544 - DNA, 201 bp, Homo sapiens
taattctcaattcaatgtctcttcatcttttagtagctgtggggttttgttgttgttcttctgtttttgcttagtatctgactactttttaattataaaawgagatgtatctaaacaaaatagagattgttatcagaagttcacaacatttattaaaaattttttcacctggacaagagtctaaagcagcataaaaatatg

SEQ ID NO: 45545 - DNA, 201 bp, Homo sapiens
cctaacaaagcaaatttttccgtctgccctttccccctcttctcgttggcagggttgatcctcattactgtttgctcaaacgtttagaagtgaatttaggkccctccccccaacttatgattttatagccaataggtgatgaggtttatttgcatatttccagtcacataagcagccttggcgtgaaaacagtgtcagact

SEQ ID NO: 45546 - DNA, 201 bp, Homo sapiens
taggggcacctcaccactcccagcttcttcagctctggcctgtcctgctgcctgcaagggttttgcttaattctcaattcaatgtctcttcatcttttagyagctgtggggttttgttgttgttcttctgtttttgcttagtatctgactactttttaattataaaaagagatgtatctaaacaaaatagagattgttatc

SEQ ID NO: 45547 - DNA, 201 bp, Homo sapiens
ggaccataatcttgaagacacagacaggcttcactcatccctgcctcctgcaccagtgggttcaaggctctgtcagtgtcccctaggggcacctcaccacycccagcttcttcagctctggcctgtcctgctgcctgcaagggttttgcttaattctcaattcaatgtctcttcatcttttagtagctgtggggttttgtt

SEQ ID NO: 45548 - DNA, 201 bp, Homo sapiens
ggactgtgggaccataatcttgaagacacagacaggcttcactcatccctgcctcctgcaccagtgggttcaaggctctgtcagtgtcccctaggggcacytcaccactcccagcttcttcagctctggcctgtcctgctgcctgcaagggttttgcttaattctcaattcaatgtctcttcatcttttagtagctgtggg

SEQ ID NO: 45549 - DNA, 201 bp, Homo sapiens
tttatttttaagagccccttgcatactttatagacattgggacctacctaggatattctcgttatttttgtgcacgtaatagaacttagagcatattgttrctattttcgattgtcctaaaaacttacaaggaattcattcttatggcattgctgattatttctatgttcatttgatataaaagagtgttagtaggggcag

SEQ ID NO: 45550 - DNA, 201 bp, Homo sapiens
actccactgacctcaataatggcatcataaaatgctatctggccacatgttgtcataccttgaatgtagctgcaaagccaatggaaagattttagatgttmctggaacagaagatgttaattaggataaatcttccaaaatgttcagaacataatgttagcttaatgttttactttaataatgttagcttgtgttaaattt

SEQ ID NO: 45551 - DNA, 201 bp, Homo sapiens
aaatattatttagaagcgaattaaatgtgactcttatccttaacccttattgacccaatgtcctactcagtagcttcaaagtatgtagttttcatatacayatttggccaaattatgtttctgaagaattctgcaatgttcagcatgaccaccttagagccaggcagacagccattttatcttttatttactatactgtag

SEQ ID NO: 45552 - DNA, 201 bp, Homo sapiens
agtgattcgatctcagctcactgcaacctctacctcccgagttcaagcaattcttctgtctcagcctcccgagtagctggggctgcaggtgcccaccaccrtgcccagctaatttttgtatttttagtagcgacagggtctcaccatgttggccaagctggtcttgaattcctgatctcaggtgatccacctgcctcggcc

SEQ ID NO: 45553 - DNA, 201 bp, Homo sapiens
tttttttttttttttttgagatggagtctctctctattgcccaggctggagtgcagtgattcgatctcagctcactgcaacctctacctcccgagttcaarcaattcttctgtctcagcctcccgagtagctggggctgcaggtgcccaccaccatgcccagctaatttttgtatttttagtagcgacagggtctcaccat

SEQ ID NO: 45554 - DNA, 201 bp, Homo sapiens
  misc_feature (1)...(201): n = A,T,C or G, or insertion/deletion polymorphism (see Tables 1-2)
agtaatcatggactttcattgtgttagtttgagacaactggatgtttccatttgccatcctcagcaacaagaagaaagtagtctcagattaaccaggtaantattttgtatttcacttaaaaaatcttgactgaaatatgcctatgtgatgacactcaaccaaattatttcattaaccagtccacaagatctccttaaata

SEQ ID NO: 45555 - DNA, 201 bp, Homo sapiens
tttgacattaaagaaaatgagcaatggtaacaggaaaccactctatagatgtacatataatatgtacagaaaatataagtagtaagaagtccatgacaaastgttagctcttttttttttttttttttttttttttgagatggagtctctctctattgcccaggctggagtgcagtgattcgatctcagctcactgcaacc

SEQ ID NO: 45556 - DNA, 201 bp, Homo sapiens
  misc_feature (1)...(201): n = A,T,C or G, or insertion/deletion polymorphism (see Tables 1-2)
gagaaccagactccaatgtcattgtggtggactggctgtcacgggctcaggagcattacccagtgtccgcgggctacaccaaactggtgggacaggatgtngcccggtttatcaactggatggaggtaagactgggagaaggagacttatgtgtccaaaacagtgtttttgactggagccagaaaaccggctgttctttct

SEQ ID NO: 45557 - DNA, 201 bp, Homo sapiens
tacaaggcagtccttgtggcctcactgatggctcaatgaaataagttcttttttaaaaaaaattttatttatttccataggttattgggggaacaggtggygtttggttacatgagtaagttctttagtagtgatttgtgagattttggtgtgcccattacggaatggaaaaatcaacgaaataagttctatgatgcacct

SEQ ID NO: 45558 - DNA, 201 bp, Homo sapiens
tgaggcagtgggtaaatgaatcgtggtttatcaagtcattaaaatcaatctagcctttaaaaactataattctaggaaacccaggaaaacatagtaaaaartggaatataaaatctaaagagaataaagaatagagaatcgtatgtgtgctatgattgtagctaaataatgttcaagtatcaacacaaattgaaaaggaat

SEQ ID NO: 45559 - DNA, 201 bp, Homo sapiens
  misc_feature (1)...(201): n = A,T,C or G, or insertion/deletion polymorphism (see Tables 1-2)
cctttgagatttctctgtatggcaccgtggccgagagtgagaacatcccattcactctgtgagtagcacaggggggcggtcatcatggcaccagtccctcncctgccataacccttggtctgagcagcagaagcagagagcgatgcctagaaaacaagtctttagttaaaaaaatcagaatttcaaaattgaggtctttcc

SEQ ID NO: 45560 - DNA, 201 bp, Homo sapiens
gcataaattagaaacccagtatccaacattgaggcagtgggtaaatgaatcgtggtttatcaagtcattaaaatcaatctagcctttaaaaactataattstaggaaacccaggaaaacatagtaaaaaatggaatataaaatctaaagagaataaagaatagagaatcgtatgtgtgctatgattgtagctaaataatgt

SEQ ID NO: 45561 - DNA, 201 bp, Homo sapiens
cctgtgaacctaaaacatatcattccaatgaataaaatcaagcaaccctccagttaacctcatatccaatttttcctttccagaaagaagagattttatcracatcgaaagtaaatttgccctaaggacccctgaagacacagctgaggacacttgccacctcattcccggagtagcagagtccgtggctacctgtcattt

SEQ ID NO: 45562 - DNA, 201 bp, Homo sapiens
tcgaccttcattttgagttctttgttggacatttttgtgcatttttaaaatatcccctaaataataaagctatttatatttggagaggagaaaaaaaagtrgggggcagggagagctgatctctataactaaccaaatttattgcttttttgtttaggcctgaagtttccacaaataagacatactccttcctaatttaca

SEQ ID NO: 45563 - DNA, 201 bp, Homo sapiens
gcttcaagaaaggctggaagacttaggagaggtcaatggtgacaatcttaattcagagttaaggttgtctctctgtcaactttgctcaacgttggagcatstgttgttctcttgcaatccacattcgttttcgaaaacacttcagaaacaaaaatagcatcagcggtggttgcctgtgaacctaaaacatatcattccaat

SEQ ID NO: 45564 - DNA, 201 bp, Homo sapiens
gaggttgaggcacctgtgcttcaaggaaaccttaactcttcaaaatcaggcaatgcgtatgaggtaaagagaggactgtgggaccataatcttgaagacasagacaggcttcactcatccctgcctcctgcaccagtgggttcaaggctctgtcagtgtcccctaggggcacctcaccactcccagcttcttcagctctgg

SEQ ID NO: 45565 - DNA, 201 bp, Homo sapiens
cttgcaatgttgcccaggctggtctcaaactcctggcctcaagtgatcctcctgcctcagcctcccaaagttctgggattgcagctgtgagccaccacgcscagtttacgatttatttttaagagccccttgcatactttatagacattgggacctacctaggatattctcgttatttttgtgcacgtaatagaacttaga

SEQ ID NO: 45566 - DNA, 201 bp, Homo sapiens
acttcaggaagggtggcttttgtggaatccagatggaaacctgagggaagggatgatattaaagaacagtggccccaggtaaaacatatggcacccatgtrtaaggtgattcttagaatctgtagaggtgtctttcgtggtatagaggttgaggcacctgtgcttcaaggaaaccttaactcttcaaaatcaggcaatgcg

SEQ ID NO: 45567 - DNA, 201 bp, Homo sapiens
gcaatagcacagaaataaagcataattacacacaatgcctgcagatttctctgggaagcctgtttcctcccactctcagctctgtgttttagtagtgtaaatgcacatcagtactaggagaaaagaagaaggaccaattccagaggccacttcgaaagaagaccgtcatctaggcaaaggtgtggcatacacacagagaga

SEQ ID NO: 45568 - DNA, 201 bp, Homo sapiens
tgtctttttaaatgcaactattcctggaaggcaagaatatctcacaccttctaagatactgccattttgccaggagtttgtttcacacttgaatttcaagsttggcctcttgtttagaggcagacctaaaggaatggtcggaaaatgagagaggaggtcttcggataaatccggtgagagggaccaacttcaggaagggtg

SEQ ID NO: 45569 - DNA, 201 bp, Homo sapiens
aaaaatacgctataagtatcagactttcccttagcaattatataaaatctccttgcagttttctgaaaggcacagaagtgcagtttgatttggttgtcttrtcaaaggacatttatgcatgaaaataggctgcaggagtattctatataagatagcaggcagttctgcacgtctgtttatatgccattcacaccatgaaca

SEQ ID NO: 45570 - DNA, 201 bp, Homo sapiens
cacttatgtgattaattagtttaattgagttgtagccaacacatgcttttcctagctgtaaatatattaaggaaggattatttccaagtagactggaaacratgccctcccatcccctccactttcactctactcacccaatatatcatgcctctcccatcacagcaactttctccctctttctcctccagatgcattcat

SEQ ID NO: 45571 - DNA, 201 bp, Homo sapiens
agccacacacattcattaccatattgtcaaaggctggtttcatgccaccataacagagttgatagcccacagagcctaaaatatttactccctggcccttyacagaatgttcacaacttacataaaggcaaggaccatctgtcttatttatttatttatttaatttgagatgaagtctagctttctcctaggctggaggag

SEQ ID NO: 45572 - DNA, 201 bp, Homo sapiens
ctttaaatggaatcatacaatatgtgtcttttgcgactatcttctttcacttatcataactcaatacggctttagattatttgacctcgatgttctgcctytgaacataaaatattatccttgcattccttgatgagtttgaggattgagaataatttgcatgagacaaaaattagaaactagttagagcaagtaggcttt

SEQ ID NO: 45573 - DNA, 201 bp, Homo sapiens
ggcctcccaaagtgctgggattataggtgtgagtcaccacacccggccctagatgcagttttatacatgcatttgtattacacataaatagcatgcatatkctgccagagcatctacaactttaaatctacatgtgaatgtgaaaataaaacctcattaaattagtaaataactctagctgcttgtaaagcacgtccagtc

SEQ ID NO: 45574 - DNA, 201 bp, Homo sapiens
tttttccatcctaaaaccagtgggggacaggcgggaattgtaaaacactcagaagataataaattgccctttttcctgtgctttttctcagaaactgggcraatctacagaacaaagaacggcatgtgaattctgtgaagaatgaagtggaggaagtaacttttacaaaacatacccagtgtttggggtgtttcaaaagtg

SEQ ID NO: 45575 - DNA, 201 bp, Homo sapiens
attcagggagagctttaggaaaccttgtatttattactgtatgatgtagattttctttaggagtcttcttttattttcttatttttggggggcggggggggaagtgacagtatttttgtatttcatgtaaggaaaacataagccctgaatcgctcacagttattcagtgagagctgggattagaagtcaggaatctcagct

SEQ ID NO: 45576 - DNA, 201 bp, Homo sapiens
cccaccaccatgcccagctaatttttgtatttttagtagcgacagggtctcaccatgttggccaagctggtcttgaattcctgatctcaggtgatccaccygcctcggcctcccaaagtgctgggattacaggtgtgagccaccatgcccagcctaccctttactactaatcaaagaaataaaagtaaggcaacttgatac

SEQ ID NO: 45577 - DNA, 201 bp, Homo sapiens; identical to SEQ ID NO: 12143

SEQ ID NO: 45578 - DNA, 201 bp, Homo sapiens
ctcttctatctccaaacaactctgtgcctctttcctacctgacctttagggctaatccatgtggcagctgttagctgcatctttccagagcgtcagtactragaggacactaagcatgtgaccttcactactcctgttctgaattccaggaatatgcccttttcaaccctccacacatcccctgccagacagcaagtgcta

SEQ ID NO: 45579 - DNA, 201 bp, Homo sapiens; identical to SEQ ID NO: 12144

SEQ ID NO: 45580 - DNA, 201 bp, Homo sapiens
tattttactccttgaactacccctgaatcttcacttctccttttttctctactgcgtctctgctgactttgcagatgccatctgcagagcatgtaacacargtttagtagttgccgttctggctgtgggtgcagctcttcccaggatgtattcagggaagtaaaaagatctcactgcatcacctgcagccacatagttctt

SEQ ID NO: 45581 - DNA, 201 bp, Homo sapiens
aaagatcttggggatggaaatgttataaagaatcttttttacactagcaatgtctagctgaaggcagatgccctaattccttaatgcagatgctaagagayggcagagttgatcttttatcatctcttggtgaaagcccagtaacataagactgctctaggctgtctgcatgcctgtctatctaaattaactagcttggtt

SEQ ID NO: 45582 - DNA, 201 bp, Homo sapiens
agagtgagaacatcccattcactctgtgagtagcacaggggggcggtcatcatggcaccagtccctctcctgccataacccttggtctgagcagcagaagyagagagcgatgcctagaaaacaagtctttagttaaaaaaatcagaatttcaaaattgaggtctttcctctatttgatattgagaaaaaaatgcttcaaat

SEQ ID NO: 45583 - DNA, 201 bp, Homo sapiens
aaagattcatttttctgggactgagagtgaaacccataccaatcaggcctttgagatttctctgtatggcaccgtggccgagagtgagaacatcccattcrctctgtgagtagcacaggggggcggtcatcatggcaccagtccctctcctgccataacccttggtctgagcagcagaagcagagagcgatgcctagaaaa

SEQ ID NO: 45584 - DNA, 201 bp, Homo sapiens
accaagtaaagattcatttttctgggactgagagtgaaacccataccaatcaggcctttgagatttctctgtatggcaccgtggccgagagtgagaacatyccattcactctgtgagtagcacaggggggcggtcatcatggcaccagtccctctcctgccataacccttggtctgagcagcagaagcagagagcgatgcc

SEQ ID NO: 45585 - DNA, 201 bp, Homo sapiens
ggccccagtgtctgttgttcccctctatgtgctcatgcaaagttttattaggacacagccacacacattcattaccatattgtcaaaggctggtttcatgycaccataacagagttgatagcccacagagcctaaaatatttactccctggccctttacagaatgttcacaacttacataaaggcaaggaccatctgtctt

SEQ ID NO: 45586 - DNA, 201 bp, Homo sapiens
ctccccaacagtcttccattaccaagtaaagattcatttttctgggactgagagtgaaacccataccaatcaggcctttgagatttctctgtatggcaccrtggccgagagtgagaacatcccattcactctgtgagtagcacaggggggcggtcatcatggcaccagtccctctcctgccataacccttggtctgagcag

SEQ ID NO: 45587 - DNA, 201 bp, Homo sapiens; identical to SEQ ID NO: 12158

SEQ ID NO: 45588 - DNA, 201 bp, Homo sapiens
gagagggagagtatggtcagtgcttagcagctgaagttccacttgcctggccatcgtgaatttccaggctgtcttctgagttgaacatgatggcaaaggasagcaaaatagcagatgtcactgaaggagagctcagcgagggagtgattgattaatagctgtattgaaaggtgggagtcaggtacgggggaagagcggcga

SEQ ID NO: 45589 - DNA, 201 bp, Homo sapiens
ctgccctcccctgtaaatgtggccattagcatgggctaggctatcagcacagagctcagagctcatttggaaccatccacctcgggtcaacaaactataasccttgtgccaaatccagcctacttcctgcttttgtaaatagtttttttaaaacttttaagttcaggggtacgtatgtaggtttgctaaaaaggtaaactt

SEQ ID NO: 45590 - DNA, 201 bp, Homo sapiens
aggagagcaaaatagcagatgtcactgaaggagagctcagcgagggagtgattgattaatagctgtattgaaaggtgggagtcaggtacgggggaagagckgcgatggaaaattttcgctttctttcagcagcttatttttaactcagctttctgttcttgctttattatggaggaaaaattgggccatagagtttactgc

SEQ ID NO: 45591 - DNA, 201 bp, Homo sapiens
aatctgggctatgagatcaataaagtcagagccaaaagaagcagcaaaatgtacctgaagactcgttctcagatgccctacaaaggtaggctggagactgytgtaaataaggaaaccaaggagtcctatttcatcatgctcactgcatcacatgtactgattctgtccattggaacagagatgatgactggtgttactaaa

SEQ ID NO: 45592 - DNA, 201 bp, Homo sapiens
ggagactgttgtaaataaggaaaccaaggagtcctatttcatcatgctcactgcatcacatgtactgattctgtccattggaacagagatgatgactggtrttactaaaccctgagccctggtgtttctgttgatagggggttgcattgatccatttgtctgaggcttctaattcccattgtcagcaaggtcccagtgctc

SEQ ID NO: 45593 - DNA, 201 bp, Homo sapiens
ggaatttaggaataaagattccatagtcaggaaaggcacaatttataacttgcgtgttacccaaaactctcccctaagggcttaatatggacatttctgaygaggcctgatgggcaggtggtacggtgatgctaagttaaattcagaatgaaggcctgcctttccttccctccttccttccccttccccttcttccttcct

SEQ ID NO: 45594 - DNA, 201 bp, Homo sapiens
tggcaccatcttggctcaccacaacctttgcttcctgggttcaagcgattctcctgcctcagccacccgagcagctgggattacaggcatgcaccaccacycctagctaattttgtatttttagtagagacggtgtttctccatattggtcaggctggtctcgaacttctgacctctggtgatccaccctcctcggcctcc

SEQ ID NO: 45595 - DNA, 201 bp, Homo sapiens
cctgtctctgggctttgttaccggctgtttccctgccagaaaatcagccctgctcccaggctccttcaccaccagatcttagcgccatcagcccagcaacsctgtcaatgaacaaattgaggtcttttttgagacagagtctcgctctgttgcccaggctggagtgcagtggcgtgatctcggctcactgcaacctccgcc

SEQ ID NO: 45596 - DNA, 201 bp, Homo sapiens
actggaacctcgggggtggaggttgcagtgaaccgagatcgcgccactgcactccggcctgggcaatgatgcgagactccatctaaaaaaaaaaaaaaaaaaaaagaaagaaagtgtcagtttgaacctcttgagtgatggctcagaactttggaatgttgggatgcaatactggcatactggaattcaggaatgccaaga

SEQ ID NO: 45597 - DNA, 201 bp, Homo sapiens; identical to SEQ ID NO: 12165

SEQ ID NO: 45598 - DNA, 201 bp, Homo sapiens
gaaagagtgagatcccatctcaaaaaaaaaaaaaaaaaaaaaagattccaggcaaagggaacagcctgtgcaaaggcctggaggccagggagagcctaachcatttgatctgtccaggagatgattgtctctgtctggtttctggcagggcccatggtgcccctatctctctccctcacctccctctcatttatgctttta

SEQ ID NO: 45599 - DNA, 201 bp, Homo sapiens
ccagatggagatagggctgggggggcaacctagggtgacacacgcacctggggaggaggggcatgtggcttctatggtggtagcccctccctgcccctgaygcgtctctcctgcctgcagctccacggagaagaactgctgcgtgcggcagctgtacattgacttccgcaaggacctcggctggaagtggatccacgagcc

SEQ ID NO: 45600 - DNA, 201 bp, Homo sapiens
gcctgggaggtcgaggctgcagtgagccataatcacactactgcaatccagcctacatgaaagagtgagatcccatctcaaaaaaaaaaaaaaaaaaaaaagattccaggcaaagggaacagcctgtgcaaaggcctggaggccagggagagcctaactcatttgatctgtccaggagatgattgtctctgtctggtttct

SEQ ID NO: 45601 - DNA, 201 bp, Homo sapiens
agcctgggaggtcgaggctgcagtgagccataatcacactactgcaatccagcctacatgaaagagtgagatcccatctcaaaaaaaaaaaaaaaaaaaaaagattccaggcaaagggaacagcctgtgcaaaggcctggaggccagggagagcctaactcatttgatctgtccaggagatgattgtctctgtctggtttc

SEQ ID NO: 45602 - DNA, 201 bp, Homo sapiens
atgttagcttggcttcttggagtctggggaattcagctttattctgcagtccctggagtggactatccagccccagaaaattcttcttttttttgtgtgtktgtgtgatggagttttgctcctgttgcccaggctggagtgcaatggcaccatcttggctcaccacaacctttgcttcctgggttcaagcgattctcctgc

SEQ ID NO: 45603 - DNA, 201 bp, Homo sapiens
gatgcgtgcctctagtcccagctactcagtagtctgaggtgggaggattgattgagcccaggaggtcgaggctgtagtgaactgtgattgcaccactgcaytccagcctgggtgatggagcgagaccgtctcaaaaatatatatatataggccaggcgtggtggctcatgcctgcaatcccagcactttgggaggccaggg

SEQ ID NO: 45604 - DNA, 201 bp, Homo sapiens
tcttttcgtctccgttagtctttctgtccacgcatgggtctcctggtttttgtctctccgactattttctctccctttctatttttctcctccacggtcckgttgcctcgtctccgtctctgacatctccccgcctctccctctctgcatcaccctccaacccttcctctccctcctctctgtcttcctccctatctgtct

SEQ ID NO: 45605 - DNA, 201 bp, Homo sapiens
ccagaaggaaggtcagggcatgggctggagagggtgagctgtgaccaagggggtggctgtgggtcggctggttacaaggtccacctagatggtccctgaargatagaagaacacaaaccatacaatcctagaactcttttttttttttttgagacagtgtctcactctgttgccaagctggagtgcagtggtatgacctca

SEQ ID NO: 45606 - DNA, 201 bp, Homo sapiens
gcaggggccagagggagatgagctatgaagacccacagagtgaagtaacagagggatgggggtgaaggggagaagagagacagggagatggaaggaaaaaygcagaaatggagagacaaaatgagagagacagatacagacacagagttaggccaaggagagacaaagacagatacacaacaaggcaagaggcgaagatga

SEQ ID NO: 45607 - DNA, 201 bp, Homo sapiens
aaaattagccatgcatgctgttacgtgcctgtagttccagctgcttgggagactgaggtgggagaatcacctgagcctgggaggtcgaggctgcagtgagycataatcacactactgcaatccagcctacatgaaagagtgagatcccatctcaaaaaaaaaaaaaaaaaaaaaagattccaggcaaagggaacagcctgt

SEQ ID NO: 45608 - DNA, 201 bp, Homo sapiens
tcccctgactcccacaccaaagcagggttcactaccggccgccgaggtgacctggccaccattcatggcatgaaccggcctttcctgcttctcatggccaycccgctggagagggcccagcatctgcaaagctcccggcaccgccgagccctggacaccaactattgcttcaggtgagccttgtagcctggatggaggcct

SEQ ID NO: 45609 - DNA, 201 bp, Homo sapiens
tgagctgtgaccaagggggtggctgtgggtcggctggttacaaggtccacctagatggtccctgaaggatagaagaacacaaaccatacaatcctagaackcttttttttttttttgagacagtgtctcactctgttgccaagctggagtgcagtggtatgacctcagctcactgcaatctccgcctcctgggttccagtg

SEQ ID NO: 45610 - DNA, 201 bp, Homo sapiens
tgcacacagctgctggtggcaccgtgcacctggagatcggcctgctgctccgcaacttcgaccgctacggcgtggagtgctgagggactctgcctccaacrtcaccaccatccacaccccggacacccagtgatgggggaggatggcacagtggtcaagagcacagactctagagactgtcagagctgaccccagctaagg

SEQ ID NO: 45611 - DNA, 201 bp, Homo sapiens
tggccgctgccagcttgcaggctatggattttgccatgtgcccagtagcccgggcacccaccagctggcctgccccacgtggcggcccctgggcagttggmgagaacagttggcacgggctttcgtgggtggtgggccgcagctgctgcatggggacaccatctacagtggggccgaccgctatcgcctgcacacagctgc

SEQ ID NO: 45612 - DNA, 201 bp, Homo sapiens
agcctgggcaacaacagtgaaactccgtctcaaaaaaaaaaaaagaaaagaaaaagaaaaaatagggattagggagcaggtgggcactgggaggagtgtcmtgggctgttcgacaaaggcctagaaggagctcatctgtcttggtcaatgctgagtcccaagcacacagcacaggcttcggcacattgtaggagcctagaa

SEQ ID NO: 45613 - DNA, 201 bp, Homo sapiens
gcaggctatggattttgccatgtgcccagtagcccgggcacccaccagctggcctgccccacgtggcggcccctgggcagttggcgagaacagttggcacrggctttcgtgggtggtgggccgcagctgctgcatggggacaccatctacagtggggccgaccgctatcgcctgcacacagctgctggtggcaccgtgcac

SEQ ID NO: 45614 - DNA, 201 bp, Homo sapiens; identical to SEQ ID NO: 12162

SEQ ID NO: 45615 - DNA, 201 bp, Homo sapiens
tgtgttcccatctgccccacgccccacttatctatccctctgagagtgtgtgtgtatgtcccctatcccctgactcccacaccaaagcagggttcactacmggccgccgaggtgacctggccaccattcatggcatgaaccggcctttcctgcttctcatggccaccccgctggagagggcccagcatctgcaaagctccc

SEQ ID NO: 45616 - DNA, 201 bp, Homo sapiens
catggaagctcctgtcaggcgtgcgggagggccaaacgcaagtggacaccccgcagataggggacatggcttactggtcccaccccatcgacctgcacttygccaccaaaggtcttcaaggtgggtatcacacctggacccggggccaggctgaggggagggggccagtagcctctgaggtccctggggctgggaacacca

SEQ ID NO: 45617 - DNA, 201 bp, Homo sapiens
tcaccctctccagcccatgccctgaccttccttctggctcatgtcctcacctggtacagctccacgtgctgctccacttttaacttgagcctcagcagacycagctctgcccgggagagcaacacgggttcaggtaccgcttctcggagctctgatgtgttgaagaacatatatatgctgtgtgtactctgcttgaacttg

SEQ ID NO: 45618 - DNA, 201 bp, Homo sapiens
catgcccagttgtgacgtgtgtgcgtgtgtgtgttcccatctgccccacgccccacttatctatccctctgagagtgtgtgtgtatgtcccctatcccctractcccacaccaaagcagggttcactaccggccgccgaggtgacctggccaccattcatggcatgaaccggcctttcctgcttctcatggccaccccgct

SEQ ID NO: 45619 - DNA, 201 bp, Homo sapiens
ataaaaggtatcagagactgactccaccccagagctgtcagctccaaaactcctagagttgggagcaccagctcccctcacctctgccaaacccctgatckcctcccttcatttctccctgctagaaatctatgacaagttcaagcagagtacacacagcatatatatgttcttcaacacatcagagctccgagaagcggt

SEQ ID NO: 45620 - DNA, 201 bp, Homo sapiens; identical to SEQ ID NO: 12164

SEQ ID NO: 45621 - DNA, 201 bp, Homo sapiens
ctgcaaagctcccggcaccgccgagccctggacaccaactattgcttcaggtgagccttgtagcctggatggaggccttccaggctgggggcatgactgcyatctgctgaccaggtgctccaggttggacacctggctgctgctgtgcttgggctgagcatctgtctcctttagcttggagggctcaggggatgaggtctg

SEQ ID NO: 45622 - DNA, 201 bp, Homo sapiens
gggtttgctccttccttcctcttcctccaggggctgggtgagctgcactctcagactggcttccctctcgccactcctacaggggaaattgagggctttcrccttagcgcccactgctcctgtgacagcagggataacacactgcaagtggacatcaacggtgaggcctgcttccccggccatgcccagttgtgacgtgtg

SEQ ID NO: 45623 - DNA, 201 bp, Homo sapiens; identical to SEQ ID NO: 12167

SEQ ID NO: 45624 - DNA, 201 bp, Homo sapiens
ggggtttgctccttccttcctcttcctccaggggctgggtgagctgcactctcagactggcttccctctcgccactcctacaggggaaattgagggctttygccttagcgcccactgctcctgtgacagcagggataacacactgcaagtggacatcaacggtgaggcctgcttccccggccatgcccagttgtgacgtgt

SEQ ID NO: 45625 - DNA, 201 bp, Homo sapiens; identical to SEQ ID NO: 12189

SEQ ID NO: 45626 - DNA, 201 bp, Homo sapiens; identical to SEQ ID NO: 12191

SEQ ID NO: 45627 - DNA, 201 bp, Homo sapiens; identical to SEQ ID NO: 12192

SEQ ID NO: 45628 - DNA, 201 bp, Homo sapiens
cacagaggcgccatggcttccaacgctgtctgttttgtttcccatagtccgacacctgggacagactgctgaaagtgaggtggccctagagacactagagwcaccagccaccatcctcagagctttgaactccccattccaaaggggcacccacatttttttgaaagactggactggaatcttagcaaacaattgtaagtc

SEQ ID NO: 45629 - DNA, 201 bp, Homo sapiens
ggagaaccagtacaggtaaagggggccctgagtgaccgggggaggggatgggcaggcatgggggcactgactacagtacaaagaggtggcagcaagagcargcccaggtttcctgtgggcagacacaccctggtccttgcagctgacccctcaacctccccccacgccaggcactcgggcccccttagagcatactgccca

SEQ ID NO: 45630 - DNA, 201 bp, Homo sapiens; identical to SEQ ID NO: 12194

SEQ ID NO: 45631 - DNA, 201 bp, Homo sapiens; identical to SEQ ID NO: 12196

SEQ ID NO: 45632 - DNA, 201 bp, Homo sapiens; identical to SEQ ID NO: 12198

SEQ ID NO: 45633 - DNA, 201 bp, Homo sapiens; identical to SEQ ID NO: 12200

SEQ ID NO: 45634 - DNA, 201 bp, Homo sapiens
cagggtcccctcctgggggatcccaaccaatgagcaaaggtctgtggctgcaggaaaagcacactgtgagtccctggcttttgccgagtcgcggtgtcgcrggagggcctgcccgggcttcgattcccgctccctgcccagatttccggcccttgctaggaatcctgagccgggggaagtgagcctgcaagccctgcgcca

SEQ ID NO: 45635 - DNA, 201 bp, Homo sapiens; identical to SEQ ID NO: 12188

SEQ ID NO: 45636 - DNA, 201 bp, Homo sapiens; identical to SEQ ID NO: 12190

SEQ ID NO: 45637 - DNA, 201 bp, Homo sapiens
acacccacctcctggtgaccatttccctgtgggacaggcagatacagcccatttgatggtctcagtgactccacaccccacagggacttcccagacatgcygccatgcccacctctcagccacagggaccccacggagcccgtgtctgtttgctctaaacccaccagtgagaagtccccttgggaaacctgcttgggaaac

SEQ ID NO: 45638 - DNA, 201 bp, Homo sapiens
ggtgagtgtttgtgacccagacagctccccactttttgctggccccgtggggtgcactgccctctccctgggatctgtaagtgacacggtgcttgtgttgyttcctgtgtcttcttgtgctgcctcctgcatctcccctgacccacaccccaacccaactctcctcccatcagggatctcttaggaagtggctgtcttgat

SEQ ID NO: 45639 - DNA, 201 bp, Homo sapiens; identical to SEQ ID NO: 12195

SEQ ID NO: 45640 - DNA, 201 bp, Homo sapiens; identical to SEQ ID NO: 12197

SEQ ID NO: 45641 - DNA, 201 bp, Homo sapiens; identical to SEQ ID NO: 12199

SEQ ID NO: 45642 - DNA, 201 bp, Homo sapiens
ccaaggtggggacgtgcaggcacagaggcgccatggcttccaacgctgtctgttttgtttcccatagtccgacacctgggacagactgctgaaagtgaggkggccctagagacactagagtcaccagccaccatcctcagagctttgaactccccattccaaaggggcacccacatttttttgaaagactggactggaatc

SEQ ID NO: 45643 - DNA, 201 bp, Homo sapiens; identical to SEQ ID NO: 12202

SEQ ID NO: 45644 - DNA, 201 bp, Homo sapiens
tatctaatcttcctggaaaccttgtgaggcggcactgcttgaacccgtcttacagcctttgaagggtcatgtggtgcccgtggccatgtgaccagcaggtktcaggctggggtcacacccaggtgtgtatgctgttcacaccacatatcagccctgcggggtgcttacagcggaaattgtgcaggttcctgcccaagaggg

SEQ ID NO: 45645 - DNA, 201 bp, Homo sapiens
gggaaaataagctgaagccttcgaagctggattttagagtgaccgagtgttggagctcacttctcacctggcacaaaaatcttcctgtttaagctatgatrtagatgcctgcaaatccaacattacagttcctctagcattgacaacattgctccaagcaactgcatcttcccttgatggaacagtatccactttgtgcaa

SEQ ID NO: 45646 - DNA, 201 bp, Homo sapiens; identical to SEQ ID NO: 12221

SEQ ID NO: 45647 - DNA, 201 bp, Homo sapiens
acgtcccaattattttcttccacctcacaaatttcattatttcatgatacttgaacacagtaggagccccacagagacaggtcacaggcttggcttcagaycttacaatatgaactatgtggacaggcgtaaggccagtggcagaggcaagcaggctttgcaggaaggtgacaggagggtgctgggcctcaccaaggccag

SEQ ID NO: 45648 - DNA, 201 bp, Homo sapiens
tgggcagtatgctctaagggggcccgagtgcctggcgtggggggaggttgaggggtcagctgcaaggaccagggtgtgtctgcccacaggaaacctgggcytgctcttgctgccacctctttgtactgtagtcagtgcccccatgcctgcccatcccctcccccggtcactcagggccccctttacctgtactggttctcc

SEQ ID NO: 45649 - DNA, 201 bp, Homo sapiens
tcgttgttttgtgtggccacggaggagtccccacctgcaggctcctgggggccagaggcagctgtggcgtgatggatgctgggctccctccagacgcctgrggacccactgggggccagcatcttgagtggggcagatgtgatgggggcgtcagatgacagcgaaggtctacttgtggtgggtgtagccttgggggtgccc

SEQ ID NO: 45650 - DNA, 201 bp, Homo sapiens
cagatgtgatgggggcgtcagatgacagcgaaggtctacttgtggtgggtgtagccttgggggtgccctcggggccccttgtgggactggctgttgcagcrcggggcacggtgctcccttctttctctcctttgtcctcctcatcggggggcccagatggtggtcccagagacacaggccccatggtgcaagagaccccat

SEQ ID NO: 45651 - DNA, 201 bp, Homo sapiens
gacctgggccccccagggccagaggccggcacatgcctttgaagctgaacttgcacacgaagccctcaatgttacttccgggggagcctgggctcccacasgggccctcagaccacttggggaggcggctgggaaggagcggctgggacaggtccagcagcagagacacacagcgcttggagatgcacgagttccggagct

SEQ ID NO: 45652 - DNA, 201 bp, Homo sapiens; identical to SEQ ID NO: 12220

SEQ ID NO: 45653 - DNA, 201 bp, Homo sapiens
attgcagggtttctttctggggtgattaaaatgttctagaattaatttgcaaaactctatgcgtatgccaaaagccattgaattatacattttagataggyaaactgtatgatgtgtggattatatctcagtatagctgtttttaagaagaagaacatatgttcccccagtgaatgaagcatgagagcttaagtgatgaac

SEQ ID NO: 45654 - DNA, 201 bp, Homo sapiens
tctgcagccctagcatccactcatagcagggagccgttctcgtggtctaggcccctgtttgtgcagctcggaggtagattcctcagaggtagattgtgatmtgcagcattcgctcagcattctacttagttggtgcttaaggatatgggctaaatgagtgactttcagcatgttagccactctgacccccagatctttgtc

SEQ ID NO: 45655 - DNA, 201 bp, Homo sapiens
cacgatgctggaatggaatgttctgatctcaaatatggggcgagtttaatctcagttatttgggagcagactaattggtttgtggatcattcaggcatccrgcctgtctttttcctttttttttttttttgtaactaaaaattaaattaaaaagggaaacaaagcacactgcgtatttcctggcataacatggtatatggt

SEQ ID NO: 45656 - DNA, 201 bp, Homo sapiens
ttgtaaaattgaaatttgtcctttattaatcgtttgctttaaaacttaaaaaactaggaaaatcactaatattgattatgacatgatgatttctgaaagtyattgtgttgtacagaggtgaggggtgctacaaggttcaccctgggcacaaagatgccaggattgctgcaggcaaccccactcgaggacacccgtctgccc

SEQ ID NO: 45657 - DNA, 201 bp, Homo sapiens
ttcagtgattgcttccccaaaaacacatttcacaagaggatagactttatcacatgggttcagccgggctgtgtcatagagacccatcccaactcaccccrtgttattaccagtgaactactgagatgctaaatctttggcttcttggtttgagttgtggaaggacagataaacaaaagtgcctgctaagacccagatatc

SEQ ID NO: 45658 - DNA, 201 bp, Homo sapiens
caccaccaggaatgtcagacaaccatcagatgatggtcaggcagttgttaactgtctttctaaaataatttgttgcagccagtgccagggaaagcagtctycctatcaatagaagaaacctcaaactggggatcagcagcttccagataagatctcaggagctgggtaagtgggctcaagcttgtgcattaagatgcaaaa

SEQ ID NO: 45659 - DNA, 201 bp, Homo sapiens
aagataattggaactatatattttaatgctattttacagaagtatattataatatattctttaaatgcatgaaatgtgagaaattgaacaatgaaaatatmtatcactaatataactgcaaatatttagtgcttgcctttaattttttgtgaaaattagagatctgaacattttgttagcacagtaagtatatttaatata

SEQ ID NO: 45660 - DNA, 201 bp, Homo sapiens
agctagcattgccctcaaagatgctcagcaagttctttcacagtaagaaatttcagagaaactccaaggagcttctctggaagagaacatctggggaatgyctggcttccatgcacccagcccagtgctggttgctagaatgcatagcaatgacctatgagcagtgggcccagcaaattattaactacagcttttcaggaa

SEQ ID NO: 45661 - DNA, 201 bp, Homo sapiens
gggctgatcacgaggtcaggagatcgagaccatcctggctaacacaatgaaaccccgtctctattaaaaacacagaaaattagccgggcgtggtggcgggygcctgtagtcccagctactcgggaggctgacgcaggagaatggcgtgaacccaggaggcagaggttgcagtgagccaagactgtgccactgcactccagc

SEQ ID NO: 45662 - DNA, 201 bp, Homo sapiens
ggccggccagggccagcgcgccaaggaccaggaccccaagcatgttacccaggcgcgccgcgtgcaggcgccggggaaagcgcgggcactgcgacagggcsgtgccggagcagaggggcacaggacgccgatggcgacagcctctcctgtccgtcccagcccagacacttcttgccgctgcgcgcagcccctgcgaggcag

SEQ ID NO: 45663 - DNA, 201 bp, Homo sapiens
tctccctcagacctggatgtccaatgatgtgaacagaaagcagagatcacacaggttgacccatggctctggtttcacaaggtctatcctgattttaaatkctcagggatagtttttaaagctaactgatttgtttatgtggtcctggtatctttccctgagaggcactatggctatttagcgttttgagaatctcaagtt

SEQ ID NO: 45664 - DNA, 201 bp, Homo sapiens; identical to SEQ ID NO: 12224

SEQ ID NO: 45665 - DNA, 201 bp, Homo sapiens; identical to SEQ ID NO: 12222

SEQ ID NO: 45666 - DNA, 201 bp, Homo sapiens; identical to SEQ ID NO: 12223

SEQ ID NO: 45667 - DNA, 201 bp, Homo sapiens
ttctggtgaaagagtagccttccttcgcgggcactgacactgagggaagcagctcagtggctacttccacctgcagatattccaggtggtggctcagaacwgctgacaaccatacctggggaagactggcctttatttttctggttgttcatactccaacagctagcaccgtacgttggggtccaatgaagcgagcagcag

SEQ ID NO: 45668 - DNA, 201 bp, Homo sapiens; identical to SEQ ID NO: 12225

SEQ ID NO: 45669 - DNA, 201 bp, Homo sapiens
ctaggtctcctctcctgggggagaaaggtagcggctggtttcctgttccattgcttctttagtatcctgagagagaacagccatgggcacccagctgcccmagcctcttcctgtcccggggccccgaggctgcccttcagcggtctccagcttcctgctcctgtaagcaggggcctctctttttggctttcctgacatttc

SEQ ID NO: 45670 - DNA, 201 bp, Homo sapiens
gactgtggaatggaagtttcaaaactaagtcagagaaccctctgatcctgcaaacacacatgcacacacacagagacatcaaccatctctaatttgttggyacccaccagggataccttgggcatctgaagtcagtctccatgtctgtgggtctcgtgtaaccataactacttggagttttttaaaactgcattatttctt

SEQ ID NO: 45671 - DNA, 201 bp, Homo sapiens
gtcagagatcttgctttttcttttacaattgtctttaatgtactgttccatggcaagccaggtgttccattttcccagatggtcagggaagatggtatttrgacatgacaggctgtcactcagcaggatacttgcccagtttgtcagctctgatctgtgagcaaagatgcatatgagtttcacactcatctgtgaagtatt

SEQ ID NO: 45672 - DNA, 201 bp, Homo sapiens
gtgaagtattggcttcactttcattaaagtcatcatagctggcattccttagatgctagaggtggatgcaaaggatcaactaaatatagcacgttttggcrgcactgcctcagaaaccagacatgaatcctagcaaatgtgggcattgacactcttctctgagaggttggaggtagtgaattacccccatctcccacattc

SEQ ID NO: 45673 - DNA, 201 bp, Homo sapiens
cgccaaacagagcagagtgctcctcaagatccagccgcatcccaaaagcaccatttccgtttgtcacgggcctccaggcagcttgctgttgagtttgctcrtgtttatcatggccgtatcctgtgctgtggagagtcatagacaaattaaacagtgaaactgggacttgccccatgcccttttcagactttccattctcct

SEQ ID NO: 45674 - DNA, 201 bp, Homo sapiens
ttattaaaagagggggacaatgaacaaggcgtaggatctccaaagagtctgtggaaggtgggatccatgttcccaaaggatttaaatcgaaacaaggcagkaggcagtgggaaaaggggaggaattagggagaatgtggaaaagcccctctcctctttgccaagtagaacaaagctttgctggacaacagcggggtaactt

SEQ ID NO: 45675 - DNA, 201 bp, Homo sapiens
agtggccagataaggaagcaaggcccagaagggcccagccagtggctctcagactccagagtcatcgagtccctcactcgagggcaggttaactcacagayggctggcccccaccctctgcatttgccatccagcaggtctgggtgggtaccaggatgcggattcgtaacaggagaggctgatgctgccagtctgggtcca

SEQ ID NO: 45676 - DNA, 201 bp, Homo sapiens
tcagcccagtctcccaaggccaggactgctgcctttgccttgccgcatctcagtgggcatccccaagctccactgacttagcacaagatgggaataatagyccctatcttctgtagtttcaaccactagtcaaaatgtgccacttactagccacgtgcccctgggcaaacaccgttcctctctgggcttcagtttccttac

SEQ ID NO: 45677 - DNA, 201 bp, Homo sapiens
aatgctggatagaccccacctgcacacagagaagaaaggctgctggagagacatcatcagaggagagagacagtggctctaatccaagaatccaggcaacrtgtgtagggctcagggtggcatgtgtgtgttttcatgcccagcaccaggacctgagcactgagagctttccctacctgccatgggatcctggtatcaagg

SEQ ID NO: 45678 - DNA, 201 bp, Homo sapiens
ccatctgaattctgctctcactgctggcccatgttctgtggcttcagccgagtaattcaactctccagggctctttgtcatccatctgtgagagccagtcygggcagagaaggagaggagcagggcaagctgagaatgcagcccatgatgccgccccgattatggtgtttcctcactggacacgtggatgaagcgtgctcg

SEQ ID NO: 45679 - DNA, 201 bp, Homo sapiens
ttctttgcctgcttttattttaccagtggctacatttcatcatccagcttcatttcccatagaagttctgaatgttgtctggttttcctcgaaactatgartcacactgtgcacgccctacctctctctagcattgtaagaaaagcactcctctgtgcaggacacaatcctgtctactgcccctgagagccctggttcatc

SEQ ID NO: 45680 - DNA, 201 bp, Homo sapiens
aattattaactacagcttttcaggaaaaaaaataacccatttgtatcatttgcctctttccgtggtataaatacctccaccagggtcagcttcagtctccycatgatgttgtggagcatggagcagggaggaggtgtgagcagcctgccgcggaacaggaggctccacagatgcagataaccttaagagcacaggttgcag

SEQ ID NO: 45681 - DNA, 201 bp, Homo sapiens
cgtaacccactggaagccgcgcaggggcccgaggcgcttggggtcgccgcagccgggtggcagctgcaggccgatccagaggcgccggcggccaacgccgscgtcgccgttcagtagcaaggaaatgacatcggcagccaccgaggagcgcactgtcattaggtggccccgcagtccgtcgcagatctgactggcattgag

SEQ ID NO: 45682 - DNA, 201 bp, Homo sapiens
ttcagtagcaaggaaatgacatcggcagccaccgaggagcgcactgtcattaggtggccccgcagtccgtcgcagatctgactggcattgaggaaggtcgyggggcccgggtagagcgcgaagcagtcgtgctcgacgcactggctgccacccggctgcggctctgcgggtgcggggaaccccaggccggccagggccagc

SEQ ID NO: 45683 - DNA, 201 bp, Homo sapiens
gtgtcagctcccgtccccgccccgggctgggtcaggagcagcagcagcagcagcagcaggcccatggaggtggccatcccggtctctgtgtggccctctgygggaggcgagaagcccagcggcgacaggagcttctatctcggctcccagctgggccccaaggggagctgaggggtgagctgcagccactccggcgcagag

SEQ ID NO: 45684 - DNA, 201 bp, Homo sapiens
cccaacagtaaactgtgagacagtcagagctggaaactcatccctcttgtctattgctggctccctagtgcctgctatagggagcaagtgatcagtaactmcttgatcccagccatacatgggaatcacctggggtgggggacaaaccatagtaccaagccccattctggaccaactatatcagacttgctgtgggtgagg

SEQ ID NO: 45685 - DNA, 201 bp, Homo sapiens
caaatcaaaacagcaacaaaattcaggctcactgtttaaaagtaaagataaatacctctttgggtgtaatttctatgacagtccagcaacatcaatttaayaccttttacatctcaacctttgtttaaaattattttgctctgggaatctgaaatttcaggataaattagcaaatctggtgaaaaagcaaatggccatttt

SEQ ID NO: 45686 - DNA, 201 bp, Homo sapiens
agtcaaggtggagccgggcgtcgggctgggcgggggctcgccagagccgctgtcgccaccgtccaccttgccggagtcacagtcggtgccaatgtggcggrcaagggccgagtcgggcccgcagatgcactcgaaggtaccggggaggttgtggcacaccccggagcagaagccgccgttttcgcactcgtcgatgtccgt

SEQ ID NO: 45687 - DNA, 201 bp, Homo sapiens
tccctccctcctccctctccctcccttcctccctctccctcccttcctcccttcctcttttcctcccttccatcctttcttccactcagttgaattctatraaccaattttaaccacaagagaacatcatcatccaagttaatcacgacaaacctcaaatagaacccaactaccagaactcagagagggacaaccgctcat

SEQ ID NO: 45688 - DNA, 201 bp, Homo sapiens
ccatgggggatgagggcctggatggaggccagggcatgaggacttgcaggacggatgagaaggaaagcagacaagggcgtgacaccccgacaaacacacgygggacaggaggcagcgatttcaacaatgaagtaaaacatttgtgatataacgtttttgggaaagccagaccctggagaaagaaggtagacgtcccaatta

SEQ ID NO: 45689 - DNA, 201 bp, Homo sapiens
ggtcctttctttagtctctcagtgatcagactgggcaaactctctgataagcaagacagggcacctaccaggagtcttggcaacactagtgtgtggctgcycagattagcatggaataagacacattctatttagaaatgtcagcctttttaacttagttgatgaaggttgaaggagaggcagcttcaggtgatggaaaga

SEQ ID NO: 45690 - DNA, 201 bp, Homo sapiens
ccccagggcttcttcccagcttgtacgtggggttgggggtcctttctttagtctctcagtgatcagactgggcaaactctctgataagcaagacagggcayctaccaggagtcttggcaacactagtgtgtggctgcccagattagcatggaataagacacattctatttagaaatgtcagcctttttaacttagttgatg

SEQ ID NO: 45691 - DNA, 201 bp, Homo sapiens
cagcactggcagtggtccccagggcttcttcccagcttgtacgtggggttgggggtcctttctttagtctctcagtgatcagactgggcaaactctctgakaagcaagacagggcacctaccaggagtcttggcaacactagtgtgtggctgcccagattagcatggaataagacacattctatttagaaatgtcagcctt

SEQ ID NO: 45692 - DNA, 201 bp, Homo sapiens
agatgcagcagaatgaatcgggtatatcagttgtaaagtcatatataatataatttgaagtgaaaaggttcaaaaaggtatattttttattggtgaaggaygaaatctgccaaacacatattagtcccttcaccacgcggctgtaaatagaagacaaaactggtggaaatccgaggagaagctgacgaagccacagccatg

SEQ ID NO: 45693 - DNA, 201 bp, Homo sapiens
tctcccattaaaagacaaagacttttgattgaataaaagaaaaaaaaagtgaaatccagctttgttgtttacaagagacaaacatgaagtgtcaccagaargctgaatttagggaaaaaataccagatattcatcagatgcagcagaatgaatcgggtatatcagttgtaaagtcatatataatataatttgaagtgaaaa

SEQ ID NO: 45694 - DNA, 201 bp, Homo sapiens
tctgtattatttctcataagttgtatgtgaatctgcaaatatctcaaaataaaatgttttattaaaaaaaaacaggagagattctcagggcagaagtttayttatacattgcataagaactagatgcaagtggctttgtcacctgttcgctgcagggaagtcacacccgtccaaagggccaccagcatccacctggatctc

SEQ ID NO: 45695 - DNA, 201 bp, Homo sapiens
gtggggcagccataaccagaggttcatgttgtatgcttccatttatgcaataatcttaaaatgatattctatcaattctttcaatggagaacagactaatrgttgtcaggggttaaggtggggtggagtcagggggcaagtgagtgtggttaaaaaaggacagcaggagtcatcttcatggtgacagacatgtgccgtgct

SEQ ID NO: 45696 - DNA, 201 bp, Homo sapiens
cttctatctcggctcccagctgggccccaaggggagctgaggggtgagctgcagccactccggcgcagagaaggacacaaaggctgagggctttccacgtycccctgacccaaggcgcatcctgtactgttgtacttcttatttctcaccggatgttggggcttcctgcaatgaatagttctctgactcctgctgccttca

SEQ ID NO: 45697 - DNA, 201 bp, Homo sapiens
cctatctgtgccccctgcacaccagggtgggccactccttcctatccctttgcagataacacatccacttcccaatgcttggcccagttcctggcccagcrccctcactctggcccaccagcagacttgctttactcctgaaacagctcccttgaagaacacccatctggtcctaaatactgttgccaaaatcttgttttc

SEQ ID NO: 45698 - DNA, 201 bp, Homo sapiens
caaggcaggtctcaggatgcacaatctttctgatcagagggcttttgagtagttctaccccagtgtgtgtgtgcgtgtgtgtgtgtgtgtgtgtgtgtgtktttggggggtacatacacaagcccaagtaagtttgtttgaacatattattaaaaatacccatattgcttaacactctgcttttcctatctgaaactggct

SEQ ID NO: 45699 - DNA, 201 bp, Homo sapiens
cattgtcccatggggggtaccacagtgtctgggttgccctacacaaggatgggtggacatgacccacttggctttcccacctgtaagggctttacccctgrccctcaggatacctttgccttgtggggcctgccctcagccgctttgtttttcctctccagccaataccttggaggctttgcatattttagactaccttct

SEQ ID NO: 45700 - DNA, 201 bp, Homo sapiens
gagcattgtcccatggggggtaccacagtgtctgggttgccctacacaaggatgggtggacatgacccacttggctttcccacctgtaagggctttacccmtgaccctcaggatacctttgccttgtggggcctgccctcagccgctttgtttttcctctccagccaataccttggaggctttgcatattttagactacct

SEQ ID NO: 45701 - DNA, 201 bp, Homo sapiens
tttacaactcctcagaggtcctccgcatgcaattccctccaaaccactgacaggcagcctgaagacctggttaggtaccgggtttgggataaaatagacarccttgccctcaaggagctcacagacaagttaaaaactccaaaaccaagtttgattgatgtaatgccagaaaatgtagccagagtctggcatgcgagagta

SEQ ID NO: 45702 - DNA, 201 bp, Homo sapiens
taactggggcacgttttgcgccttcaccattgtatgtctgagtcatgatgtctttacaactcctcagaggtcctccgcatgcaattccctccaaaccactsacaggcagcctgaagacctggttaggtaccgggtttgggataaaatagacagccttgccctcaaggagctcacagacaagttaaaaactccaaaaccaag

SEQ ID NO: 45703 - DNA, 201 bp, Homo sapiens
gagaggtaactggggcacgttttgcgccttcaccattgtatgtctgagtcatgatgtctttacaactcctcagaggtcctccgcatgcaattccctccaawccactgacaggcagcctgaagacctggttaggtaccgggtttgggataaaatagacagccttgccctcaaggagctcacagacaagttaaaaactccaaa

SEQ ID NO: 45704 - DNA, 201 bp, Homo sapiens
aggggcctttcatcccagcagaagggagaggagaggtaactggggcacgttttgcgccttcaccattgtatgtctgagtcatgatgtctttacaactcctyagaggtcctccgcatgcaattccctccaaaccactgacaggcagcctgaagacctggttaggtaccgggtttgggataaaatagacagccttgccctcaa

SEQ ID NO: 45705 - DNA, 201 bp, Homo sapiens
gatctctgtgtactgtggagtacagggccttgggctgagcccaaagcattctgagcaaagcatgcatgtatgggcatgtatgggaactaggagttctaaaygctttcccttaccctgtccccttaatcctcttaccaacctgcaagacaggtccttccacagtttcatgtgagatgagtaacggcagttttctcagctgtt

SEQ ID NO: 45706 - DNA, 201 bp, Homo sapiens
cctggcattcatccacgtccacacagtccagctgactcgagtccagctggtacccttgggggcagcggcacgtgtagtttttcccatggggtcccaggacrcacgtggcccccccacgacatgggctggagctgcaagggtttcgagaggcacaggtcaccaggtcatccagcagccggaatcctggtcggcagccgcaga

SEQ ID NO: 45707 - DNA, 201 bp, Homo sapiens
agccccagagccagggccagcaggagtaggatggccaccacggtgcctaggatgtagaataaaagcagcttttgcccgtcagtgccatcgttgttttgtgyggccacggaggagtccccacctgcaggctcctgggggccagaggcagctgtggcgtgatggatgctgggctccctccagacgcctgaggacccactgggg

SEQ ID NO: 45708 - DNA, 201 bp, Homo sapiens
gccgaggctcattctcctccctctaatcaccccctcgccagttagccatggaatagaagaaaacagcttggggggtgcggggagggtcttctccagctgtmatgccagctaaggtgctttggtagcaaagctgggggtgaggaggcacaggctcctggacggagccaggctcctggacggaggccgctcagagtctctgcg

SEQ ID NO: 45709 - DNA, 201 bp, Homo sapiens
tctcaaaaatgaaattataataatttaaaaaggatacttgaataaccccaaagaaaacaggaaaagagaactgaaaggaagggaaggaggaggaggtggargaggaaggtaggaaaggtagaaaaagaaccgaataacaggcctaaccccaataaatgctgattctatctacgaatacttctaaaacaggccaaacaaatc

SEQ ID NO: 45710 - DNA, 201 bp, Homo sapiens
tcctggttacatgctctcactgcaaacctctcaaccttgctcctcttcctcccagaactgagcatagtggtaactttgtatatgtgaaattgatctcccarcagtaaactgtgagacagtcagagctggaaactcatccctcttgtctattgctggctccctagtgcctgctatagggagcaagtgatcagtaactacttg

SEQ ID NO: 45711 - DNA, 201 bp, Homo sapiens
caatacacacacacgcacacacgtgtgtgaacatgcatgcagactgagtgactgatgaactcttttaactgcattaggccttggggagctttgcccatctycccactgtagattcagcctcctggttacatgctctcactgcaaacctctcaaccttgctcctcttcctcccagaactgagcatagtggtaactttgtata

SEQ ID NO: 45712 - DNA, 201 bp, Homo sapiens
aaagaaaataaatatttgtgcacacagagatagcatgaaatcattctacagtgaaaataatagcctctggaaaaagctttgaaaatcagagatggtgccaycaccagacaacacaagtgctggggtacagggcagccctccatgcatctcatagcatttgcatggtttgtgagccccatttaatgacataaaatgagggca

SEQ ID NO: 45713 - DNA, 201 bp, Homo sapiens
aaatcagatttttttttttttttgaggcagtctcactctgttgctcaggctggagtggcacgatctcggctcactgcaacctccgcctcttgggttcaagmgattctcctgcctcagcctcccaagtagctgagattacaagcatgtactaccatgcccagctaattttttctatttttagtagagatggcatttcaccat

SEQ ID NO: 45714 - DNA, 201 bp, Homo sapiens
aaacacaagcaatccaagaaaatgtagataagttagacattatcaaaatttaaaacttttatgcttcaaaaaaaaaaggtggagacaagccacagaatggragaatggtaggagacatttacaaattatgtacctgataaggtctctctagaatatataaggaactacaagtcaataattaaagacaacaaacccaattaa

SEQ ID NO: 45715 - DNA, 201 bp, Homo sapiens
ccatctctaatttgttggcacccaccagggataccttgggcatctgaagtcagtctccatgtctgtgggtctcgtgtaaccataactacttggagtttttwaaaactgcattatttctttgttcctcagtgtctgacaatgcctgccaggatgggcactgatgaatatggttgaacggaactccaaggaccacccaggttg

SEQ ID NO: 45716 - DNA, 201 bp, Homo sapiens
cccagctacctgggaggctgaggcaggagaatcacttaatcccaggaggcagaggttgtggtgagccgagatcgcaccattgcactcagcctgggcaacargagtgaaactctgtctcaaaataaataaaaaaataaaaataaaaacaaaaaataaaaataaaaataaaaaaaccttctgcccagctcttgcctgcatctg

SEQ ID NO: 45717 - DNA, 201 bp, Homo sapiens
ttcaaaaccttctgcccaggccgggagcagtggctcacgcctgtaatcccagcactttgggaggccaagacgggtggatcacctgaggtcgggagtttgasaccagcctgaccaacatggagaaaccctatctctactaaaaatacaaaaaattagctgggcgtgatggcacatgtctgtaatcccagctacctgggaggc

SEQ ID NO: 45718 - DNA, 201 bp, Homo sapiens
gtacagcatgttactctactgatcagtagaggcaattgtaacacaatggtaagtattcatatatcttaacatctgaacatagaaaaagtatagtaaaaatmcagtattataatcttatgggatcatcttcatatacatggtttgtcattgattgaaatgtcattatgcagtgcatgactttatctgatgaagggctaatat

SEQ ID NO: 45719 - DNA, 201 bp, Homo sapiens
gtaactacttgatcccagccatacatgggaatcacctggggtgggggacaaaccatagtaccaagccccattctggaccaactatatcagacttgctgtgrgtgaggcgcacgcgcacacacacacacacacacacacaggtgattcttacaccagctctgagaagcactgaggttgggaagtgagaggtggagagcttgc

SEQ ID NO: 45720 - DNA, 201 bp, Homo sapiens
attcttcttcagatccttctttttagctagatctacaatggcattccttttcccaggaatgcgattcccaggctggccaaactcatgttgccatgtattamcccccaaggcaaatagcaaagtttcctttgaagacaataaatacatagtccatgggctggacaactggaggtgttttggaaagttctttttattttcagc

SEQ ID NO: 45721 - DNA, 201 bp, Homo sapiens
catgttgaaatagaagcctgatcatttgttttcccataagcacacacaccacagtgaaatgctgctggggcttgccattgatcataggataaaaatcagatttttttttttttttgaggcagtctcactctgttgctcaggctggagtggcacgatctcggctcactgcaacctccgcctcttgggttcaagcgattctcc

SEQ ID NO: 45722 - DNA, 201 bp, Homo sapiens
cagatattccaggtggtggctcagaacagctgacaaccatacctggggaagactggcctttatttttctggttgttcatactccaacagctagcaccgtaygttggggtccaatgaagcgagcagcagtagatggcatggccagggcaaggcagacacgctggagcagtcgggaaacctggcatctacacccatgcactgg

SEQ ID NO: 45723 - DNA, 201 bp, Homo sapiens
tctcattcttaattgtttgagcagttatactttggttgttacttgcagccaaaagcattttctccagacttctgagtcctaaaaatttcattctttgacayaagagctgacccagaggccctgaagcccctctcaggcctgcagagctttggtctgtttgctgaatcagattcatatctacacaacagttctagggccaaa

SEQ ID NO: 45724 - DNA, 201 bp, Homo sapiens
gtttcccaagcaggtttcccaaggggacttctcactggtgggtttagagcaaacagacacgggctccgtggggtccctgtggctgagaggtgggcatggcrgcatgtctgggaagtccctgtggggtgtggagtcactgagaccatcaaatgggctgtatctgcctgtcccacagggaaatggtcaccaggaggtgggtgt

SEQ ID NO: 45725 - DNA, 201 bp, Homo sapiens
atcaagacagccacttcctaagagatccctgatgggaggagagttgggttggggtgtgggtcaggggagatgcaggaggcagcacaagaagacacaggaarcaacacaagcaccgtgtcacttacagatcccagggagagggcagtgcaccccacggggccagcaaaaagtggggagctgtctgggtcacaaacactcacc

SEQ ID NO: 45726 - DNA, 201 bp, Homo sapiens
aaacaaatcatttcaatcctaatcagcatgagcaactcaccttttcctcttagatggtggaagtgagcagagaagatattcaggggagccccttagccccrgcctcctcacaccctgatccggaattggtcacattggaatttgaaaagggagggggagtaacaatcattatagagtcacgaaatccccaccgtggcacgc

SEQ ID NO: 45727 - DNA, 201 bp, Homo sapiens
aactggcaagagtattaaccctgcaccttgtggcccttcaaccgctccagagtgtcacctcagagaccgatgcattgctaaggcaaaaccagaaacacccyttctctgaggctttggggccttggagggagacacatttcctctgtctgttctcctgcacagtggtggtaaaaagcccacaggagacatgaggcctcccag

SEQ ID NO: 45728 - DNA, 201 bp, Homo sapiens
ccctgcccctttagttttctattaaaaacaatctgaaccatagcatctatatttcaaaactggcaagagtattaaccctgcaccttgtggcccttcaaccrctccagagtgtcacctcagagaccgatgcattgctaaggcaaaaccagaaacaccctttctctgaggctttggggccttggagggagacacatttcctct

SEQ ID NO: 45729 - DNA, 201 bp, Homo sapiens
tgctcccaaccctcacccccactctcacataaccattgaactaccatccatcactgcggattagttttacctcttctagaatgtcatagaaatggaatcakgcagtgtccagctaattttgttcctttgtgtctggctttcttgctcattgtgtatttcagacgcctgctccttttccttgataagggatatcccattgtg

SEQ ID NO: 45730 - DNA, 201 bp, Homo sapiens
cgatagaccagtagccccagagccagggccagcaggagtaggatggccaccacggtgcctaggatgtagaataaaagcagcttttgcccgtcagtgccatygttgttttgtgtggccacggaggagtccccacctgcaggctcctgggggccagaggcagctgtggcgtgatggatgctgggctccctccagacgcctgag

SEQ ID NO: 45731 - DNA, 201 bp, Homo sapiens
gacttacaattgtttgctaagattccagtccagtctttcaaaaaaatgtgggtgcccctttggaatggggagttcaaagctctgaggatggtggctggtgwctctagtgtctctagggccacctcactttcagcagtctgtcccaggtgtcggactatgggaaacaaaacagacagcgttggaagccatggcgcctctgtg

SEQ ID NO: 45732 - DNA, 201 bp, Homo sapiens
gattcccatagacaggtcgttctctcagctctttagtactcaccactccctccctgccctgtacctaatcatgcatataccacactttttgctgcacttakactccagattcccacacatttttgtatccccttacacctaacagcacgctttgtaactagacagtgcccagagcttattggagcacctgtggtagatgtt

SEQ ID NO: 45733 - DNA, 201 bp, Homo sapiens
agagtgtggactttggagccgacttggctgcactggagacccagctccggcattcacaagtttttgtttattgttaagatttgactaataacccctccccrtgtagctcagtttccttgactgtgtaatgggaatagtccctccttcaaagtgttaggatgaagattaaatgggttatacatgtaaagcatttagaacaga

SEQ ID NO: 45734 - DNA, 201 bp, Homo sapiens
cagctccggcattcacaagtttttgtttattgttaagatttgactaataacccctccccgtgtagctcagtttccttgactgtgtaatgggaatagtcccwccttcaaagtgttaggatgaagattaaatgggttatacatgtaaagcatttagaacagaggagccgtagtcagctctcaataaattttagcaaaaaagaa

SEQ ID NO: 45735 - DNA, 201 bp, Homo sapiens
ctcacttcctcccccagtccaccatccgtccagtgatccacgacgtgcaggcggcatccttcctcccaccttcccagcctctagggatgatctggctccawgccctgggccagtcctctttttccccgcccatgccccacctccaccgcctctcacatgggtgggcacagcactggtgtcctgaccagcccctggctccag

SEQ ID NO: 45736 - DNA, 201 bp, Homo sapiens
gcctgtccacatcaggcctgtcctttcatctcccaatcagagcacccagctgtccactatttcccagaacatctcagagtcaccaagacccaaactactcycacttcctcccccagtccaccatccgtccagtgatccacgacgtgcaggcggcatccttcctcccaccttcccagcctctagggatgatctggctccatg

SEQ ID NO: 45737 - DNA, 201 bp, Homo sapiens
acacagtgttttaaatatttcagtgaattgtgcatatttaagaaatgtgagattttacagaaagatttgcatttctggcttttctaaaaaaaaaaaaaaaatcaaagtgtcttgcaatgctggcaaccagcccaacgtggcaatcagtgcctgcattagcttcctccttagtgccgccaggctggctcctgcagccctggg

SEQ ID NO: 45738 - DNA, 201 bp, Homo sapiens
tggcgcagggcttgcaggctcacttcccccggctcaggattcctagcaagggccggaaatctgggcagggagcgggaatcgaagcccgggcaggccctccygcgacaccgcgactcggcaaaagccagggactcacagtgtgcttttcctgcagccacagacctttgctcattggttgggatcccccaggaggggaccctg

SEQ ID NO: 45739 - DNA, 201 bp, Homo sapiens
ctactcgggaggctgacgcaggagaatggcgtgaacccaggaggcagaggttgcagtgagccaagactgtgccactgcactccagcctgggcgacagagcragactccgtctcaaaaaaaaaaaaagaaagaaagaaatacttttggactaaggcttcccctgtgtgatgggtactacataaattaataaacttctgcttg

SEQ ID NO: 45740 - DNA, 201 bp, Homo sapiens
cgggcgtggtggcgggtgcctgtagtcccagctactcgggaggctgacgcaggagaatggcgtgaacccaggaggcagaggttgcagtgagccaagactgygccactgcactccagcctgggcgacagagcaagactccgtctcaaaaaaaaaaaaagaaagaaagaaatacttttggactaaggcttcccctgtgtgatg

SEQ ID NO: 45741 - DNA, 201 bp, Homo sapiens
ctctttgctgaaatactatttaaccaaggacccctaagccattgccttcagaaatacttttggactggccgggcacggtggctcgcgcctgtaatcccagyactttgggaggcagaggcgggctgatcacgaggtcaggagatcgagaccatcctggctaacacaatgaaaccccgtctctattaaaaacacagaaaatta

SEQ ID NO: 45742 - DNA, 201 bp, Homo sapiens
tcttggtttgagttgtggaaggacagataaacaaaagtgcctgctaagacccagatatctggaggaattctgtggatgccctagagcaaggttgacgtgcygtgtctgtcaagggcaagagagtaaacatttcagctgcaggcctttcagcctctgtcataaccactgaactctgcctttgttgtgtgaaagcagcaagcc

SEQ ID NO: 45743 - DNA, 201 bp, Homo sapiens
ttacacaagcatggatggcatagcctactacacacctaggctatgtggtatggcctattgctcctaagttacgaacctgtacagcatgttactctactgawcagtagaggcaattgtaacacaatggtaagtattcatatatcttaacatctgaacatagaaaaagtatagtaaaaatacagtattataatcttatgggat

SEQ ID NO: 45744 - DNA, 201 bp, Homo sapiens
aggactgaaaactgcagactagctactctagacttctggtggctgagaacaagcctgcaggatggcttgacagctctgggtaaactgtctgagaacatcttcagcttgggcagaacagccttccaggaatgaagatgtcacagagagcagggtgctggagagggctttactctgaagtaggggcggccaatatttgatccc

SEQ ID NO: 45745 - DNA, 201 bp, Homo sapiens
aacatatttagatataagcaggaccagaataacatacctagaacagatactgattttcttgcattcatgtaataatcatttaaaattcatatctgctttaygcgaatagatataaacatagagctaagtgctcctacaagatgaatttttagtaggctaaacagcacagctaaagtctcttatgaacctcatttccccaac

SEQ ID NO: 45746 - DNA, 201 bp, Homo sapiens
gtgccgtaggtgatcgagacggcggcagccgcggcgccgggctccacagccagtggcctgcaggtggctgggaagtggaactcgcagaggaagccatcggscttcacttcgcactgctgctcctcccagatcggctcgctgggcacagtggcctcagcagcggagacagcgacgcacaacgggccgcagaggggagcccca

SEQ ID NO: 45747 - DNA, 201 bp, Homo sapiens
cctcggccgctgtttggctgacggcagcacacaagcccttccttactgaagacagcactcgcttcccagcccagagagggcatcagcaggcacaagagacrtctggaagggggctttactatcttcccagatcttcctgccttttaaaagacaagaactgctctcctctttgttttgtcactacataggatttatggctct

SEQ ID NO: 45748 - DNA, 201 bp, Homo sapiens
tttttcatgttgagcagtagaatataagagatgataatgaggaaatggaaattaaagacgtgtgcgtgtgccactccctgcagattcggtttataccatgsctccaggagtcacagagcgttggacacagcaggatgggtggtctgatcccagctatttgcagcccacacagtgatcaggggattctttattggtcacttt

SEQ ID NO: 45749 - DNA, 201 bp, Homo sapiens
gattccagtccagtctttcaaaaaaatgtgggtgcccctttggaatggggagttcaaagctctgaggatggtggctggtgactctagtgtctctagggccmcctcactttcagcagtctgtcccaggtgtcggactatgggaaacaaaacagacagcgttggaagccatggcgcctctgtgcctgcacgtccccaccttgg

SEQ ID NO: 45750 - DNA, 201 bp, Homo sapiens
tatgaaaacttcctctacttcaaaaaagatatatatagagaagaaaaaaacccaaccactaagaagcattgtattcaaatgcaagagacaatggtgggaaragccctctttgtcttgtttctgtccattgtggatgtttcttgtcactgttgtggaattatggtgagtgaaagagagggcgttaagaaggaagagaagaga

SEQ ID NO: 45751 - DNA, 201 bp, Homo sapiens
agagtttaattggtatatgaccttctagggacatttgactggcaagggaagaatgcttgaagtgagcatgtgtacaactccagtaaacaaactgtgctggyaggccactgagcatgtggacagcccatcccaagggaagaatcaggggagaaaggatgcaagaccccagaagtatgccaacacataaaaccccaagtgaaa

SEQ ID NO: 45752 - DNA, 201 bp, Homo sapiens
agcggctgggacaggtccagcagcagagacacacagcgcttggagatgcacgagttccggagctccttgtgccagttagagtaaggcgtgtcctccccccygcccacccagctgaagcccttcagcggcagactagggtccaggcacttgcccttctctcgctggagcccaatccagaacttgctcatcctcgccgtcagg

SEQ ID NO: 45753 - DNA, 201 bp, Homo sapiens
aatgacagagtttaattggtatatgaccttctagggacatttgactggcaagggaagaatgcttgaagtgagcatgtgtacaactccagtaaacaaactgwgctggtaggccactgagcatgtggacagcccatcccaagggaagaatcaggggagaaaggatgcaagaccccagaagtatgccaacacataaaaccccaa

SEQ ID NO: 45754 - DNA, 201 bp, Homo sapiens
agctagtaagtggtgaaacaaagattcaccggcctgtggtaaggatgaaagaattacaatgtggagtatgtctgagcccccattttgccacatactggcckacttggctaagttatttcaatctctggtgttctttcccaaaaactggagatataatatctaatatgtaggattagtgtaaaataaaactctttcccaaaa

SEQ ID NO: 45755 - DNA, 201 bp, Homo sapiens
ttttcttttgtgtgtgtgtgcagaaatggggtctcactatgttgtccaggctagtctggaactcctgggctcagacaatcctccacctcagcctccaaaastgctgagatcacatgcatgagccactatgcccagccaagcccagctttttagatgggagtttctgcttgatgtctgtggaggaggctggaccaactacct

SEQ ID NO: 45756 - DNA, 201 bp, Homo sapiens
tgaaaacaattccatttataatagcatcaaaaagaataacatacttgaggataaatttaacaaaagaaatgcaaaacatttgctcttaaaactacaaaacrttgctgaaagaaactttaaaaggcttaaataaatggaaagacaccctacgttcatggattggaagacttaatatgattaaggtggaaatatccccacaat

SEQ ID NO: 45757 - DNA, 201 bp, Homo sapiens
actacaaaacgttgctgaaagaaactttaaaaggcttaaataaatggaaagacaccctacgttcatggattggaagacttaatatgattaaggtggaaatwtccccacaatttatctacaaattagatgcaatctctatcaaaatctccgcttttttctttgcagaaatttacatattgatcctagcattcacatggaagt

SEQ ID NO: 45758 - DNA, 201 bp, Homo sapiens
ccaaggcaattgaaagaatagtctcttccacaaatgattctggaacaactgcatatctacatgtggtagggtgggacctctacctcacatcaaataaaaarttaaagaaaaatggtcaaaacacttaaatgtaagattaaaactagaaaatccttagaagaaaatataggtgtaaatctttgtggccttcaataaggcact

SEQ ID NO: 45759 - DNA, 201 bp, Homo sapiens
gcttattgtatgaggaaggatagaatacctatagctgtctaccttgacacagaactttggatctatcatctattggatttccatggagccaaaggaagctygggaatgcccagtgatctattcagggtcagtcatccagggtggcctactttgagagcaaagagaattttgtgtctagcagattcatgggacactaccttg

SEQ ID NO: 45760 - DNA, 201 bp, Homo sapiens
tatcccctcctctcaagaggtgttttctgagaaaagtggaggaccacagaaaatagcaagagagccccagaggctgcctgctgggcaatgtctctttctgraacatgtatctggctggacctggtaatctctgctcaggccaataggtggtgagcaagagatgaacaggcatttgggccatgggtcctctggcagttggtt

SEQ ID NO: 45761 - DNA, 201 bp, Homo sapiens
agggcagtgggacgcattgtctgttctccatagacaatagggcagactgcttcctccttgggactggtagttacgtttatgtttctgacaaccagctggcyactgaagaagcgtggagccaacagctgcaagggataattttggcagcatcacccacggtgcaaatttaaaactccagctggttctactgcaagcagaata

SEQ ID NO: 45762 - DNA, 201 bp, Homo sapiens
ccagccctgtgggttttagcaagctctccagggcattctgatgcacaggtttgagaaacaactggctcattgtatgtgaggcatgaatgaagtggcctccsaggctctgctcacatcctcactaccctcatctcttcctcctgggctttccaccttgggtcctggctctaccaactcttccttggatcctgaatctacagt

SEQ ID NO: 45763 - DNA, 201 bp, Homo sapiens
cgccaaaagcgccaccaccaggcacaggctcgcgatggagatgcctatgagcaagcccgaatgcacgagccccacggccggaggagtcaaggtggagccgrgcgtcgggctgggcgggggctcgccagagccgctgtcgccaccgtccaccttgccggagtcacagtcggtgccaatgtggcgggcaagggccgagtcggg

SEQ ID NO: 45764 - DNA, 201 bp, Homo sapiens
accaccaggaatgtcagacaaccatcagatgatggtcaggcagttgttaactgtctttctaaaataatttgttgcagccagtgccagggaaagcagtctcsctatcaatagaagaaacctcaaactggggatcagcagcttccagataagatctcaggagctgggtaagtgggctcaagcttgtgcattaagatgcaaaat

SEQ ID NO: 45765 - DNA, 201 bp, Homo sapiens
ttgaggaaggtcgcggggcccgggtagagcgcgaagcagtcgtgctcgacgcactggctgccacccggctgcggctctgcgggtgcggggaaccccaggcyggccagggccagcgcgccaaggaccaggaccccaagcatgttacccaggcgcgccgcgtgcaggcgccggggaaagcgcgggcactgcgacagggccgtg

SEQ ID NO: 45766 - DNA, 201 bp, Homo sapiens
aggcacaggctcgcgatggagatgcctatgagcaagcccgaatgcacgagccccacggccggaggagtcaaggtggagccgggcgtcgggctgggcggggrctcgccagagccgctgtcgccaccgtccaccttgccggagtcacagtcggtgccaatgtggcgggcaagggccgagtcgggcccgcagatgcactcgaag

SEQ ID NO: 45767 - DNA, 201 bp, Homo sapiens
acttatggtataggagatatatatatataattgttacagtaggtagctagtcaggcctgagcatggcaggagagggctcctccaccaccaggaatgtcagrcaaccatcagatgatggtcaggcagttgttaactgtctttctaaaataatttgttgcagccagtgccagggaaagcagtctccctatcaatagaagaaac

SEQ ID NO: 45768 - DNA, 201 bp, Homo sapiens
caatctgaagacaatcaagtccagactggatgtcagggtcccaggggtcatgtggtggatgattagagaccagagtttggaggagttatgccaaatccccrgaagcatggaaatcccccacctctgccgaatgttactggattgtgagctccctgccctgcagctggtcagtgaggctcccacaaatcagtactgacaaat

SEQ ID NO: 45769 - DNA, 201 bp, Homo sapiens
aaggagccaggagtgatggggagccagtagtgatgggggagccagaagtgatgggggaggagccaggagtgatgggggaggagccaggagtgttgggggarccaggagtgatgagggaggagccaggagtgatggggagccagtagtgatgggggagctaggagtgatgagggaggagccaggagtgatggaggagctagg

SEQ ID NO: 45770 - DNA, 201 bp, Homo sapiens
cttttgtgggttacatcagtttccagcaggcacatggctattagggggactcagcctcttggggataaaaagcaaagcaacttggagagttcatggcgccrtggggctgcaggaaggaaggtagccctagccttcagccccagaactggctgcaggtgaacaatctgaagacaatcaagtccagactggatgtcagggtcc

SEQ ID NO: 45771 - DNA, 201 bp, Homo sapiens
ccagggcattctgatgcacaggtttgagaaacaactggctcattgtatgtgaggcatgaatgaagtggcctcccaggctctgctcacatcctcactacccycatctcttcctcctgggctttccaccttgggtcctggctctaccaactcttccttggatcctgaatctacagtttctacctgcatgggcacaagtatcac

SEQ ID NO: 45772 - DNA, 201 bp, Homo sapiens
acaggagaccagccgcagaccatatataaacgaatggatgtggctgtggtccaataaaactttgtttacagactttgaaattttcataattttacatgccrtgaaatatttttcttcttttgatttttttctgaccattaaaaaaatgcaaaaaagccatttttagctcacgcaccatacagaaacaggcagtgggccaga

SEQ ID NO: 45773 - DNA, 201 bp, Homo sapiens
ctttgaaattttcataattttacatgccatgaaatatttttcttcttttgatttttttctgaccattaaaaaaatgcaaaaaagccatttttagctcacgmaccatacagaaacaggcagtgggccagagtgggcctgcaggccatagttttccaaaccctgccctacaaacattaataaagaaaaaaacttagaagatgc

SEQ ID NO: 45774 - DNA, 201 bp, Homo sapiens; identical to SEQ ID NO: 12219

SEQ ID NO: 45775 - DNA, 201 bp, Homo sapiens
atagcctatgcatcttctatcgaaagtcatgacagttcttcaaatgaaagttagctgggaactatccaggattctccctataccaagcttgtccaacctayagctcaagggcccatgaggcccaggatggctttgaatgcagtccaacacaaattcataaactttctcaaaacactatgagatttttttggtgattttttt

SEQ ID NO: 45776 - DNA, 201 bp, Homo sapiens
cctgaactgtgagaagccaagtcctgtgttttagatacaataccatctgaattctgctctcactgctggcccatgttctgtggcttcagccgagtaattcmactctccagggctctttgtcatccatctgtgagagccagtccgggcagagaaggagaggagcagggcaagctgagaatgcagcccatgatgccgccccga

SEQ ID NO: 45777 - DNA, 201 bp, Homo sapiens
caggatgaaggtaaatcctgcatagaaatcttgtaattccagaattagtcaaacaaatttgaaatacacacatttaaaaatacttacattctcatttagcrttcatgaagtgattactgacatttacaattacatctgacatcacagagcaagcctttgcagggatctaattcaagcttaagccaaatctatgcaaagaac

SEQ ID NO: 45778 - DNA, 201 bp, Homo sapiens
tgatgtaattttttttccctgatcctttgatgtgggaacatgagaactcattaaggcagcaatttatactgtggtggtgagtgagagaggagccatgggcrggaaaagctgaccagagagcagcgagggatgggaaccagcccaggttttggatagaggaagcagcttcatcaccaccccctattttagaatgtcatcttt

SEQ ID NO: 45779 - DNA, 201 bp, Homo sapiens
cccacctggcttcaaccccaggaatgcgtccagcgtgatccagggcctgcagaacaggtgctggttctccctccccgtctacagctctggggatcggaggsgggggggcaattgtccagcccccaggcaacaggggaagggccttggccaacatctgggtgccagcagggcaggggtggggctctgaggggataagggctt

SEQ ID NO: 45780 - DNA, 201 bp, Homo sapiens
agtagtcctggagaggtggcctctgcgatgtgcccgcaggggcagcgtcctgcagatggtcctgcccctcctccccctaacctgtctgcaggcactgtccwcctggaccctgccccatgtgcaggagctggaccctgaggtcccttcccccttggccaggactggagaccctgtcccctctgtgggaatccctgcccacct

SEQ ID NO: 45781 - DNA, 201 bp, Homo sapiens
atctcaccccccacaccagagttcaccgttcctcgtggtaatgtgttgttaccgtcgagtcagagagtagtcctggagaggtggcctctgcgatgtgcccrcaggggcagcgtcctgcagatggtcctgcccctcctccccctaacctgtctgcaggcactgtccacctggaccctgccccatgtgcaggagctggaccct

SEQ ID NO: 45782 - DNA, 201 bp, Homo sapiens
tgttgttaccgtcgagtcagagagtagtcctggagaggtggcctctgcgatgtgcccgcaggggcagcgtcctgcagatggtcctgcccctcctccccctracctgtctgcaggcactgtccacctggaccctgccccatgtgcaggagctggaccctgaggtcccttcccccttggccaggactggagaccctgtcccct

SEQ ID NO: 45783 - DNA, 201 bp, Homo sapiens
ctgcgatgtgcccgcaggggcagcgtcctgcagatggtcctgcccctcctccccctaacctgtctgcaggcactgtccacctggaccctgccccatgtgcyggagctggaccctgaggtcccttcccccttggccaggactggagaccctgtcccctctgtgggaatccctgcccaccttcctctgggagtgggcactgga

SEQ ID NO: 45784 - DNA, 201 bp, Homo sapiens
ctggttttctggaaccccacgccaaggatcctgaatgccttctcagccagcgcttctgccctggcctcccccaagtcagtatgtgattctacaacctcacrtcaagtgggtcctgcattgcattcccacagctgcttggcgcctgttctcaccacttctccaatcctcttcctaggattgcctccaagaggaccccatatc

SEQ ID NO: 45785 - DNA, 201 bp, Homo sapiens
gcgatgtgcccgcaggggcagcgtcctgcagatggtcctgcccctcctccccctaacctgtctgcaggcactgtccacctggaccctgccccatgtgcagmagctggaccctgaggtcccttcccccttggccaggactggagaccctgtcccctctgtgggaatccctgcccaccttcctctgggagtgggcactggagg

SEQ ID NO: 45786 - DNA, 201 bp, Homo sapiens
ccccccgataagaccttcccctccaacaccccaccctcatccctctggcccacagtctatcctagtccggggtgccccggctcttatctatcttgcgcggscccaccctaaacttccacccccgctcctccatgttgtcatagtgctcactcccacaccagattcctgctcctcccaggaagcctcagtactttctcctct

SEQ ID NO: 45787 - DNA, 201 bp, Homo sapiens
ttttctcccgggttcgtagtctcatttccagatgatctccagtgtgtggacctcaaaatcctgcctaatgatgagtgcaaaaaagcccacgtccagaaggwgacagacttcatgctgtgtgtcggacacctggaaggtggcaaagacacctgtgtggtgaggcagccctgcccccagggtctggaagggctgagggagggg

SEQ ID NO: 45788 - DNA, 201 bp, Homo sapiens; identical to SEQ ID NO: 12250

SEQ ID NO: 45789 - DNA, 201 bp, Homo sapiens
ccaactcacataaccctggatgagggattctcctggcatatgctggcctctgggccacagaggtaatcatgtgattctggctgagccaatcacagtacccyagctgcagaccctgcaattggcccaaagatggacacatgaccaaagcccaaccaatcaagctctgccccaagactttttattaggaagctgtcaaggaaa

SEQ ID NO: 45790 - DNA, 201 bp, Homo sapiens
gtatttttagtagagacatggtttcaccatgttggccaggctggtctcaaactcctgacctcaggtgatcggcttcccaaagtgctgggattacaagcgtsagccactgagcccagcctcgatcatttctagaaccacccccacagacacccctggtcaccctacttgaactcctaaaaggtgtctcataacaactcatgt

SEQ ID NO: 45791 - DNA, 201 bp, Homo sapiens
tttccctagcctaggagccccttagccctccagattcttcctcagtgagcctctgatcctgtcccacccttggcgccttgatccctggtttccagaatccytttccactcccctaacccaccacctcccatcccccagccccagaccccaaatgacctgacgcccagatgcagtgtctgctccagacactgtctcctgtct

SEQ ID NO: 45792 - DNA, 201 bp, Homo sapiens; identical to SEQ ID NO: 12252

SEQ ID NO: 45793 - DNA, 201 bp, Homo sapiens
gggcgggaggaggactcagcacagggccacggccagtaacatgaagcccttgctcatatggatgagaactggggagagggggacaggggccccagagtcamccccagatacccctcttggtcaccctccaaagtcatctctgctgatacccacaagcagcccaacagacaaccccaaagtctggcacatcctcaaaatcac

SEQ ID NO: 45794 - DNA, 201 bp, Homo sapiens; identical to SEQ ID NO: 12245

SEQ ID NO: 45795 - DNA, 201 bp, Homo sapiens; identical to SEQ ID NO: 12246

SEQ ID NO: 45796 - DNA, 201 bp, Homo sapiens
aggggcctggggtctgggaggagggcatctatgctgccacaggattgacaggccagtggcattccccttggataacctcaggcaagactggggggctgagscagagaggaaggctctggcgcaggtcgcctggcagggcagagctgggctggacacccctctccaaggctgcctgggtctcttgggatctggttctgcttg

SEQ ID NO: 45797 - DNA, 201 bp, Homo sapiens
acatgagcctcctggagaaccacacccgccaagcagacgaggactacagccacgacctcatgctgctccgcctgacagagcctgctgataccatcacagaygctgtgaaggtcgtggagttgcccaccgaggaacccgaagtggggagcacctgtttggcttccggctggggcagcatcgaaccagagaattgtatgtggg

SEQ ID NO: 45798 - DNA, 201 bp, Homo sapiens
tgtcctccagaccctgacatctggtctccccagtccttccagggtcccccaaatttcaccagaaaaccctgcttcccaaactggcatgtgggatcccccayctggtatgggggggggtctgcaaatgtcccttcccacccagcacccccagctctcccaggaaaaacaccacaccctcccaccacatgctcctttccttgg

SEQ ID NO: 45799 - DNA, 201 bp, Homo sapiens
ggtgaggtcgggctgcagccctttttctcccgggttcgtagtctcatttccagatgatctccagtgtgtggacctcaaaatcctgcctaatgatgagtgcraaaaagcccacgtccagaaggtgacagacttcatgctgtgtgtcggacacctggaaggtggcaaagacacctgtgtggtgaggcagccctgcccccaggg

SEQ ID NO: 45800 - DNA, 201 bp, Homo sapiens
cttcccaaactggcatgtgggatcccccatctggtatgggggggggtctgcaaatgtcccttcccacccagcacccccagctctcccaggaaaaacaccamaccctcccaccacatgctcctttccttggggaagttccatcccgccccaggccccagcccttctctgcctgaattgttcctacacagctctggttttctg

SEQ ID NO: 45801 - DNA, 201 bp, Homo sapiens
ccacatgctcctttccttggggaagttccatcccgccccaggccccagcccttctctgcctgaattgttcctacacagctctggttttctggaaccccacsccaaggatcctgaatgccttctcagccagcgcttctgccctggcctcccccaagtcagtatgtgattctacaacctcacatcaagtgggtcctgcattgc

SEQ ID NO: 45802 - DNA, 201 bp, Homo sapiens
tcaccctgtccgagaaggactgccactcacgcctccctcctcctgagccccgtcccagtcctgaccgcaactgtgttctcagggccccaacctcccctcakattgccattcctggttcacaggaaggaccccaaaacctctcggaagcccacctctagccttaaccatagccctttcttttaccctttaaccaggaagccc

SEQ ID NO: 45803 - DNA, 201 bp, Homo sapiens
cagagacatgctaagacagaggccccgaggggagcagcacggaagtctagatacacctccagaaagccagagagcagggctggggttagggagggcccccrccccccaagccaacacctaccaatgccgaggcagaggaaactgaagacaaagtcggccatgttcaggcggaggaccactggccaggaggagagggccatg

SEQ ID NO: 45804 - DNA, 201 bp, Homo sapiens
accctttaaccaggaagccctgaaatctaactgtcccagccaagctggccccttccaaccccaatgtagggaccccaagtcacccccaaactcttcagtcsagatgctcttctttacctctcagacctggttccctaaagctgcatcctttcctgaacctcaaaagcccaacccaggtcctgtttccctagcctaggagcc

SEQ ID NO: 45805 - DNA, 201 bp, Homo sapiens
ccaagcagacgaggactacagccacgacctcatgctgctccgcctgacagagcctgctgataccatcacagacgctgtgaaggtcgtggagttgcccaccsaggaacccgaagtggggagcacctgtttggcttccggctggggcagcatcgaaccagagaattgtatgtgggggcagactgtgtagcccaaggcggggat

SEQ ID NO: 45806 - DNA, 201 bp, Homo sapiens
gtgcaccccactcccagccatggcaagtggctctctacgagcgtggacgctttaactgtggcgcttccctcatctccccacactgggtgctgtctgcggcmcactgccaaagccggtatgaaggcaggggctcagggtcctgagggagcctggttcggggggaagagctcctagatttgggggaagacggaggcagacgcc

SEQ ID NO: 45807 - DNA, 201 bp, Homo sapiens
gtggggagcacctgtttggcttccggctggggcagcatcgaaccagagaattgtatgtgggggcagactgtgtagcccaaggcggggatggggactcctgygtccaagggagaaagggccagggaagcaggtgaggtcgggctgcagccctttttctcccgggttcgtagtctcatttccagatgatctccagtgtgtgga

SEQ ID NO: 45808 - DNA, 201 bp, Homo sapiens
ggcttcaaccccaggaatgcgtccagcgtgatccagggcctgcagaacaggtgctggttctccctccccgtctacagctctggggatcggaggggggggggcaattgtccagcccccaggcaacaggggaagggccttggccaacatctgggtgccagcagggcaggggtggggctctgaggggataagggcttttaaaag

SEQ ID NO: 45809 - DNA, 201 bp, Homo sapiens
ttttctatgcatattactattaaagctaagactgtctagaatttctaaacaacaacaacaacaacaaaaatctaacttaaaatttactttttgcagtattrcaaaatgaatcctaaattattggcttaatcacctgtgttaaagaagtttcaatgcagaaactagacaaaacaactaacaaaatcatcatgtcctttatta

SEQ ID NO: 45810 - DNA, 201 bp, Homo sapiens
ataatgagatttttcattactgtgaatttcacatttcatgtatgctgatagattataagagcaatgttttttaggggcttgaacaagaaattagttccccrcctcagctaaatttcaagtcaatttgtctgttaacacatccctttcagatttcctctctcgctcatgcactacagtcatggaggattttattttttatct

SEQ ID NO: 45811 - DNA, 201 bp, Homo sapiens
cagctggtggggagcctgagaatggagaaatagtttcctgtggaaacatgaagaagccaggaaaccctcacaaggagagaacatgggccagggcggagggkaggctggtgcccacggccccggccctggaccgtgggagcagtcagggaagggagtggagtgagaggacagcaggtgggttgaaggctggtgaacttgctt

SEQ ID NO: 45812 - DNA, 201 bp, Homo sapiens
atcttgcaatgcagctatcagcaatgatgagcagagacacactgtcattgctgggctaggatcaggtgtcacggaattacgtattcgggtttccctcatgkctgagatgatattgagggaggcatcctatcatttattaccaaaaaatgactaataaactggtaacgagctcaatatgttgctacataaatgtacaaaaat

SEQ ID NO: 45813 - DNA, 201 bp, Homo sapiens
tttggttctgaagattccagaaactaacaactcagtctgtgatagaaattgcagcaggtgtgacctttaatccttgtctttggcagggagacaaaggattrcctggttcttctggagagaaagggaatcctggaagaagggtaggtgtatttccacggtggtgctattatggaaagaatatcaacatttcatttagggaat

SEQ ID NO: 45814 - DNA, 201 bp, Homo sapiens
taacgagctcaatatgttgctacataaatgtacaaaaatattttatggtggaagcaggcaagaacttgcttagaaagtccttctctagcttgaaagctgayaaatacatatctttagacgtttttaaaaaacatttacttaacttgtaattaatcaacaatttaagatggtatagatgcaaagctattcaaatagttatcc

SEQ ID NO: 45815 - DNA, 201 bp, Homo sapiens
gatttctttattgacgatttcagacctgagcctggggaagagggttgttgggaaagggggatgaaaggaagaattctacttttgaaattgctttaaaacaygttgataaaatatgtgctttgtctttttcttgcagtttgggggtttggggagatgtgttggttctcttgctaaccagataatcatttgcaagtcctgtta

SEQ ID NO: 45816 - DNA, 201 bp, Homo sapiens
agggattccagcctcccactccccatcctgtgccctcaatcctgtcttgcggtagggatgggaagctctcattctctctggaatgtcagtgggggcacagytcacctcacctgaaaattgagttgtcttaaactaaagggaaaagtttccgtgttgaaataaggttttagctcctatttagggagtgagagagacagaaag

SEQ ID NO: 45817 - DNA, 201 bp, Homo sapiens
tggtatagatgcaaagctattcaaatagttatccagtagctccagaaacatttattaatttgcactttttcaccatctcttttatgttatttgtgggttgsgtagactgtaccacattttaagagttaatttcatccatcagtttattcattcacctaacaggctttaacatgcccatatgtaccaggtgctcactgtgag

SEQ ID NO: 45818 - DNA, 201 bp, Homo sapiens
cacctggatgatgtattttaagaggtgttggttagggattccagcctcccactccccatcctgtgccctcaatcctgtcttgcggtagggatgggaagctstcattctctctggaatgtcagtgggggcacagttcacctcacctgaaaattgagttgtcttaaactaaagggaaaagtttccgtgttgaaataaggtttt

SEQ ID NO: 45819 - DNA, 201 bp, Homo sapiens
ccccgctgctgctgctgcaaaaccagtggcgaccaagcctgaggtccctaggccacaggcagccaaaccagctgccaccaagccagccaccactaagcccrtgggtaagaaagcccttgctagggctgccatcttgtgacatcctcatttcctgctccagggtgtgttcctcaaagcctgcatgtaacacactcagaatac

SEQ ID NO: 45820 - DNA, 201 bp, Homo sapiens
gtccttgctgccaggaggctccaaggacaacttctgatgtgttgtgttttaaaagaattatttctttaaaaattgtctttgtatttgagtgagtgttttcktttgatgactcagcagacatttctttctttcaaggtcaatttattttagatgaatttaaattagaaccaagtattaaataatctatttttcctttatagg

SEQ ID NO: 45821 - DNA, 201 bp, Homo sapiens
cctttcttctctttgcttcttttctagcttgctgttacggtaagttgattttggtgactttctcctaaggaaaggaagcctcccttttgtagtaagtacartttgtctttaaccctccaccctctactttccacagggcccctggagtgccccgtcttcccaacagaactagcctttgctttagacacctctgagggagtc

SEQ ID NO: 45822 - DNA, 201 bp, Homo sapiens
ggttgcttgtccctaaacttgaatttaagagacattttagctcccttaaagtgagagatttttcgtggtgatggagtcccttgggttagatcacttttacygtaccttccaactataggagccttaaattctccactttctgacacagttgaacaatgtttgttctgctccctctagggaaattcgggacctccagggata

SEQ ID NO: 45823 - DNA, 201 bp, Homo sapiens
tttttctttcatcctccttgggctgttctggctcccgaggctctgtcagccgtctccttaaacagcctcttctgcagagtctagagaaaatggtgcccagyggggacttggggtccaagtgcaggaaacatgactgaggcagtagtgtcccgggcgggcgcctcttccagaacgtgctcacctatctggccatcagcaacc

SEQ ID NO: 45824 - DNA, 201 bp, Homo sapiens
cactttctgacacagttgaacaatgtttgttctgctccctctagggaaattcgggacctccagggatagttggacagaagggagaccctggctacccaggmccagctgtaagtatttatccagttctgacccggccacctggggctgggtgctttacacgtggtccctgaaaacttcccaccatctgctttgctcacaaga

SEQ ID NO: 45825 - DNA, 201 bp, Homo sapiens
aaggtttgtctttagaaaggtagagctttcctgaggacagggaccagccaggcacacatgcccctctccctctttggtcagtctgtctgtccctcctcttyagtactactggttcccactccagcctcccctgttgatcgcggcttggccagtggaatcattgtcccccaacaatccccaccataattcccaccaccatcc

SEQ ID NO: 45826 - DNA, 201 bp, Homo sapiens; identical to SEQ ID NO: 12276

SEQ ID NO: 45827 - DNA, 201 bp, Homo sapiens
ccagatgcaggaaggcatttttcatctaggatccttgaatctttaagatttctgtttcccaaaacgaattaaaagcatgggttctaattaactctattaaraatttgatttcagagttttagaaaagtgggaaatgcttcatgcattgcaagctggaaaggactcaggtgggtctccctctccttgacccagagagcttgg

SEQ ID NO: 45828 - DNA, 201 bp, Homo sapiens
aaaagttccaaaataaaaggggtccctatattggtgtattagtttcccattgctgttataacaaagtaacacaaatttagtggccaaaaacaaaacaggcygggtgcggtggctcacacctgtaatcccagcactctgggaggccaaggcgggcccattgcctgaggtcaggagttggagaccagcctgaccaacatggtg

SEQ ID NO: 45829 - DNA, 201 bp, Homo sapiens
ttgctgtgactgcagatgttatcttgcaatgcagctatcagcaatgatgagcagagacacactgtcattgctgggctaggatcaggtgtcacggaattacrtattcgggtttccctcatgtctgagatgatattgagggaggcatcctatcatttattaccaaaaaatgactaataaactggtaacgagctcaatatgttg

SEQ ID NO: 45830 - DNA, 201 bp, Homo sapiens
aataggaagtcatgtgcatgttctatgaagactgacgggaggggtgggagtgggcaggactgtggcacccatgccgatgctgctgcctggcccatgtgccrtgtttcatgccctgctccatctcgggtgccaaccctaggagcaaagagggcagtgggggcatgtaacagagggctagctggggtgatgtggctgcaagaa

SEQ ID NO: 45831 - DNA, 201 bp, Homo sapiens
aaactgatcattccctttgccctgttttctcttttaggttcatatttggtgcttagacaaattcaaaatgaggaaacatcggcacttgcccttagtggccrtcttttgcctctttctctcaggctttcctacaactcatgcccagcagcagcaagcaggtaagagccagaaacgtccttgattttgtaaaaaggaatatca

SEQ ID NO: 45832 - DNA, 201 bp, Homo sapiens
tgtgtcatgctttggagggaagtgcagattctgcagattctgaacttcgtacacagatgagatgtgaacgcaaatgatccttgaaaaatgactatctggcytacgactagctgactctcaagatggggaaagagagcccatctcttcctactgcagacccttctgtctatcaccacttaagtccttcagctctttcttttg

SEQ ID NO: 45833 - DNA, 201 bp, Homo sapiens; identical to SEQ ID NO: 12288
  misc_feature (1)...(201): n = A,T,C or G, or insertion/deletion polymorphism (see Tables 1-2)

SEQ ID NO: 45834 - DNA, 201 bp, Homo sapiens
taagttgtttccatcttttggatattacaaataatgctgaaatgaacatgggtgtgcacatatatctttgagatcctgttttcacttcttttggatatacycaaaagtgggatagatgaattatatgataattctgttttcagttttttgaggaacattcatacgatggaggctagcctttccccactgtgtagctttgtt

SEQ ID NO: 45835 - DNA, 201 bp, Homo sapiens; identical to SEQ ID NO: 12292

SEQ ID NO: 45836 - DNA, 201 bp, Homo sapiens
acgtagcctaagattagcagcagagtccccgtgaaggaagtctccgtggggaaccagagtgacccttgccaagtggggcttctcagcagaatctgtgcctsttagatatttacggaaggtgcttgttaagccaaaggcttgtagaggtgggagtgtactgaagtccggtgcatcctgcaaagtgtgcaactgtcctgcaga

SEQ ID NO: 45837 - DNA, 201 bp, Homo sapiens; identical to SEQ ID NO: 12293

SEQ ID NO: 45838 - DNA, 201 bp, Homo sapiens; identical to SEQ ID NO: 12294

SEQ ID NO: 45839 - DNA, 201 bp, Homo sapiens
ctggccgaggaggtcacatctcagttcttatcgcttgtcagatccctgtgttcttctgtttctactggtgatttctgtccagtctcctcctcatcaccaggatgtagctttcctttcctgagttgtccatctacttctaaacagccccagtctgagctgtttagggcacagtgtcctcagcttttaatccctctcttctct

SEQ ID NO: 45840 - DNA, 201 bp, Homo sapiens; identical to SEQ ID NO: 12295

SEQ ID NO: 45841 - DNA, 201 bp, Homo sapiens
gttacaccagtaggcaactgtgttattgtattaaggacgttggtgcataacatgttacccttctcttagaacatagaccttgtcttgatgctacaggtgakcacccagatgaggcactgctgtcttcatttggcatgtatcagcgattctcaccccaggcatcacgctcccagcttctggtccaaacaactagaaatgaac

SEQ ID NO: 45842 - DNA, 201 bp, Homo sapiens
ccagagcctctcctttgattactgggcccattggccgttggcttgggatggtaactccgacatctgggttccgtttcctcccattaacccacttgtgactygcagcaactcaattgaaacctcccatcgataaaatgctagtggttgtgcaggtgctgccatctcatgtctctcctcccatcccaagttttttcttgaata

SEQ ID NO: 45843 - DNA, 201 bp, Homo sapiens
tttttatcttcacgctctgatctatctttcagttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacggaccgcgtcat

SEQ ID NO: 45844 - DNA, 201 bp, Homo sapiens
ttacaccagtaggcaactgtgttattgtattaaggacgttggtgcataacatgttacccttctcttagaacatagaccttgtcttgatgctacaggtgagyacccagatgaggcactgctgtcttcatttggcatgtatcagcgattctcaccccaggcatcacgctcccagcttctggtccaaacaactagaaatgaact

SEQ ID NO: 45845 - DNA, 201 bp, Homo sapiens
aaatatagtagtaacccactggaaaagtgaatcaaaactaaccacttggctgcccgggaaaagtgtgacccacacgtctcctggatgtcttaccccacggrccctcagtgagatcttctgttccaaagcttactgtgccacttctcggctttcttcccagggtaacccaggtgaacctgggctaaatggaacaacaggacc

SEQ ID NO: 45846 - DNA, 201 bp, Homo sapiens
tgattttccctggtaggtttggtagtggacaattcatgctactacttttccctccaaatttagtggaaatttctagaatatgtacccaagattgtcccctsagaaaagtgaatatgatgtttggaaatttaactatgaggatggcacaaatgaaaaattgctataaatgtcccttttttacaccatgatttctaagaggtt

SEQ ID NO: 45847 - DNA, 201 bp, Homo sapiens
gtccaccccccgacccctccactgcaaaacaaaaacaaaaacaaaaacaaaaatccttattatctgacagttttgaaggctggaaattggaaaccagtgtygctaagctaaaatcaaggtgtcaacaggctgtgttctttctgcaggttctaagggattcttcatctgctcaccttttccagcctccaggggctgcctgca

SEQ ID NO: 45848 - DNA, 201 bp, Homo sapiens
atagtagtaacccactggaaaagtgaatcaaaactaaccacttggctgcccgggaaaagtgtgacccacacgtctcctggatgtcttaccccacggaccckcagtgagatcttctgttccaaagcttactgtgccacttctcggctttcttcccagggtaacccaggtgaacctgggctaaatggaacaacaggacccaaa

SEQ ID NO: 45849 - DNA, 201 bp, Homo sapiens
cgtctcctggatgtcttaccccacggaccctcagtgagatcttctgttccaaagcttactgtgccacttctcggctttcttcccagggtaacccaggtgarcctgggctaaatggaacaacaggacccaaaggcatcagaggccgaagggtaagtttgcgtgggccttggctgcaggtgaggaatgagaacgtatgtctca

SEQ ID NO: 45850 - DNA, 201 bp, Homo sapiens
aagatattcccaatactgccctattgggaagttaatctattttattgatgtagctttgatttactcctctgccatattttcagatattactgatcatgtaygcccctaccaaaattgttcttttgtttaaaccagatcaataacacagcagtggggcatgcgcttgtcctgcctgcagggagagacctcacagacttcctg

SEQ ID NO: 45851 - DNA, 201 bp, Homo sapiens
ttggcatcacactgtaagccagccccaggccacagggtctcagccatgtttctcatgtctagggtgagcccggagagccaggaccaaaaggaggaatcggsaaccggggccctcgtggggagacggtaaggtcacagcgcgcttggggtcaggctgtcgctgactctttgctggaaggtgcaggaagccaggagagggttc

SEQ ID NO: 45852 - DNA, 201 bp, Homo sapiens; identical to SEQ ID NO: 12264

SEQ ID NO: 45853 - DNA, 201 bp, Homo sapiens; identical to SEQ ID NO: 12266

SEQ ID NO: 45854 - DNA, 201 bp, Homo sapiens
tggtgaggtgtgcatctgatcaaactcctctatttggtgttgggatctgtttcctttaaggaaagctccctgttggagagtgcgtgaactgagacgggagygagggcatctgtttttgtgtccagtggactagcagagagcttctctcttctactttacggagttaatttaagagtgttggtagaatcggaattacaagaa

SEQ ID NO: 45855 - DNA, 201 bp, Homo sapiens; identical to SEQ ID NO: 12268

SEQ ID NO: 45856 - DNA, 201 bp, Homo sapiens
gttcccaggtaagtgagtctaccttcctgtattatcagtgaggtgtgaagtgtttagtagcagtatagtgtaaaccaaatttgtttaggaaggctttgcaytgataggaagtaattgcttacatagtagaaaaatctaaaccaatgtctttttttaaagatgtcaaaaatggtgcggctgctgatataatatttctagtgg

SEQ ID NO: 45857 - DNA, 201 bp, Homo sapiens
tggacaaggcttgacatggtcccagctgctgtggttgggttgcatttggtgtaatttgggcaaagcccgttctctccataaactgaaactttcctctgagsttcttttaaacatgacttacaaacttaagctgggtgtcaaaacctgatgccttgtgcctatgagtgcttttactcctgacccatttccattctgctcttt

SEQ ID NO: 45858 - DNA, 201 bp, Homo sapiens
gagaatcagaatatcttggcattagtcttgggtcagccactcagttaactgggctaccctgagaaagacccttccttccctaaaatactctctcatctgtyaagtggaggtcataatacgtacttgtcctggtgtttatgagatttaaataaaatatgctgcaatcaaagtactctgtaagctgtgaaatgctataaccta

SEQ ID NO: 45859 - DNA, 201 bp, Homo sapiens
taaaagaattatttctttaaaaattgtctttgtatttgagtgagtgttttcgtttgatgactcagcagacatttctttctttcaaggtcaatttattttasatgaatttaaattagaaccaagtattaaataatctatttttcctttatagggagaaagaggattccctggatacccaggaccaaaggtaaataatccctg

SEQ ID NO: 45860 - DNA, 201 bp, Homo sapiens
cacatctctttcccactcttagggagatgacgggagagacggagttggcagtgaaggacgcagaggcaaaaaagtacgtatctgctgaggattatccaagygtccttgctgccaggaggctccaaggacaacttctgatgtgttgtgttttaaaagaattatttctttaaaaattgtctttgtatttgagtgagtgttttc

SEQ ID NO: 45861 - DNA, 201 bp, Homo sapiens
atgttctctgtaaaagaaatgagttcctgtgaatccacgatggtctctgcctggagagtgttttggggttttatgctgggctcaatgcccaccgccttccrtgccttcttctcccagttgttactctctcttctcatcagcccgtcccccatgccacgctggtgaaaaggacaaacaaaaccctcctggattcttttccag

SEQ ID NO: 45862 - DNA, 201 bp, Homo sapiens
aaggaatttgtaggtagaaacactctgaaatgaaaaggttcctagtcctgggcacctaaggcaggggaagaggagaggaccagtgttaccattggttttcrtttgcatatgttaatgtttgcccattttgacagtcacattgaatagatgcttgtttatcaggaatgtgagtcaggcatgtaatgcgagggcagtctggtt

SEQ ID NO: 45863 - DNA, 201 bp, Homo sapiens
aaattggcccaaatcctccagatgagctaatagagagactagaattttgaaaataatgttctgaatgcaaatggacattgagaagcaatggaaacagtgtrcaggactacatgcccggtgcctggagctgctcatgctcattccatcatggtgccgttttgtgactctggcaattaagaaaacaatcaagtgaaaatttat

SEQ ID NO: 45864 - DNA, 201 bp, Homo sapiens
tgagattattaaacatcaccgtattaactacttataatccagtcttcctaaaaatgggcttgaggggctcattacagttctgagaaagttactccaggacyatggcattgagctctaaaagtcagtgttagaagtgtgctcatagacagagtatctttccaaaagcaaagatggagtgagggtgtctcctcaaagtcattt

SEQ ID NO: 45865 - DNA, 201 bp, Homo sapiens
ttaagcgtgtgaggaacggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcaggtctgtgctctgtgcgtgctgttggcat

SEQ ID NO: 45866 - DNA, 201 bp, Homo sapiens; identical to SEQ ID NO: 12281

SEQ ID NO: 45867 - DNA, 201 bp, Homo sapiens
ctcttagggagatgacgggagagacggagttggcagtgaaggacgcagaggcaaaaaagtacgtatctgctgaggattatccaagcgtccttgctgccagsaggctccaaggacaacttctgatgtgttgtgttttaaaagaattatttctttaaaaattgtctttgtatttgagtgagtgttttcgtttgatgactcagc

SEQ ID NO: 45868 - DNA, 201 bp, Homo sapiens
cagacatttctttctttcaaggtcaatttattttagatgaatttaaattagaaccaagtattaaataatctatttttcctttatagggagaaagaggattycctggatacccaggaccaaaggtaaataatccctggtcggtgaagcatcatcatgattttgggatggctctggtatgtccatggactgagaatcagaata

SEQ ID NO: 45869 - DNA, 201 bp, Homo sapiens
tcacggtcacggaccgcgtcattggaggcctgctcgctgggcagacataccatgtggctgtggtctgctacctgaggtctcaggtcagagccacctaccayggaagtttcagtacaagtaagtacatgatcagtacaagtcggtacctgatttctatgtagagtatcaaataggacacaaaggagacacttacttattgaa

SEQ ID NO: 45870 - DNA, 201 bp, Homo sapiens
gcaacaagggcggtcctggccagccgggctttgagggagagcaggggaccagaggtgcacaggtgagtgcttccgtgtgtgactgtgtgccctctgatatytcacaaatcatttaaaaaatgattgggtggcatttatatccggaaagttaaccattttaaagtgaacaatccagtggcatttggtacttccacaatgctg

SEQ ID NO: 45871 - DNA, 201 bp, Homo sapiens
tcaaatatactcctccattttaagtgcaatatcaaagtcttgtgaacatgggtaatcattcctcaacttgggccctcagtttccttaagtgtaaaatgaarggcttgagacagcgagtctctcagttttctatcagcagtctgcaacactcctttttagttttcctgggatttgacagctctcttatctgcaggtggtcat

SEQ ID NO: 45872 - DNA, 201 bp, Homo sapiens
cgctggcaatttctatcatatcgtcagtcgtccagcaaatgtcacctggagggacttcatctcacaccgtgaaacccccacacatccgattttgacccttraagcgcatttatgattttctgctgggcatttcttgagatctgaacatttggtttctcttcctttcggtaggacaacattgccgagaaagcttgctgtggg

SEQ ID NO: 45873 - DNA, 201 bp, Homo sapiens
tttctaactggggctgcagaaaacccatcattcatcagagcccagggcaacagatggaagagagcagtcgcaggactatggcctgttcgagcaacaggcarggagccttcttttacacaaaagggaggctgggagagattggccgaccattgctgacagaggcagtaaggaagtagaatttcccaggttactgcaataaat

SEQ ID NO: 45874 - DNA, 201 bp, Homo sapiens
ctcatgtttttattaaagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctggtaagtgattcttccttg

SEQ ID NO: 45875 - DNA, 201 bp, Homo sapiens
ggcatctaaaagaattatgctccagccacttttctgtcacacatctgctgcctgtaaatggcagtgagcagcagtggatctttcattcgttaccgtggccycctgaaagcatgggtgtgctgggcctttctgccacctgctttgtcgctgctgattttgacagtgctacgtagttgctaattttggtttcaggcttttgtt

SEQ ID NO: 45876 - DNA, 201 bp, Homo sapiens
ttccaggaaactggtttttcacttctggaatcttcattagttgattcagcagcccagggccggtacccagagttagcgccaactcagctaaacccacagcyggcccggcggtgcaccagggtgctctgtttctaactggggctgcagaaaacccatcattcatcagagcccagggcaacagatggaagagagcagtcgcag

SEQ ID NO: 45877 - DNA, 201 bp, Homo sapiens; identical to SEQ ID NO: 12297

SEQ ID NO: 45878 - DNA, 201 bp, Homo sapiens
attcttggggaatattaaaaaaatgactaagacatagccccctctcttctggttggcaaacatataatttctgtttggctaattgaaatatcaaaaaaackactaccttggtggatggtttctccacgccctttatgcttcagatgaagaaagagagctcagagaggtatgcccagtgacagggccacagagctagtagca

SEQ ID NO: 45879 - DNA, 201 bp, Homo sapiens
agatcgtgctgtctccagcgtttatcctggctgcagagtcgcttcccaagattggagatcttcatccacagatagtgaatctcttaaaatcagtgcacaayggagcaccagcaccaggtatggtagagaaatgctagttgctctgccactcagttctctaatgcatgagttgagggtaggctgctggccactggtccttag

SEQ ID NO: 45880 - DNA, 201 bp, Homo sapiens; identical to SEQ ID NO: 12300

SEQ ID NO: 45881 - DNA, 201 bp, Homo sapiens
aatgactgtagagcaaagagctgacattgacaggaaccatcctgactcctccctgcatcttctcttatttcaaagggcaacaagggcggtcctggccagcygggctttgagggagagcaggggaccagaggtgcacaggtgagtgcttccgtgtgtgactgtgtgccctctgatatttcacaaatcatttaaaaaatgatt

SEQ ID NO: 45882 - DNA, 201 bp, Homo sapiens
cctttggttggtctttgtgttctcatgtttacttaagtttaacaagacctattgtgcatcatggccttgagccctgaggttcagggaggggatatatcccyaatgctaaatgacgagttgatgggtccagcacaccaacatggcacatgtatacatatgtaacaaacctgcatgttgtgcacatgtaccctaaaacttaaa

SEQ ID NO: 45883 - DNA, 201 bp, Homo sapiens
gctggggtgaggggctttcaaaaggagcgactcaccaaaatcaaattgatggactatgggcatcattttgctttgaaaattcagaagaaaatagaaatttkgaaaatatcattttaaaatgtttgagcactatttatttatttatttttaataaattgtaaagacctggatcaactgcttggaagtgagcattatttttga

SEQ ID NO: 45884 - DNA, 201 bp, Homo sapiens
cctgtttggggctaagagtgctttgctgatcccgtgattgggtttcgtaagacctgcatggatgttacctggatgggttgtggccgaagggcttgtccctygaagccttgcatgcaggtccttgctaatatttccctgaccatccagtccagtggcagctgctttccttccatatgtggctcatttccctttcccatgttg

SEQ ID NO: 45885 - DNA, 201 bp, Homo sapiens
acgctggtgaaaaggacaaacaaaaccctcctggattcttttccaggagtttgcacatgaatgttgcaatttagaaaatcattccaccgaaatctcaaagrtgaagtcagcatgttgcagcacccttacctagagcaaaagcatggcttggcatcacactgtaagccagccccaggccacagggtctcagccatgtttctc

SEQ ID NO: 45886 - DNA, 201 bp, Homo sapiens
ttttttctgtgcttcactgcagttcactcaaacaaaagggatatcatctttcttttggatggatcagccaacgttggaaaaaccaatttcccttatgtgcrcgactttgtaatgaacctagttaacagccttgatattggaaatgacaatattcgtgttggtttagtgcaatttagtgacactcctgtaacggagttctct

SEQ ID NO: 45887 - DNA, 201 bp, Homo sapiens
tacattgctcctaagcaaaactatattgaaaactgagtgggtggccgttgatgacattactgggacttctgaggtttttgttgggctaaagataatggaakagatttttggtcagaagccactgatgcagtagtttcctggttttcaaaatgagcaaccaggggctctgagatgcggaattccttgcccaggccagggagc

SEQ ID NO: 45888 - DNA, 201 bp, Homo sapiens
gctggtcctccagggctgataggagaacaaggcatttctggacctcgggtaagcctgtcctaataccagccccctctctagctgaacagagggcacatttycaagcaggctgagagagtttctcggatgatgctattgtagacagacctccctttagctctcctctttggcaacaaaaaccccagatttaacctcaggcct

SEQ ID NO: 45889 - DNA, 201 bp, Homo sapiens
catgacctcctccccagtcctcttctatctcggcagctaccatggggtgctcaggtcagtgtgctctgagctgtgacccttggtgaccaaccctgggatcygccaggcacccaacaccagcctcttgcaggaacttgcggagcagagagctgtgggcccagctcccatagcggtgggctgagtgctccacttcccaaggga

SEQ ID NO: 45890 - DNA, 201 bp, Homo sapiens; identical to SEQ ID NO: 12308

SEQ ID NO: 45891 - DNA, 201 bp, Homo sapiens
tgctggtcctccagggctgataggagaacaaggcatttctggacctcgggtaagcctgtcctaataccagccccctctctagctgaacagagggcacattktcaagcaggctgagagagtttctcggatgatgctattgtagacagacctccctttagctctcctctttggcaacaaaaaccccagatttaacctcaggcc

SEQ ID NO: 45892 - DNA, 201 bp, Homo sapiens
atcagcaacccgcaacttcccggtgtctcggtcctctgctttaggtctaaatgatccctgtttcacaaagctgtccgaggagaggtgaggcaagagtgagraacaattgtagaagtgcagggagacagctggctcctgtgctcagtgtctcacctggggttaccgctttgatcatctgttacctctggaagagctgagttt

SEQ ID NO: 45893 - DNA, 201 bp, Homo sapiens; identical to SEQ ID NO: 12315

SEQ ID NO: 45894 - DNA, 201 bp, Homo sapiens
ttgcaggtctgtgctctgtgcgtgctgttggcatctccctttcttctggggctctgagaaggttctcagacacgtccatgctcctttgtggcttcatgtcvcatagctcctaaaacgtccccaatgaggccatctgcctgagaacttctcttgtgaggtctccaggacaacctcgtggctccagcactacagggacgccta

SEQ ID NO: 45895 - DNA, 201 bp, Homo sapiens; identical to SEQ ID NO: 12258

SEQ ID NO: 45896 - DNA, 201 bp, Homo sapiens
acactcacaggggttgacctgggggcgttacacgccagcattttgaggctgccctgcacacactgttgctagaaaagtaaagcagagaagaagagggatgygggccactgaggtggagtgctgtcagcacacctggaagcagccagcacagctgcaggggagcacagaggcgggccgaggagcaaggtataaacagcatca

SEQ ID NO: 45897 - DNA, 201 bp, Homo sapiens
tcggcatctaaaagaattatgctccagccacttttctgtcacacatctgctgcctgtaaatggcagtgagcagcagtggatctttcattcgttaccgtggsctcctgaaagcatgggtgtgctgggcctttctgccacctgctttgtcgctgctgattttgacagtgctacgtagttgctaattttggtttcaggcttttg

SEQ ID NO: 45898 - DNA, 201 bp, Homo sapiens
attccattaatatacctagggcatcgttagcaaccactcaggattccagctttacaatattacatgatttgattttcagtggttaatatttgtattttttwaaataaaaccaaatgaacccccacaaaaacatctcactccactttttgctttgctcggcatctaaaagaattatgctccagccacttttctgtcacacat

SEQ ID NO: 45899 - DNA, 201 bp, Homo sapiens
ctgccaccaagccagccaccactaagcccatgggtaagaaagcccttgctagggctgccatcttgtgacatcctcatttcctgctccagggtgtgttcctyaaagcctgcatgtaacacactcagaatacagtccttgatctgggcttgtacacctggatgatgtattttaagaggtgttggttagggattccagcctccc

SEQ ID NO: 45900 - DNA, 201 bp, Homo sapiens
ggttacaatgtggtctcattttcatcttgccccattgtgatcacagagtagccttgtctgttgtgggggtcctgtgagatcatgtgtgctcaacaggagarccccaaggccatgtgtgctggaccagctccccaatgcgggggctgattctctctttcttaaacagctccatcacaagagctgctcagcttccactatgct

SEQ ID NO: 45901 - DNA, 201 bp, Homo sapiens
acggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagccctt

SEQ ID NO: 45902 - DNA, 201 bp, Homo sapiens
gacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagccct

SEQ ID NO: 45903 - DNA, 201 bp, Homo sapiens
agacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagccc

SEQ ID NO: 45904 - DNA, 201 bp, Homo sapiens
ttcattaattatttgctcattcattcattcaaactagctatttgttaaatgaataattactaatcgtgtgccaggtacggcgatagacaggactctttgcmcccactgggagtgattttgttacttgctttaaccacacctgagagggtggggaagggatggagctcccatattgttgctaaaaataacgataagattaag

SEQ ID NO: 45905 - DNA, 201 bp, Homo sapiens
catgtgtgcacgtgttgtaggcacacatgataaaactctccgtggttgtgtatgtctcacttttttttctgtgcttcactgcagttcactcaaacaaaagrgatatcatctttcttttggatggatcagccaacgttggaaaaaccaatttcccttatgtgcgcgactttgtaatgaacctagttaacagccttgatattg

SEQ ID NO: 45906 - DNA, 201 bp, Homo sapiens
tcctggacagcagcagaagaggctgtctgggaagtgagaggatttgttcagaagttcagggatcccctcccgtcgcttattagctcatggatccaacttgyagcccacagcataagtcgtggatgtagaggtgtcttggatctgtgtctttcaatcaccactccccaacataagacattaatcacagcaggcaaccttata

SEQ ID NO: 45907 - DNA, 201 bp, Homo sapiens
ccccacccatttaaagtaatgtgcacgccacttagcgtccctgcgtctcagatttttcacctgtaaattgagactggggcaggatgattgctaatgtcttyccttccacattggatattctatgcttttaccacagcctgtgtcggcgaaagacattgggtcatcactgccattcctcagggcttgttctgccgaacacag

SEQ ID NO: 45908 - DNA, 201 bp, Homo sapiens
ggagtgcaatggcgtgatctcggctcactgcaacctccaccttccagttttaagtgattctcctgcttcagcctcctgagtagctgggattacaggcactygccaccatgcctggctaatttttgtatttttctttcttttttttttttttagtagagacgggggtttcaccatattggtcagactggtctcgaactcctg

SEQ ID NO: 45909 - DNA, 201 bp, Homo sapiens
tgcacatgtgtgtgcttcagatattttacttaaccgagtgtgtgttgtgtttggccgggatcacttggagaacctgggactcccttccattataattaatrtatttcatgacttctcagtacagttgggaaggtggaagaaaaatagacaggttgacattcccttttcacattcctcatttgaaactggctgggatcgtgc

SEQ ID NO: 45910 - DNA, 201 bp, Homo sapiens
gcagtgagccaagatcatgccattgcactccagcctgggcaactagagtgaaactccatctcaaaaaaaaaaaaaaaaattctttgtagctatcttatttragaatagaatgggaggcagctctgtctgatgcagttcccagcttgacttttccctttggcttagcgattttggggttctgagatttatttttctttcatc

SEQ ID NO: 45911 - DNA, 201 bp, Homo sapiens
ctggaagagatcgctttcgactcctccctggtgttcatcccagctgagttccgagccgccccattgcaaggcatgctgcctggcttgctggcacctctcasgaccctctctggaacccctgaaggtatggtggtgatggcttcagacacacaatggggtggtctccaggcagggcctttaagaacaaaacaaaatgaagtg

SEQ ID NO: 45912 - DNA, 201 bp, Homo sapiens; identical to SEQ ID NO: 12273

SEQ ID NO: 45913 - DNA, 201 bp, Homo sapiens; identical to SEQ ID NO: 12274

SEQ ID NO: 45914 - DNA, 201 bp, Homo sapiens
ccaaaggcttgtagaggtgggagtgtactgaagtccggtgcatcctgcaaagtgtgcaactgtcctgcagacgggctcttcctctgtgaatcgaccccttkccctgcaatgtcttgtgcagcatttcagagctagacattcttctctgcagatgagaatctcatgctaattttccccacaccagggtgtcccagggagaga

SEQ ID NO: 45915 - DNA, 201 bp, Homo sapiens
gccccatggtaaggtgctgcacattcctagactctccctgtactgagggcaagagaaaggacacacttctcggctcatcagcagccacagaggccaaagaygtggcctttaacactgcaacgtagcctaagattagcagcagagtccccgtgaaggaagtctccgtggggaaccagagtgacccttgccaagtggggcttc

SEQ ID NO: 45916 - DNA, 201 bp, Homo sapiens
tgttgcttgtatacattttaagctcacttgcctattcacgatctggattgaggcagctgctactgcagctaagacaggataattgtgggttttggtggccrtttttggccagcagaagtgaggttccaggccctgtgggatgggcagatgccatgcagaggcttctcatggaaagtcacctcattagcactcacgatggtc

SEQ ID NO: 45917 - DNA, 201 bp, Homo sapiens
ggatatgcctttgtctcccatgagcagagggatgactttcagttctgtctgtcctttgtccacaaggaatttccctgtgggcagaatgtgagggaggtatkcagcttaaaaaaaaaaaaatctggccaggacggtggctgatgcctgtaatcccagcactctgggaggctgagacaggcggatcacctgaggttgggagtt

SEQ ID NO: 45918 - DNA, 201 bp, Homo sapiens
ctaccctcccagatctcattcccttcagggaaactgcaggttccaggccaggcctcatgcaggggcccaagaggctccctggctcacgtagcctcgatcgrcgttccccatggtgaaatctgctttctgctgcatgctgttcacagtaccctttacgctgctgcaagcccggcagagaaagggtgatgaagggctccagct

SEQ ID NO: 45919 - DNA, 201 bp, Homo sapiens
cagaacctcacggtcacggaccgcgtcattggaggcctgctcgctgggcagacataccatgtggctgtggtctgctacctgaggtctcaggtcagagccayctaccacggaagtttcagtacaagtaagtacatgatcagtacaagtcggtacctgatttctatgtagagtatcaaataggacacaaaggagacacttact

SEQ ID NO: 45920 - DNA, 201 bp, Homo sapiens
tgtatgccttttgatgaaaaatgaagactccagagcctctcctttgattactgggcccattggccgttggcttgggatggtaactccgacatctgggttcygtttcctcccattaacccacttgtgacttgcagcaactcaattgaaacctcccatcgataaaatgctagtggttgtgcaggtgctgccatctcatgtctc

SEQ ID NO: 45921 - DNA, 201 bp, Homo sapiens
attgtacctaaaacagccttcatcttcatattcacccaatgcctttatattgttataattccttcattacattcattaaaaattaaaggagtagaagaggyagataactttccaccataaactctgcattaaaatcccccaactgctaattgacactgccatgacttttcatttaacccctttaatttagtgataaaaatg

SEQ ID NO: 45922 - DNA, 201 bp, Homo sapiens
gatctcaggaagttgaagctgcagtaagctctgatcatgccactgcattccaacctggacaacagagctatactctgtctcaaaaaaaaaaaaaaaaaaaagggaaaaaagaaagaaatgtgaaatccaagttgttaaataaacagtaaaaaaacaaaatttgctatatttctttggaggtttcttggagctcttccaaaa

SEQ ID NO: 45923 - DNA, 201 bp, Homo sapiens
gtctttgtgttctcatgtttacttaagtttaacaagacctattgtgcatcatggccttgagccctgaggttcagggaggggatatatccccaatgctaaawgacgagttgatgggtccagcacaccaacatggcacatgtatacatatgtaacaaacctgcatgttgtgcacatgtaccctaaaacttaaagtataataat

SEQ ID NO: 45924 - DNA, 201 bp, Homo sapiens
agactggacaatgacgatgtcacttactctctcggaacttcttttcttttcttcttttcttttcttttctttttttcttttttctcttctcttctcttctyttcttttcatttcttttctttctttcctttttctcttttttggagtctcactctgttgcccaggctagagtgcagtggcgccatctcggctcactgcaac

SEQ ID NO: 45925 - DNA, 201 bp, Homo sapiens
tgcaaggtgcacaccaaacctgggtgagggctacttacacactgaatgtttccctttttcttctttgatctgcagcagttgagagtgatgctgcagacatygtctttctgatcgacagctctgagggagttaggccagatggctttgcacatattcgagattttgttagcaggattgttcgaagactcaacatcggcccca

SEQ ID NO: 45926 - DNA, 201 bp, Homo sapiens
aacctttggcctcagctgtttctcttcttgtacaacaaagatatagatcccagtggccttggtctcttctggtagcaacagttcatgattctgtagattayggtagcccaagattgatttctaaatgctccttacattttagaaatcagtagtaacccagaccacaatgccaaaatttaaatagagtaaattcagaaagac

SEQ ID NO: 45927 - DNA, 201 bp, Homo sapiens
gcccacaggtgaggggacatgtggcaaatgtccaaacctggggtctgaatgatatttttgatacgaggtaggcacctttctgaaaaattgtctttacttcmcacttcattttatttctaaagcattcaggactcagcaaattgcactgactttatcatcagtgccttttgtgatttcctatcctagaacttaatacgtccc

SEQ ID NO: 45928 - DNA, 201 bp, Homo sapiens
acaccacaccactgtgcaaagctttcttcagtgaggccccaagggtcagcccatggagaggccaagtgtcgcttgtaattctattaaataactggtttaawtgtggggttttttttttttttttttttttttgagacagagtcttgctctgtcacccaggctggagtgcaatggcgtgatctcggctcactgcaacctcca

SEQ ID NO: 45929 - DNA, 201 bp, Homo sapiens
atccagggtggccctggaggcctgtagtctctcagtgaggtccccaaaactatgccgactcagcacccccaatctacaccacaccactgtgcaaagctttyttcagtgaggccccaagggtcagcccatggagaggccaagtgtcgcttgtaattctattaaataactggtttaaatgtggggtttttttttttttttttt

SEQ ID NO: 45930 - DNA, 201 bp, Homo sapiens
ctcttctctcggctcctcacctcaccccacccaccccctctctcgacgctcagtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttc

SEQ ID NO: 45931 - DNA, 201 bp, Homo sapiens
ctgtcccaatcggccctgaaggtgaatatccagggtggccctggaggcctgtagtctctcagtgaggtccccaaaactatgccgactcagcacccccaatytacaccacaccactgtgcaaagctttcttcagtgaggccccaagggtcagcccatggagaggccaagtgtcgcttgtaattctattaaataactggttta

SEQ ID NO: 45932 - DNA, 201 bp, Homo sapiens
tcttagacatcaggcactgacatagagcttagatatgttcttaaggtagctaagccatttattataggatagtcagataggatagttctaggatttatagrccttttcagatactctttatccagtgagagatgacctatttttattaaaacttgggtttggtatcttggaattggcttgaaaatgatttgtttttacatt

SEQ ID NO: 45933 - DNA, 201 bp, Homo sapiens
cgtgacatggtgtactgaggggaaaagcagtaacagggaaagccatgctgagttttagtgctgctctgccaaatgaagggggaccacagggattcttactstagagcaaagaagaccacgggattaaacagaggacccgattactttgtttcagggtattcctggagaagacggctaccgaggctatcctggtgatgaggg

SEQ ID NO: 45934 - DNA, 201 bp, Homo sapiens
ctcaatcactctctgtggctctccctgtacctttgctaagtggtccatctggacactagtctgctgctccattcatggcaaagttacatcactcatcagcyggacagactctcctctgctatcaatcttcaggtggcaaggctgagaacattagatcatcctcatccctgatttcattagctgtatggggaaaatggaatt

SEQ ID NO: 45935 - DNA, 201 bp, Homo sapiens; identical to SEQ ID NO: 12301

SEQ ID NO: 45936 - DNA, 201 bp, Homo sapiens
tcacgttggccacagtaaatgagggtgtcctttaaatggagttagctttgttgaaagtcattgttgattgtgcttggtaaggccattctaattgccttatratgttgccacctacagtcattgaagtcaacaagagagacatagtcttcctggtggatggctcatctgcactgggactggccaacttcaatgccatccgag

SEQ ID NO: 45937 - DNA, 201 bp, Homo sapiens
attcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaaggtatgtatcctcttct

SEQ ID NO: 45938 - DNA, 201 bp, Homo sapiens
ttggcttgtgccaatagtgcagcaccctctgagccatcagagcagccgggcagtgcttggtacagtttcagtataatatggaacgagcagtctttaaacaygggcagtgcacgcacagtggctcagctaatcacatttagatcatccaagagccccgaccctgactgtcctggataacagcaagtctgctgtatgaaggct

SEQ ID NO: 45939 - DNA, 201 bp, Homo sapiens; identical to SEQ ID NO: 12304

SEQ ID NO: 45940 - DNA, 201 bp, Homo sapiens; identical to SEQ ID NO: 12362

SEQ ID NO: 45941 - DNA, 201 bp, Homo sapiens
tcttctctttgcttcttttctagcttgctgttacggtaagttgattttggtgactttctcctaaggaaaggaagcctcccttttgtagtaagtacagtttrtctttaaccctccaccctctactttccacagggcccctggagtgccccgtcttcccaacagaactagcctttgctttagacacctctgagggagtcaacc

SEQ ID NO: 45942 - DNA, 201 bp, Homo sapiens
cttctcttttttgctttgcaagggataagatcaggtttagagggagaggctgtaaacaatcaaggttatccaggggcccctttgtcttgctctgtgtattyctgggggccaaagcctgtttattcgaattccccatctgctgtgcctctcacctttcgttccttggttttacagggtcccaagggcaacaggggcgactcc

SEQ ID NO: 45943 - DNA, 201 bp, Homo sapiens
ctgctgcatgctgttcacagtaccctttacgctgctgcaagcccggcagagaaagggtgatgaagggctccagcttgcaaaatgcctttgtctctcacaayagggtgagcgtggtccgcctggtgtgaacggcactcaaggtttccagggctgcccgggccagagaggagtaaaggtgaggcgtgggtgatggggttgcta

SEQ ID NO: 45944 - DNA, 201 bp, Homo sapiens
atgacatagtaggaaacttagtgtcctgtgtgcattcatccgtgagtccagaaagggctggggacacggaaacccttaaagacatcacaggtaatggcaaygccaccaagctacgccctgccctgctgttcttgggagatgagcttggcaactgctggccttaaagcaacagctaggatggcgggtgggccagggaagaga

SEQ ID NO: 45945 - DNA, 201 bp, Homo sapiens
cgctgctgcaagcccggcagagaaagggtgatgaagggctccagcttgcaaaatgcctttgtctctcacaacagggtgagcgtggtccgcctggtgtgaayggcactcaaggtttccagggctgcccgggccagagaggagtaaaggtgaggcgtgggtgatggggttgctagcgtggggaggggtcaggtgactcgcagt

SEQ ID NO: 45946 - DNA, 201 bp, Homo sapiens
gggcaccagcagctattgagtgcatgggctcaggtccctggttcccaggtaagtgagtctaccttcctgtattatcagtgaggtgtgaagtgtttagtagmagtatagtgtaaaccaaatttgtttaggaaggctttgcattgataggaagtaattgcttacatagtagaaaaatctaaaccaatgtctttttttaaagat

SEQ ID NO: 45947 - DNA, 201 bp, Homo sapiens
gtgaacggcactcaaggtttccagggctgcccgggccagagaggagtaaaggtgaggcgtgggtgatggggttgctagcgtggggaggggtcaggtgactygcagtttctccagatgctgccagggagggaggcgctggtccaggcttcttgacctcagcattcagcagcccgtgacctctcattggaaggcagttctgag

SEQ ID NO: 45948 - DNA, 201 bp, Homo sapiens
gccaaaccttctcccaaaggcaaattgttagtcttgtaggggtctggctgcattcagcatagtatgatcctactgttctcctgaagtttaaactcatgaawtacagagaaacatttgagaattgcaagtggccagggaaaagtacaatgggaaatgtttctgtaaaaccccctgtgtgtgctatacattaggttttcagga

SEQ ID NO: 45949 - DNA, 201 bp, Homo sapiens
ctctgatgtcctgtgtgagttaccaggctgtcctcctcccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggacca

SEQ ID NO: 45950 - DNA, 201 bp, Homo sapiens
gtccatggctctcctcctgtaggtgtattcctcttcctccaactcacctccagggtcgccagcccagctcactccaggcacagcacccacctgcagtctcraatctcattatgggtgactgggaagtctgtgcagtcactttgggccatgcccacccagacggccaggcaatgggagtgaatgaggcatggcaactgcttc

SEQ ID NO: 45951 - DNA, 201 bp, Homo sapiens
caggaagtgtgcctactcctgtaccttagtctgcaaacatttcaggagctcaaggatccacttctcaggggcagcggcagggcagagacggtggttatggygtgccaggcatggcgacctacagtcacatctctttcccactcttagggagatgacgggagagacggagttggcagtgaaggacgcagaggcaaaaaagta

SEQ ID NO: 45952 - DNA, 201 bp, Homo sapiens
tgtcaattctaagattcttggggttgacgagtctttgattctacatccaaacagaatctttaccaaaagcaaccagcagttctttctatgttagtccgccrgtgccattttgctacgggagtcctttgagcccaccgcctacagaaatggtcttgttcacacttggaagataggacaggagcaggaagtgtgcctactcct

SEQ ID NO: 45953 - DNA, 201 bp, Homo sapiens
gggtcaacagatctctagttgttgatatctgttgaaaactgtaaattaactaagtggcaattcctacatatgttagagatagtaatgtacaattcacacamgttcttctgattcttctgattcataattaatgacgtccagttctgaatgctcctcatgagagagcaacaggaacagatctgagcatgctggggggaggtg

SEQ ID NO: 45954 - DNA, 201 bp, Homo sapiens
tgctcaagctctcagatgcggggatcacccccttgttccttacaaggcaggaagaccggcagctcatcaacgctttgcaggtctgtgctctgtgcgtgctsttggcatctccctttcttctggggctctgagaaggttctcagacacgtccatgctcctttgtggcttcatgtcccatagctcctaaaacgtccccaatga

SEQ ID NO: 45955 - DNA, 201 bp, Homo sapiens
ctttgattttagatcttagacatcaggcactgacatagagcttagatatgttcttaaggtagctaagccatttattataggatagtcagataggatagttytaggatttataggccttttcagatactctttatccagtgagagatgacctatttttattaaaacttgggtttggtatcttggaattggcttgaaaatgat

SEQ ID NO: 45956 - DNA, 201 bp, Homo sapiens
cctgaggtctcaggtcagagccacctaccacggaagtttcagtacaagtaagtacatgatcagtacaagtcggtacctgatttctatgtagagtatcaaayaggacacaaaggagacacttacttattgaatctattctgaaataaccacaaattcaaaaaacaacaacagcaacaacaacaaaacaactcagcctgggtg

SEQ ID NO: 45957 - DNA, 201 bp, Homo sapiens; identical to SEQ ID NO: 12271

SEQ ID NO: 45958 - DNA, 201 bp, Homo sapiens; identical to SEQ ID NO: 12275

SEQ ID NO: 45959 - DNA, 201 bp, Homo sapiens
ctgtttctctaacaggaagatctgctcagctgcaattgcaaaacataatatccatgggagagtgagagaataatgatgatctgtaaaaagagcttgagttyaattgattcacaaagcctcgtatttaccagagtaaatactactgcagcagtttctatattaaaaatggacctcccaaaacagagcttctctttgatggcg

SEQ ID NO: 45960 - DNA, 201 bp, Homo sapiens
tacctgatttctatgtagagtatcaaataggacacaaaggagacacttacttattgaatctattctgaaataaccacaaattcaaaaaacaacaacagcarcaacaacaaaacaactcagcctgggtgctttggtggcagcctaagcttataaaacacagaatggaaatgggattccatgtgggatgcagtcctgccctct

SEQ ID NO: 45961 - DNA, 201 bp, Homo sapiens
tgatcagtacaagtcggtacctgatttctatgtagagtatcaaataggacacaaaggagacacttacttattgaatctattctgaaataaccacaaattcraaaaacaacaacagcaacaacaacaaaacaactcagcctgggtgctttggtggcagcctaagcttataaaacacagaatggaaatgggattccatgtggg

SEQ ID NO: 45962 - DNA, 201 bp, Homo sapiens; identical to SEQ ID NO: 12278

SEQ ID NO: 45963 - DNA, 201 bp, Homo sapiens
ttgttgacagattaattttaattttcatgttattagcatgcggttcaattgttttctttgttttttttctttaggtgaaaatgctttttacttgtccccasatatcaggaaacagtgtgattggttccaaggggaccaacccacaaagaaccttgtgaagtttggtcacaaacaagtgtaagtgattataattattgtctt

SEQ ID NO: 45964 - DNA, 201 bp, Homo sapiens
aaagccatgctgagttttagtgctgctctgccaaatgaagggggaccacagggattcttactgtagagcaaagaagaccacgggattaaacagaggacccrattactttgtttcagggtattcctggagaagacggctaccgaggctatcctggtgatgagggtggacccgtaagtaaaaattgttttagtccctaaaatt

SEQ ID NO: 45965 - DNA, 201 bp, Homo sapiens
agcactctcctctctccttcctccgggagggtggtgtcggggaatgagcgcggatggctgcctcattccctcttgttgaagagggcgggtggtcatctggkgagatggtgtttgacatcttttaataatctaaatgaaaaagttctccaaaatttgctgccagggaatttcgtttttttataaatggagactccaggacat

SEQ ID NO: 45966 - DNA, 201 bp, Homo sapiens; identical to SEQ ID NO: 12282

SEQ ID NO: 45967 - DNA, 201 bp, Homo sapiens
tgctccctctagggaaattcgggacctccagggatagttggacagaagggagaccctggctacccaggaccagctgtaagtatttatccagttctgacccrgccacctggggctgggtgctttacacgtggtccctgaaaacttcccaccatctgctttgctcacaagaaaatgtgctctctttgtatttgcttggttgtc

SEQ ID NO: 45968 - DNA, 201 bp, Homo sapiens
gtaggacaacattgccgagaaagcttgctgtggggttccctgcaagtgctctgggcagaggggagaccgcgggcccatcggcagcatcgggccaaaggtayggtggctttacccttgcccacgcctgagatgaggtgtcagaagcccgacattactttggtggggtaatttctctaacagaagagtgtggagatgaaggag

SEQ ID NO: 45969 - DNA, 201 bp, Homo sapiens
ctatctatctatcatctatctaactgtctatcatccatccttttgctgctggttcaaagaatgaatcagatacaaagtcttcttggaagtctaaaaaggaygtagaaagcatgggattttgagagattttgcataatgagagtcaaaaactgatcattccctttgccctgttttctcttttaggttcatatttggtgctta

SEQ ID NO: 45970 - DNA, 201 bp, Homo sapiens
tgattttctgctgggcatttcttgagatctgaacatttggtttctcttcctttcggtaggacaacattgccgagaaagcttgctgtggggttccctgcaartgctctgggcagaggggagaccgcgggcccatcggcagcatcgggccaaaggtacggtggctttacccttgcccacgcctgagatgaggtgtcagaagcc

SEQ ID NO: 45971 - DNA, 201 bp, Homo sapiens
acaccttcgccagtgagccaaacgacgtcttcttcaaattagtggacaagtccaccgagctcaacgaggagcctttgatgcgcttcgggaggctgttgccrtccttcgtcagcagtaagtcctgcgtggcacagcatgtgccctggcctggctttatgctcgggccaggagaagtgtaggaacagtcatggaaaagacaac

SEQ ID NO: 45972 - DNA, 201 bp, Homo sapiens; identical to SEQ ID NO: 12289

SEQ ID NO: 45973 - DNA, 201 bp, Homo sapiens
tggcccggaggatgcagggtggggctcgggccctctcttgctgaggatggacacgttcgctgacagtggccagcctgtttggggaacctgtttcaaggggmctactatgttagataatgaacgggtattgaagtatgggtggggtcactgggagggactagggagtggttaaagaaaaatctgcttccacaggaagctcca

SEQ ID NO: 45974 - DNA, 201 bp, Homo sapiens
gggcctactatgttagataatgaacgggtattgaagtatgggtggggtcactgggagggactagggagtggttaaagaaaaatctgcttccacaggaagcyccaggagccagtttcgaggccggtgcagaccccaggagcaaacccctctgagcacaggggagtctgctgtgctggatggggaggcagggctgtggccccg

SEQ ID NO: 45975 - DNA, 201 bp, Homo sapiens
aagctccaggagccagtttcgaggccggtgcagaccccaggagcaaacccctctgagcacaggggagtctgctgtgctggatggggaggcagggctgtggycccggctgactggcttctctccccacatacagctcaccccggcgaggaccacagggtgctagagctgcagggtgctcagagctcacggggatggtggatg

SEQ ID NO: 45976 - DNA, 201 bp, Homo sapiens
ataaacaaagtgaaagaggctttctttcttcctaactaaggcgctttgtgtgtctccaacacaagaaaggaaatgcaacatttccaaaatgtatctgcctrcaggaggcctctgtgatgctgtgtcttggccccagattgccgaggatggactttgggaatattgtcacagtgcgggtgcagcttctgttgtcaggaacgt

SEQ ID NO: 45977 - DNA, 201 bp, Homo sapiens
acagaggggctcacgaggaacagtgtggtcaccagggcccagccggcagggctcggctagagaactgggaatcaagcatcacttggaggagctgtcagccyggtgggtcttcccgggattcagcacccacagagacacagtgctgggggccacccacccttgccccacagggcagtgctgtctgcgctgctaccctcccag

SEQ ID NO: 45978 - DNA, 201 bp, Homo sapiens
ctgggcattggcaggaaggtgaacatcaaggaggtatacaccttcgccagtgagccaaacgacgtcttcttcaaattagtggacaagtccaccgagctcamcgaggagcctttgatgcgcttcgggaggctgttgccatccttcgtcagcagtaagtcctgcgtggcacagcatgtgccctggcctggctttatgctcggg

SEQ ID NO: 45979 - DNA, 201 bp, Homo sapiens
ttaattaacaccaccaacaaagctgactttttaaaatagcttactatttggcacctaacagctaccctcatttctctctgtgagaggggtggatagaattkcttctcaaagctcacacacacaggatctcattttgcacttgagtgcgatgccctggtcctctgcctgggttgtccctactgctggtataagtagagttcg

SEQ ID NO: 45980 - DNA, 201 bp, Homo sapiens; identical to SEQ ID NO: 12306

SEQ ID NO: 45981 - DNA, 201 bp, Homo sapiens
ataggctgccatgcttctttctagacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcatacctggtcagac

SEQ ID NO: 45982 - DNA, 201 bp, Homo sapiens
ctgtgcgtgctgttggcatctccctttcttctggggctctgagaaggttctcagacacgtccatgctcctttgtggcttcatgtcccatagctcctaaaaygtccccaatgaggccatctgcctgagaacttctcttgtgaggtctccaggacaacctcgtggctccagcactacagggacgcctacatgcttgtagcact

SEQ ID NO: 45983 - DNA, 201 bp, Homo sapiens
tgggcaaccacatggcataggggaactgatcataggaagcaagatttatgaacagatttttctcctacacttttaaaaatggttaccaccaagatggccaytgggacaggaggtaggaggtgaggtgactgatggagagtcagtctcttgtgaatacacatggatggtggggcaggaaaaagagagttgaggcttggaggc

SEQ ID NO: 45984 - DNA, 201 bp, Homo sapiens
attcattttactgatggagcagacggagatctggctgatttacacagagcatctgagaacctccgccaagaaggtaggtgccaaggctttctaaatatgasaagtaaaccctggtgaggcggggtgtactgctctgctggagagaaacctctctgctaatgcagcgccccaagggagcagcgttgtcttgggagactcttc

SEQ ID NO: 45985 - DNA, 201 bp, Homo sapiens; identical to SEQ ID NO: 12311

SEQ ID NO: 45986 - DNA, 201 bp, Homo sapiens; identical to SEQ ID NO: 12312

SEQ ID NO: 45987 - DNA, 201 bp, Homo sapiens; identical to SEQ ID NO: 12313

SEQ ID NO: 45988 - DNA, 201 bp, Homo sapiens
tggaaaccagaggctgcgggactgtgtcatgataatgacagtgcccttttgggtcagtaatgtggcttttcctctcttctctcggctcctcacctcacccyacccaccccctctctcgacgctcagtgctcgccaaacccggagtcatcagtgtgatgggaacctaagcgtgggtggccaacatcatatacctcttgaaga

SEQ ID NO: 45989 - DNA, 201 bp, Homo sapiens; identical to SEQ ID NO: 12314

SEQ ID NO: 45990 - DNA, 201 bp, Homo sapiens
gttcaaaaccaccctggccaacatggcaaaaccccgtctctactaaaaatacaaaaattagccgggcatggtggaggggggcgcctgtaatcccagctacrcaggaggctaaggcacaagaatcgcttgaacccgggaggcggaggttgcagtgagccgagattgcgccatgcactccagcctgggccagagcgagactcc

SEQ ID NO: 45991 - DNA, 201 bp, Homo sapiens
atggtggaggggggcgcctgtaatcccagctacacaggaggctaaggcacaagaatcgcttgaacccgggaggcggaggttgcagtgagccgagattgcgscatgcactccagcctgggccagagcgagactccgtctcaaaaaaaaggccaggcacggtggctcacgcctgtaatcccagcactttgggaggccgaggtg

SEQ ID NO: 45992 - DNA, 201 bp, Homo sapiens
gggaggccgaggtgggcggatcacgaggtcaggagatcgagaccacggtgaaaccccgtctctactaaaaatacaaaaaattagccgggcgcggtggcggrcgcctgtagtcccagctactgggaaggctgaggcaggagaatcacttgaacccgagaggcggagcttgcagtgagccgagatcgcgccactgcactccag

SEQ ID NO: 45993 - DNA, 201 bp, Homo sapiens
gcctgtagtcccagctactgggaaggctgaggcaggagaatcacttgaacccgagaggcggagcttgcagtgagccgagatcgcgccactgcactccagcstgggcgacagagcaagactccgtctcaaaaaaaaaaaaaagcaacaacaaaaaacccaaccaaccaaccaaacaaacaaagttataaaagttacagttaa

SEQ ID NO: 45994 - DNA, 201 bp, Homo sapiens
aatggtgtgaacccgggaggcggagcctgcagtgagccgagatctcgccattacactccagcctgggcgacagagcaagactccgtctcaaaaaaaaaaamaaaaaaaacaaaaaaaaaacagatttttatatgttttaattcctaaagccagctcacggccttcagatatgccacttgcctgatccctgttacctctgta

SEQ ID NO: 45995 - DNA, 201 bp, Homo sapiens
tggtgtgaacccgggaggcggagcctgcagtgagccgagatctcgccattacactccagcctgggcgacagagcaagactccgtctcaaaaaaaaaaacamaaaaaacaaaaaaaaaacagatttttatatgttttaattcctaaagccagctcacggccttcagatatgccacttgcctgatccctgttacctctgtaca

SEQ ID NO: 45996 - DNA, 201 bp, Homo sapiens
acaacaaaaaacccaaccaaccaaccaaacaaacaaagttataaaagttacagttaaataaattatattaaacacaaaggttagaaacactcaaactcatygcttcctaaacgccttactcccataatctatactcttggggttacttatgtctgttggatctgtatagtgaaaatactatataatactgtggtactgcaa

SEQ ID NO: 45997 - DNA, 201 bp, Homo sapiens
ggaggcggagcttgcagtgagctgagatcacgccactgcactccagcctgggcgaaagagcaagactctgtctcaaaaaaaaaaaaaaaaaaaaaaatagwataaaacaaaataaagatacagggaaatgaaattcatagtaagatgagtatttgactacaccgtaatttaaaacattagaacattgagatgcaaggtgta

SEQ ID NO: 45998 - DNA, 201 bp, Homo sapiens
aatactatataatactgtggtactgcaaagctcttcccaactctacattcaacgacaccatattggtaggttgaaatcagtgatggaagtatttacatcayggaaatgagaaaacagtacaaatcatgtcttcccccatccccagaaggctgtgtttggatcctaactctgccacttacttcctaggtggtctttgcaaaa

SEQ ID NO: 45999 - DNA, 201 bp, Homo sapiens
ctgaggagctggaactgcaggcctgcgacactgcacccagctaatttttttttcataaatattatgcttttgtacccagcttttttttttttttttttttttaactgcagccttgacctcccaggcttacatgatcctcccacctctgcttcctgagtagctgtgattacaggtgcatgccaccatgcccagtgaattaaa

SEQ ID NO: 46000 - DNA, 201 bp, Homo sapiens
aactttctgcttgggagagagagccacatgcccgggtgcacttgcaaaccagggtgcccctcatggtcaacctagcccaccacccaaactgtctgcctctyccccacagtgtacaagacccgactggtcaaggttcagctgtccaatgactttgacgagtacatcatggccattgagcagaccatcaagtcaggtcaggct

SEQ ID NO: 46001 - DNA, 201 bp, Homo sapiens
ccttcctgacctgccattcttccctccagcctcagctacatcatcgggaaggacacttgggtggagcactggcccgaggaggacgaatgccaagacgaagrgaaccagaaacaatgccaggacctcggcgccttcaccgagagcatggttgtctttgggtgccccaactgaccacacccccattcccccactccagataaa

SEQ ID NO: 46002 - DNA, 201 bp, Homo sapiens
aaatcagtgatggaagtatttacatcacggaaatgagaaaacagtacaaatcatgtcttcccccatccccagaaggctgtgtttggatcctaactctgccrcttacttcctaggtggtctttgcaaaattactgcatctctcagggctcagtatgctcatcaggttttatgagattaaatgtgtgggtatctgaatgacac

SEQ ID NO: 46003 - DNA, 201 bp, Homo sapiens
tgaggagctggaactgcaggcctgcgacactgcacccagctaatttttttttcataaatattatgcttttgtacccagcttttttttttttttttttttttaactgcagccttgacctcccaggcttacatgatcctcccacctctgcttcctgagtagctgtgattacaggtgcatgccaccatgcccagtgaattaaaa

SEQ ID NO: 46004 - DNA, 201 bp, Homo sapiens; identical to SEQ ID NO: 12722

SEQ ID NO: 46005 - DNA, 201 bp, Homo sapiens
agtgatggaagtatttacatcacggaaatgagaaaacagtacaaatcatgtcttcccccatccccagaaggctgtgtttggatcctaactctgccacttayttcctaggtggtctttgcaaaattactgcatctctcagggctcagtatgctcatcaggttttatgagattaaatgtgtgggtatctgaatgacacaaagt

SEQ ID NO: 46006 - DNA, 201 bp, Homo sapiens
gaggagctggaactgcaggcctgcgacactgcacccagctaatttttttttcataaatattatgcttttgtacccagcttttttttttttttttttttttwactgcagccttgacctcccaggcttacatgatcctcccacctctgcttcctgagtagctgtgattacaggtgcatgccaccatgcccagtgaattaaaaa

SEQ ID NO: 46007 - DNA, 201 bp, Homo sapiens
cctaggtggtctttgcaaaattactgcatctctcagggctcagtatgctcatcaggttttatgagattaaatgtgtgggtatctgaatgacacaaagtaastgtgagctatgatgatgaagaagataaagatgatgatgacgatgatgatgatgactggatgaggtgttcacagtggtatactgaatctggcgcatactag

SEQ ID NO: 46008 - DNA, 201 bp, Homo sapiens
ggggtgcagaacccccgagcagaagacctggtggggaagtctttgtacgtgtctgccaccgtcatcttgcactcaggtgaggcccagtctgaaggccaggstcaggaccaccaagtgggccggtctgagaggggagaccaggtcagaagagaaagcctagtctaaggagggaggctcagagtgaaagtggggttcagtctg

SEQ ID NO: 46009 - DNA, 201 bp, Homo sapiens
ttggccctggtgggagtatttacaccacagaaattgtaaatcattataaaccaaggatccctcaaccctcccactggagagctggctgttaaacgtttacyagcacaccatggggtacgtggatttctccagatacataatagatatgcagcaacaaggcagctcatggtggctaaaatatctgggaaattctcaaaaatg

SEQ ID NO: 46010 - DNA, 201 bp, Homo sapiens
tgggagtatttacaccacagaaattgtaaatcattataaaccaaggatccctcaaccctcccactggagagctggctgttaaacgtttactagcacaccayggggtacgtggatttctccagatacataatagatatgcagcaacaaggcagctcatggtggctaaaatatctgggaaattctcaaaaatggacaaatcta

SEQ ID NO: 46011 - DNA, 201 bp, Homo sapiens
tggaggagttgctgacgctggttggaaggttcagggtttggtgggatgtgtggccccctcgttgcccaggctttcaaaggccaggcccagctggctgagartgggagtcatggtggctgctgtcctgcccatgtggttgagacggtggcagtgcccagagaagataatggcattggcaagtgcgccggcagtcactggatc

SEQ ID NO: 46012 - DNA, 201 bp, Homo sapiens
cttttagctgagctgggacggatgaccctaagccaagctgagatggatagtcctaaggtatcaagctgggatgcataaccctgagctgagctgggatgcayggctctaagttttcgcaggtcctcattgtaaaccacacgagaaagtttgttgcgtcatttattcaacaaatgcgtattaagcattcatttcaaagggaga

SEQ ID NO: 46013 - DNA, 201 bp, Homo sapiens
gcacctccacctcccagatgctgggagcagagctctggaaaccgggggcctgggttcaagccccgcctccaccaccacctagtaaatccctcccctctgarcctcagtttgctcttccatcaaatgggagcaggaacacccccacctcacacgatcgtgaggggtgaaccgaggacacctagtaggtgcctcatccatctt

SEQ ID NO: 46014 - DNA, 201 bp, Homo sapiens
tttttaagggattccagctactttgttgttatggagatccagaacccaattaaagcctgtctatcatgtttgaggaaagtgcagtttgagtcaaagcctaktccagtccaatttcatttacttgctggtagtgtcaagctgtttttgtttatttatatatttatttagaggcaggatcttgctctttcgcccaggctggag

SEQ ID NO: 46015 - DNA, 201 bp, Homo sapiens
tctgggaatgttctcagctcacctagtcatgttcagaatggacaaatccctcagaggaagcagacacggtttctcgggacggtgatcctttagagccacaygcacatgcttgctttcttttattattatctttttttgagatggagtctcactccgtcaccgaggctggagtgcagtggcataatcttggctcactacaac

SEQ ID NO: 46016 - DNA, 201 bp, Homo sapiens
acctccacctcccagatgctgggagcagagctctggaaaccgggggcctgggttcaagccccgcctccaccaccacctagtaaatccctcccctctgagcytcagtttgctcttccatcaaatgggagcaggaacacccccacctcacacgatcgtgaggggtgaaccgaggacacctagtaggtgcctcatccatcttct

SEQ ID NO: 46017 - DNA, 201 bp, Homo sapiens
ggctggtccccgggaggcagggaccccagggtgtctgagtgtcatctcattttatccaaactcaatcaaccctatgtttcctggcactttattctctgccstggttaccacagaggtgttgttaccaggaactgtgggaatccttagttcctgtctaacttggaagaaagaattcagccaagagtcacatagcaagggtta

SEQ ID NO: 46018 - DNA, 201 bp, Homo sapiens
ccctgtccatcaccaccgacttcatcccttccttccgcctggtggcgtactacacgctgatcggtgccagcggccagagggaggtggtggccgactccgtktgggtggacgtcaaggactcctgcgtgggctcggtaagtgtgccctgggctcgctcgccccctctccctctccctactcctctctctctctctctctccc

SEQ ID NO: 46019 - DNA, 201 bp, Homo sapiens
tgagatggagtctcgctctgtcacacaggctgcagtacagtggtgcaatcttggctcactacaacctccgcctcccgtgttcaagtgattctcctgcctcrgcctcccaagtagctgggattacaggcacctgccaccacacccagctaatttttgtatttttagtagaaaagaggtttcaccgtgttggccaggctggtg

SEQ ID NO: 46020 - DNA, 201 bp, Homo sapiens
aatcttaccaatttttttttattttattattattactattttaagttccggggtacatgtgcaggatgtgcaggtttgttacataggtcaagtgtgccatrgtggtttcctgcacctatcaacccatcacctaggttttttgtttgtgtgttttgaggcagagtcttgttctgtcgcccaggctggagtgcagtggcacaa

SEQ ID NO: 46021 - DNA, 201 bp, Homo sapiens
ccctcgaagtctcctcttctgaactcctcccctcttagtctccatcactttctaagttccctcacctgagtccctccccctttctgagcccctcccatgtsagccccttccctttctgagtccccgccccttctgagcccctcctcctataagctctctcctccttgtgagctcttctttttgagttccctccctggtccc

SEQ ID NO: 46022 - DNA, 201 bp, Homo sapiens
atttattcaacaaatgcgtattaagcattcatttcaaagggagaagtgagagttgatgaaacaagagaggtaaggcaggagccaagtaattgagagcctcraatgtcagccaggacacccaaacaccaggaagtctagcatgcatctctttctgagctttctctgagccatccccaggctggacagagcagtgagcactgg

SEQ ID NO: 46023 - DNA, 201 bp, Homo sapiens
cccctgcgccacgcccacaccacgccccttcctgacctgccattcttccctccagcctcagctacatcatcgggaaggacacttgggtggagcactggccygaggaggacgaatgccaagacgaagagaaccagaaacaatgccaggacctcggcgccttcaccgagagcatggttgtctttgggtgccccaactgaccac

SEQ ID NO: 46024 - DNA, 201 bp, Homo sapiens
cgtgcgttggctcaatgaacagagatactacggtggtggctatggctctacccaggcaagtgggcccacagcccctaggcacatgcatccctgtctcctgyggcttcccactggcctcctagagaagacactgaggcccagcgaggcagttcttcattcccacgagccagtgtgattgcagtggagttgagaatcagtttt

SEQ ID NO: 46025 - DNA, 201 bp, Homo sapiens
cccactggcctcctagagaagacactgaggcccagcgaggcagttcttcattcccacgagccagtgtgattgcagtggagttgagaatcagtttttattasttgcaaacccatctataggttctagaatacaatctgggtactccaagctgtgtgttgagccttcttcttgccccaggtgtctagatcatgttctcagggc

SEQ ID NO: 46026 - DNA, 201 bp, Homo sapiens
catgagccaccgcgcccggcaatgctagggtgatcctaaggacagtgccctgctgaccatctgtgtgtctgtctgttcttttattcatccaatgactcccmccacctctaacactgcgtagccggaaggaatcagaatgaacaaaactgtggctgttcgcaccctggatccagaacgcctgggccgtggtgagtcggctgc

SEQ ID NO: 46027 - DNA, 201 bp, Homo sapiens
ggcagttcttcattcccacgagccagtgtgattgcagtggagttgagaatcagtttttattacttgcaaacccatctataggttctagaatacaatctggrtactccaagctgtgtgttgagccttcttcttgccccaggtgtctagatcatgttctcagggcccaggttcaggtctaagcctctctctccacctggtggg

SEQ ID NO: 46028 - DNA, 201 bp, Homo sapiens
ccacgagccagtgtgattgcagtggagttgagaatcagtttttattacttgcaaacccatctataggttctagaatacaatctgggtactccaagctgtgwgttgagccttcttcttgccccaggtgtctagatcatgttctcagggcccaggttcaggtctaagcctctctctccacctggtgggctctagaccaggttc

SEQ ID NO: 46029 - DNA, 201 bp, Homo sapiens
tcttgccccaggtgtctagatcatgttctcagggcccaggttcaggtctaagcctctctctccacctggtgggctctagaccaggttcccagttctatctsacaatcttaccctgtcttgctggtgggttctagaccatgttcccagttctaccaggctcccaatgtcacattgcctcactggcgggctctatagtatgtt

SEQ ID NO: 46030 - DNA, 201 bp, Homo sapiens
ctatctgacaatcttaccctgtcttgctggtgggttctagaccatgttcccagttctaccaggctcccaatgtcacattgcctcactggcgggctctatastatgttcccagttaccctggggcattacgcaaaccctcttctaggccatggtttcagtaacttcaggcttcagcaacttcaggctccagttggcctcctt

SEQ ID NO: 46031 - DNA, 201 bp, Homo sapiens
aacatacacaaccacgcaatacacacaaaacacacacaacacaacacaacatacataaccacaccacacacaacacacaaccacacaacactatcacacamcacacacaaacacacacaacacacaacacacacaacacacacaaaacacaacacacacacaacatacacaaccacacaacacacaaccacacaacataca

SEQ ID NO: 46032 - DNA, 201 bp, Homo sapiens
gactttctgatggattctagacatgttctcagcatctccaagtcctggtgtaagtttctgtctctcggagagttctgaacatgtcctcagagtccagtgasctccagttatcacccctgcactctctagtaggttctaggccacattttgatgtcccagctctgatttgaacctctttatcccccactggattctagccac

SEQ ID NO: 46033 - DNA, 201 bp, Homo sapiens
catttgccttccctgagttcctctacactacctatctctcaaatggcagcagggtcaacatcaccatagtctgctattctttgataactccatttatgctstctttgaagttcacttctggcattatcacttttcatttctttgctgcatttttatctttgttggccagttccctcttttcgtgatacattgttgtaaaat

SEQ ID NO: 46034 - DNA, 201 bp, Homo sapiens
catcttctataaacatctcatcttctgaccatttgcctcctccaacttgttatcagagtcttaaacaaccattgaaaaaaagcccttttggtttttttggktttttttttaagtgctttgtagagagcaaggtcttgcctcgttccctaacccaatcctgggctttgtttctttctttgatctatttctctcttctgttgt

SEQ ID NO: 46035 - DNA, 201 bp, Homo sapiens
ggactgggggtggggccaggtaagagccaggtgagggaccaggtgaagaccaggtgggggactgggggtggagtcaggtggggggctggagatgggaccasgtggggggctgggggtggagtcaggtggggggctgggggtggggaaggtggggggctgggggtggggcaaggtgaggggctgggggtgggaccaggtggg

SEQ ID NO: 46036 - DNA, 201 bp, Homo sapiens
gtgtatatctcttgaggagctggatggaccatgtccatcttccctactagacaaaagctctgtgagggctagagcctgtgtctggttttacaatggatcaraccgttgtacccattgtacattgcacattgtacattgacatttgcagaaggaacaaattgttgcatgaattaatactaagaagtttgaccttcctagggt

SEQ ID NO: 46037 - DNA, 201 bp, Homo sapiens
ttgcatgaattaatactaagaagtttgaccttcctagggtagcggggtaacacctagaagagactcagccctgcccagaccccctgattctgaatctgcarggggggatgactgccatgtgtggacacaccggtgaccccatccttgctttctgctctctatctcagggtggattacggaacaacaacgagaaagacatgg

SEQ ID NO: 46038 - DNA, 201 bp, Homo sapiens
aaaacacacacaacacaacacaacatacataaccacaccacacacaacacacaaccacacaacactatcacacaccacacacaaacacacacaacacacamcacacacaacacacacaaaacacaacacacacacaacatacacaaccacacaacacacaaccacacaacatacacgaccacacaacacagtgcacacaaa

SEQ ID NO: 46039 - DNA, 201 bp, Homo sapiens
tcccaacagccagctcaggccatgcatactccccaccctcaacccccagcagggcccggaccctggccaggggtggtcccttaggccagccttgcccaaayagccctggacctgcagagtccaggcaagcgctggctgagtggccggcggtcattaagcatccttaagcacggaccgcatacaacagctgggtcctggggc

SEQ ID NO: 46040 - DNA, 201 bp, Homo sapiens
cccttaggccagccttgcccaaacagccctggacctgcagagtccaggcaagcgctggctgagtggccggcggtcattaagcatccttaagcacggaccgyatacaacagctgggtcctggggcctgggaaggcaaaccaggcaaactgggccaggccctggtccctcccccacgctcattggctggttgacatggcagtc

SEQ ID NO: 46041 - DNA, 201 bp, Homo sapiens
ataaccctgagctgagctgggatgcacggctctaagttttcgcaggtcctcattgtaaaccacacgagaaagtttgttgcgtcatttattcaacaaatgcrtattaagcattcatttcaaagggagaagtgagagttgatgaaacaagagaggtaaggcaggagccaagtaattgagagcctcgaatgtcagccaggacac

SEQ ID NO: 46042 - DNA, 201 bp, Homo sapiens
tgtgggaatccttagttcctgtctaacttggaagaaagaattcagccaagagtcacatagcaagggttaagtagcagagtttattgaaggaagaaacagckctgggctggtccccctggaaaaatagtagtagcaatgcttatttaaagagagagggccagcctcgatggctcatacctataatcccagcactttgggagg

SEQ ID NO: 46043 - DNA, 201 bp, Homo sapiens
tctgagttgtcccagatataacacacatgtgacccagattatacaaaaattgatggggaatttatgtgcaggcaccaaggcatcaaatagagatgaaggtrgcctcagggactctgccaggatgctttgctcctctctcccgtgatcttcattccgttcttggccaataattcagttcaggcagaatatggctgccttcct

SEQ ID NO: 46044 - DNA, 201 bp, Homo sapiens
gttgcggtgagctgagattgtgccactgcactccagcctgggcaacaagagcaaaactccttctctaaataaataaaaagtgaccgtatgctctgaaagaygacacagacatggctgctcaacagaacgagccagcagcagatactgctggtagactctttttatgagactcttacatgatttttcgtgaaggggcgtgag

SEQ ID NO: 46045 - DNA, 201 bp, Homo sapiens
ccctgagactccaccccctctctgagagccctcccctccctgaaagccccccaccctcaatatccttctcctctctgaatcccttgtcctcttgagaactyttccacctcctcgttctgatcccccaccctctttgagtccttccctttttaaggtcccctcctcccagaacccctccgccaccctgagcccctgtcccct

SEQ ID NO: 46046 - DNA, 201 bp, Homo sapiens
cccccaccctcaatatccttctcctctctgaatcccttgtcctcttgagaacttttccacctcctcgttctgatcccccaccctctttgagtccttccctytttaaggtcccctcctcccagaacccctccgccaccctgagcccctgtcccctctctgcaccccgcccctgccctttctggcgtgccccctctgctcagc

SEQ ID NO: 46047 - DNA, 201 bp, Homo sapiens
cttcagcaaagacaggctgagttagggagagctcctgcggagtggactaagagctgagacccaggagcctggccttgtccactccccgaccttgacactcmgtgttctgtctctgcccgagcagggatctgtgtggcagaccccttcgaggtcacagtaatgcaggacttcttcatcgacctgcggctaccctactctgtt

SEQ ID NO: 46048 - DNA, 201 bp, Homo sapiens
accagcagaccgtaaccatcccccccaagtcctcgttgtccgttccatatgtcatcgtgccgctaaagaccggcctgcaggaagtggaagtcaaggctgcygtctaccatcatttcatcagtgacggtgtcaggaagtccctgaaggtcgtggtgagtgcttggggcacccacaaacccttgtccttcagagagggctcct

SEQ ID NO: 46049 - DNA, 201 bp, Homo sapiens
catagtgtccagcttaggaaatttggaagtcccagatttcagaagcagagccaggattggggtaaagtgagtgagatgaccccaggcttagaattttaggkggtgccaaaaacctcgtcgaccatcaccaatcaataatttttttatactcgatttaaaatttatttatttatttatttatttatttatttatttatttat

SEQ ID NO: 46050 - DNA, 201 bp, Homo sapiens
gtgccacttgggacttccactccaagactagaaaggaggctgtaggctgtgcatctccagttgatagattaggaaccgaggctgggaggaggggttggacmttcccaggggccctgcagagctggaatcaaaacccactgctctccattttcccagggcgggagtctatagggccccagcttgtttctgctgagtgtacca

SEQ ID NO: 46051 - DNA, 201 bp, Homo sapiens
cagtgggagaagttcggcctagagaagcggcagggggccttggagctcatcaagaagggtgggctccctgcccctcttggagaccccagggacccctttcygagcgcatccctcccctaagatcccacctcatctcaagaccacgccctcccctgaggctccaccttctctcctagccactcccctcatttgaggccccac

SEQ ID NO: 46052 - DNA, 201 bp, Homo sapiens
gagtctaagagactcaagggtctgagaatcccaaagatcagaaagtagagggggtcttggggtctgagggatctgaggggttgaagacctagcatctccakgtctgaagactgagaactggggatctgggcctcccaggcatggtctttggagggaggcccttatcctctcatcttcacatcacatctgcccgcagaggaa

SEQ ID NO: 46053 - DNA, 201 bp, Homo sapiens
cccctttctgagcccctcccatgtgagccccttccctttctgagtccccgccccttctgagcccctcctcctataagctctctcctccttgtgagctcttstttttgagttccctccctggtcccccctctcccctcgcacctccttcacatgcccctccctccccaaaacggccacctcggaagaccaagaataatgggc

SEQ ID NO: 46054 - DNA, 201 bp, Homo sapiens
agaagggggggctgagtgggggaaaggcaggagccagataaaaagccagctccagcaggcgctgctcactcctccccatcctctccctctgtccctctgtscctctgaccctgcactgtcccagcaccatgggacccacctcaggtcccagcctgctgctcctgctactaacccacctccccctggctctggggagtccca

SEQ ID NO: 46055 - DNA, 201 bp, Homo sapiens
aggctaaagatatttgcgaggagcaggtcaacgtaagtgccctccatcttcccaccctaccctaccttacccgatgcagagcacagccaccttggagagtragaggttgccttcagggaatttgcagctctcccagtgcaataacagacatcactgcagtcatgttaatagctaacatcttttgagcacttaactcatcta

SEQ ID NO: 46056 - DNA, 201 bp, Homo sapiens
ccaacttgttatcagagtcttaaacaaccattgaaaaaaagcccttttggtttttttgggtttttttttaagtgctttgtagagagcaaggtcttgcctcrttccctaacccaatcctgggctttgtttctttctttgatctatttctctcttctgttgttttctttctttcaggagacagggtcttgctctgtcacccag

SEQ ID NO: 46057 - DNA, 201 bp, Homo sapiens
gactggagtacagtgtcttgatactagctcactgcaaagtcaaattcctgggctcaagggatcctcctgcctcagccacctgaggagctggaactgcaggyctgcgacactgcacccagctaatttttttttcataaatattatgcttttgtacccagcttttttttttttttttttttttaactgcagccttgacctccc

SEQ ID NO: 46058 - DNA, 201 bp, Homo sapiens
gggtcttgatatgttgctcaagttggtctcaaactactggcctcaagcgatcttcctgcctcagcctcccaaagggctgggattccaagcatgagccaccrcacctgccccctcttctgttattttctctccatctggcattctctgactctttcatctctaccatgatttgggctttctcctctcccttctcttatttct

SEQ ID NO: 46059 - DNA, 201 bp, Homo sapiens
ttagtgaggtaggatagggcgggagggagctagagccatcggtatctctcactcaccctgcagaaggagtgcagaaagaggacatcccacctgcagacctyagtgaccaagtcccggacaccgagtctgagaccagaattctcctgcaaggtgagacacccttgaccccgaccccatgggtcccaggagggcatggacgga

SEQ ID NO: 46060 - DNA, 201 bp, Homo sapiens
actttctgcttgggagagagagccacatgcccgggtgcacttgcaaaccagggtgcccctcatggtcaacctagcccaccacccaaactgtctgcctctcycccacagtgtacaagacccgactggtcaaggttcagctgtccaatgactttgacgagtacatcatggccattgagcagaccatcaagtcaggtcaggctc

SEQ ID NO: 46061 - DNA, 201 bp, Homo sapiens
ggaggctgaagcaggataatcgattgaacgtgggaggcgtaggttgcagtaagccgagatcaggccactgcactccagcctgggcggcagagcaagacttygtctcaaacaaaaacaaacaaacaaacaaacaaaaagacaagcaacatagtacaagagcagaaattctggaggtcatttcttgccccaggagggaagact

SEQ ID NO: 46062 - DNA, 201 bp, Homo sapiens
ctgcaacctccgcctcccaggttcaagtaattctcctgcctcggcctccccagtagctgggattacaggtgcccgccaccaatcctagttaatttttgtayttttagtagagatggggtttcaccatgttggccaggctggtcttgaactcctgacctcaggtgatccacccatctcggccttccaaagtgctgggatgac

SEQ ID NO: 46063 - DNA, 201 bp, Homo sapiens
tcccaggttcaagtaattctcctgcctcggcctccccagtagctgggattacaggtgcccgccaccaatcctagttaatttttgtatttttagtagagatrgggtttcaccatgttggccaggctggtcttgaactcctgacctcaggtgatccacccatctcggccttccaaagtgctgggatgacaggtgtgagccacc

SEQ ID NO: 46064 - DNA, 201 bp, Homo sapiens
cagctggccttcagacaacccagctctgcctttgcggccttcgtgaaacgggcacccagcacctggtgagtcccaacagccagctcaggccatgcatactycccaccctcaacccccagcagggcccggaccctggccaggggtggtcccttaggccagccttgcccaaacagccctggacctgcagagtccaggcaagcg

SEQ ID NO: 46065 - DNA, 201 bp, Homo sapiens
gctcctgagtctcgcaggatgaacacgagagagagccccacctccatgtgcccactgcccaattccctttgcaaagattgggctggggggtgggggcaggsagatatatgagccagaggcgtcactccagcattgcaaaaaccagagacctgcgaagcccagcgcaaaatgaagagacacggcccctcgctcagaaattat

SEQ ID NO: 46066 - DNA, 201 bp, Homo sapiens
gagtctcgcaggatgaacacgagagagagccccacctccatgtgcccactgcccaattccctttgcaaagattgggctggggggtgggggcaggcagatawatgagccagaggcgtcactccagcattgcaaaaaccagagacctgcgaagcccagcgcaaaatgaagagacacggcccctcgctcagaaattattaagaa

SEQ ID NO: 46067 - DNA, 201 bp, Homo sapiens
ctgccacctagtatgctaatccctgccgtctgtgagagttgactccctcagggacactttttctgacctccccaactgggtcacactcccacagttcattmtcgctgcgatgtcctctttcccttgcacagaactcatccacttataagtatatatctcttggctgggcgcagtggctcatgcctgtaatcccagcactgt

SEQ ID NO: 46068 - DNA, 201 bp, Homo sapiens
ccacctagtatgctaatccctgccgtctgtgagagttgactccctcagggacactttttctgacctccccaactgggtcacactcccacagttcattatcrctgcgatgtcctctttcccttgcacagaactcatccacttataagtatatatctcttggctgggcgcagtggctcatgcctgtaatcccagcactgtggg

SEQ ID NO: 46069 - DNA, 201 bp, Homo sapiens
gaggaaaaaaaaagaagagagagagaaacagagagaaagaaaaagaaaggagataaagaggaagggagggagggagtgaagaatgaaggaaggaaagaagsaaggaaggaaggagggaaggagggaaggaaagggggagcaaaggaaggaggaaaggaggaatggagggaggaagggagggagaggaaggaagggaaagaa

SEQ ID NO: 46070 - DNA, 201 bp, Homo sapiens
cagtcatgttaatagctaacatcttttgagcacttaactcatctaatacagacccgccctctaatagtttcacatgttaagtctcataatccttttagcascctgaaaggtaagtcactcttattatccccagtttgcagatgagaaaactgaggcacaaagagatcaaaggtggggattctttctgtctgccttacaatt

SEQ ID NO: 46071 - DNA, 201 bp, Homo sapiens
ttggggtaaagtgagtgagatgaccccaggcttagaattttagggggtgccaaaaacctcgtcgaccatcaccaatcaataatttttttatactcgatttraaatttatttatttatttatttatttatttatttatttatttatttttgagacagagtctcactctgttccccaggctggagtgcagtggcgcgatctca

SEQ ID NO: 46072 - DNA, 201 bp, Homo sapiens
ctgaacatgtcctcagagtccagtgacctccagttatcacccctgcactctctagtaggttctaggccacattttgatgtcccagctctgatttgaacctstttatcccccactggattctagccactttcccaggctcccagatcaccatctttctctcttgtgggttctaggccaccttcatggtgttccaagccttgg

SEQ ID NO: 46073 - DNA, 201 bp, Homo sapiens
aaatactttgatctgtattttaggtttcataaaatttacagttgaaaaggtagattctcaggccgggtgcaaaggctcaagcctgtaatcccattactttsagaggctgaggccggcaaatcatttgaggtcggagtttgagaccagcctgggcaacatggcaaagccccgtctctacaaaaaaaaaaaaagaaaagaaaa

SEQ ID NO: 46074 - DNA, 201 bp, Homo sapiens
tctctctgtcacccaggctggagtgcagtggtgcaatctcagctcactgcaacctctgcctcccggcttcaagcgattctcctgcctcagcctcctgagtrgctgggattacaggcacccaccaccacgcctggctaatttttgtactttcagtaaagacggggtttcaccatgttggccaggctggtctccaactcctgg

SEQ ID NO: 46075 - DNA, 201 bp, Homo sapiens
tcctccttgtgagctcttctttttgagttccctccctggtcccccctctcccctcgcacctccttcacatgcccctccctccccaaaacggccacctcggragaccaagaataatgggcaggcaaggagggacccagcccaagatccggaagctggaccgtgggcatggggccttggaacagacccctgacaatgccctgc

SEQ ID NO: 46076 - DNA, 201 bp, Homo sapiens
ctgaggctccaccttctctcctagccactcccctcatttgaggccccacctcttctcaaggctacgccctctgaggccctgactcctcccaggccaggctyttcatgagaccccgcctctcctcaaggccatgcccatcccctgagggccccccacctcttctcaaggccacgccctctgaggccctgactcctcccaggc

SEQ ID NO: 46077 - DNA, 201 bp, Homo sapiens
gcatagacattctcatttgcctagaggggttctgtcctgcacagtggggtcctgccgtctgcatggaggggtccgcagtttgaggaaacaggaatcttccycttgcatgccctgctccttccacttacacggagaggcgctccatccacgcacagtctttccactcccatgggggaaggagcctgaatctcacaaggaggg

SEQ ID NO: 46078 - DNA, 201 bp, Homo sapiens
aggccccacctcttctcaaggctacgccctctgaggccctgactcctcccaggccaggcttttcatgagaccccgcctctcctcaaggccatgcccatccyctgagggccccccacctcttctcaaggccacgccctctgaggccctgactcctcccaggccaggctcttcatgagaccccgcctctcctcaaggccatgc

SEQ ID NO: 46079 - DNA, 201 bp, Homo sapiens
ggctccagtcttcagcacaggcaggagaagctgggggagatcccattctccaggagggatggacctgaagccctccttgtctgtcccgtaggttcctctaygggaagaaagtggagggaactgcctttgtcatcttcgggatccaggatggcgaacagaggatttccctgcctgaatccctcaagcgcattccggtaccat

SEQ ID NO: 46080 - DNA, 201 bp, Homo sapiens
tcttctcaaggccacgccctctgaggccctgactcctcccaggccaggctcttcatgagaccccgcctctcctcaaggccatgcccatcccctgagggccycccacctcttctcaaggccacgccctctgaggccctgactcctcccaggccagaatctcgagaccctgcctcttttcaaggccacgcccatcccctgagt

SEQ ID NO: 46081 - DNA, 201 bp, Homo sapiens
ccaggccaggctcttcatgagaccccgcctctcctcaaggccatgcccatcccctgagggcctcccacctcttctcaaggccacgccctctgaggccctgmctcctcccaggccagaatctcgagaccctgcctcttttcaaggccacgcccatcccctgagtccccacatcttctcaaggccacacccttctgtgaggcg

SEQ ID NO: 46082 - DNA, 201 bp, Homo sapiens
aggagaattgtttgaacccaggaggtggagggtgcagtgagctgagatagcgccactgccctccagcctgggtgacagggcaagactctaaaaaaaaaacwaacaaacaaaatatcccccaaaaagtaggaggctggttactttctcacaatataacaagaggcctgtaacctgtaagaatgaggaagttctttgctcact

SEQ ID NO: 46083 - DNA, 201 bp, Homo sapiens
gagggccagcctcgatggctcatacctataatcccagcactttgggaggccgaggcaggggaatcacttcaggtcaggagttcaagaccagcctggtcaaygtggtgaaaccccgtctctactgaaagtacaaaacaattagccaggcagggggtggcaggtgcctataatcccagctactcgggaggctgaggcaggaga

SEQ ID NO: 46084 - DNA, 201 bp, Homo sapiens
gggaatcacttcaggtcaggagttcaagaccagcctggtcaatgtggtgaaaccccgtctctactgaaagtacaaaacaattagccaggcagggggtggcrggtgcctataatcccagctactcgggaggctgaggcaggagattcggttgaacccgggaggtggaggttgcggtgagctgagattgtgccactgcactcc

SEQ ID NO: 46085 - DNA, 201 bp, Homo sapiens
gtgaaattggccctggtgggagtatttacaccacagaaattgtaaatcattataaaccaaggatccctcaaccctcccactggagagctggctgttaaacktttactagcacaccatggggtacgtggatttctccagatacataatagatatgcagcaacaaggcagctcatggtggctaaaatatctgggaaattctca

SEQ ID NO: 46086 - DNA, 201 bp, Homo sapiens
aaggtgagggttggcctggaggggtgaagggagatgcatggctgaagttcagggcgggagatactgagctgggatgcatggcttttagctgagctgggacrgatgaccctaagccaagctgagatggatagtcctaaggtatcaagctgggatgcataaccctgagctgagctgggatgcacggctctaagttttcgcagg

SEQ ID NO: 46087 - DNA, 201 bp, Homo sapiens
aaggtatcaagctgggatgcataaccctgagctgagctgggatgcacggctctaagttttcgcaggtcctcattgtaaaccacacgagaaagtttgttgcrtcatttattcaacaaatgcgtattaagcattcatttcaaagggagaagtgagagttgatgaaacaagagaggtaaggcaggagccaagtaattgagagcc

SEQ ID NO: 46088 - DNA, 201 bp, Homo sapiens
tctttttagaggcagggcctcactgtgttgcccaggctggtctcgaactcctagccttgagcattcctctgccttgggctgccaaagttttgggatcacargcatgagccactatgcccagcctaaatgtttctattacaacatttaaaattatcatactgccagttataaagatacagggaaatggccgggtgtggcggc

SEQ ID NO: 46089 - DNA, 201 bp, Homo sapiens
aatttacagttgaaaaggtagattctcaggccgggtgcaaaggctcaagcctgtaatcccattactttcagaggctgaggccggcaaatcatttgaggtcrgagtttgagaccagcctgggcaacatggcaaagccccgtctctacaaaaaaaaaaaaagaaaagaaaagaaaagagaaagaaaaggtagatcctcatact

SEQ ID NO: 46090 - DNA, 201 bp, Homo sapiens
tatgttgctcaagttggtctcaaactactggcctcaagcgatcttcctgcctcagcctcccaaagggctgggattccaagcatgagccaccacacctgccmcctcttctgttattttctctccatctggcattctctgactctttcatctctaccatgatttgggctttctcctctcccttctcttatttcttcccattct

SEQ ID NO: 46091 - DNA, 201 bp, Homo sapiens
ctgagaggctggtggcagcacacccagggtcattcagtggggaaggtttccggagtagggacgaagatggagatggggttggcttgggatcaggagtgagratgggaatgcagatggaatcagaggggaaatggagataagatttggaatggaggccaggtgcggtggctcacgtctggaatcccagcactttgggaggtc

SEQ ID NO: 46092 - DNA, 201 bp, Homo sapiens
gcatctccaggtctgaagactgagaactggggatctgggcctcccaggcatggtctttggagggaggcccttatcctctcatcttcacatcacatctgccygcagaggaaagctgtacccggttctaccatccggaaaaggaggatggaaagctgaacaagctctgccgtgatgaactgtgccgctgtgctgagggtgagt

SEQ ID NO: 46093 - DNA, 201 bp, Homo sapiens
aaaggctcaagcctgtaatcccattactttcagaggctgaggccggcaaatcatttgaggtcggagtttgagaccagcctgggcaacatggcaaagccccrtctctacaaaaaaaaaaaaagaaaagaaaagaaaagagaaagaaaaggtagatcctcatactcaagtagttgcaaaaatacttaaacgttttccactcaa

SEQ ID NO: 46094 - DNA, 201 bp, Homo sapiens
agtctccctacatttcccaggctggtcttgaacccttgaccttgagcaatcttcccacttctgcctctcaaagtgctgggattacaggcttgagccattgmgctcgccctaatacattattttttgagatggggtctcgctctttcacccagactggagtgcagtggtgcaatgatgtctcatgatgtttaaatgttggca

SEQ ID NO: 46095 - DNA, 201 bp, Homo sapiens
gctggaggaggccgctgtctgaggggggaggaggcccctgtctgagggggcaggaggtccctgtctcaggggggaggaggcccctgtctgaggagggaggaaacctccgtctgaggagggaggaggtccctgtctgaggagggaggaggccttgaggggggaggaggtccccgtctgaggagggaggaggcctctgtctga

SEQ ID NO: 46096 - DNA, 201 bp, Homo sapiens
cctcccacctcttctcaaggccacgccctctgaggccctgactcctcccaggccagaatctcgagaccctgcctcttttcaaggccacgcccatcccctgrgtccccacatcttctcaaggccacacccttctgtgaggcgccacctcctgtcccagccactctcatctgaggccccacgtcctctccaggccatgcctct

SEQ ID NO: 46097 - DNA, 201 bp, Homo sapiens
cctaccaccatgcctggctaatttttgtatttttagtagagacagggtttcatcacgttggccaggctggtcttgaactcctgacctcaggtgatctgccygcctcagcctcccagagtgctgggatgacaggcgtgagccgctgcgcccacctgggtccctgttcttaaccacagtagacactgtgcacagagaatgtcc

SEQ ID NO: 46098 - DNA, 201 bp, Homo sapiens
ctggaggaggccgctgtctgaggggggaggaggcccctgtctgagggggcaggaggtccctgtctcaggggggaggaggcccctgtctgaggagggaggaaacctccgtctgaggagggaggaggtccctgtctgaggagggaggaggccttgaggggggaggaggtccccgtctgaggagggaggaggcctctgtctgag

SEQ ID NO: 46099 - DNA, 201 bp, Homo sapiens
ccctgccccagtccccgccacctctgagcccgctcccctctctgagccctcctctcccttctcagattgaggatggctcgggggaggttgtgctgagccgraaggtactgctggacggggtgcagaacccccgagcagaagacctggtggggaagtctttgtacgtgtctgccaccgtcatcttgcactcaggtgaggccc

SEQ ID NO: 46100 - DNA, 201 bp, Homo sapiens
ggaggaggccgctgtctgaggggggaggaggcccctgtctgagggggcaggaggtccctgtctcaggggggaggaggcccctgtctgaggagggaggaaasctccgtctgaggagggaggaggtccctgtctgaggagggaggaggccttgaggggggaggaggtccccgtctgaggagggaggaggcctctgtctgagga

SEQ ID NO: 46101 - DNA, 201 bp, Homo sapiens
aggctaccaggaccatgcaggctctgccctacagcaccgtgggcaactccaacaattacctgcatctctcagtgctacgtacagagctcagacccggggasaccctcaacgtcaacttcctcctgcgaatggaccgcgcccacgaggccaagatccgctactacacctacctggtccgtggccacctggaaacctcagccc

SEQ ID NO: 46102 - DNA, 201 bp, Homo sapiens
gaggaggccgctgtctgaggggggaggaggcccctgtctgagggggcaggaggtccctgtctcaggggggaggaggcccctgtctgaggagggaggaaacstccgtctgaggagggaggaggtccctgtctgaggagggaggaggccttgaggggggaggaggtccccgtctgaggagggaggaggcctctgtctgaggag

SEQ ID NO: 46103 - DNA, 201 bp, Homo sapiens
aggaggccgctgtctgaggggggaggaggcccctgtctgagggggcaggaggtccctgtctcaggggggaggaggcccctgtctgaggagggaggaaacctccgtctgaggagggaggaggtccctgtctgaggagggaggaggccttgaggggggaggaggtccccgtctgaggagggaggaggcctctgtctgaggaga

SEQ ID NO: 46104 - DNA, 201 bp, Homo sapiens
tatgaatttggggtctgagggtcccaggcttctgtgagttgagagtctaagagactcaagggtctgagaatcccaaagatcagaaagtagagggggtcttrgggtctgagggatctgaggggttgaagacctagcatctccaggtctgaagactgagaactggggatctgggcctcccaggcatggtctttggagggaggc

SEQ ID NO: 46105 - DNA, 201 bp, Homo sapiens
gaaagtagagggggtcttggggtctgagggatctgaggggttgaagacctagcatctccaggtctgaagactgagaactggggatctgggcctcccaggcrtggtctttggagggaggcccttatcctctcatcttcacatcacatctgcccgcagaggaaagctgtacccggttctaccatccggaaaaggaggatggaa

SEQ ID NO: 46106 - DNA, 201 bp, Homo sapiens
gaccctgcctcttttcaaggccacgcccatcccctgagtccccacatcttctcaaggccacacccttctgtgaggcgccacctcctgtcccagccactctyatctgaggccccacgtcctctccaggccatgcctcttccctgagactccaccccctctctgagagccctcccctccctgaaagccccccaccctcaatat

SEQ ID NO: 46107 - DNA, 201 bp, Homo sapiens
cgttctgatcccccaccctctttgagtccttccctttttaaggtcccctcctcccagaacccctccgccaccctgagcccctgtcccctctctgcaccccrcccctgccctttctggcgtgccccctctgctcagccccggctcttttgggggttcctctctcttctctgcagggtacacccagcagctggccttcagaca

SEQ ID NO: 46108 - DNA, 201 bp, Homo sapiens
tgtggaatccaggtatggtggaattggagtttgggatgtttctagaattgaggtcatctgttggtttagggtgtatgtggtgttcattgatggtgcggttgggggtgtttggagactcggaggtttggactttacaagatttgggagtttgcagcttggggacttgcaattttcagtgtgggtttaaagattggctacttc

SEQ ID NO: 46109 - DNA, 201 bp, Homo sapiens
gggcatgtgtgggtttaggcgattgtgggtctggaagtccagagacttggaggagttgctgacgctggttggaaggttcagggtttggtgggatgtgtggccccctcgttgcccaggctttcaaaggccaggcccagctggctgagagtgggagtcatggtggctgctgtcctgcccatgtggttgagacggtggcagtgc

SEQ ID NO: 46110 - DNA, 201 bp, Homo sapiens
atgccccaacctcttctccatccagaatctctacgaagctcatgaatatatttttgaaagactccatcaccacgtgggagattctggctgtgagcatgtcrgacaagaaaggtgagagaggatgctggctggtccccgggaggcagggaccccagggtgtctgagtgtcatctcattttatccaaactcaatcaaccctat

SEQ ID NO: 46111 - DNA, 201 bp, Homo sapiens
gaactcgtcaagtatgtcaggttcttgaggagggggctcagggctcccctatccccggagagggagcaggggggctccgaggcctgagagaccactcatcygccctcctcacagcatgggccagtggaagatccgagcctactatgaaaactcaccacagcaggtcttctccactgagtttgaggtgaaggagtacggtaa

SEQ ID NO: 46112 - DNA, 201 bp, Homo sapiens
tcctccccttctaagccctgaccttccctgagaccccaccccttctgagactcctccccttctgagtccctcccttccctgagaccccaccccttctgagrctcctccccttctaagtccctcccttccctgagaccccaccccttctgaggttcctccccttctctgagactccaccccttctgagtctcctccccctct

SEQ ID NO: 46113 - DNA, 201 bp, Homo sapiens
aaaaaaaaaaaaaaaagtgtatatctcttgaggagctggatggaccatgtccatcttccctactagacaaaagctctgtgagggctagagcctgtgtctgsttttacaatggatcagaccgttgtacccattgtacattgcacattgtacattgacatttgcagaaggaacaaattgttgcatgaattaatactaagaagt

SEQ ID NO: 46114 - DNA, 201 bp, Homo sapiens
tttctgtctttccactctagcccagcacccactccatcccaggcactcctctctcccagggctgacttctttcggcgtctccaccctccccacagctggtrgtaaaaagcggccagtcagaagaccggcagcctgtacctgggcagcagatgaccctgaagatagagggtgaccacggggcccgggtggtactggtggccg

SEQ ID NO: 46115 - DNA, 201 bp, Homo sapiens
ctgaacaagctctgccgtgatgaactgtgccgctgtgctgagggtgagttccctggagccgggaacaggtgggtctgagcaagccacacttacccaggtcrtctatcccatggtcagggacccccagacccatacccaggggataccaaggggggtaggctcccagggctggccacacccatgggcagtaggccccagata

SEQ ID NO: 46116 - DNA, 201 bp, Homo sapiens
aaacactacctcatgtggggtctctcctccgatttctggggagagaagcccaagtgagtgctttccctgcgcgtgcgcgcgaccgcccgactgccccgccyatgccacgcccacaccattgtcacgcccctgcgccacgcccacaccacgccccttcctgacctgccattcttccctccagcctcagctacatcatcggga

SEQ ID NO: 46117 - DNA, 201 bp, Homo sapiens
tgtgtatctgatactgttctaagtatccaccatgaggtagacaacacagacagtccttgctttgcatgttaatgtgagaccacagcaatgaccacgtaagytgagactgtcaaagcatcttagtaatcaatggaggaaagtacacaatcattccatgacctttaaagttttctttttttctttttagagagatagggtctt

SEQ ID NO: 46118 - DNA, 201 bp, Homo sapiens
gtatccaccatgaggtagacaacacagacagtccttgctttgcatgttaatgtgagaccacagcaatgaccacgtaagctgagactgtcaaagcatcttaktaatcaatggaggaaagtacacaatcattccatgacctttaaagttttctttttttctttttagagagatagggtcttgctctgtcagccaggctggagt

SEQ ID NO: 46119 - DNA, 201 bp, Homo sapiens
cttgctttgcatgttaatgtgagaccacagcaatgaccacgtaagctgagactgtcaaagcatcttagtaatcaatggaggaaagtacacaatcattccaygacctttaaagttttctttttttctttttagagagatagggtcttgctctgtcagccaggctggagtgcagtggcacaatcatagctcactgtaacctca

SEQ ID NO: 46120 - DNA, 201 bp, Homo sapiens
aatcacttcaggtcaggagttcaagaccagcctggtcaatgtggtgaaaccccgtctctactgaaagtacaaaacaattagccaggcagggggtggcaggygcctataatcccagctactcgggaggctgaggcaggagattcggttgaacccgggaggtggaggttgcggtgagctgagattgtgccactgcactccagc

SEQ ID NO: 46121 - DNA, 201 bp, Homo sapiens
ccgctcccctctctgagccctcctctcccttctcagattgaggatggctcgggggaggttgtgctgagccggaaggtactgctggacggggtgcagaaccyccgagcagaagacctggtggggaagtctttgtacgtgtctgccaccgtcatcttgcactcaggtgaggcccagtctgaaggccaggctcaggaccaccaa

SEQ ID NO: 46122 - DNA, 201 bp, Homo sapiens
gctctgttgcccctcactgggagggaagcaagtctcatgacagctgcggaggttgcagatggcctcccagtccctctgcagctcccaggctgcgcaccccwcttacccctccctgtgctcagcatgtgcgtgaatttccggtggctaccatgagaaatggccacagcctagtgatctaaagcaacacacatttatgggtct

SEQ ID NO: 46123 - DNA, 201 bp, Homo sapiens
ctgcgaatggaccgcgcccacgaggccaagatccgctactacacctacctggtccgtggccacctggaaacctcagcccccgcctcctccttgtttcttcygcacccctgggactccttcccccatcccggatccctccctgcgttccctgccactcaccctccccagcctgatgccagcctgtccccccagatcatgaac

SEQ ID NO: 46124 - DNA, 201 bp, Homo sapiens
tacttatgaaacaagacagaagccaagtgcagtggctcacgcctgtaattctagcattttgggaggctgaggtgggcagatcacctgaggtcaggagttcragaccagcctggccaacatatagacaacatatatgttacaacatatataatggccaacatataatacaaaaattagctatgcatggtggtgggcgcctgt

SEQ ID NO: 46125 - DNA, 201 bp, Homo sapiens
agcagatgaccctgaagatagagggtgaccacggggcccgggtggtactggtggccgtggacaagggcgtgttcgtgctgaataagaagaacaaactgacrcagagtaaggtaagggccagtgacccaaggctgctgagaagaggcggaggcacggagctggggctgggggaggtgggtgggactggagagggcagtgcag

SEQ ID NO: 46126 - DNA, 201 bp, Homo sapiens
agaaggagtctcactcggtcatccagccataatttatatggtttattataatttataataaatttaattataatatttatttatatatttattaattgtaatatgtttataattataatatataattatatattacataatatatttcatatctacatatcacatattacatatgcaatatattatataccacatattaca

SEQ ID NO: 46127 - DNA, 201 bp, Homo sapiens
gaaggagtctcactcggtcatccagccataatttatatggtttattataatttataataaatttaattataatatttatttatatatttattaattgtaatatgtttataattataatatataattatatattacataatatatttcatatctacatatcacatattacatatgcaatatattatataccacatattacat

SEQ ID NO: 46128 - DNA, 201 bp, Homo sapiens
cctggcccagcgccggccccaccaacgccatctctcccccagtgctgcccagtttcgaggtcatagtggagcctacagagaaattctactacatctataaygagaagggcctggaggtcaccatcaccgccaggtgagggactgggggtggggccaggtaagagccaggtgagggaccaggtgaagaccaggtgggggact

SEQ ID NO: 46129 - DNA, 201 bp, Homo sapiens
ataattataatatataattatatattacataatatatttcatatctacatatcacatattacatatgcaatatattatataccacatattacatatataayataccacatattacatatataatatatcatatattatatattacatatataatatatcatatattatatattacatatataatatatcatatattatata

SEQ ID NO: 46130 - DNA, 201 bp, Homo sapiens
cttttttttttgatacaggagcttgctctgtcacctaggatggagtgcagtggtgtaaacaggatgctaagttttctttttttagtagagacagggtgtcrccatgttggccaggctggtctcaaactcctggcctcaagcaatctgccttcctcagcctcccaaagtgctggaattacaggcgtgagccaccgcgcccag

SEQ ID NO: 46131 - DNA, 201 bp, Homo sapiens
caattaccggcagaaccaagagctcaaggtgggtcccggggtggcagaggcttcttggaggctgccagggggtaggtagcctgttgcacacacacttgccyggatcctttctctccctggcaggtgagggtggaactactccacaatccagccttctgcagcctggccaccaccaagaggcgtcaccagcagaccgtaacc

SEQ ID NO: 46132 - DNA, 201 bp, Homo sapiens
tgctaagttttctttttttagtagagacagggtgtcgccatgttggccaggctggtctcaaactcctggcctcaagcaatctgccttcctcagcctcccaragtgctggaattacaggcgtgagccaccgcgcccagcgcaggatgctaggttttcactggaaatactttgatctgtattttaggtttcataaaatttaca

SEQ ID NO: 46133 - DNA, 201 bp, Homo sapiens
cataaccctgagctgagctgggatgcacggctctaagttttcgcaggtcctcattgtaaaccacacgagaaagtttgttgcgtcatttattcaacaaatgygtattaagcattcatttcaaagggagaagtgagagttgatgaaacaagagaggtaaggcaggagccaagtaattgagagcctcgaatgtcagccaggaca

SEQ ID NO: 46134 - DNA, 201 bp, Homo sapiens
tctcagtgtctccaagccctggtctaagactctctcctcttgatgggtctagactgcatcctcagggtcgctagacattcagtcttacatttggactttcygatggattctagacatgttctcagcatctccaagtcctggtgtaagtttctgtctctcggagagttctgaacatgtcctcagagtccagtgacctccagt

SEQ ID NO: 46135 - DNA, 201 bp, Homo sapiens
ctcagccctgcccagaccccctgattctgaatctgcaaggggggatgactgccatgtgtggacacaccggtgaccccatccttgctttctgctctctatcycagggtggattacggaacaacaacgagaaagacatggccctcacggcctttgttctcatctcgctgcaggaggctaaagatatttgcgaggagcaggtca

SEQ ID NO: 46136 - DNA, 201 bp, Homo sapiens
catctccaggtctgaagactgagaactggggatctgggcctcccaggcatggtctttggagggaggcccttatcctctcatcttcacatcacatctgcccrcagaggaaagctgtacccggttctaccatccggaaaaggaggatggaaagctgaacaagctctgccgtgatgaactgtgccgctgtgctgagggtgagtt

SEQ ID NO: 46137 - DNA, 201 bp, Homo sapiens
ctccccttctgagtccctgaccttccctgagaccccaccccttctgagactcctccccttctgagtccctcccttccctgagaccccaccccttctgaggytcctccccttctctgagactccaccccttctgagtctcctccccctctaagtccctcccactgaattccttttccaagcccctccccctcgaagtctcct

SEQ ID NO: 46138 - DNA, 201 bp, Homo sapiens
ggaagctggaccgtgggcatggggccttggaacagacccctgacaatgccctgcccacgcctagatcccagccaacagggagttcaagtcagaaaaggggsgcaacaagttcgtgaccgtgcaggccaccttcgggacccaagtggtggagaaggtggtgctggtcagcctgcagagcgggtacctcttcatccagacaga

SEQ ID NO: 46139 - DNA, 201 bp, Homo sapiens
aaattagcttggtgtggtggtgcatgcttgtaatcccagctacttcggaggctgaggcaggagaattgcttgaatccaggaggcggaggttgcagggagtygagattgcgccattgcactccagcctgggcaacaagagcaaaactgtcccaaaaaaaaaaaaaaaaagtgtatatctcttgaggagctggatggaccatg

SEQ ID NO: 46140 - DNA, 201 bp, Homo sapiens
cagttctctatcggatcttcaccgtcaaccacaagctgctacccgtgggccggacggtcatggtcaacattgaggtgccagccagagggggccccaggggmagcaggggcacaggcttaggagaggcaaagagatcgagagagacagagaaagacacaccggaaggggtgcagtggcagagacacagaggcaaagagatat

SEQ ID NO: 46141 - DNA, 201 bp, Homo sapiens
ttaaatacaagtacatcaaataaaagtacaaatccagtttctcactcaggcaaaccccatttcaagtgctcagcgctcccccacagcttggggctaccatwtcagacaagcagatatattttggagatttctcttcctccctacacgtagatctctgagtcaaactacaaacagaatgtaaatcattaaatagtggtaact

SEQ ID NO: 46142 - DNA, 201 bp, Homo sapiens
gactcagccctgcccagaccccctgattctgaatctgcaaggggggatgactgccatgtgtggacacaccggtgaccccatccttgctttctgctctctayctcagggtggattacggaacaacaacgagaaagacatggccctcacggcctttgttctcatctcgctgcaggaggctaaagatatttgcgaggagcaggt

SEQ ID NO: 46143 - DNA, 201 bp, Homo sapiens
gagactcagccctgcccagaccccctgattctgaatctgcaaggggggatgactgccatgtgtggacacaccggtgaccccatccttgctttctgctctcyatctcagggtggattacggaacaacaacgagaaagacatggccctcacggcctttgttctcatctcgctgcaggaggctaaagatatttgcgaggagcag

SEQ ID NO: 46144 - DNA, 201 bp, Homo sapiens
agcctgatgccagcctgtccccccagatcatgaacaagggcaggctgttgaaggcgggacgccaggtgcgagagcccggccaggacctggtggtgctgccmctgtccatcaccaccgacttcatcccttccttccgcctggtggcgtactacacgctgatcggtgccagcggccagagggaggtggtggccgactccgtgt

SEQ ID NO: 46145 - DNA, 201 bp, Homo sapiens
gacagggggagggggccgtctgatgggggaggagactcctgtctgaggagggaggatgccctgtctggtgggggtggggctggaggaggccgctgtctgargggggaggaggcccctgtctgagggggcaggaggtccctgtctcaggggggaggaggcccctgtctgaggagggaggaaacctccgtctgaggagggagg

SEQ ID NO: 46146 - DNA, 201 bp, Homo sapiens
ttctgtgtttctagaaaagaggcctcaggatgccaagaacactatgatccttgagatctgtaccaggtaagaagctaggtcaccggggttcatcttggccrtccctctatctctagcaagaattcttgcaaataatatccatgatattcagtactttccaagtacactgtgtatctgatactgttctaagtatccaccatg

SEQ ID NO: 46147 - DNA, 201 bp, Homo sapiens
atcacaggcatgagccaccgcgcccggcaatgctagggtgatcctaaggacagtgccctgctgaccatctgtgtgtctgtctgttcttttattcatccaaygactcccaccacctctaacactgcgtagccggaaggaatcagaatgaacaaaactgtggctgttcgcaccctggatccagaacgcctgggccgtggtgag

SEQ ID NO: 46148 - DNA, 201 bp, Homo sapiens
actcccaccacctctaacactgcgtagccggaaggaatcagaatgaacaaaactgtggctgttcgcaccctggatccagaacgcctgggccgtggtgagtyggctgcagggggaggggctgaggggctggcagggtaaggggggtaaatgacctgggtttagtgaggtaggatagggcgggagggagctagagccatcggt

SEQ ID NO: 46149 - DNA, 201 bp, Homo sapiens
gaatgaacaaaactgtggctgttcgcaccctggatccagaacgcctgggccgtggtgagtcggctgcagggggaggggctgaggggctggcagggtaaggsgggtaaatgacctgggtttagtgaggtaggatagggcgggagggagctagagccatcggtatctctcactcaccctgcagaaggagtgcagaaagaggac

SEQ ID NO: 46150 - DNA, 201 bp, Homo sapiens
ggcccaggcctgagggaggagaagggcctagtctgatggggagaagggcccttgcctgaaggcagagcagtttcctgcctgggaaggtcatcccagccccrcccatcagtctgaattggacatcaccagtgcccaggacattggaggtctgagggaaaagtctagaaagatgatggggctggtcacacactaattaccaat

SEQ ID NO: 46151 - DNA, 201 bp, Homo sapiens
gcattccagaaagacctgccaaactcgatgagtgaacaggcagcccttcttcattcatgcatgcattcagtttttgaatcaggtgagactttagatctcaygtgaaataagtcttaagtgaaacaaagagaaatttatcttataataagagaaaattggccgggcatggtggctcacaccggcaatcgcagcactttggga

SEQ ID NO: 46152 - DNA, 201 bp, Homo sapiens
ctgaagtcctccatgtccgggatgtatttcactgctaggaatccctcctgggcagaggtaggatctaaaggtgtgaccgctgaggaagtaggtcggctctytttttgtttgttttttgtttttgttttcagatggagtctgtctctgtcgcctgggctggagtgtagtcgtgtgatctcagctcactgcaacctccacctc

SEQ ID NO: 46153 - DNA, 201 bp, Homo sapiens
gtgggtttaggcgattgtgggtctggaagtccagagacttggaggagttgctgacgctggttggaaggttcagggtttggtgggatgtgtggccccctcgytgcccaggctttcaaaggccaggcccagctggctgagagtgggagtcatggtggctgctgtcctgcccatgtggttgagacggtggcagtgcccagagaa

SEQ ID NO: 46154 - DNA, 201 bp, Homo sapiens
ccttccctgagaccccaccccttctgagactcctccccttctgagtccctcccttccctgagaccccaccccttctgaggttcctccccttctctgagacyccaccccttctgagtctcctccccctctaagtccctcccactgaattccttttccaagcccctccccctcgaagtctcctcttctgaactcctcccctct

SEQ ID NO: 46155 - DNA, 201 bp, Homo sapiens
aatttccaggaatttttcaagctggtcattaaatacaattattattaaaaactaaatattaggccaggcacagtgagcctgtaatcccggcactttgggargccaaggccggcagatcacctgaggtcaggagttcaaaaccaccctggccaacatggcaaaaccccgtctctactaaaaatacaaaaattagccgggcat

SEQ ID NO: 46156 - DNA, 201 bp, Homo sapiens
gggagagaggggtccaggagggatttttcacaggctccacctttccccagctggccaatggtgttgacagatacatctccaagtatgagctggacaaagcyttctccgataggaacaccctcatcatctacctggacaaggtaaggctgcatcatcctcccctgggaggcttccaggggcaccctgacctctatctggctg

SEQ ID NO: 46157 - DNA, 201 bp, Homo sapiens
taagaagctaggtcaccggggttcatcttggccatccctctatctctagcaagaattcttgcaaataatatccatgatattcagtactttccaagtacacygtgtatctgatactgttctaagtatccaccatgaggtagacaacacagacagtccttgctttgcatgttaatgtgagaccacagcaatgaccacgtaagc

SEQ ID NO: 46158 - DNA, 201 bp, Homo sapiens
acaacacaacacacaacacaatacacacagcacaacgtgcatgaccacaccacacacaacacacaacacacacaacacaatacacaacatacacaaccacrcaatacacacaaaacacacacaacacaacacaacatacataaccacaccacacacaacacacaaccacacaacactatcacacaccacacacaaacacac

SEQ ID NO: 46159 - DNA, 201 bp, Homo sapiens
ttgaatccatgcagttgggtgcagagtctgagctcttaatcaccttgaccattacattaccttgctttttatttcctttggggaaatgtttcctaaaaaaygtaacgcccctctgtgctgctatgtgggaatcagaagtctcagtgcctgatcagacctccttgtccaggaacagacccttggggctgacccctccttggg

SEQ ID NO: 46160 - DNA, 201 bp, Homo sapiens
tgcccatcccctgagggccccccacctcttctcaaggccacgccctctgaggccctgactcctcccaggccaggctcttcatgagaccccgcctctcctcmaggccatgcccatcccctgagggccccccacctcttctcaaggccacgccctctgaggccctgactcctcccaggccaggctcttcatgagaccccgcct

SEQ ID NO: 46161 - DNA, 201 bp, Homo sapiens
ccaggcaggcagatcacctgaggtcaggaggtggagaacagcctggccaacatggtgaaaccctgtctctactaaaaatacaaaaaattagcaggacatgsgggtgggtgcctgtaatcccagctactcaggaggctgaggcaggagaattgcttgaacccaggatatagaggttgtagtgagccaagatcacgccactgc

SEQ ID NO: 46162 - DNA, 201 bp, Homo sapiens
aagacatggccctcacggcctttgttctcatctcgctgcaggaggctaaagatatttgcgaggagcaggtcaacgtaagtgccctccatcttcccaccctmccctaccttacccgatgcagagcacagccaccttggagagtgagaggttgccttcagggaatttgcagctctcccagtgcaataacagacatcactgcag

SEQ ID NO: 46163 - DNA, 201 bp, Homo sapiens
tctgcagcctggccaccaccaagaggcgtcaccagcagaccgtaaccatcccccccaagtcctcgttgtccgttccatatgtcatcgtgccgctaaagacyggcctgcaggaagtggaagtcaaggctgccgtctaccatcatttcatcagtgacggtgtcaggaagtccctgaaggtcgtggtgagtgcttggggcaccc

SEQ ID NO: 46164 - DNA, 201 bp, Homo sapiens
cttcagggaatttgcagctctcccagtgcaataacagacatcactgcagtcatgttaatagctaacatcttttgagcacttaactcatctaatacagaccygccctctaatagtttcacatgttaagtctcataatccttttagcagcctgaaaggtaagtcactcttattatccccagtttgcagatgagaaaactgagg

SEQ ID NO: 46165 - DNA, 201 bp, Homo sapiens
accgctgggaggaccctggtaagcagctctacaacgtggaggccacatcctatgccctcttggccctactgcagctaaaagactttgactttgtgcctccmgtcgtgcgttggctcaatgaacagagatactacggtggtggctatggctctacccaggcaagtgggcccacagcccctaggcacatgcatccctgtctcc

SEQ ID NO: 46166 - DNA, 201 bp, Homo sapiens
taacacacatgtgacccagattatacaaaaattgatggggaatttatgtgcaggcaccaaggcatcaaatagagatgaaggtggcctcagggactctgccrggatgctttgctcctctctcccgtgatcttcattccgttcttggccaataattcagttcaggcagaatatggctgccttccttagagaaaatatcagatc

SEQ ID NO: 46167 - DNA, 201 bp, Homo sapiens
ggcctcaagtgatccacctgccttggcctccctaagtgctgggatttcaggcatgagccatggcaactggcctgctctgttctaaatgcagatctaaaccycctgcaggtaacctggatgaggacatcattgcagaagagaacatcgtttcccgaagtgagttcccagagagctggctgtggaacgttgaggacttgaaag

SEQ ID NO: 46168 - DNA, 201 bp, Homo sapiens
ttagggccgccatattcccaggaaaggactctgattggctcagcctgggtcagatgactatatctggaccaatcagctaaggacaggaagtaggtctcagkgggcagacatggctgtttccactgtggccacgtgaatggaagggagaagaagttcttacaaaaggagtggatgtcagagaggcaaatgggcaggaataaa

SEQ ID NO: 46169 - DNA, 201 bp, Homo sapiens
acctacatggaggcacccccagacccttccagcctgtcccttggggtccctctgcaccagttcttcccctctaccaccctgctagatgacatctcctaatrccccaacctcttctccatccagaatctctacgaagctcatgaatatatttttgaaagactccatcaccacgtgggagattctggctgtgagcatgtcgga

SEQ ID NO: 46170 - DNA, 201 bp, Homo sapiens
catctcctaatgccccaacctcttctccatccagaatctctacgaagctcatgaatatatttttgaaagactccatcaccacgtgggagattctggctgtsagcatgtcggacaagaaaggtgagagaggatgctggctggtccccgggaggcagggaccccagggtgtctgagtgtcatctcattttatccaaactcaat

SEQ ID NO: 46171 - DNA, 201 bp, Homo sapiens
gaaaggtgagagaggatgctggctggtccccgggaggcagggaccccagggtgtctgagtgtcatctcattttatccaaactcaatcaaccctatgtttcytggcactttattctctgccgtggttaccacagaggtgttgttaccaggaactgtgggaatccttagttcctgtctaacttggaagaaagaattcagccaa

SEQ ID NO: 46172 - DNA, 201 bp, Homo sapiens
tcacatagcaagggttaagtagcagagtttattgaaggaagaaacagcgctgggctggtccccctggaaaaatagtagtagcaatgcttatttaaagagasagggccagcctcgatggctcatacctataatcccagcactttgggaggccgaggcaggggaatcacttcaggtcaggagttcaagaccagcctggtcaat

SEQ ID NO: 46173 - DNA, 201 bp, Homo sapiens
cagagtttattgaaggaagaaacagcgctgggctggtccccctggaaaaatagtagtagcaatgcttatttaaagagagagggccagcctcgatggctcayacctataatcccagcactttgggaggccgaggcaggggaatcacttcaggtcaggagttcaagaccagcctggtcaatgtggtgaaaccccgtctctact

SEQ ID NO: 46174 - DNA, 201 bp, Homo sapiens
tcaaggactcctgcgtgggctcggtaagtgtgccctgggctcgctcgccccctctccctctccctactcctctctctctctctctctccctgtctcctctytctctctctctccctttctccttttctctctcctttctctctcttctcttcctctccctttctctcctccctctctgtctctcaactgtctctcttttta

SEQ ID NO: 46175 - DNA, 201 bp, Homo sapiens
ggctgcagggggaggggctgaggggctggcagggtaaggggggtaaatgacctgggtttagtgaggtaggatagggcgggagggagctagagccatcggtrtctctcactcaccctgcagaaggagtgcagaaagaggacatcccacctgcagacctcagtgaccaagtcccggacaccgagtctgagaccagaattctcc

SEQ ID NO: 46176 - DNA, 201 bp, Homo sapiens
tgggctggtccccctggaaaaatagtagtagcaatgcttatttaaagagagagggccagcctcgatggctcatacctataatcccagcactttgggaggcygaggcaggggaatcacttcaggtcaggagttcaagaccagcctggtcaatgtggtgaaaccccgtctctactgaaagtacaaaacaattagccaggcagg

SEQ ID NO: 46177 - DNA, 201 bp, Homo sapiens
tagggtagcggggtaacacctagaagagactcagccctgcccagaccccctgattctgaatctgcaaggggggatgactgccatgtgtggacacaccggtraccccatccttgctttctgctctctatctcagggtggattacggaacaacaacgagaaagacatggccctcacggcctttgttctcatctcgctgcagga

SEQ ID NO: 46178 - DNA, 201 bp, Homo sapiens
cctcagtgaccaagtcccggacaccgagtctgagaccagaattctcctgcaaggtgagacacccttgaccccgaccccatgggtcccaggagggcatggayggagccaaattccatctcattctggaggtgtttaacccgcacctttctcttccccttcagctagaacagcccatctgtgatctgttttccctcttttaca

SEQ ID NO: 46179 - DNA, 201 bp, Homo sapiens
cagcctgcagagcgggtacctcttcatccagacagacaagaccatctacacccctggctccacaggtgaggctgggggcggctggagagggcggggcaccrgcgtgggcgggctagggtctcacgaggcctctttgtctctccccagttctctatcggatcttcaccgtcaaccacaagctgctacccgtgggccggacgg

SEQ ID NO: 46180 - DNA, 201 bp, Homo sapiens
cagagaaagacacaccggaaggggtgcagtggcagagacacagaggcaaagagatatgcagacacacacccacacaacacacacacatacagcacacaacrtgcacacacacagcacacaatacacacacagaggcaaagagatatgcagacacatgtgcacacacaatgcacacacacaatgcaacacacacaaacacac

SEQ ID NO: 46181 - DNA, 201 bp, Homo sapiens
gtaggggctggcaggcagggcagtgtttccggctggagccccagggaggggaagacatgagtcagcagttagggagggagtgcgggggctttgtggtcacrgcacacaaagtgctttctggtgacagcgctgcttggggagcagcagccttgggtttggagagcaggggcgctgttgctaaaggggactggggccctgagc

SEQ ID NO: 46182 - DNA, 201 bp, Homo sapiens
acacatttatgggtctatagtttgagaggtcagaagtcctggctctgggggaaagttcgctcccttgctttttccagtgtcgccagggcaccctaaaggcytggctcatggccccttcctccacctttaaaggcagcagcatagcatcttccagtgtctctctttctctctgtctctgtctctcctttctcccctgcccct

SEQ ID NO: 46183 - DNA, 201 bp, Homo sapiens
aatcccagcactttgggaggtggaggcgggcagatcacgaggtcaggagatcgagaccatcctggctaacacggtgaaaccccgtctttattaaaagtacaaaaaaaaaattagctgggcgtggtggcgggcacctgtagtcccagctactcgagaggctgaggcaggagaatggtgtgaacccgggaggcggagcctgca

SEQ ID NO: 46184 - DNA, 201 bp, Homo sapiens
ctccagccctgccttcctgcctttgacgcagggagctaagggtctgaatgaaccctgttggaggttgcaattaaatctttgtggacaaaggcacacacacrcacacatacacagaatcctcagataacaggaggcaataaatccaacagcacatccacgttcagagaacagtgtccctgctgtcttgctaacagctgccaa

SEQ ID NO: 46185 - DNA, 201 bp, Homo sapiens
gtgcctactgtgtgccaggcactcttctaagtgtttattgttcatttattttctcgaatcttcacaagaatgctctaagtcagcaaatggaagtactaagmaatcaggtagtgtgtctaaagtctcacagctaagtgaatggcagacccaggactgaaactgatcattcagatgcttcttttctgtgtcctagtatttcta

SEQ ID NO: 46186 - DNA, 201 bp, Homo sapiens
ggagccccccggcaaaggaagagaagcttgtaaggagcaccgactgttaaaagagaaattcacttctgtttctttccatcatctctctcattccctttcaycctgggctgttatttcctccctctattgctctgttgatactctctctgctttgccatgtttcccaatcccctttcatcttcatatttcttttgtgcactt

SEQ ID NO: 46187 - DNA, 201 bp, Homo sapiens
tgccagcaccatcccacctccagccactgaagccatctcagctcataaaaacaactgcttgcaaggcacaggtttcttggaggaagagactacccgggtcrgggttctgtttgcttcaaaggctgtgatgcaacttctggtcaacccattcgtgggccctctcaccaacaggtatctcactgggtgcagtgccccgcaggg

SEQ ID NO: 46188 - DNA, 201 bp, Homo sapiens
catctgcttaccggattagttacgctcaccgatgtagcagtcctgcacctgttttcccgcctttcttgaccacaaagaaaggagtccaggctgctggattmtggtggtccattaccagcgtgcccaacattgcctttgcgatcaggggtgagttcttgagctgggctgcgcaacccagttgccccatcaagatgcattccc

SEQ ID NO: 46189 - DNA, 201 bp, Homo sapiens
ccgatgagcattagtcctagagtgtcctctatggtcctaatgcttattcctttccagggtgtgtaaccacccagggacatctgcttaccggattagttacrctcaccgatgtagcagtcctgcacctgttttcccgcctttcttgaccacaaagaaaggagtccaggctgctggattctggtggtccattaccagcgtgcc

SEQ ID NO: 46190 - DNA, 201 bp, Homo sapiens
tctgttagtggcttctgactcagaggaccttcgtcccctgggacagtgggccttccagtgattctcttgacataaggggcatagatgagggggtggcttayttctattcggacaatcttttttaaagcgtccttgtagactgcactagaagcaagccctattaggcatttgatttgcccaggctttccatattccagagcc

SEQ ID NO: 46191 - DNA, 201 bp, Homo sapiens
gctatgtcctccaaaatttgtgtgttggaaacttaatccccaatgcaacagtgttgagaagtggaacctttagtaggtgataaagtcctaggggcaccacmtttatgaatagattaaagcaattatcataggagtgggttagtcacaaaaggggggagtttggcccctttttcttttctctctcaaatgccctttctccat

SEQ ID NO: 46192 - DNA, 201 bp, Homo sapiens
gccatccttgttatacagttacaaaaaacttggcagacttgtatccataacctaggacttcatggaatgaagaacttagaggcaataaactaggatatctrgcagaagaaatatctaagcagcaaagcttcaggctgctttgtggctgttttaactgcatatatagtgacatgtgaaagcaaagaaatgatttaaaggtga

SEQ ID NO: 46193 - DNA, 201 bp, Homo sapiens
tcggataagttatttaacctctttgacctctgatatggtgtgaatgtgtcccccaaaatttatatgttgcaaattgaatccccagtgcaacagtcttgagmagtgggacctttgagagatgatgagatcatgggagcaccctcatgaatggattaaggccattatcatgggagtgagtttgtcataataaaaggggagttc

SEQ ID NO: 46194 - DNA, 201 bp, Homo sapiens
agcatgcaataaaaagcactaaatctaattttgggggggcaattctaagcaagactcccagctgcactcctagtgccaaattgaatttttatgggttgcargtgcttttgaccatgacgattaattgagttagtcggtattcagtgcagataattcatcgcctgccctaaggctctgaccactcagggtctcgatactagt

SEQ ID NO: 46195 - DNA, 201 bp, Homo sapiens; identical to SEQ ID NO: 12754

SEQ ID NO: 46196 - DNA, 201 bp, Homo sapiens
tcaaaaacacacagaggttgttggggactggaaaaaagccctgcagaaaatggagtctgacacttgtcaaacacagctaaaagactcaggaggttcaaagrgcaggaggtccagagagggtctgactggagaagaggatggcccggagccagaactggctgtgcttttctttctccccacactgtcttctcaaggtgctaa

SEQ ID NO: 46197 - DNA, 201 bp, Homo sapiens
ctgccaatacctcactgagtgcctcacaccaacatgggctccaaggtaagatttttctctctccggacaaatttaatctttccttgtgatttgtgtctctrtcagaggattttgactgttaagtaaagtttactattgatttgttggcaaattcctggttttgtttgtttttgttttgggatttgggtgtgtgtgtttctc

SEQ ID NO: 46198 - DNA, 201 bp, Homo sapiens
tgcacttttcgttttaatagtgagtttccttcgtctgggcagactccctcccctcttccataaaggctgcaggagacctgtagctgtcacaggaccttccstaagagcccgcaggggaagactgccccagtccggccatcaccatgctccggaccattctggatgctccccagcggttgctgaaggaggggagagcgtccc

SEQ ID NO: 46199 - DNA, 201 bp, Homo sapiens
tggagaggaggatctagcccttcccaggaaccctgaggaaagaggacagggaaggctacgtgcaaattgctccatcactgcagggaggagaggcttacggrgccagaggggaagctgataagaacatgatatagttcagcatgcaataaaaagcactaaatctaattttgggggggcaattctaagcaagactcccagctg

SEQ ID NO: 46200 - DNA, 201 bp, Homo sapiens
tggtttcagctcctttgattttctgtgaaaacttgtgcagatgccttaaaccctctgagcatcacttttctcattgctaaaatgagcatcaaaatactatstagttcaagagaaattggatgaataaatgacatatgaggtgaaaatgctttgtaccctgtacaatattaatgtgcaccattaccatccacattctcctcc

SEQ ID NO: 46201 - DNA, 201 bp, Homo sapiens; identical to SEQ ID NO: 12764

SEQ ID NO: 46202 - DNA, 201 bp, Homo sapiens
cagaccatgtgctcccccaagtggcagctgggtaagtgacctcagcacccccgctcagggcctggcaggaggaggtgggtgccatgagtcctttcgttcartgtcacacagggacaacatgcttcctttgtagaatgacctcccacgtccacacccatgaatcaagcccaagagggtgtgtggtccctcagagaagcagtc

SEQ ID NO: 46203 - DNA, 201 bp, Homo sapiens
ttatagttataaatagtgctgtaatttgcatgactgcatgtttataatgttgtcattaatctttagagtcaattcctagaagtgggactgttgggtcaaasggtttattgtacttttaaatgtatattttaatgatttacatcagtttctttacttcgaataataattgggtaagcgaatgatctctttagttttaggatc

SEQ ID NO: 46204 - DNA, 201 bp, Homo sapiens
ccgcagtctcctgagatgctctgctctttacagactggctttaggagtaggatgtctgggtcctggagagggaagtcataaccaccacccatccaggactyctcagggcaaggagcaccaaataccctctgcacaggctcccaggcctggcatatgcttgggcccagcacccctccagccctggcccaggcgtagggacac

SEQ ID NO: 46205 - DNA, 201 bp, Homo sapiens
taaatatggataattctcactgcaaaggactcaccctcacctctggaatctgtgtctcctatgcctctccagtgggagctccctttggaagtgtaatgtaygagtttgttgggaagtctgcacccttcctcatcctggccttcctggcactactggatggaggtaagtcaccatcagagcctccagcaggtgacagcccag

SEQ ID NO: 46206 - DNA, 201 bp, Homo sapiens
aataaaagacatcctctgtgaatatccctaactgtcattctgtcacagttaataaatatcagagttggtacttgtttgactctaagccaaaaacggctctrgaaaatccatatcccaccacgaaggaaaaaaagtaagaaagtgcatcaagtgtaaaaatgtttgatctaaaggccttgactttgcattccacagcttgtc

SEQ ID NO: 46207 - DNA, 201 bp, Homo sapiens
gagattgttgatgcccgttactacccttaaaccctccaccccccaactaggagccatgcctaatgtaatcaagagtgaaatggtggcccatgtaaagggtycaaagtgaaaaaaataattgctttggtattcctaaatagaatgaccaactctcctggtttgcctagaattgaggggtgtcttagtccatttagcattgct

SEQ ID NO: 46208 - DNA, 201 bp, Homo sapiens
ttgcatgcaacattttactgtcaaactttcaccatgctttaattatttgtgtccctccctacacacacacacacatacatacacacacgcgcgcacacacrcacacacacaaacacacacacttcctccactagaaagtgggcttgatggggacagggatcatgtctccatctctgaattcccagagcctcaggtggagct

SEQ ID NO: 46209 - DNA, 201 bp, Homo sapiens
catgtatatctggagatctccatatatatatatatatgtgcacacacacatgtaattatagctaggagataatgacattggggactgagtatttggagctrtaacatcatctcagagatgaaggctgtgggggccacctagacaacatcttctgcaataaaagacatcctctgtgaatatccctaactgtcattctgtcac

SEQ ID NO: 46210 - DNA, 201 bp, Homo sapiens
attttactgtcaaactttcaccatgctttaattatttgtgtccctccctacacacacacacacatacatacacacacgcgcgcacacacacacacacacamacacacacacttcctccactagaaagtgggcttgatggggacagggatcatgtctccatctctgaattcccagagcctcaggtggagcttagcccctagc

SEQ ID NO: 46211 - DNA, 201 bp, Homo sapiens
tgcaggaacccaggcatgcctgccaaaccataagaagaaaagtgaagaggaatagggtcagcgaaagtgagaactgtgtttggattccaggatagggttaygtttcaggtagtgtgggggatagtgacgtatttggcttgatgttggacaaagatggtggaagaaccttgtgcataatcaaagaagccatagagaatctat

SEQ ID NO: 46212 - DNA, 201 bp, Homo sapiens
gatggctgaatgcaggaacccaggcatgcctgccaaaccataagaagaaaagtgaagaggaatagggtcagcgaaagtgagaactgtgtttggattccagkatagggttacgtttcaggtagtgtgggggatagtgacgtatttggcttgatgttggacaaagatggtggaagaaccttgtgcataatcaaagaagccata

SEQ ID NO: 46213 - DNA, 201 bp, Homo sapiens
ggcatcagacaagtcactttctctccctgtactggggttcctggtctctgcagtaaaggagatactgtagatggtctctaagcccataattgtactttctmagattctgtgaaaataggagagatgtatgcactgtacaaatggacattttttgttatccatgttctcagagtgccaaggggactcccctctttatgcttc

SEQ ID NO: 46214 - DNA, 201 bp, Homo sapiens
ccttgagaggggtgctttcgatgtcatcaacattggagcatgggctagcaggccagtccaggggtctgtagtagatcttagtcacagactgcatctggggytccatttgaagaaccatttatagttttacagcttcaattctggaagagacaaacttaaccaggaggttaagatacagagattgaaatgtatagcctaaag

SEQ ID NO: 46215 - DNA, 201 bp, Homo sapiens
cggtggctcacgcctgtaatcccagcactttaggaggctgaggcgggcgcatcacgaggtcaggagatcgagaccattctggctaacatggtgaaaccccrtctctgctaaaaatacaaaaaattagcctggcgtggtgatgggcgcctgtagttccagctactctggaggctgaggcaggagaacggcatgaacccggga

SEQ ID NO: 46216 - DNA, 201 bp, Homo sapiens
caatttgtattcagacccaggcaagagttaaagagttcgatgatagataagcacagatgcaaaacagtacagtccagtgcctctttgcttaggctaatatstgccctctctttatcctctccagccctgccttcctgcctttgacgcagggagctaagggtctgaatgaaccctgttggaggttgcaattaaatctttgtg

SEQ ID NO: 46217 - DNA, 201 bp, Homo sapiens
aatgaggagattggtaaaaaaaagatgtgcggtggttggccgggcgcggtggctcacgcctgtaatcccagcactttaggaggctgaggcgggcgcatcaygaggtcaggagatcgagaccattctggctaacatggtgaaaccccgtctctgctaaaaatacaaaaaattagcctggcgtggtgatgggcgcctgtagtt

SEQ ID NO: 46218 - DNA, 201 bp, Homo sapiens
ttttgggatttgggtgtgtgtgtttctctctctttgtagtacttacttcactcactatgttttttaattttccatggcttgtcttttattcttatccatayatatcctaagtcaatttgtattcagaaatacctcctttatatagagaaatgaaggatcttaagtaattgcatgcatttactggttaaaacttaactgaga

SEQ ID NO: 46219 - DNA, 201 bp, Homo sapiens
ccattgtaaaggccatcggttttccctggctcatggtcatcactggggtcatcaacatcgtctatgctccactctgctactacctgcggagccccccggcraaggaagagaagcttgtaaggagcaccgactgttaaaagagaaattcacttctgtttctttccatcatctctctcattccctttcatcctgggctgttat

SEQ ID NO: 46220 - DNA, 201 bp, Homo sapiens
cgccacacctcggtgtatgggagtgtctacgccatcgctgatgtggctttttgcatgggctttgctataggtatgttggcaggacctggtgccccactttyccctgtctactctttaccagctggaagtgcagccaggaagctatcctcctagggttctggagatctttgacgctgagacatcctctgggtcacccactgc

SEQ ID NO: 46221 - DNA, 201 bp, Homo sapiens
aacagccactcctggctccttgtcacttctgggttagaatctggcagcatcctccctcttgtgtactccctccttccaccacgatgctgcctgaacaatcytcctgagcccagagcaggtgatgtttctcacctgatgtttctccataggccgcaaggccaagtacatgactcatctgcatatacaaggttcctgcatatg

SEQ ID NO: 46222 - DNA, 201 bp, Homo sapiens
cttccatctgctgtgtggtgactcggtttatacttctgtggtttctcagttttcttgccatttaaatagcaaaactgaggagtgggagattgaaaagacarctcaaaaaacagggaacagtcatcatgctttattaaaaacatatgcatcaagactcatatctgcagtatcacgggcatgttctctggcggctggggaagc

SEQ ID NO: 46223 - DNA, 201 bp, Homo sapiens
taaaaacacaaccaaagacatctgtaatgaatgggcaaagggattacaattcttctgattcagacacttcgaggagattattcttaccctaggagacattwttctggaattggaggtgagacatgtctggacttaactaccctgaccaccagcaccctctgatttagttttgtgttgcgggaagtcagggaccctgaatgg

SEQ ID NO: 46224 - DNA, 201 bp, Homo sapiens
gagggatccttccccataacccaaacaccttccactgggccccatctccaacaccggggatcaaatttcaacatgagatttggtggggacaaacaacccawgtccacactgtagtgaggggcttcccaggatgtaagacttcctgtttttgtggggtattttgagtttcagttttaaaaacaaggaagttctgggcagacc

SEQ ID NO: 46225 - DNA, 201 bp, Homo sapiens
aaaaaataattgctttggtattcctaaatagaatgaccaactctcctggtttgcctagaattgaggggtgtcttagtccatttagcattgctataaaggartacctgaggctgggtcatttatattagaaagaggtttgttggctcatggttctgcaggctctacaagaagcatgacaccagcatctgcttctggtgcggg

SEQ ID NO: 46226 - DNA, 201 bp, Homo sapiens
ggtggcccatgtaaagggtccaaagtgaaaaaaataattgctttggtattcctaaatagaatgaccaactctcctggtttgcctagaattgaggggtgtcytagtccatttagcattgctataaaggaatacctgaggctgggtcatttatattagaaagaggtttgttggctcatggttctgcaggctctacaagaagca

SEQ ID NO: 46227 - DNA, 201 bp, Homo sapiens
actttaagttctagggtacacgtgcacaacgtgcaggtttgttacgtatgtatacatgtgccatgttggagtactgcacccattaactcatcatttacatyaggtatatctcctaatgctatccctcccctctcccccgactccatgacaggccccggtgtgtgaagttccccttccggtgtccatgtgttctctgttcaa

SEQ ID NO: 46228 - DNA, 201 bp, Homo sapiens
caacacacctccttctccctcgcgtttttcttttcttttcttttctttttaattatactttaagttctagggtacacgtgcacaacgtgcaggtttgttaygtatgtatacatgtgccatgttggagtactgcacccattaactcatcatttacattaggtatatctcctaatgctatccctcccctctcccccgactcca

SEQ ID NO: 46229 - DNA, 201 bp, Homo sapiens
tcacttctcattattcatagttctgtagttatagttatgctctataaagtcgctgcaaacactgaattagtgaatactgaatcattgctcccagggaaacmacacacacacacacacacacacacacacacacacacaattataatcttaaatcttaaacatcgtggtacatcgtgttttctttataaaagagaaaaagaa

SEQ ID NO: 46230 - DNA, 201 bp, Homo sapiens
cacttctcattattcatagttctgtagttatagttatgctctataaagtcgctgcaaacactgaattagtgaatactgaatcattgctcccagggaaaccacacacacacacacacacacacacacacacacacacaattataatcttaaatcttaaacatcgtggtacatcgtgttttctttataaaagagaaaaagaag

SEQ ID NO: 46231 - DNA, 201 bp, Homo sapiens
aaaaaattagcctggcgtggtgatgggcgcctgtagttccagctactctggaggctgaggcaggagaacggcatgaacccgggaggcggagcttgcagtgrgccgagattgcgccactgcactccagcctgggcaacagagcgagactccgtctcaaaaaaaaaaaaatgataataatgtgcagtggcttctcttcttgcc

SEQ ID NO: 46232 - DNA, 201 bp, Homo sapiens
tcgcctctcagtggtgatgtccattttgatcactgggtcaaggtgttgtctgggtctcttgtgtagtaattacttcttcaccttgtaactaatacataacmtgtgggagatgttgtaaagtcatataaatctcctactcctccttaaatttcctttctgcctagatttgttatccattgatgattcttgactgacccaatc

SEQ ID NO: 46233 - DNA, 201 bp, Homo sapiens
attccaaaaagcctactgcttttcagttaagggctttaaaggttaagcttagaaaagtaaatttgctaaagaaacaagaaagagaaagacaaatactctayccaggatcagctaaatgtttctaataaaatggagatgggataaacacagtacatgagaaaagtaagtctggaaattgatgctgagaagtaaaggaagaag

SEQ ID NO: 46234 - DNA, 201 bp, Homo sapiens
cagtctagttggaattggtctattctgctatagaagaacagatattttattcacttcacttcagctggacataatgagagctgtttgaatatgtatgctayggggtgtgtgtgtgtgtgtgtgtgtgtgtgtgttatatgcatcagtaatcccttgagcaagtttaatacaaactttccatctatgagaagcaatgatatt

SEQ ID NO: 46235 - DNA, 201 bp, Homo sapiens
tcctgtttgctctggccacaggcatggtggattcttctatgatgcccatcatggggcacctggtggatctacgccacacctcggtgtatgggagtgtctaygccatcgctgatgtggctttttgcatgggctttgctataggtatgttggcaggacctggtgccccactttcccctgtctactctttaccagctggaagtg

SEQ ID NO: 46236 - DNA, 201 bp, Homo sapiens
ctccacactacattcagaggcatgttttaccatacacccaaatagctgcatttctgctcccacttacatttaaaaatgtagtccatgtatgtgagtgcctkttggaattgtatctttttttttttcaattcccttttaggattggatatcatatccccatgtttgctggctttgttatcatgtttctctccacagttagta

SEQ ID NO: 46237 - DNA, 201 bp, Homo sapiens
atatctgcatgtttgtttgtttgctcatactcatccacatgccctatttcatctccacactacattcagaggcatgttttaccatacacccaaatagctgyatttctgctcccacttacatttaaaaatgtagtccatgtatgtgagtgcctgttggaattgtatctttttttttttcaattcccttttaggattggatat

SEQ ID NO: 46238 - DNA, 201 bp, Homo sapiens
atgggacagtcctgttgtaatctagagcactggcttcccaggagttgtattgacgattattctgatattttcaagagatatacactccacctaggctatcmtttctggaaatgagaattttggccctgatctatggtcatatctgcatgtttgtttgtttgctcatactcatccacatgccctatttcatctccacactac

SEQ ID NO: 46239 - DNA, 201 bp, Homo sapiens; identical to SEQ ID NO: 12763

SEQ ID NO: 46240 - DNA, 201 bp, Homo sapiens
ctcggtgtatgggagtgtctacgccatcgctgatgtggctttttgcatgggctttgctataggtatgttggcaggacctggtgccccactttcccctgtcyactctttaccagctggaagtgcagccaggaagctatcctcctagggttctggagatctttgacgctgagacatcctctgggtcacccactgcccctagca

SEQ ID NO: 46241 - DNA, 201 bp, Homo sapiens
agggcagctggcagggttgtggagagatgagctcgtaattcccacctggaacaggtgttagtccgaggcagaagacagcagacaaagcaaatggactaaakggaggaggagaggcggggtggtactaactgtgggtggggctgactgtgtcctgtttgctctggccacaggcatggtggattcttctatgatgcccatcat

SEQ ID NO: 46242 - DNA, 201 bp, Homo sapiens
ccccatgcaggttcctctggctcacaatatttttggtctcattggccccaatgcagggcttggccttgccataggtaagaagtgccctcaaagaaaacaakaagcccctgcatgttggctttgggtctgatgcctttcctcccccttttctcatcagaggaggtaggtgcagaggcagaaggatcaggagggcagctggca

SEQ ID NO: 46243 - DNA, 201 bp, Homo sapiens
acttctcattattcatagttctgtagttatagttatgctctataaagtcgctgcaaacactgaattagtgaatactgaatcattgctcccagggaaaccacacacacacacacacacacacacacacacacacacaattataatcttaaatcttaaacatcgtggtacatcgtgttttctttataaaagagaaaaagaagt

SEQ ID NO: 46244 - DNA, 201 bp, Homo sapiens
agtgtcagtcttcactaagaatgggcggtttggacatgttttgatggatcaaggactgccccgttgtagaaaagaaagaagaaactcagggagttaaattkatgcataatagggtggtagcactacagctgttattggagcccccagctaatcagtagacacgctgaactgtctcaccttctttgtttcttagcactccag

SEQ ID NO: 46245 - DNA, 201 bp, Homo sapiens
cttctcattattcatagttctgtagttatagttatgctctataaagtcgctgcaaacactgaattagtgaatactgaatcattgctcccagggaaaccacmcacacacacacacacacacacacacacacacacaattataatcttaaatcttaaacatcgtggtacatcgtgttttctttataaaagagaaaaagaagtt

SEQ ID NO: 46246 - DNA, 201 bp, Homo sapiens
acgagtttgttgggaagtctgcacccttcctcatcctggccttcctggcactactggatggaggtaagtcaccatcagagcctccagcaggtgacagcccmggtcaggttgggaatgcattatgttgtagtgtcagtcttcactaagaatgggcggtttggacatgttttgatggatcaaggactgccccgttgtagaaaa

SEQ ID NO: 46247 - DNA, 201 bp, Homo sapiens
cagaggcatgttttaccatacacccaaatagctgcatttctgctcccacttacatttaaaaatgtagtccatgtatgtgagtgcctgttggaattgtatctttttttttttcaattcccttttaggattggatatcatatccccatgtttgctggctttgttatcatgtttctctccacagttagtaagtaatttgcttcc

SEQ ID NO: 46248 - DNA, 201 bp, Homo sapiens
ctttggaagtgtaatgtacgagtttgttgggaagtctgcacccttcctcatcctggccttcctggcactactggatggaggtaagtcaccatcagagcctmcagcaggtgacagcccaggtcaggttgggaatgcattatgttgtagtgtcagtcttcactaagaatgggcggtttggacatgttttgatggatcaaggac

SEQ ID NO: 46249 - DNA, 201 bp, Homo sapiens
ttaccatacacccaaatagctgcatttctgctcccacttacatttaaaaatgtagtccatgtatgtgagtgcctgttggaattgtatctttttttttttcaattcccttttaggattggatatcatatccccatgtttgctggctttgttatcatgtttctctccacagttagtaagtaatttgcttcctcttttcttccc

SEQ ID NO: 46250 - DNA, 201 bp, Homo sapiens
gtctagttggaattggtctattctgctatagaagaacagatattttattcacttcacttcagctggacataatgagagctgtttgaatatgtatgctacgkggtgtgtgtgtgtgtgtgtgtgtgtgtgtgttatatgcatcagtaatcccttgagcaagtttaatacaaactttccatctatgagaagcaatgatattat

SEQ ID NO: 46251 - DNA, 201 bp, Homo sapiens
tagttggaattggtctattctgctatagaagaacagatattttattcacttcacttcagctggacataatgagagctgtttgaatatgtatgctacggggtgtgtgtgtgtgtgtgtgtgtgtgtgtgttatatgcatcagtaatcccttgagcaagtttaatacaaactttccatctatgagaagcaatgatattatttt

SEQ ID NO: 46252 - DNA, 201 bp, Homo sapiens
gttggaattggtctattctgctatagaagaacagatattttattcacttcacttcagctggacataatgagagctgtttgaatatgtatgctacggggtgtgtgtgtgtgtgtgtgtgtgtgtgtgttatatgcatcagtaatcccttgagcaagtttaatacaaactttccatctatgagaagcaatgatattattttgt

SEQ ID NO: 46253 - DNA, 201 bp, Homo sapiens
ctctgtggcatcagacaagtcactttctctccctgtactggggttcctggtctctgcagtaaaggagatactgtagatggtctctaagcccataattgtaytttctcagattctgtgaaaataggagagatgtatgcactgtacaaatggacattttttgttatccatgttctcagagtgccaaggggactcccctcttta

SEQ ID NO: 46254 - DNA, 201 bp, Homo sapiens
ggcaggggaaggcagcctgtggatccagccttggttcccgatggccctgctgatcctctgctctccaacaacacacctccttctccctcgcgtttttcttytcttttcttttctttttaattatactttaagttctagggtacacgtgcacaacgtgcaggtttgttacgtatgtatacatgtgccatgttggagtactgc

SEQ ID NO: 46255 - DNA, 201 bp, Homo sapiens
tagaaagaggtttgttggctcatggttctgcaggctctacaagaagcatgacaccagcatctgcttctggtgcgggcctcagggagcttccactcatggtrgaaggtgaaggggagctggctgtgcagagatgagagaggaagaaagagagaggagagggaggtgccagcctttttttaaccagcagctcttgagagaact

SEQ ID NO: 46256 - DNA, 201 bp, Homo sapiens
tgactccaagtgcctctgaggcagcgagatcttctcacaggggtgcctttctggactctgctctataaaaacagcatattttatttggatatctgatttaktatcaagaccttgccttccttgtggttctttccctcagaatcctgctttttttagttgatactctcctaatcattacattaagttacacccttgtataaa

SEQ ID NO: 46257 - DNA, 201 bp, Homo sapiens
atcaatatctatgttggttttaaaaattttttgagagttaggggtcttgctatgtagtccaggctggactcaaactcctgggctcaagatatcctcccacytcagcctcccaagtaactgagactccaggcacatcccaccatacctggcagtatctcaatattttaaaagagtggatctagaggaaaaagatgaagtaaa

SEQ ID NO: 46258 - DNA, 201 bp, Homo sapiens
cgtcaaagaaaatgaaattctccccagaaactcttattacttgaagtttgacaaggtactgtgacttaatgctgactaatgatatgaaatcctgaatagasaactaatcatgaaagtcaatattttattttcacagatgaaggcatctttctgatcaggggtttgtagctcaaacaaaagaatgagcgtgcttctagaacc

SEQ ID NO: 46259 - DNA, 201 bp, Homo sapiens
gaagccacgtcaaagaaaatgaaattctccccagaaactcttattacttgaagtttgacaaggtactgtgacttaatgctgactaatgatatgaaatcctraatagagaactaatcatgaaagtcaatattttattttcacagatgaaggcatctttctgatcaggggtttgtagctcaaacaaaagaatgagcgtgcttc

SEQ ID NO: 46260 - DNA, 201 bp, Homo sapiens
agataactgaagtcattgattataaataactggcatttgagtatctctctactctctcaaaaatgtgcccatatatttatatttagacaattgagataaasttgaaaacacagtttaatttcccttttttacttaacattatagtaatagtattttctgtatcattaaaattatttgaaaatataatttttaagagccgct

SEQ ID NO: 46261 - DNA, 201 bp, Homo sapiens
ttacttcactcactatgttttttaattttccatggcttgtcttttattcttatccatacatatcctaagtcaatttgtattcagaaatacctcctttatayagagaaatgaaggatcttaagtaattgcatgcatttactggttaaaacttaactgagaatttggttcacttaggaccttggtcacgttaatatgtagtag

SEQ ID NO: 46262 - DNA, 201 bp, Homo sapiens
gcagctggcagggttgtggagagatgagctcgtaattcccacctggaacaggtgttagtccgaggcagaagacagcagacaaagcaaatggactaaatggrggaggagaggcggggtggtactaactgtgggtggggctgactgtgtcctgtttgctctggccacaggcatggtggattcttctatgatgcccatcatggg

SEQ ID NO: 46263 - DNA, 201 bp, Homo sapiens
acttacttcactcactatgttttttaattttccatggcttgtcttttattcttatccatacatatcctaagtcaatttgtattcagaaatacctcctttayatagagaaatgaaggatcttaagtaattgcatgcatttactggttaaaacttaactgagaatttggttcacttaggaccttggtcacgttaatatgtagt

SEQ ID NO: 46264 - DNA, 201 bp, Homo sapiens
tttgtagtacttacttcactcactatgttttttaattttccatggcttgtcttttattcttatccatacatatcctaagtcaatttgtattcagaaatacmtcctttatatagagaaatgaaggatcttaagtaattgcatgcatttactggttaaaacttaactgagaatttggttcacttaggaccttggtcacgttaa

SEQ ID NO: 46265 - DNA, 201 bp, Homo sapiens
agagagagagagagagagagagagagggagagagagagagagaaagacacagacatttaaagactaatttcctttaagatgagcagagatggcttggcaargactgtcagaaagactgtttctgaataggcaggaatttagcacgggggaagaggccaccagctgcagtggctttcctttgaggggaagtgggaaaggaga

SEQ ID NO: 46266 - DNA, 201 bp, Homo sapiens
ggtttggggatcttggaaggttacaggggtggacttcagtgtcttgtacgagacaaggcattttagagtaaattggacatgtcctaaggtaaggatctgtrtccttccacaggtctagctttcttgcctgccagtgtgtcctacctcattggcaccaacctctttggtgtgttggccaacaagatgggtcggtatgtagcc

SEQ ID NO: 46267 - DNA, 201 bp, Homo sapiens
caaagacccttacatcctggtggctgcaggtaagctggcgatgacctcccattgggcggggagtgtctgggcttcaagcagccacggctgctcacagaacwgtctccccagggtccatctgctttgccaacatgggggtggccatcctggagcccacactgcccatctggatgatgcagaccatgtgctcccccaagtggc

SEQ ID NO: 46268 - DNA, 201 bp, Homo sapiens
aggctctacttttctcctcgcaaatattcatactctgctaacacccgctttcttctttttcttctccaactacacactcttttctgacacctctgtgttcttcacacaagcttcttcccctccagatactctacacttggcaaagccctcgtggctgcctgaaattcctgagacattgactgtgctttcattgcatgcaac

SEQ ID NO: 46269 - DNA, 201 bp, Homo sapiens
gctttcattgcatgcaacattttactgtcaaactttcaccatgctttaattatttgtgtccctccctacacacacacacacatacatacacacacgcgcgcacacacacacacacacaaacacacacacttcctccactagaaagtgggcttgatggggacagggatcatgtctccatctctgaattcccagagcctcagg

SEQ ID NO: 46270 - DNA, 201 bp, Homo sapiens
ctttcattgcatgcaacattttactgtcaaactttcaccatgctttaattatttgtgtccctccctacacacacacacacatacatacacacacgcgcgcacacacacacacacacaaacacacacacttcctccactagaaagtgggcttgatggggacagggatcatgtctccatctctgaattcccagagcctcaggt

SEQ ID NO: 46271 - DNA, 201 bp, Homo sapiens
cattttactgtcaaactttcaccatgctttaattatttgtgtccctccctacacacacacacacatacatacacacacgcgcgcacacacacacacacacaaacacacacacttcctccactagaaagtgggcttgatggggacagggatcatgtctccatctctgaattcccagagcctcaggtggagcttagcccctag

SEQ ID NO: 46272 - DNA, 201 bp, Homo sapiens
gtgggggatagtgacgtatttggcttgatgttggacaaagatggtggaagaaccttgtgcataatcaaagaagccatagagaatctatctatctatctatctatctatatattcgacacatatatggggtgtgtatatatatattcatgtatatctggagatctccatatatatatatatatgtgcacacacacatgtaat

SEQ ID NO: 46273 - DNA, 201 bp, Homo sapiens; identical to SEQ ID NO: 12757

SEQ ID NO: 46274 - DNA, 201 bp, Homo sapiens
tgggggatagtgacgtatttggcttgatgttggacaaagatggtggaagaaccttgtgcataatcaaagaagccatagagaatctatctatctatctatctatctatatattcgacacatatatggggtgtgtatatatatattcatgtatatctggagatctccatatatatatatatatgtgcacacacacatgtaatt

SEQ ID NO: 46275 - DNA, 201 bp, Homo sapiens
gggggatagtgacgtatttggcttgatgttggacaaagatggtggaagaaccttgtgcataatcaaagaagccatagagaatctatctatctatctatctatctatatattcgacacatatatggggtgtgtatatatatattcatgtatatctggagatctccatatatatatatatatgtgcacacacacatgtaatta

SEQ ID NO: 46276 - DNA, 201 bp, Homo sapiens
cactactggatggaggtaagtcaccatcagagcctccagcaggtgacagcccaggtcaggttgggaatgcattatgttgtagtgtcagtcttcactaagartgggcggtttggacatgttttgatggatcaaggactgccccgttgtagaaaagaaagaagaaactcagggagttaaatttatgcataatagggtggtagc

SEQ ID NO: 46277 - DNA, 201 bp, Homo sapiens
tcacggggtaaatatggataattctcactgcaaaggactcaccctcacctctggaatctgtgtctcctatgcctctccagtgggagctccctttggaagtrtaatgtacgagtttgttgggaagtctgcacccttcctcatcctggccttcctggcactactggatggaggtaagtcaccatcagagcctccagcaggtga

SEQ ID NO: 46278 - DNA, 201 bp, Homo sapiens
ggggatagtgacgtatttggcttgatgttggacaaagatggtggaagaaccttgtgcataatcaaagaagccatagagaatctatctatctatctatctatctatatattcgacacatatatggggtgtgtatatatatattcatgtatatctggagatctccatatatatatatatatgtgcacacacacatgtaattat

SEQ ID NO: 46279 - DNA, 201 bp, Homo sapiens
aaagaagccatagagaatctatctatctatctatctatctatatattcgacacatatatggggtgtgtatatatatattcatgtatatctggagatctccatatatatatatatatgtgcacacacacatgtaattatagctaggagataatgacattggggactgagtatttggagctgtaacatcatctcagagatgaa

SEQ ID NO: 46280 - DNA, 201 bp, Homo sapiens
aagaagccatagagaatctatctatctatctatctatctatatattcgacacatatatggggtgtgtatatatatattcatgtatatctggagatctccatatatatatatatatgtgcacacacacatgtaattatagctaggagataatgacattggggactgagtatttggagctgtaacatcatctcagagatgaag

SEQ ID NO: 46281 - DNA, 201 bp, Homo sapiens
aagaatggtatttccctagctactaacagtgtatgtgaatttccattccacagtactcacagtttttttttttattctatgattaaagggaggaagttgastgctcattcatttttaatggacaacaatttgattattaatagtgatgggcatttgtgaggagaccccagacttggccagcctgtgaatactagcatggtt

SEQ ID NO: 46282 - DNA, 201 bp, Homo sapiens
tagaagaaagacagaaaaaataactgattagacccaagatttcatgggaagaagttaaaagaaactgccttgaaatccctcctgattgtagatttcctaayaggaggggtgtaatgtgacattgttcatacttgctaataaatacattattgcctaattcagacctggtaaactagatgttgttttatagcacaagagagt

SEQ ID NO: 46283 - DNA, 201 bp, Homo sapiens
aaaattagcctggcgtggtgatgggcgcctgtagttccagctactctggaggctgaggcaggagaacggcatgaacccgggaggcggagcttgcagtgggscgagattgcgccactgcactccagcctgggcaacagagcgagactccgtctcaaaaaaaaaaaaatgataataatgtgcagtggcttctcttcttgcctc

SEQ ID NO: 46284 - DNA, 201 bp, Homo sapiens
ttccatttggcttcctgctgtaactttcactaccactgttaaattcagttaaaagcaaatgagatacttgtcctgacaagggttgatatactaggtacccsgggaggctggtgcatgtacatgcagagggtcctatgcatgtttcttgagtacttagcaatgccagccttggaagaactagtgggaggacggaatgaggag

SEQ ID NO: 46285 - DNA, 201 bp, Homo sapiens
tgcttctctatctgtgactattacagtgcctacctttcacacaggaggggtcctgcctccagcttcctctgtggcatcagacaagtcactttctctccctrtactggggttcctggtctctgcagtaaaggagatactgtagatggtctctaagcccataattgtactttctcagattctgtgaaaataggagagatgtat

SEQ ID NO: 46286 - DNA, 201 bp, Homo sapiens
agtaccagggagatctagtggaaaccaggagtccagacatctattgtccaaccctgaccttgctaccaatccactctgaccttgttgatggtcacgtgaasgcaggaaccatggctggaatatgttgcttctctatctgtgactattacagtgcctacctttcacacaggaggggtcctgcctccagcttcctctgtggca

SEQ ID NO: 46287 - DNA, 201 bp, Homo sapiens
aataattttatgtacatgtgattatgttcacaaaaaacttaaaaaacatttatttatctgatattatcagtgtagaatcatggagtcctatttttgtagttcatcactctatttacttgtttaatttttttttggagacagggcctctttctgtgactgaggctggagtgtagaggtgtgatcatggctcactgtagcctc

SEQ ID NO: 46288 - DNA, 201 bp, Homo sapiens
ataattttatgtacatgtgattatgttcacaaaaaacttaaaaaacatttatttatctgatattatcagtgtagaatcatggagtcctatttttgtagttcatcactctatttacttgtttaatttttttttggagacagggcctctttctgtgactgaggctggagtgtagaggtgtgatcatggctcactgtagcctcc

SEQ ID NO: 46289 - DNA, 201 bp, Homo sapiens
taattttatgtacatgtgattatgttcacaaaaaacttaaaaaacatttatttatctgatattatcagtgtagaatcatggagtcctatttttgtagttcatcactctatttacttgtttaatttttttttggagacagggcctctttctgtgactgaggctggagtgtagaggtgtgatcatggctcactgtagcctcca

SEQ ID NO: 46290 - DNA, 201 bp, Homo sapiens
gtattcttttttttgcgttctcctttttttctcaataatatgtcctgaaaattactctactagttcacagaatctttccttattattttccacctggtggtatatatatatatatatatatatatatatatatatatatatatatatacacacacacacacccacacacaattttgtatgtgtacacaatagtgtgtgcgc

SEQ ID NO: 46291 - DNA, 201 bp, Homo sapiens
tattcttttttttgcgttctcctttttttctcaataatatgtcctgaaaattactctactagttcacagaatctttccttattattttccacctggtggtatatatatatatatatatatatatatatatatatatatatatatatacacacacacacacccacacacaattttgtatgtgtacacaatagtgtgtgcgcc

SEQ ID NO: 46292 - DNA, 201 bp, Homo sapiens
tgtgtctctgtcagaggattttgactgttaagtaaagtttactattgatttgttggcaaattcctggttttgtttgtttttgttttgggatttgggtgtgygtgtttctctctctttgtagtacttacttcactcactatgttttttaattttccatggcttgtcttttattcttatccatacatatcctaagtcaatttg

SEQ ID NO: 46293 - DNA, 201 bp, Homo sapiens
attcttttttttgcgttctcctttttttctcaataatatgtcctgaaaattactctactagttcacagaatctttccttattattttccacctggtggtatatatatatatatatatatatatatatatatatatatatatatatacacacacacacacccacacacaattttgtatgtgtacacaatagtgtgtgcgcca

SEQ ID NO: 46294 - DNA, 201 bp, Homo sapiens
agatctgtaactctggatagagcaataaataaacacaacagcgctggtcaagttttcatatccttaaaatggaggtatagattcttttccatgagaaagtstgagagtgcaggaggatgatgtatgtggccaatagtgcactctgaataaatgcatttcatgtgaaaactctttgaaccttgctcccacctgacccatctg

SEQ ID NO: 46295 - DNA, 201 bp, Homo sapiens
ttcttttttttgcgttctcctttttttctcaataatatgtcctgaaaattactctactagttcacagaatctttccttattattttccacctggtggtatatatatatatatatatatatatatatatatatatatatatatatacacacacacacacccacacacaattttgtatgtgtacacaatagtgtgtgcgccat

SEQ ID NO: 46296 - DNA, 201 bp, Homo sapiens
aacacacacacttcctccactagaaagtgggcttgatggggacagggatcatgtctccatctctgaattcccagagcctcaggtggagcttagcccctagsaggccttctgcaaatgctcacggggtaaatatggataattctcactgcaaaggactcaccctcacctctggaatctgtgtctcctatgcctctccagtgg

SEQ ID NO: 46297 - DNA, 201 bp, Homo sapiens
tcctgaaaattactctactagttcacagaatctttccttattattttccacctggtggtatatatatatatatatatatatatatatatatatatatatakatatacacacacacacacccacacacaattttgtatgtgtacacaatagtgtgtgcgccatattttattccatctcctatgtttaggtagttttcagtat

SEQ ID NO: 46298 - DNA, 201 bp, Homo sapiens
ttttttctttaagaattacccaatctgtggtaatatgttacagcagcaaaaataaaacagactaagaccaacttcagttttttaatttgtaaaaaagtagrtatttttcagagtcattttcatctggaatcctaaatggattagcccagtgcgtggaatacaggatactatcagtaaataaaaaattatttgtacaatttt

SEQ ID NO: 46299 - DNA, 201 bp, Homo sapiens
cttgatggggacagggatcatgtctccatctctgaattcccagagcctcaggtggagcttagcccctagcaggccttctgcaaatgctcacggggtaaatrtggataattctcactgcaaaggactcaccctcacctctggaatctgtgtctcctatgcctctccagtgggagctccctttggaagtgtaatgtacgagtt

SEQ ID NO: 46300 - DNA, 201 bp, Homo sapiens
ctgaaaattactctactagttcacagaatctttccttattattttccacctggtggtatatatatatatatatatatatatatatatatatatatatatayatacacacacacacacccacacacaattttgtatgtgtacacaatagtgtgtgcgccatattttattccatctcctatgtttaggtagttttcagtattt

SEQ ID NO: 46301 - DNA, 201 bp, Homo sapiens
tccactccagtgtgcccaggattttggacatggagtcaaaggcaattattctccagctttaagacataatattgttttctgttttgggctttggactttcrtgggacctgttacccctttcttcttccctgttgcttccttttgaaataagaatgcctgttctatctttgttccaccattatttttgaaagtaggtaaatt

SEQ ID NO: 46302 - DNA, 201 bp, Homo sapiens
cattgcatgcaacattttactgtcaaactttcaccatgctttaattatttgtgtccctccctacacacacacacacatacatacacacacgcgcgcacacrcacacacacacaaacacacacacttcctccactagaaagtgggcttgatggggacagggatcatgtctccatctctgaattcccagagcctcaggtggag

SEQ ID NO: 46303 - DNA, 201 bp, Homo sapiens
gaaaattactctactagttcacagaatctttccttattattttccacctggtggtatatatatatatatatatatatatatatatatatatatatatatayacacacacacacacccacacacaattttgtatgtgtacacaatagtgtgtgcgccatattttattccatctcctatgtttaggtagttttcagtatttta

SEQ ID NO: 46304 - DNA, 201 bp, Homo sapiens
tggatgaataaatgacatatgaggtgaaaatgctttgtaccctgtacaatattaatgtgcaccattaccatccacattctcctcccttcagctcctcatcytcaagactaccctttggttatcttttttacctctaaaaaggggtgtatgtagcactcacttaggaaaagctatgggcccaggagagagggttccagcttc

SEQ ID NO: 46305 - DNA, 201 bp, Homo sapiens
gctgcgcattcagtataatttaatacctgctgattttgtctggttaaaagatcgttcaatataagatataaaaaaggatctgattgtatcacaagatattrttttctacccaattcctataatcctcgaagcacctacttactgtcactgtactccagatgatcctgtgggacccagcaatggtaaagaccagatctggat

SEQ ID NO: 46306 - DNA, 201 bp, Homo sapiens
tgagagaggacgagccatgggaactgctctggggggcctggccttggggttgctgggtaagtggcaccagctggagctctgggttcgggagggtgggactytaggaagcaggtgttcccgaggtgtagaagacgagtattttccttcccttgttggcctcatcctatttcaactcctttagaaatatcactgagaaaaggt

SEQ ID NO: 46307 - DNA, 201 bp, Homo sapiens
aattcacttctgtttctttccatcatctctctcattccctttcatcctgggctgttatttcctccctctattgctctgttgatactctctctgctttgccrtgtttcccaatcccctttcatcttcatatttcttttgtgcacttccttaatttcccttctctaagtaaccacttccctctttctggggctatcaggaagg

SEQ ID NO: 46308 - DNA, 201 bp, Homo sapiens
catcagaggaggtaggtgcagaggcagaaggatcaggagggcagctggcagggttgtggagagatgagctcgtaattcccacctggaacaggtgttagtcygaggcagaagacagcagacaaagcaaatggactaaatggaggaggagaggcggggtggtactaactgtgggtggggctgactgtgtcctgtttgctctgg

SEQ ID NO: 46309 - DNA, 201 bp, Homo sapiens
gcagggcttggccttgccataggtaagaagtgccctcaaagaaaacaataagcccctgcatgttggctttgggtctgatgcctttcctcccccttttctcmtcagaggaggtaggtgcagaggcagaaggatcaggagggcagctggcagggttgtggagagatgagctcgtaattcccacctggaacaggtgttagtccg

SEQ ID NO: 46310 - DNA, 201 bp, Homo sapiens
tgaaaactctttgaaccttgctcccacctgacccatctggagtcctgatgactcttcctccttccccatgcaggttcctctggctcacaatatttttggtvtcattggccccaatgcagggcttggccttgccataggtaagaagtgccctcaaagaaaacaataagcccctgcatgttggctttgggtctgatgcctttc

SEQ ID NO: 46311 - DNA, 201 bp, Homo sapiens
gggtttttgttgggggattgggagggcaatgggaatgagtctcacaagcttcctgacaggggacccaagccacaccacctgccccctctagcttacagctractggttgttggggcctcttctctatcttctttttccaacagctaccaagttagaagtctaaatgaaacctttcagtgatgtccataatggaaaacagag

SEQ ID NO: 46312 - DNA, 201 bp, Homo sapiens
agccaatactattgataatttataaacatttcttgaggcatgaaccctaaaaattgttatcagccagcagcatctaaacggtatgctaaacccttaagggktgagtgtcctggggtagcaggtttgaatggcaggtacccagagagggaggtaaggaacctgaaaaagagggaagaaggggtttttgttgggggattggga

SEQ ID NO: 46313 - DNA, 201 bp, Homo sapiens
gcccccatcacctgtcctccttgactttcagtagaattgacatctgtccttagccccttgagtttcagtggtaagatgacatcggtccttagcccccatcrcctgtcctctttgactttcagtgccaattgtgcccaccttcctatatgacatggagttcaaagaagtcaactcttctctgcacctcggccatgccggaag

SEQ ID NO: 46314 - DNA, 201 bp, Homo sapiens
ggttctgatggtgtccacagggttgtcaaggtaatccaaataaaccacagtgtctggcacatggtgagcccatagtgaatctcagccaatactattgatawtttataaacatttcttgaggcatgaaccctaaaaattgttatcagccagcagcatctaaacggtatgctaaacccttaaggggtgagtgtcctggggtag

SEQ ID NO: 46315 - DNA, 201 bp, Homo sapiens
cacaaacctcctaggcctgagggagagaagaacagggctacaaggcactgtaaactgtgctcaagaccagctggaggtcctgagcaggagcatgggatccrggttccatggcaggttttgccactttctatgcatgtgactttgagcaggttacttcatctccgtgtgctcagcatcctcatctatgtagagagggttctg

SEQ ID NO: 46316 - DNA, 201 bp, Homo sapiens
ccagcttgctctgtgtaagtataagaagacctgggggaggggaaggagagagagagcgagagacagacagacagagagagagagagagagagagagagagrgagagagagagagagaaagacacagacatttaaagactaatttcctttaagatgagcagagatggcttggcaaggactgtcagaaagactgtttctgaat

SEQ ID NO: 46317 - DNA, 201 bp, Homo sapiens
ctttctcctgtagttaaccatccagtcatccatgcaagaaatatttattggatgctaccatgtatcaggcactgagccagtattgagatgtgaagacacastgcataatctaagcctttacagaggccacagatgttgggtttttatggcttgagaacaacatacattgtttctttccaggaagctaattggggtacatgg

SEQ ID NO: 46318 - DNA, 201 bp, Homo sapiens
gtctagctttcttgcctgccagtgtgtcctacctcattggcaccaacctctttggtgtgttggccaacaagatgggtcggtatgtagcctcgggatctggracgaacagtagaaatgtaagatggaagagcgcccgttcctgatcttggaatgatgaacagcttccatacggttgaaagtttaggatgagtacacaccgat

SEQ ID NO: 46319 - DNA, 201 bp, Homo sapiens
ttgatatgcactattttgtttaaacctcacaactggcctgtctggtagaaattatgattatccccatatttcagagatttcttttcttttctttttctttyttttttttttttggcagctgcaagatttaatagagtgaaaacagagctaccatataatgggaggcggcccaaagggaattgccactgctggctggaatgc

SEQ ID NO: 46320 - DNA, 201 bp, Homo sapiens
ctgagtctggtcagaccttcgtatggtaattaagattaaaatcccctgttaggaaattggctgggttaagggaattttcagtggttaatgttaagtcatctttttttttttttaacagactagccccatactttaagatttttgagttagtaagctacttttttttttttttttgacttaggatagttctgaactggtgag

SEQ ID NO: 46321 - DNA, 201 bp, Homo sapiens
attgttttttgagtaatgttttacttttcgatacaaaaatatgtcctacgttcatcttgtactttccctgcctcagccctgaattcatttccccaaggagsccaggttcttgttagtagggaatggtgtttagaaaccaaactatggggccgggcacggtggttcacgcctgtaatcccagcagtttgggaggccgaggca

SEQ ID NO: 46322 - DNA, 201 bp, Homo sapiens
ggctgggttaagggaattttcagtggttaatgttaagtcatctttttttttttttaacagactagccccatactttaagatttttgagttagtaagctacttttttttttttttttgacttaggatagttctgaactggtgaggtgtgctcacaatgaggtttcctctaaaagttatttttctacttccttctgttagcaa

SEQ ID NO: 46323 - DNA, 201 bp, Homo sapiens
aatcaggagtggcaatgggtgccttgctggatcagaagtgcagtggacaccctgccagatctggaggggtggaagtcaatggtgggtctgtgatggcagcrctcagccgtggtggacggcgaatgaaagctcagctcgagccagaacaaacacggaccagaagagtgtacagttgcaagatttaatagagtgaaaacagag

SEQ ID NO: 46324 - DNA, 201 bp, Homo sapiens
tggcaggacagagccatatttctcttattgttttggatgacatattcctgttggatctcagtttcctgggtgtccatcttcaacagactgcctctcttcamggacaataactagatgttatttttattttgcatttgctacagagtctagcagagctgcgcattcagtataatttaatacctgctgattttgtctggttaa

SEQ ID NO: 46325 - DNA, 201 bp, Homo sapiens
tggaagtcaatggtgggtctgtgatggcagcgctcagccgtggtggacggcgaatgaaagctcagctcgagccagaacaaacacggaccagaagagtgtayagttgcaagatttaatagagtgaaaacagagctcccaaagggggttgccctcagagatttcttgatcttaccaaatttcccagtgctctttcaaatcctg

SEQ ID NO: 46326 - DNA, 201 bp, Homo sapiens
gtgggtctgtgatggcagcgctcagccgtggtggacggcgaatgaaagctcagctcgagccagaacaaacacggaccagaagagtgtacagttgcaagatytaatagagtgaaaacagagctcccaaagggggttgccctcagagatttcttgatcttaccaaatttcccagtgctctttcaaatcctggacttgtcatca

SEQ ID NO: 46327 - DNA, 201 bp, Homo sapiens
ctgctcccacttacatttaaaaatgtagtccatgtatgtgagtgcctgttggaattgtatctttttttttttcaattcccttttaggattggatatcatayccccatgtttgctggctttgttatcatgtttctctccacagttagtaagtaatttgcttcctcttttcttcccttcactgattacctttgattttatcaa

SEQ ID NO: 46328 - DNA, 201 bp, Homo sapiens
tcccagcactttgggaggccaaggcaggcaggatttcatgaccagcctgggcaacatgacgagactccatctctacaaaacaaacaaacaaacaaacaaamaaaaaaaaaacaaaaaaaaacaactaggtgtggtggtgttcatctgtaatcccagccacttgggaggctgagctgggaggatcacttgatcccaggaggt

SEQ ID NO: 46329 - DNA, 201 bp, Homo sapiens
cccagcactttgggaggccaaggcaggcaggatttcatgaccagcctgggcaacatgacgagactccatctctacaaaacaaacaaacaaacaaacaaacaaaaaaaaaacaaaaaaaaacaactaggtgtggtggtgttcatctgtaatcccagccacttgggaggctgagctgggaggatcacttgatcccaggaggtc

SEQ ID NO: 46330 - DNA, 201 bp, Homo sapiens
gactgtctgggagcctggcaggacagagccatatttctcttattgttttggatgacatattcctgttggatctcagtttcctgggtgtccatcttcaacasactgcctctcttcaaggacaataactagatgttatttttattttgcatttgctacagagtctagcagagctgcgcattcagtataatttaatacctgctg

SEQ ID NO: 46331 - DNA, 201 bp, Homo sapiens
attacctttgattttatcaagtgaatgcggtgtagatagcagggtaacctagaatgtaattaggcatctgactaagcagactggaatattggtttaaatgytctgctgtttttggtatgtggactagaacagtagtgacaattcagtctagttggaattggtctattctgctatagaagaacagatattttattcacttca

SEQ ID NO: 46332 - DNA, 201 bp, Homo sapiens
gggtgcagtgccccgcagggtacacaggagtaggaggactagaaaagtatagaaagggggttggaagggaaaaagaagaaatactcacttgtatgattccycaggggagtcagctattcggaaagctcgttactcaaagaataacatgttactgatgaaatgttatgggatcagattttcttagtgatatattgagtattg

SEQ ID NO: 46333 - DNA, 201 bp, Homo sapiens
actgccataggacatcagagaaggaaagaagtttggtactttctgtgttttttgagacagacctcaaggaccaaataaaataggacaggtaggaggcagtstgagctgggcaacagcatgagttaagtttgagggctacttctaaggaacaagtgcctcctgagtcagctgattcctcctgtaagggaaggaagagtgtgt

SEQ ID NO: 46334 - DNA, 201 bp, Homo sapiens
acctaggctatcatttctggaaatgagaattttggccctgatctatggtcatatctgcatgtttgtttgtttgctcatactcatccacatgccctatttcrtctccacactacattcagaggcatgttttaccatacacccaaatagctgcatttctgctcccacttacatttaaaaatgtagtccatgtatgtgagtgcc

SEQ ID NO: 46335 - DNA, 201 bp, Homo sapiens
ggaggcccagctcttttaacaaccagctcttgtgtgaacttacagagcaagaagtcactcattaccgtgaggatggggacagcaccacgccattcacgagsgattcattcccatgacccaaacacctcccactcagccccacctttaccactggagatgaagttataacgtgaaatttcaagaggacaaatatcaagcaat

SEQ ID NO: 46336 - DNA, 201 bp, Homo sapiens
cagcaagcatcctatgccctcatccttttctctgaacatgtctttcatcttcttgccctactgagacccagatgttttctgtgaacattgttttcctgcarcatctagatggaagttcatgttccacaccttgctctcctttgttgcttccgagtcatttcttctctattctccttcaaagatctcagctcctttgaatgt

SEQ ID NO: 46337 - DNA, 201 bp, Homo sapiens
gttctctgacctggggttcttggcctcacagattccaaggaatggaaccttgggccatgtggtgagtgttatagctctattagaagccgtgggtcacagawgagaaccgtggaatgcagtgactagtgttcagctggattaggatgaacctgggcacttaggtgtgcaggaacaatggcaagcttttagcccaatcaggag

SEQ ID NO: 46338 - DNA, 201 bp, Homo sapiens
taagatggcagcaagccttttgttctctgacctggggttcttggcctcacagattccaaggaatggaaccttgggccatgtggtgagtgttatagctctaktagaagccgtgggtcacagaagagaaccgtggaatgcagtgactagtgttcagctggattaggatgaacctgggcacttaggtgtgcaggaacaatggca

SEQ ID NO: 46339 - DNA, 201 bp, Homo sapiens
agagctcccaagatggggcgggctgctcctaagatggcagcaagccttttgttctctgacctggggttcttggcctcacagattccaaggaatggaacctkgggccatgtggtgagtgttatagctctattagaagccgtgggtcacagaagagaaccgtggaatgcagtgactagtgttcagctggattaggatgaacct

SEQ ID NO: 46340 - DNA, 201 bp, Homo sapiens
tggtagtaggtaccagcttgctctgtgtaagtataagaagacctgggggaggggaaggagagagagagcgagagacagacagacagagagagagagagagrgagagagagagggagagagagagagagaaagacacagacatttaaagactaatttcctttaagatgagcagagatggcttggcaaggactgtcagaaaga

SEQ ID NO: 46341 - DNA, 201 bp, Homo sapiens
agttaccaagttaactccctcataagtgggcagaattccattggcacatccgttcatccactcattcactctagtgcaacattatccttaccaggtcacttttttttttttttttgatggagtttcactcttgttgcccagggtggagtgtaatagtgtgatctcggctcaccacaacctctgcctcccgggttcaagaga

SEQ ID NO: 46342 - DNA, 201 bp, Homo sapiens
tgtgatctcggctcaccacaacctctgcctcccgggttcaagagattctcctgccttggcatcccaagtagctgggattacaggcatgtaccaccatgtcyggctaattttttgtatttttagtagagatggggtttatccatgttggtcagcaggtcacgtttttaaaagtacaaaaaccccagggaagagatccatacc

SEQ ID NO: 46343 - DNA, 201 bp, Homo sapiens
ctatgtagtccaggctggactcaaactcctgggctcaagatatcctcccacctcagcctcccaagtaactgagactccaggcacatcccaccatacctggyagtatctcaatattttaaaagagtggatctagaggaaaaagatgaagtaaatgatagtacaggtagtccttagatatgacataaaccatcaaggtgatag

SEQ ID NO: 46344 - DNA, 201 bp, Homo sapiens
ttgtagctcaaacaaaagaatgagcgtgcttctagaaccacagagcaagggaacatggtagaggataagctggcaagttgaaaagcgtgggatttcatccmagtttgacactaactgtgcaaccccaaacaaatctcctaaccttcagaggctcggatttcttgtctatgagatgaaggttggtctacatcagtgtttctc

SEQ ID NO: 46345 - DNA, 201 bp, Homo sapiens
atgaatgacactgccagcaccatcccacctccagccactgaagccatctcagctcataaaaacaactgcttgcaaggcacaggtttcttggaggaagagaytacccgggtcggggttctgtttgcttcaaaggctgtgatgcaacttctggtcaacccattcgtgggccctctcaccaacaggtatctcactgggtgcagt

SEQ ID NO: 46346 - DNA, 201 bp, Homo sapiens
gcttcccaggagttgtattgacgattattctgatattttcaagagatatacactccacctaggctatcatttctggaaatgagaattttggccctgatctrtggtcatatctgcatgtttgtttgtttgctcatactcatccacatgccctatttcatctccacactacattcagaggcatgttttaccatacacccaaat

SEQ ID NO: 46347 - DNA, 201 bp, Homo sapiens
cgagaccatcctgactaacacagtgaaaccctgtctctactaaaaatgcaaaaagttagccaggcgtggtggcaggcgcctgtagtcccagctactcaggrggctgaggcaggagaatggcgtgaacccggaaggtggagcttgcagtgagctgagatcacgccactacactccagtccgggcgacagagcgagactctgt

SEQ ID NO: 46348 - DNA, 201 bp, Homo sapiens
cccaggttagaagggcccccctctctgaagacccccactccctgggatgctacaatccaatgatggaagatggcattagctacaccaccctgcgctttccmgagatgaacataccacgaactgggtactgagggtaccaggagggtgaccctgcaccctgggagggaggcgggaggaaaagctctgtcccgcctgccctct

SEQ ID NO: 46349 - DNA, 201 bp, Homo sapiens
agtgattcaaagtggagaaaagcaggactgcgttgggtgcagtggttcccgcctgtaaccccagcactttgggaggctgagatcggaggatcgtttgagcycaggagtttgagaccagcctgggtaacatggcaagaccctgtctctacaaaatgtttaaaaaactagctaggtgtggtggcacatgcctgtagtcccagt

SEQ ID NO: 46350 - DNA, 201 bp, Homo sapiens; identical to SEQ ID NO: 12796

SEQ ID NO: 46351 - DNA, 201 bp, Homo sapiens
gacctgtgcgccacatcctatctcctgtgacgctgcaggagcttccctggttttaagaggtgacatggtggagagaaagcacaggactgggggccacaggycctggcttctcatccaggctccgctgctccctgactgctgcctttctctgtgggcctcgtttcctccctgatcccaccaggtgaattgtaattctccaca

SEQ ID NO: 46352 - DNA, 201 bp, Homo sapiens
aaaaatcagccaggcgtggtggcacctgcctttacccagctacttggggggctgaggccagagaaacgcttgagcctgggaagcagaggttgcagtgagcrgagatcacaccactgcactctagcctgggagacagagcaagactctgtctcaaaaaaaaagaaagaactccgtgagcatcccaaatgccacatccccata

SEQ ID NO: 46353 - DNA, 201 bp, Homo sapiens
gtggctcctctcttcacctgactgttccccagacccccagaccccctgcccaggtggcccctgagaactgctaagctcaaccgtgacatggatggggcccrgctgacccttgggctctccctgggggacccccttttcctgtccctggccacaccctcaccttatccacacccttctcctccctgctgccccgccggcttt

SEQ ID NO: 46354 - DNA, 201 bp, Homo sapiens
agaggagaaagtccacatcccaaagatcctcccctggcacgctgggacttattcctgtgtggcagaaaacattcttggtactggacagaggggcccgggarctgagctggatgtccagtgtgagtagccacggagcctctggttctagggagagaagatggacacagggaacggggaaggcagatggggtgcagggcattc

SEQ ID NO: 46355 - DNA, 201 bp, Homo sapiens
tgtggctcctctcttcacctgactgttccccagacccccagaccccctgcccaggtggcccctgagaactgctaagctcaaccgtgacatggatggggccyagctgacccttgggctctccctgggggacccccttttcctgtccctggccacaccctcaccttatccacacccttctcctccctgctgccccgccggctt

SEQ ID NO: 46356 - DNA, 201 bp, Homo sapiens; identical to SEQ ID NO: 12792

SEQ ID NO: 46357 - DNA, 201 bp, Homo sapiens; identical to SEQ ID NO: 12793

SEQ ID NO: 46358 - DNA, 201 bp, Homo sapiens
gggaggaaaagctctgtcccgcctgccctctttgtgccaggcccatgccaggcaccctgatacatgctctgcctcattcccactcggcaacaagcctctgrgtaagggccagtctccagaagtggacctgctccttcaagtcagcagcacacatgcccagtccgttcttatcacaaagatcaagagctcgtgatacacacc

SEQ ID NO: 46359 - DNA, 201 bp, Homo sapiens
gaaagtccacatcccaaagatcctcccctggcacgctgggacttattcctgtgtggcagaaaacattcttggtactggacagaggggcccgggagctgagytggatgtccagtgtgagtagccacggagcctctggttctagggagagaagatggacacagggaacggggaaggcagatggggtgcagggcattccggggt

SEQ ID NO: 46360 - DNA, 201 bp, Homo sapiens; identical to SEQ ID NO: 12784

SEQ ID NO: 46361 - DNA, 201 bp, Homo sapiens
catgaaagtaacacaagtttgtcaaagctgaaaagtccgtgaactaaactgataaaattcacttagaggtggtgggaataggccgggcacggtggctcacrcctgtaatcccagaactttgggaggccgaggcaggcggatcacaaggtcaggagatcgagaccatcctgactaacacagtgaaaccctgtctctactaaa

SEQ ID NO: 46362 - DNA, 201 bp, Homo sapiens
gtaatcccagcactttgggaggctgaggcaggtggatcacctgaggtcaggagttcgagaccagcgtagccaacatggtgaaaccctgtctctacaaaaartattttaaaaattagccgggcgtgatggtccatgcctgtaattccagctactcgggaggctgaggcaggagaatcgcttgaacctgggaggcagaggttg

SEQ ID NO: 46363 - DNA, 201 bp, Homo sapiens
ttctggatgtcatcaaggaggtctgtgtgacctaaggatcattgttctttgaaagagagacaagttcatttatcttgcaggcagctgccagggagtcaggwtgtaagttaaacaattatgagtgaattaatggttacctgctactgaaatgaccaaatgtaactaatcatgcatggaggaaggaaaggacaaagagaaaag

SEQ ID NO: 46364 - DNA, 201 bp, Homo sapiens
tgcaccctgggagggaggcgggaggaaaagctctgtcccgcctgccctctttgtgccaggcccatgccaggcaccctgatacatgctctgcctcattcccrctcggcaacaagcctctgggtaagggccagtctccagaagtggacctgctccttcaagtcagcagcacacatgcccagtccgttcttatcacaaagatca

SEQ ID NO: 46365 - DNA, 201 bp, Homo sapiens
tactcgggaggctgaggcaggagaatcgcttgaacctgggaggcagaggttgcagtgagccaagattgcgccattgcactccagcctgggtgacatactgwgactctgcctcaaaaaaaaaaaaaaaaaaaaaaaaagggtaggcatgaggcagactgtgaagctgagtggggaaacaaggtgaaggaaggggataaaatg

SEQ ID NO: 46366 - DNA, 201 bp, Homo sapiens; identical to SEQ ID NO: 12788

SEQ ID NO: 46367 - DNA, 201 bp, Homo sapiens
ggcacagagctcacaaaccgagcttcctgcagagctcaggcaggggacgccagcggatgacgatggcgatgcagcagcactagacagagctgcgggacctyggatgtcccatctgaccctcagttcctgcccctctgggacctggattccaaagttatcggatctcctgatctttccctctttctttctcaccatgtattt

SEQ ID NO: 46368 - DNA, 201 bp, Homo sapiens
caatcctcttccaacaaattacacgtggtaccacaatgggaaagaaatgcagggaaggacagaggagaaagtccacatcccaaagatcctcccctggcacrctgggacttattcctgtgtggcagaaaacattcttggtactggacagaggggcccgggagctgagctggatgtccagtgtgagtagccacggagcctctg

SEQ ID NO: 46369 - DNA, 201 bp, Homo sapiens; identical to SEQ ID NO: 12797

SEQ ID NO: 46370 - DNA, 201 bp, Homo sapiens
tctgccggcccggcccgcttcagcctctctctcctgctcttttttctgcccttggccatcacagccttctgctacgtgggctgcctccgggcactggcccrctccggcctgacgcacaggcggaagctgcgggccgcctgggtggccggcggggccctcctcacgctgctgctctgcgtaggaccctacaacgcctccaac

SEQ ID NO: 46371 - DNA, 201 bp, Homo sapiens
gcaggagaatcgcttgaacctgggaggcagaggttgcagtgagccaagattgcgccattgcactccagcctgggtgacatactgagactctgcctcaaaamaaaaaaaaaaaaaaaaaaaagggtaggcatgaggcagactgtgaagctgagtggggaaacaaggtgaaggaaggggataaaatgtcctctgaggagacct

SEQ ID NO: 46372 - DNA, 201 bp, Homo sapiens
  misc_feature (1)...(201): n = A,T,C or G, or insertion/deletion polymorphism (see Tables 1-2)
ggctgtcagaggccagggaaggggacgagggttggggaacaggtggttagcacttcatcctcgtctccctcccaggttagaagggcccccctctctgaagncccccactccctgggatgctacaatccaatgatggaagatggcattagctacaccaccctgcgctttcccgagatgaacataccacgaactgggtactga

SEQ ID NO: 46373 - DNA, 201 bp, Homo sapiens
ggcaacaagcctctgggtaagggccagtctccagaagtggacctgctccttcaagtcagcagcacacatgcccagtccgttcttatcacaaagatcaagasctcgtgatacacacccacgcctactccctccacgcacatttgcacgagctcctactgtgagctttgggcactggggaggccacaggttttacataagggg

SEQ ID NO: 46374 - DNA, 201 bp, Homo sapiens
acaagcctctgggtaagggccagtctccagaagtggacctgctccttcaagtcagcagcacacatgcccagtccgttcttatcacaaagatcaagagctcrtgatacacacccacgcctactccctccacgcacatttgcacgagctcctactgtgagctttgggcactggggaggccacaggttttacataaggggctga

SEQ ID NO: 46375 - DNA, 201 bp, Homo sapiens
ggccacagccagtttcctgacacgaggacacccgcctgggcttttggacccccgggtggaatgaaggagagaatgcggagaaaagcggcggtggaggctgrcgacagtggggccaggctaaccaccatgcggttttctcagggcgactatgagaacgtcattccagattttccagaagatgaggggattcattactcagag

SEQ ID NO: 46376 - DNA, 201 bp, Homo sapiens
gtgcctgtggtcccagctactggggaggctgaggagggagaatcacttgagcccaggaagtgaaggctgcagactgaactatgttcctgctactgcactcyagcctgggtgacagagcaagacctgggtctcaaaaagaaaaagaaaatgctgggactgggattataggtgtgagctgggcacagtggctcacacttgtaa

SEQ ID NO: 46377 - DNA, 201 bp, Homo sapiens
aacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggagg

SEQ ID NO: 46378 - DNA, 201 bp, Homo sapiens
gaggccgaggcaggcggatcacaaggtcaggagatcgagaccatcctgactaacacagtgaaaccctgtctctactaaaaatgcaaaaagttagccaggcrtggtggcaggcgcctgtagtcccagctactcaggaggctgaggcaggagaatggcgtgaacccggaaggtggagcttgcagtgagctgagatcacgccac

SEQ ID NO: 46379 - DNA, 201 bp, Homo sapiens
tactacatatataacagctttgctgagatataattcacataccataaaacacacccatgtaaaatgtccaattgaatggttttgggtctattcactgaatkatgcaaccatcaccacaaccagttttagaacatttcatcaccccaaaataatctcacatccattagcagtcactcttcatttcctcttacctttcccacc

SEQ ID NO: 46380 - DNA, 201 bp, Homo sapiens
ttacccggtatgaatggaaaccccatggcgcctgggaggagccatcgcttggggtgctgaagatccaaaacgttggctgggacaacacaaccatcgcctgygcagcttgtaatagttggtgctcgtgggcctcccctgtcgccctgaatgtccagtgtgagtccctgggctaggcagggggatctgggaggtggcccggct

SEQ ID NO: 46381 - DNA, 201 bp, Homo sapiens
ccatcccccaccacctcctctatcccttggcagaggcccgtgtccagttgctccatctcgaagcctccagcctgtggagtccctgaccctcacacatgtgyctttatttctcagttggaagaggacacagagccagcaggggcttcaggagaattccagcggccagagcttctttgtgaggaataaaaaggtaggatgggg

SEQ ID NO: 46382 - DNA, 201 bp, Homo sapiens
gctgcagagagaagtccaggatgccttccaggcaaaggctgccagggagagctggcccctcagttgattaaggtctctcctttctccacccagatagcccrgagaccatcggcaggcgagtggctgtgggactcgggtcctgcctcgccatcctcatcctggcaatctgtgggctcaagctccagcgacggtgagctcctg

SEQ ID NO: 46383 - DNA, 201 bp, Homo sapiens
tctcagagatgcagagtcctcagagatgcagagacctcccccggactgcgatgacacggtcacttattcagcattgcacaagcgccaagtggtaaggaggrtctccccaggtctccccagaggggctgtggaaggctggggacagggcctggcctcagtggtgggtcccacataggaaggagttgggtaggcatccgtggt

SEQ ID NO: 46384 - DNA, 201 bp, Homo sapiens
gctgcagtgagcctgtgatcatgccgctgcactccagcctgggtgactgagtgagaccttgtctcaaaaaaaagaatggattggccaggcatggtggcttrcgcctgtaatcccagcactttgggaggccaaggtgggcagatcacctgaggtcaggagttcgagaccagcctggccaacatggcgaaaccctgtctctac

SEQ ID NO: 46385 - DNA, 201 bp, Homo sapiens
attccggggtcctggagtcaagagcaaggagcagccagggtctcctgttcacaactgctgtctcagctcctagcatagggcctggctcatggagggtgctyggtagatgcttgtttttttgtgttttagttttttttgagatggagtctccctctgtctcccaggctggagtgcagtggcacaatctcggctcactgcaag

SEQ ID NO: 46386 - DNA, 201 bp, Homo sapiens
atctttctctcccctctgcacgtcctcacctgcctgtcttccgtgggccgcgagcagaggccttgtacttacgggaaggaggaggcagtctgtttctgacycacaggaactgccactccggtgatgcacttgaggacagctactctgaaatcagttcccaggagagaacatttgatttccgagtaggagaggaggcaggag

SEQ ID NO: 46387 - DNA, 201 bp, Homo sapiens; identical to SEQ ID NO: 12798

SEQ ID NO: 46388 - DNA, 201 bp, Homo sapiens
tgtgtcacctgggtctggtctttgggttggaggctccaggaggctggctggaccacagcaacacctccctgggcatcaacacaccggtcaacggctctccsgtctgcctggaggcctgggacccggcctctgccggcccggcccgcttcagcctctctctcctgctcttttttctgcccttggccatcacagccttctgct

SEQ ID NO: 46389 - DNA, 201 bp, Homo sapiens
tcagaaagcagacatccggcaatgagcatgaaagaaaagtagatcacagttcccaaggaggcttagtgtggtcaaggcctttcagaggggatttcgggtgwgcaaaagtgattcaaagtggagaaaagcaggactgcgttgggtgcagtggttcccgcctgtaaccccagcactttgggaggctgagatcggaggatcgtt

SEQ ID NO: 46390 - DNA, 201 bp, Homo sapiens
ttcagaaagcagacatccggcaatgagcatgaaagaaaagtagatcacagttcccaaggaggcttagtgtggtcaaggcctttcagaggggatttcgggtgagcaaaagtgattcaaagtggagaaaagcaggactgcgttgggtgcagtggttcccgcctgtaaccccagcactttgggaggctgagatcggaggatcgt

SEQ ID NO: 46391 - DNA, 201 bp, Homo sapiens
ctgatacatgctctgcctcattcccactcggcaacaagcctctgggtaagggccagtctccagaagtggacctgctccttcaagtcagcagcacacatgcscagtccgttcttatcacaaagatcaagagctcgtgatacacacccacgcctactccctccacgcacatttgcacgagctcctactgtgagctttgggcac

SEQ ID NO: 46392 - DNA, 201 bp, Homo sapiens; identical to SEQ ID NO: 12790

SEQ ID NO: 46393 - DNA, 201 bp, Homo sapiens
aagagagagaggctgcccccgcagggctctcagtttgaaggagaggtgcagcacactcagaaaaaactcccggccaggagtggtggctcacacctgtagtrccagcactttgggaggccaaggctggcagatcacctgagatcaggagttcaagaccagccaggccaacatggtgaaaccccatctctactgaaaatacaa

SEQ ID NO: 46394 - DNA, 201 bp, Homo sapiens
aagagtcctaatttgcacagcctggggcctgggcactaccccgagctacttccttttccccagccctggggcccggagccagctttgtccttcccatctcygagggcatggactgctgctgccctgatgggcccctgtcctggccatgggacccctgtcttccacaggttgtcggcggcttccccagccaggcccaagtca

SEQ ID NO: 46395 - DNA, 201 bp, Homo sapiens
cttgctccccaagaagggctgactggggctctgtcccctgccccagggctcgaggtagtgtttacagccctcatgaacagcaaaggcgtgagcctcttcgrcatcatcaaccctgagattatcactcgagatgtgagtacaaagcccccctcaccagcccctgttcctggggagagaggcccagacaggattcctggggtg

SEQ ID NO: 46396 - DNA, 201 bp, Homo sapiens
agcagtgaagtccagactgggcacagtggctcacacctgtaatcccaatcctttgggaagctgagatgtagcaggacgaaccgcagacaaaactcctcagrcactgagttaaagaaggaaagagtttattcagccgggagcatgggtaagactcctgtctcaagagcggagctctccgagtgcgcaattcctgtccctttt

SEQ ID NO: 46397 - DNA, 201 bp, Homo sapiens
tcggaaacttggtggtgggcaaaagaactaagctggagcaatagcagtgaagtccagactgggcacagtggctcacacctgtaatcccaatcctttgggargctgagatgtagcaggacgaaccgcagacaaaactcctcagacactgagttaaagaaggaaagagtttattcagccgggagcatgggtaagactcctgtc

SEQ ID NO: 46398 - DNA, 201 bp, Homo sapiens
tctacaagaatgtctcagaggacctccccctccccaccttctcgcccacactgctgggggactcccgcatgctgtacttctggttctctgagcgagtcttycactcgctggccaaggtagctttccaggatggccgcctcatgctcagcctgatgggagacgagttcaaggtgagtgggtggggctgggctgctagggaat

SEQ ID NO: 46399 - DNA, 201 bp, Homo sapiens
gccccgctgggggaaactgggtacagctctttcctcagtttccccatctgcactctgggctgaatgctggggctcctcccaatctccctgaagctggaccygagcccagtagggacacacagggtccagccagcgtcctggcttcctccagggtcatttcatctacaagaatgtctcagaggacctccccctccccacctt

SEQ ID NO: 46400 - DNA, 201 bp, Homo sapiens
ggcaaatctctgcccctttgggctgcagcctcacaagctgtgtggcgttgggcaagtctatagaactcaggacaaatgggtgattaagtccaagaggactycaagattctcctggaagtagattaggaaaaaagataattagattgctcacatggctgggcactcatccatgtactgtactctcctatgcagtacagagca

SEQ ID NO: 46401 - DNA, 201 bp, Homo sapiens
cactcttcctgtctaggtcccatgggctctatctggctctgacacttgatgattagttatgagcatactttggcaaatctctgcccctttgggctgcagcmtcacaagctgtgtggcgttgggcaagtctatagaactcaggacaaatgggtgattaagtccaagaggactccaagattctcctggaagtagattaggaaa

SEQ ID NO: 46402 - DNA, 201 bp, Homo sapiens
tgcctggaaagcacctgctctgtctgccccagatctgcaaagagatcaacgtcatctctaacatcatggccgattttgtccagacaagggctggtgagtgygtttctgtctgcatgcctcagaagacagcagtgggagccagaaagccacctgctgcactatgtggccttgggactgtcactcttcctgtctaggtcccat

SEQ ID NO: 46403 - DNA, 201 bp, Homo sapiens
ccgtgttctcagctgcaaaatgggagtgataattcttacttcctgagctacaagagtcagggccaacagagccatgaacggtgcctggtacacactaggcrctccatggatgcacaggactggtcaggggctcattgtggtgcttgctgccttcaggcctgggtggatcaagcagctgttcacaaatttcatctccttcac

SEQ ID NO: 46404 - DNA, 201 bp, Homo sapiens
gggctgaatgctggggctcctcccaatctccctgaagctggacctgagcccagtagggacacacagggtccagccagcgtcctggcttcctccagggtcayttcatctacaagaatgtctcagaggacctccccctccccaccttctcgcccacactgctgggggactcccgcatgctgtacttctggttctctgagcgag

SEQ ID NO: 46405 - DNA, 201 bp, Homo sapiens
gcctcgggccggccttgctccccaagaagggctgactggggctctgtcccctgccccagggctcgaggtagtgtttacagccctcatgaacagcaaaggcrtgagcctcttcgacatcatcaaccctgagattatcactcgagatgtgagtacaaagcccccctcaccagcccctgttcctggggagagaggcccagacag

SEQ ID NO: 46406 - DNA, 201 bp, Homo sapiens
ataagctgctcctgcatctccaaggggagcgagagtaagtacaccaccctgtggcccccattcctgctcgtgcccatcctgttagtgtgtccacggccccytccaggctcaaccccacacagggcatgcttgtgggtggccaaacctgagggcagcaataccttcagtggggtcacttcctaccccctcccatcaatacac

SEQ ID NO: 46407 - DNA, 201 bp, Homo sapiens
aaccaaccctaggatatagattctgttatcatcccctttttacatatgggtaaactgagtcacagagaggttagaaaggaaaagctcatatctacggagtscatcctgcattccaagcaccacactaactcagagataaaactctagccaagctaagtaacttgctgaggacacacaactcgccactaagggatgggagta

SEQ ID NO: 46408 - DNA, 201 bp, Homo sapiens
tggtcaggggctcattgtggtgcttgctgccttcaggcctgggtggatcaagcagctgttcacaaatttcatctccttcaccctgaagctggtcctgaagkgacaggtgagtgaggctggctgactccctgtggtccagggccatgcccaggaggctggatccctttcctccctgcctttccctgagaaggtgccactccc

SEQ ID NO: 46409 - DNA, 201 bp, Homo sapiens
accaaccctaggatatagattctgttatcatcccctttttacatatgggtaaactgagtcacagagaggttagaaaggaaaagctcatatctacggagtgsatcctgcattccaagcaccacactaactcagagataaaactctagccaagctaagtaacttgctgaggacacacaactcgccactaagggatgggagtag

SEQ ID NO: 46410 - DNA, 201 bp, Homo sapiens
gactcactgcaacttctgcctcctgggttcaagcgattctcctgcctcaacctcccgagcagctggaaccacaagcatatgccaccactcccggctaatctttttttttttttttatgcatttttagtagagatggggtttcaccatgctggccaggctggtctcgaactcctgacctcagatgatccacctgcctcggcc

SEQ ID NO: 46411 - DNA, 201 bp, Homo sapiens
ttctgaggagtggactttactccacccaccctccaacttcctcatttcttttcaggcagtgctggagacctggggcttcaacaccaaccaggaaatcttcyaagaggtaactgccccctgcccctgtgtggggtttatctcacgtaccccaatcctgctctggcttcaagagcccccacacagccaataacaccaccaatg

SEQ ID NO: 46412 - DNA, 201 bp, Homo sapiens
gaaggaggcactgcctctggcctcctttcctgcctggaaagcacctgctctgtctgccccagatctgcaaagagatcaacgtcatctctaacatcatggcygattttgtccagacaagggctggtgagtgcgtttctgtctgcatgcctcagaagacagcagtgggagccagaaagccacctgctgcactatgtggccttg

SEQ ID NO: 46413 - DNA, 201 bp, Homo sapiens
accagggctgcccactacaaggatcccagcaaagcaccagctccttcctagagggcttattcggcttctgtcatcctctacagcagtggattgtggccccycccagggggtactgacaaaagctttggaccctctattacttaggatatagatttctgtaacaaagaaatccgaaataatagctgcttaaacacaataaac

SEQ ID NO: 46414 - DNA, 201 bp, Homo sapiens
cttcccttctgaactcaggccgtccagccttccccggctctgtgatgtctctctccctgcacatacacaactcacaatattgggcaggcccctgaccggcycttctcccttagccccttgtctgagtcctgttcctttgatgtcctatttctagtctttccatttctctctgtctctacctcctccccaggctaccattat

SEQ ID NO: 46415 - DNA, 201 bp, Homo sapiens
agccagctttgtccttcccatctccgagggcatggactgctgctgccctgatgggcccctgtcctggccatgggacccctgtcttccacaggttgtcggcrgcttccccagccaggcccaagtcaccgtccactgcctcaagatgcccaagatctcctgccaaaacaagggagtcgtggtcaattcttcagtgatggtgaa

SEQ ID NO: 46416 - DNA, 201 bp, Homo sapiens
gttcaaaagccagaattatagacccccaggactacagacagtgtcacagcatcgtctgggtgaggctagggttagtgtgcggctgggctcagggctgcccmatttgctaggatcgtggggttcccatgtgtcaggatccagaggctagggtatgatcaggatctctagctggggtcagggtcagagctctctgtgtcccct

SEQ ID NO: 46417 - DNA, 201 bp, Homo sapiens
caggggccctgagctaggagggttgctctctgcttcgggaagagccctggctcacagcaaatttggtttctctccccaggatatcgtgactaccgtccagscctcctattctaagaaaaagctcttcttaagcctcttggatttccagtatgtgctgcagagaagagagggggcggtcaactccgcaaacctctccctggc

SEQ ID NO: 46418 - DNA, 201 bp, Homo sapiens
ggtcacttctgtgctccagggaggactcaccatgggcatttgattggcagagcagctccgagtccgtccagagcttcctgcagtcaatgatcaccgctgtrggcatccctgaggtcatgtctcgtaagtgtgggctggaggggaaactgggtgccgaggctgacagagcttcccatttcaccttgtgggcccttcccaggc

SEQ ID NO: 46419 - DNA, 201 bp, Homo sapiens
ggcctgggagtcagcccagctcgcccctctctcctactgcccctcccttcagggcttcctgctgctgcagatggactttggcttccctgagcacctgctgrtggatttcctccagagcttgagctagaagtctccaaggaggtcgggatggggcttgtagcagaaggcaagcaccaggctcacagctggaaccctggtgtc

SEQ ID NO: 46420 - DNA, 201 bp, Homo sapiens
tccctccatctacttttatttagggcgagggaagcttcctgctctgactttctcatttatggtattctcccctgctttccagcagctgtgattgtcccaartcctgtcctctggttctctaggccagaaaaactatgatctaccagagctcaagaacttgaaagggccttttcccactgtcccttctcacagtgagagccg

SEQ ID NO: 46421 - DNA, 201 bp, Homo sapiens
agctccacctctgcccccggggcctagctgaggcctcctccaagctgagccacctactatcttccaaactcccaccctccatctggtgtcacctcctcccrgaagccctctgtatcagtttcctgttttctgccataaaaaaaatcactccaagtttagtggcttaacatgacacaagtttaccattttacagtttaaaag

SEQ ID NO: 46422 - DNA, 201 bp, Homo sapiens
acccactatgccaggagcctccctggcctgaagccagccctgaagccggctgccacactagcccagagagaggagtgccctgggagggagatgggctgagyggagctgtcatcaccccctcctgacctcgccttcaaggtcaagttctttggtgagaaggtcctagctgcattgcaaacagccaggtatagggatttgtgt

SEQ ID NO: 46423 - DNA, 201 bp, Homo sapiens
gctctgtcccctgccccagggctcgaggtagtgtttacagccctcatgaacagcaaaggcgtgagcctcttcgacatcatcaaccctgagattatcactcragatgtgagtacaaagcccccctcaccagcccctgttcctggggagagaggcccagacaggattcctggggtgactgggggctgttggggagacagacag

SEQ ID NO: 46424 - DNA, 201 bp, Homo sapiens
ccttcaaggtcaagttctttggtgagaaggtcctagctgcattgcaaacagccaggtatagggatttgtgtttgtctgagacccagaatcactggggttcragttagggttcagatctgagccaggttagggggttgagtcagggggtaaagattaggaggttggtgtatatttggtgttgggggtcactctatggccaaa

SEQ ID NO: 46425 - DNA, 201 bp, Homo sapiens
agacaggattcctggggtgactgggggctgttggggagacagacagaggggcctctaccagcttggctccctcctggtggcctgggagtcagcccagctcrcccctctctcctactgcccctcccttcagggcttcctgctgctgcagatggactttggcttccctgagcacctgctggtggatttcctccagagcttgag

SEQ ID NO: 46426 - DNA, 201 bp, Homo sapiens
tccagagcttgagctagaagtctccaaggaggtcgggatggggcttgtagcagaaggcaagcaccaggctcacagctggaaccctggtgtctcctccagcrtggtggaagttgggttaggagtacggagatggagattggctcccaactcctccctatcctaaaggcccactggcattaaagtgctgtatccaagagctgg

SEQ ID NO: 46427 - DNA, 201 bp, Homo sapiens
ccaacagagccatgaacggtgcctggtacacactaggcgctccatggatgcacaggactggtcaggggctcattgtggtgcttgctgccttcaggcctggrtggatcaagcagctgttcacaaatttcatctccttcaccctgaagctggtcctgaagggacaggtgagtgaggctggctgactccctgtggtccagggcc

SEQ ID NO: 46428 - DNA, 201 bp, Homo sapiens
tgactctggagcagacggatacatgtatgaatttggactctagacacgttctcgtgtgtgtgacaggtgtgagcgtcacaggagctgggccctcccgaggrattctgggatggtgccacagttaattcttgggtctgaggctccgtgttctcagctgcaaaatgggagtgataattcttacttcctgagctacaagagtca

SEQ ID NO: 46429 - DNA, 201 bp, Homo sapiens
tcatttcatctacaagaatgtctcagaggacctccccctccccaccttctcgcccacactgctgggggactcccgcatgctgtacttctggttctctgagygagtcttccactcgctggccaaggtagctttccaggatggccgcctcatgctcagcctgatgggagacgagttcaaggtgagtgggtggggctgggctgc

SEQ ID NO: 46430 - DNA, 201 bp, Homo sapiens
tgttctcagctgcaaaatgggagtgataattcttacttcctgagctacaagagtcagggccaacagagccatgaacggtgcctggtacacactaggcgctycatggatgcacaggactggtcaggggctcattgtggtgcttgctgccttcaggcctgggtggatcaagcagctgttcacaaatttcatctccttcaccct

SEQ ID NO: 46431 - DNA, 201 bp, Homo sapiens
gcaggcatcgtgtgccgcatcaccaagcctgccctcctggtgtgtaagtatcagtgcatctgtctgccctgccaggggtcttttcatggacacccactatrccaggagcctccctggcctgaagccagccctgaagccggctgccacactagcccagagagaggagtgccctgggagggagatgggctgagtggagctgtc

SEQ ID NO: 46432 - DNA, 201 bp, Homo sapiens
gacaaatgggtgattaagtccaagaggactccaagattctcctggaagtagattaggaaaaaagataattagattgctcacatggctgggcactcatccaygtactgtactctcctatgcagtacagagcagagctgggtttcagcccaagtcttggactctgctctgaaccaaccttctagaagggctctacctacccag

SEQ ID NO: 46433 - DNA, 201 bp, Homo sapiens
gagtcttccactcgctggccaaggtagctttccaggatggccgcctcatgctcagcctgatgggagacgagttcaaggtgagtgggtggggctgggctgckagggaatccagatggcatgtggtatgtgtgtgtgtgcacacgcatggggaggagggaggaaactcggaaacttggtggtgggcaaaagaactaagctgga

SEQ ID NO: 46434 - DNA, 201 bp, Homo sapiens
tctcacgtaccccaatcctgctctggcttcaagagcccccacacagccaataacaccaccaatggcaacaattataacagcgaacacagctcctactcggktgttcggcatggagtgaagcacttagtgtgtgtgacttccttcagtgctcacaccgaccctatgagtggggcggtcaaactgtccccattttacacacag

SEQ ID NO: 46435 - DNA, 201 bp, Homo sapiens
cacactagcccagagagaggagtgccctgggagggagatgggctgagtggagctgtcatcaccccctcctgacctcgccttcaaggtcaagttctttggtragaaggtcctagctgcattgcaaacagccaggtatagggatttgtgtttgtctgagacccagaatcactggggttcgagttagggttcagatctgagcca

SEQ ID NO: 46436 - DNA, 201 bp, Homo sapiens
acaaaataagtatttttttaaaaaatgtataaatgttgttttcttatagtacagacaggtcttgctatgttggccaggttggtcttgaactcttggcttakccagtcccccaccccaagcctaaaattagtatcttgactttatttgggatgatggtaacagtcaagggtcggttgtgggccaggtgcttttacaaacaat

SEQ ID NO: 46437 - DNA, 201 bp, Homo sapiens
gattggctcccaactcctccctatcctaaaggcccactggcattaaagtgctgtatccaagagctggggagtccttcttctgtggctggcgggtagagggrgggggaagggattgtctcaccagtgccgtccacctcttttcagcccttccaaggcagctgcccccaaaccctccaagcttcatgatgactggaggaagaa

SEQ ID NO: 46438 - DNA, 201 bp, Homo sapiens
ggcagacattgttcagggaccttgtctttgtcttaaagccaatctcctcctcctccccggccctgctaaacacgctccccaggggtggtctctgctacccscgcacattgggccttgagtcttggtaaatgtttctgagccaccagggggcgccagcggtgctggatgccacttcgccttttgcaggaaaactcccgccgc

SEQ ID NO: 46439 - DNA, 201 bp, Homo sapiens
ccagacccctgttcttggtttacctgcagaatattatctttgccaccccgcgggatggctcaacccactttcaggatgcaggtctcctaatagcaacctgwtatagcagaaagacccctgggctgggagtctgagacctagttctagcccagccctgaacctcagtttccctttctgtgaaacaagaatgttgaacttgat

SEQ ID NO: 46440 - DNA, 201 bp, Homo sapiens
taaatggttcctacaactacttgcaaggagaccactctgtgtggttgcaaagaacactttgagaagctgtgtgggaaagtttccttcctagcagggtagaytcagctaactgcaggtcatgtggccattgtggatgggttgggagctcaagtttggggcagaagggaattttttttggcagcagagtggcaagccctgccg

SEQ ID NO: 46441 - DNA, 201 bp, Homo sapiens
ataacctaggatcatctccccacctaccccaaggtccttaacttaaccatactttcatatgggtaacacgagttgagtgtggtacccagggtttgacatgytgggtaacatatttgcaggttctgtggattaggaggacattttgggggccatgattctatcttccaccctcgcctagacaaaattggaggctcactcctt

SEQ ID NO: 46442 - DNA, 201 bp, Homo sapiens
tttgaccttgaaatggtagaatatttatccctttgaggtgactcggatggtagactctcagacaccatagcacacgtgtgctgggggtattttggaccagrctctgctgagagctttctgctcccttccccacagagtatgttgagctgactgtgctttccttttgaacatctgcttgtccacatggcttaggtaggagag

SEQ ID NO: 46443 - DNA, 201 bp, Homo sapiens
aatgcttgtccaggccgtgcagcatctgccttgtgggtcacttctgtgctccagggaggactcaccatgggcatttgattggcagagcagctccgagtccrtccagagcttcctgcagtcaatgatcaccgctgtgggcatccctgaggtcatgtctcgtaagtgtgggctggaggggaaactgggtgccgaggctgacag

SEQ ID NO: 46444 - DNA, 201 bp, Homo sapiens
aatagcaacctgatatagcagaaagacccctgggctgggagtctgagacctagttctagcccagccctgaacctcagtttccctttctgtgaaacaagaaygttgaacttgatgattcccaattttccttttgaccttgaaatggtagaatatttatccctttgaggtgactcggatggtagactctcagacaccatagca

SEQ ID NO: 46445 - DNA, 201 bp, Homo sapiens
gatggccgcctcatgctcagcctgatgggagacgagttcaaggtgagtgggtggggctgggctgctagggaatccagatggcatgtggtatgtgtgtgtgygcacacgcatggggaggagggaggaaactcggaaacttggtggtgggcaaaagaactaagctggagcaatagcagtgaagtccagactgggcacagtggc

SEQ ID NO: 46446 - DNA, 201 bp, Homo sapiens
ttggtttacctgcagaatattatctttgccaccccgcgggatggctcaacccactttcaggatgcaggtctcctaatagcaacctgatatagcagaaagasccctgggctgggagtctgagacctagttctagcccagccctgaacctcagtttccctttctgtgaaacaagaatgttgaacttgatgattcccaattttc

SEQ ID NO: 46447 - DNA, 201 bp, Homo sapiens
tgacttcttcaggccttccctgccatcctcaaatctccagctgccccctcctgtctaccttccacttccctctccacacacaacctgcttaccagagagcwgagcagagccaccaacagaacttcccccccacgtcgctgctcccagtcgcaacccactcacccacacctgcgccttcctgcggccgttctcctgttctaa

SEQ ID NO: 46448 - DNA, 201 bp, Homo sapiens
gagtgcggtggcacaatctcggctcactacaacctctgcctcccaggttccagcgattctcatgcctcagcctcccaggtagctgggattacaggcatgcrctaccacgcctgactaattttttgtatttttagtagagacagggtttcgctatgtgggcccagctggtctgagactcctggtttcaagtgatctgcccgc

SEQ ID NO: 46449 - DNA, 201 bp, Homo sapiens
gctcactgcagcctcgaatcctgggctcgagtgatcctcccacctcagccctcctgagtagctgggaccacagacaaacaccaccacacctggctaatttwaaaaaaaaaatttccttagaggcggggtcttgttatgttgtccaggctgttctcaaactcctggcctcaagcaattctcctgccttggcctcctaagttg

SEQ ID NO: 46450 - DNA, 201 bp, Homo sapiens
gctcttgactggcctgggcagcatgtggataccatctgatagcggaggctgccctgaggtcatgtcgggtctccctgcagcctgtgactctggtagagtgyggaccgatgcccctgactgctacctgtctttccataagctgctcctgcatctccaaggggagcgagagtaagtacaccaccctgtggcccccattcctgc

SEQ ID NO: 46451 - DNA, 201 bp, Homo sapiens
tggtttgccctcccccatgccatctgctcctcctcctgccacctcagggaaggcctctcccacctccctgactaggtcaggtcccctcgtgccacagcctrgtgtgtctctcctttaaatactcctcagctgcagttttacgttctgttctgggatgccctggaaaatgctgggctcctgcagatatggcccgcagctcct

SEQ ID NO: 46452 - DNA, 201 bp, Homo sapiens
tggtgtgtaagtatcagtgcatctgtctgccctgccaggggtcttttcatggacacccactatgccaggagcctccctggcctgaagccagccctgaagcmggctgccacactagcccagagagaggagtgccctgggagggagatgggctgagtggagctgtcatcaccccctcctgacctcgccttcaaggtcaagttc

SEQ ID NO: 46453 - DNA, 201 bp, Homo sapiens
atatacgggctccaggctgaacggctcgggccacttacacaccactgcctgataaccatgctggctgccacagtcctgaccctggccctgctgggcaatgsccatgcctgctccaaaggcacctcgcacgaggcaggcatcgtgtgccgcatcaccaagcctgccctcctggtgtgtaagtatcagtgcatctgtctgccc

SEQ ID NO: 46454 - DNA, 201 bp, Homo sapiens
ggctcgggccacttacacaccactgcctgataaccatgctggctgccacagtcctgaccctggccctgctgggcaatgcccatgcctgctccaaaggcacmtcgcacgaggcaggcatcgtgtgccgcatcaccaagcctgccctcctggtgtgtaagtatcagtgcatctgtctgccctgccaggggtcttttcatggac

SEQ ID NO: 46455 - DNA, 201 bp, Homo sapiens
tctagaggaggccgcaggggctgggcaggaaggaggtgaatctctggggccaggaagaccctgctgcccggaagagcctcatgttccgtgggggctgggcrgacatacatatacgggctccaggctgaacggctcgggccacttacacaccactgcctgataaccatgctggctgccacagtcctgaccctggccctgctg

SEQ ID NO: 46456 - DNA, 201 bp, Homo sapiens
tgggggactcaggtctctccccttgatttggaaccagagcctgacaccttccctacccccaccctccatcccctggtgccctggggggatttattggagtrtatcaacctctccaacagcccctctaagagtcaggcttcaaagggtcctttcccactgccctgggaagatggaggtcttatttcggggtgaatggggggt

SEQ ID NO: 46457 - DNA, 201 bp, Homo sapiens
ccaccaacagaacttcccccccacgtcgctgctcccagtcgcaacccactcacccacacctgcgccttcctgcggccgttctcctgttctaacagaggacrgtccctcttcccttctgaactcaggccgtccagccttccccggctctgtgatgtctctctccctgcacatacacaactcacaatattgggcaggcccctg

SEQ ID NO: 46458 - DNA, 201 bp, Homo sapiens
atggctcaacccactttcaggatgcaggtctcctaatagcaacctgatatagcagaaagacccctgggctgggagtctgagacctagttctagcccagccmtgaacctcagtttccctttctgtgaaacaagaatgttgaacttgatgattcccaattttccttttgaccttgaaatggtagaatatttatccctttgagg

SEQ ID NO: 46459 - DNA, 201 bp, Homo sapiens
tcaagtatctttttagttcattaattctttttacagctgtgtcttatttgtttacttacccactgagattttcattttattttatttaattaattaatttrtttatttttgagacagagtctcgctcttgttccccaggctggagtgcagtggcgcaatctcagctcactgcaacctacgcctcctgtgttcaagcaattc

SEQ ID NO: 46460 - DNA, 201 bp, Homo sapiens
caagttcaaaagccagaattatagacccccaggactacagacagtgtcacagcatcgtctgggtgaggctagggttagtgtgcggctgggctcagggctgccccatttgctaggatcgtggggttcccatgtgtcaggatccagaggctagggtatgatcaggatctctagctggggtcagggtcagagctctctgtgtcc

SEQ ID NO: 46461 - DNA, 201 bp, Homo sapiens
aagttcaaaagccagaattatagacccccaggactacagacagtgtcacagcatcgtctgggtgaggctagggttagtgtgcggctgggctcagggctgccccatttgctaggatcgtggggttcccatgtgtcaggatccagaggctagggtatgatcaggatctctagctggggtcagggtcagagctctctgtgtccc

SEQ ID NO: 46462 - DNA, 201 bp, Homo sapiens
aaaaggctagaagtccaccatggccctccctgagctaagatcaagctgtcagcagaaccagattccttctgggggctataggggagaattaattccctcgytttctgcagcttctagaggcttcccccattccttggcttccctccatctacttttatttagggcgagggaagcttcctgctctgactttctcatttatgg

SEQ ID NO: 46463 - DNA, 201 bp, Homo sapiens
agcccctctaagagtcaggcttcaaagggtcctttcccactgccctgggaagatggaggtcttatttcggggtgaatggggggtagggtagaaaaatctcaaacaaaataagtatttttttaaaaaatgtataaatgttgttttcttatagtacagacaggtcttgctatgttggccaggttggtcttgaactcttggctt

SEQ ID NO: 46464 - DNA, 201 bp, Homo sapiens
gcagacaaaactcctcagacactgagttaaagaaggaaagagtttattcagccgggagcatgggtaagactcctgtctcaagagcggagctctccgagtgmgcaattcctgtcccttttaagggctcacaactctaagggggtctgcatgagagggtcgtgatctattgagcaagtagcaggtacgtgactgggggctgca

SEQ ID NO: 46465 - DNA, 201 bp, Homo sapiens
cagatagatagatggatagatagacagagtgatcaatagatttaggtatagatataacttggcacgtagtaactgtgcattaaatataagttgatattagwcttacatttattgcagttatatttgctacactttgttttgttgcactcatcctgtgaaataagtactgttacctctgttttgcaaacaaaaaaaccacaa

SEQ ID NO: 46466 - DNA, 201 bp, Homo sapiens
cactgcaacctacgcctcctgtgttcaagcaattctcgtgcctcagcctcccgagtggctggggttacaggggtgcaccactgtgcccagctcattttttkgtatttttagtagagacggggtttcaccatgttggccaggctggtcttgacctcctgacctcaaatgatcctcctgcctcagcctcccaaagtgccggga

SEQ ID NO: 46467 - DNA, 201 bp, Homo sapiens
actaccaggcttaggtcaggtaggcccaggcctggtttcgggtctggttccttggtttcgggtctggtctctaggcgttgggctacctgcctttagtttcrcttctctttctttttctgagtataaaacaatataaaacaatatgagagggtctgtctctcttctctcagagacaggagggtccctggaggccaggagttc

SEQ ID NO: 46468 - DNA, 201 bp, Homo sapiens
ctcgctcttgttccccaggctggagtgcagtggcgcaatctcagctcactgcaacctacgcctcctgtgttcaagcaattctcgtgcctcagcctcccgaktggctggggttacaggggtgcaccactgtgcccagctcatttttttgtatttttagtagagacggggtttcaccatgttggccaggctggtcttgacctc

SEQ ID NO: 46469 - DNA, 201 bp, Homo sapiens
ttccactcgctggccaaggtagctttccaggatggccgcctcatgctcagcctgatgggagacgagttcaaggtgagtgggtggggctgggctgctagggratccagatggcatgtggtatgtgtgtgtgtgcacacgcatggggaggagggaggaaactcggaaacttggtggtgggcaaaagaactaagctggagcaat

SEQ ID NO: 46470 - DNA, 201 bp, Homo sapiens
gtaacagagcctctccctggaaaactggacagaaggatcatttcagaggttcatggccactcctgaagcctgttcacaacccatgggctggatgatctagwggggcgggggactgggcagcagcttgttttcctgattttggcctccaggagccgatggtcaatggactgccctctgcaggggcagggctggtggtcagct

SEQ ID NO: 46471 - DNA, 201 bp, Homo sapiens
gccttcctgcggccgttctcctgttctaacagaggacggtccctcttcccttctgaactcaggccgtccagccttccccggctctgtgatgtctctctccytgcacatacacaactcacaatattgggcaggcccctgaccggctcttctcccttagccccttgtctgagtcctgttcctttgatgtcctatttctagtct

SEQ ID NO: 46472 - DNA, 201 bp, Homo sapiens
cacacctgcgccttcctgcggccgttctcctgttctaacagaggacggtccctcttcccttctgaactcaggccgtccagccttccccggctctgtgatgyctctctccctgcacatacacaactcacaatattgggcaggcccctgaccggctcttctcccttagccccttgtctgagtcctgttcctttgatgtcctat

SEQ ID NO: 46473 - DNA, 201 bp, Homo sapiens
gcaccacactaactcagagataaaactctagccaagctaagtaacttgctgaggacacacaactcgccactaagggatgggagtaggatttgaacccagcmttctctgaccccagaagctgagttcctagatactttactctcctgcttcccagggtggggctttttgtcttggccaacaccctctgtcaaggagctgtgg

SEQ ID NO: 46474 - DNA, 201 bp, Homo sapiens
tcttcctcatcctcagaagcacttgctcactctgctaaatcaaagtgaaacgcatgtttacagaatattggtccaaaagggtctcagcatctcccactacycagggtggcagagcctcgggccggccttgctccccaagaagggctgactggggctctgtcccctgccccagggctcgaggtagtgtttacagccctcatg

SEQ ID NO: 46475 - DNA, 201 bp, Homo sapiens
acacacagggaaacttagtgaatggcaaggctgggtttgagcccagctctattgcccccaaagataaggctccattccctgctccatttcccaggcatagrgacttgtagggggctggaaccccaggatcaactctgggctcagagggccccagcaataagtgactgttgattactcctgatcccaaagctgacttcaggc

SEQ ID NO: 46476 - DNA, 201 bp, Homo sapiens
actgcagggagataagaccctgcctagatagaatcttcgtggggaagaaggggctccaggaagaatggagggagggcctggcaggaggagagcgctgcccragcaaaggcctggccgccagaatagcaaatctcaagggaatagcaaatctcaagagagtgccccaaagggcctgagctatgagacaaaagcactggctgc

SEQ ID NO: 46477 - DNA, 201 bp, Homo sapiens
tgtccccattttacacacagggaaacttagtgaatggcaaggctgggtttgagcccagctctattgcccccaaagataaggctccattccctgctccattwcccaggcatagggacttgtagggggctggaaccccaggatcaactctgggctcagagggccccagcaataagtgactgttgattactcctgatcccaaag

SEQ ID NO: 46478 - DNA, 201 bp, Homo sapiens
agcaccacactaactcagagataaaactctagccaagctaagtaacttgctgaggacacacaactcgccactaagggatgggagtaggatttgaacccagmattctctgaccccagaagctgagttcctagatactttactctcctgcttcccagggtggggctttttgtcttggccaacaccctctgtcaaggagctgtg

SEQ ID NO: 46479 - DNA, 201 bp, Homo sapiens
gagagcgctgcccgagcaaaggcctggccgccagaatagcaaatctcaagggaatagcaaatctcaagagagtgccccaaagggcctgagctatgagacaraagcactggctgctattcttagagtttctttcccaggggatgttacaggagggggcccaatggagggtcaaattatcatcgcttttttatttcaggatta

SEQ ID NO: 46480 - DNA, 201 bp, Homo sapiens
cagtctctcctctctgatccttgcttcctaagggtcttcactgagccccacctctgaccaagtccccggcggcacaggcagcacagatcctctgctgtacytacaccaagaccccagggccaacgcttctcccattgtgcagctccacctctgcccccggggcctagctgaggcctcctccaagctgagccacctactatc

SEQ ID NO: 46481 - DNA, 201 bp, Homo sapiens
ttttctgccataaaaaaaatcactccaagtttagtggcttaacatgacacaagtttaccattttacagtttaaaaggctagaagtccaccatggccctccytgagctaagatcaagctgtcagcagaaccagattccttctgggggctataggggagaattaattccctcgctttctgcagcttctagaggcttcccccat

SEQ ID NO: 46482 - DNA, 201 bp, Homo sapiens
gagggcctggcaggaggagagcgctgcccgagcaaaggcctggccgccagaatagcaaatctcaagggaatagcaaatctcaagagagtgccccaaagggsctgagctatgagacaaaagcactggctgctattcttagagtttctttcccaggggatgttacaggagggggcccaatggagggtcaaattatcatcgctt

SEQ ID NO: 46483 - DNA, 201 bp, Homo sapiens
tcccactttacagaggggaacactgaggctggagggttgggtagctgtgtggatgcaggggagcggtgactcagggcaattcccccatcctgaggccctgygttgatcttttcctcctgcagccagcatcctttcagatggagacattggggtggacatttccctgacaggtgatcccgtcatcacagcctcctacctgga

SEQ ID NO: 46484 - DNA, 201 bp, Homo sapiens
cagggagataagaccctgcctagatagaatcttcgtggggaagaaggggctccaggaagaatggagggagggcctggcaggaggagagcgctgcccgagcraaggcctggccgccagaatagcaaatctcaagggaatagcaaatctcaagagagtgccccaaagggcctgagctatgagacaaaagcactggctgctatt

SEQ ID NO: 46485 - DNA, 201 bp, Homo sapiens
agtgccgggattacaggtgtgagctcccgcaccccgccggccctttctttcttttgagctgagctatgtatttaatgaaaccttttcttgtgtatccagcrgttcagtggtttcttggggcatgtgatctccttgagcccagtcccacaggctgtaatcgaaggtcctcaggccacactccccagccccgctggctgcctg

SEQ ID NO: 46486 - DNA, 201 bp, Homo sapiens
actcccgcatgctgtacttctggttctctgagcgagtcttccactcgctggccaaggtagctttccaggatggccgcctcatgctcagcctgatgggagaygagttcaaggtgagtgggtggggctgggctgctagggaatccagatggcatgtggtatgtgtgtgtgtgcacacgcatggggaggagggaggaaactcgg

SEQ ID NO: 46487 - DNA, 201 bp, Homo sapiens
agtgagctgagatcgtgccactgccctccagcctgggcaacagagtgagactgtctcaaaaacaaaaaaagaaaagaaaagaaaaagaaagtgacttctcrggtcctaaccccaaagccacaggtgctggggaactttcctcggttttcagaagagcagtagctaagcctggttcccgtgtcatccttgcctctccagtcc

SEQ ID NO: 46488 - DNA, 201 bp, Homo sapiens
tgttgtccaggctgttctcaaactcctggcctcaagcaattctcctgccttggcctcctaagttgctggggttataggcatgagccaccatgccaagcatrtgttctttcattcttatttttatttattatttatttatttacttatttatttttttgacacagagtctcactgtgttgcccaggctggagtgcggtggca

SEQ ID NO: 46489 - DNA, 201 bp, Homo sapiens
tccataagctgctcctgcatctccaaggggagcgagagtaagtacaccaccctgtggcccccattcctgctcgtgcccatcctgttagtgtgtccacggcyccctccaggctcaaccccacacagggcatgcttgtgggtggccaaacctgagggcagcaataccttcagtggggtcacttcctaccccctcccatcaata

SEQ ID NO: 46490 - DNA, 201 bp, Homo sapiens
ggagctggactccagggcttggcctcagcagagggggaggttgtgcaggcagagggttctggggccaccaaaggaggcccagcctgggaagtttgcagggktggggaccccagagctggccaagctcttgactggcctgggcagcatgtggataccatctgatagcggaggctgccctgaggtcatgtcgggtctccctgc

SEQ ID NO: 46491 - DNA, 201 bp, Homo sapiens
gtgggcagatcacttgagcccaggagtctgagaccagattaggcactgtgatgaaaccctgtctctaccaaaaacacaaaaattagctgggcatggtgggrcatgcctatagttccagttacttgggaggctggggagggaggattgcttgagcctgggagacggaggttgcagtgagctgtgatctcaccactgcactcc

SEQ ID NO: 46492 - DNA, 201 bp, Homo sapiens
ggtccctggaggccaggagttcaagaccagcctgggcaacatggggagacccctgtctctacaaaaataaaaataagtttaaaaatcagctgtgcacggcrgtgcatacctatagtcccaactactcaggtggctgaggagggaggatcacttgagcccaggaggttgaggctgcagtgagctatgatggcaccactgcac

SEQ ID NO: 46493 - DNA, 201 bp, Homo sapiens
acaaaaataaaaataagtttaaaaatcagctgtgcacggcagtgcatacctatagtcccaactactcaggtggctgaggagggaggatcacttgagcccargaggttgaggctgcagtgagctatgatggcaccactgcactccagtgtgggtgacagagtaggactccatctcaagaaaaaaatacagtccagcatttat

SEQ ID NO: 46494 - DNA, 201 bp, Homo sapiens
ggcctgagctatgagacaaaagcactggctgctattcttagagtttctttcccaggggatgttacaggagggggcccaatggagggtcaaattatcatcgyttttttatttcaggattacaccaaagactgtttccaacttgactgaggtaggtagtcttggatagactgggggaaataagtcctgtgggacctcctgcct

SEQ ID NO: 46495 - DNA, 201 bp, Homo sapiens; identical to SEQ ID NO: 12885

SEQ ID NO: 46496 - DNA, 201 bp, Homo sapiens
gatccctgcctctgggaaagtgcatgtcaggctggtgtgtggctggcgcctggcctgcctttgccagtttgagcctgcacgtccaagtgtggggacccctyagctcccgggtgctgggatgggccaactgaatagggtggactcaaccctcaccacttggtccccacagtgctgggcagtgccccctggtccatccccagg

SEQ ID NO: 46497 - DNA, 201 bp, Homo sapiens
ttccacgccccgaggcccgcccctagctgggagcctctagggagcctcaggccccgcctctccgaggcaggcccctcccctgagacccaggccccgccccygagacccaggccccgcccccactcggttgccaactttcgcccgtctatgccaaagcctcggcggcgaccccgccccaagggcccgccccattggccgccg

SEQ ID NO: 46498 - DNA, 201 bp, Homo sapiens
tggactgttggggaggggagtggcagtggctgcccctgctgtggtcacttgggtgcccatgcaccacatacttgctgcttcccattggatcccaggagagycctgcagatgtggtgtgggcgtggggaggccgaacagtgcctggctggagcctgtgtgttgtgagctgggcctgaggggtgcagggcctccagggagggc

SEQ ID NO: 46499 - DNA, 201 bp, Homo sapiens
tcactccctagatcccactggcctggttcgtgggccgctttttccagggcaactatggcaacgcagctgtgtggctgtcgctcatcatcggacagccaatwgccgtcctcatgtacgtccacgactactacgtgctcaactatgaggccccagcggcagaggcctgagctgcacctgagggcctggcttctcactgccacc

SEQ ID NO: 46500 - DNA, 201 bp, Homo sapiens
cgggctctgtcctccatatcgaataataatgacacatatcgaatcgcatggacttatccgacctcctcagaccccgcttccgccctgccccgggcccccacccccccccccgtaccccaggcattcgtgttggaggacggattcccggggccggcaggcaggcctgggcgctgccctctacacacctctgtcttcgctttg

SEQ ID NO: 46501 - DNA, 201 bp, Homo sapiens; identical to SEQ ID NO: 12883

SEQ ID NO: 46502 - DNA, 201 bp, Homo sapiens; identical to SEQ ID NO: 12890

SEQ ID NO: 46503 - DNA, 201 bp, Homo sapiens
agcggccaatgtctttgctgtggctgcattccaggttgagaagcgcctggcggtggtaagcagtgcccctcacctccgtgtgtgctcaccctgctgtgtgygctcctgggaggagctgctccccaggcctggcagccctctcccaggcaatgggagccctggttgagtgctctgctccccactccagggtgccctgacgga

SEQ ID NO: 46504 - DNA, 201 bp, Homo sapiens
ccctgggggctgggatgggccatggtgtgctctgatccccctgtggtctcttggcccccaggaactccgagtctgtcacctacttctggcagaactggaasatccctgtgcacaagtggtgcatcaggtaggtggggtgtgtgtgtgtgtgatgtggaacatggctgtgaacctgaaccgctttccatgccccctcctctg

SEQ ID NO: 46505 - DNA, 201 bp, Homo sapiens
gcggccaatgtctttgctgtggctgcattccaggttgagaagcgcctggcggtggtaagcagtgcccctcacctccgtgtgtgctcaccctgctgtgtgcrctcctgggaggagctgctccccaggcctggcagccctctcccaggcaatgggagccctggttgagtgctctgctccccactccagggtgccctgacggag

SEQ ID NO: 46506 - DNA, 201 bp, Homo sapiens
cctcgggtggggatcaggctgacgtggccctaaacctgccccttggtgcttctgtccacagcggccaatgtctttgctgtggctgcattccaggttgagargcgcctggcggtggtaagcagtgcccctcacctccgtgtgtgctcaccctgctgtgtgcgctcctgggaggagctgctccccaggcctggcagccctctc

SEQ ID NO: 46507 - DNA, 201 bp, Homo sapiens
ggtgtcgggagcgggtctaggtccaggtggggctctgtcccaggctggcctttgcctgagaacaggctctgtcacccagggtgtccaggctggagcccctstgggctggggtgtgtggagcaggctgcacctccatgtggctgccagcactggactgttggggaggggagtggcagtggctgcccctgctgtggtcacttg

SEQ ID NO: 46508 - DNA, 201 bp, Homo sapiens
ggttagcgctgaccccactggggagggaggagggctctgccagcgctcgggccctcccacacagccgtggaccagacccagcctggccgggcatgagcgtygggcctgggcggcagcagccgagacccctctgtggcgggggctcagtgtcgtcatggctcccctggccacgggcctgtggtcattgcctgtgacagggat

SEQ ID NO: 46509 - DNA, 201 bp, Homo sapiens
tggggcaacatagcttggccaacatggtgaaaccttgtctctactaaaaatacaaaaactagctgggcgtggtggcaggtgcctgtaatccccgctactcrggaggctgaggcgggagaatctctggaacccaggaggcagaggctgcagtgagccgaaactgcaccattgcactccagcctgggcgacacagcgagactc

SEQ ID NO: 46510 - DNA, 201 bp, Homo sapiens
cacggagttccagcacccatgcttcctgcgtggccaggagcagctccttgagaacatcaagaggaaagtgaccagtgtgagtgccggccctgcacccttgmccggtctcacctgccacagctctccccgcccgcccctccctgagggctcccaccccagcctgccccttcctgagggacctggctgcagtggacgagcctg

SEQ ID NO: 46511 - DNA, 201 bp, Homo sapiens
cgacaaagcgagactccgtctcaaaaaaaataaaaagcatccagaagagccgtgcacggtggtggtgcctgtggtgccagctactcagaggctcgggtggmaggattgctcccagatggggcaacatagcttggccaacatggtgaaaccttgtctctactaaaaatacaaaaactagctgggcgtggtggcaggtgcctg

SEQ ID NO: 46512 - DNA, 201 bp, Homo sapiens
gcccagtcctgggcctcacagtgaggatgcaggtcacgctgcacagatgaggcccgtgtggcaggtggtcccaggaacgaactcgcctcccgccagccccmtgggcctcccatggccccagccccatcaggtggaacgtgcactgcctgcgtttcagaaggggcggcctggggaaggggcggcttgggcacgctgcccctc

SEQ ID NO: 46513 - DNA, 201 bp, Homo sapiens
ctggtgtgagccactgcacccagcccttcttctttttcttattccccttaatcctcagaagttaaggggaataactcccccattgggggaggggcatccgmgattatctgggatattctaagcttaatcctactagcgtgatctgtcctgtcccgtaatctgcttgctgtttctgcttaaagattatgaggcatgtgggtt

SEQ ID NO: 46514 - DNA, 201 bp, Homo sapiens; identical to SEQ ID NO: 12906

SEQ ID NO: 46515 - DNA, 201 bp, Homo sapiens; identical to SEQ ID NO: 12907

SEQ ID NO: 46516 - DNA, 201 bp, Homo sapiens
gaacctggcgcctagagtggcctgcgggccattcagcccatgggagccaggatgagttgaattcgcttcacaaagcaatggggcagtttcaacaacccagmgcggccgcggccgagggggctgtgaggggctggctgtccatcccctccaccacccaatttgatgatccccacaaccaagacagggctgagctagcagaga

SEQ ID NO: 46517 - DNA, 201 bp, Homo sapiens
cagaggagggggcatggaaagcggttcaggttcacagccatgttccacatcacacacacacacaccccacctacctgatgcaccacttgtgcacagggatsttccagttctgccagaagtaggtgacagactcggagttcctgggggccaagagaccacagggggatcagagcacaccatggcccatcccagcccccaggg

SEQ ID NO: 46518 - DNA, 201 bp, Homo sapiens; identical to SEQ ID NO: 46506

SEQ ID NO: 46519 - DNA, 201 bp, Homo sapiens
ggaggctgaggcggttggatcacctgaggtcagcagttcaagaccagcctgaccaacatggtgaaaccccgtctctactaaaaatacaaaaaaaaaaaaaatagccaggcgtggtggtgcgtgcctgtaatcccagctactcgggaggctgaggcaggagaatcacttgaacctgggatacagaggttgcagtgagccgag

SEQ ID NO: 46520 - DNA, 201 bp, Homo sapiens
gcagaaagtgaagcctcagaactgggttcaccatcatcccagttttttacaagctatgattttgtcccatctttattaacaagataaggaagtatgaaaartaatctcgacatctgagatggtgagattacagccccaggagccacccagctggctgaggagcctgagaacaaggcacagccacatgacctgtgccagaca

SEQ ID NO: 46521 - DNA, 201 bp, Homo sapiens
ccatgagacccgggacccgcagcctccctgccccgtgccctggtgccggccctcagcccagcttcctcgtctgcatgcagcagctcctctgtccaccagcrgaggctcttctagggccttgctgggctgcagctgactcaggagggcaacagcctcttcagagaatttgacagcatggagaaccaaacaaaagcagaaagt

SEQ ID NO: 46522 - DNA, 201 bp, Homo sapiens; identical to SEQ ID NO: 46499

SEQ ID NO: 46523 - DNA, 201 bp, Homo sapiens
ggggaggggctttccgactgagaggaaggcctcgcatctgcccaccgcccagtcctgggcctcacagtgaggatgcaggtcacgctgcacagatgaggccmgtgtggcaggtggtcccaggaacgaactcgcctcccgccagccccctgggcctcccatggccccagccccatcaggtggaacgtgcactgcctgcgtttc

SEQ ID NO: 46524 - DNA, 201 bp, Homo sapiens
agtgggactgaagaagatgtgacaactggatggattttggatgatgtcctggagcagaggaaggattgggtaaaaagctaaggaatctgattagaatgtgsgtcctagttaacaatgtgtctaatgttcttgagacaactgtaccacacaaaggcaggatgttaatgatgggggacactggtgtagggcatgtattctaaa

SEQ ID NO: 46525 - DNA, 201 bp, Homo sapiens
tagggctccatttccttcgctgttcccaagggaaaggtcctgcttaaacaggtgctttgtgagtggaaacgtggccagagtgcggcgggtgctttgtgagkggaaatgtggccagagtgcggcggatgctttgtgagtggaaacgtggccttctctggaagccctggggaggggctttccgactgagaggaaggcctcgca

SEQ ID NO: 46526 - DNA, 201 bp, Homo sapiens
ggtctaacgtatttgaggttccagaaaacagtggggaagagaatacagaaatatgaccaaaaggctggacacggtggctcctgcccgaaatcccagcactytgggaggctgacatgggtggatcgcttgagcccaggagttcaagaccagcctgggcaacatagcaagaccctgtctctataaataatacaaaaattagcc

SEQ ID NO: 46527 - DNA, 201 bp, Homo sapiens
tcttactaagattcagctgtttttcttgaataaatgctccccgtgctactgtaattctttggttaactttcagagttctggaaagttggcttggcgctttycgccgtctctctcctgctgccttggggtcctttccgtgaccgtttccctccctgacacgtgtacatccctgtgtatttcacatctctctatgctggaaag

SEQ ID NO: 46528 - DNA, 201 bp, Homo sapiens
gactccaacctggataacctgcagaccatgctgagcagccacggcttcagcgtggacaccagtgccctgctggacgtgagtggagccccgccgccccgcckccccgccccgcctccccgcgcctccccgcctccccgcctcgcctcgccgcctccccgcctccccgcgccgcctccccgcctccccgcgccgcctccccgc

SEQ ID NO: 46529 - DNA, 201 bp, Homo sapiens; identical to SEQ ID NO: 12908

SEQ ID NO: 46530 - DNA, 201 bp, Homo sapiens
ttcctacccctccctagaatcttctgaatgtagtaccttctggccaggtatgagaacaccctggctgctcagttctttggccacactcatgtggatgaatytgaggtcttctatgatgaagagactctgagccggccgctggctgtagccttcctggcacccagtgcaactacctacatcggccttaatcctggtgagtga

SEQ ID NO: 46531 - DNA, 201 bp, Homo sapiens; identical to SEQ ID NO: 12910

SEQ ID NO: 46532 - DNA, 201 bp, Homo sapiens; identical to SEQ ID NO: 12911

SEQ ID NO: 46533 - DNA, 201 bp, Homo sapiens; identical to SEQ ID NO: 12912

SEQ ID NO: 46534 - DNA, 201 bp, Homo sapiens
ggaacaagtgttgacctctcatgtttactttgtttcagaattggggggttctatgctctttccccataccccggtctccgcctcatctctctcaatatgartttttgttcccgtgagaacttctggctcttgatcaactccacggatcccgcaggacagctccagtggctggtgggggagcttcaggctgctgaggatcga

SEQ ID NO: 46535 - DNA, 201 bp, Homo sapiens
tttactttgtttcagaattggggggttctatgctctttccccataccccggtctccgcctcatctctctcaatatgaatttttgttcccgtgagaacttckggctcttgatcaactccacggatcccgcaggacagctccagtggctggtgggggagcttcaggctgctgaggatcgaggagacaaagtgagggccagtag

SEQ ID NO: 46536 - DNA, 201 bp, Homo sapiens; identical to SEQ ID NO: 12916

SEQ ID NO: 46537 - DNA, 201 bp, Homo sapiens
ggagccagagcctgcaaagcatgggcaggatgtgtggcccctccctggagttacccttgctccttgcccctccagtcagccccacatccttgcaggttacygtgtgtaccaaatagatggaaactactccgggagctctcacgtggtcctggaccatgagacctacatcctgaatctgacccaggcaaacataccgggagc

SEQ ID NO: 46538 - DNA, 201 bp, Homo sapiens
ttgctccttgcccctccagtcagccccacatccttgcaggttaccgtgtgtaccaaatagatggaaactactccgggagctctcacgtggtcctggaccakgagacctacatcctgaatctgacccaggcaaacataccgggagccataccgcactggcagcttctctacagggctcgagaaacctatgggctgcccaaca

SEQ ID NO: 46539 - DNA, 201 bp, Homo sapiens; identical to SEQ ID NO: 12918

SEQ ID NO: 46540 - DNA, 201 bp, Homo sapiens
gctccttgcccctccagtcagccccacatccttgcaggttaccgtgtgtaccaaatagatggaaactactccgggagctctcacgtggtcctggaccatgwgacctacatcctgaatctgacccaggcaaacataccgggagccataccgcactggcagcttctctacagggctcgagaaacctatgggctgcccaacaca

SEQ ID NO: 46541 - DNA, 201 bp, Homo sapiens; identical to SEQ ID NO: 12920

SEQ ID NO: 46542 - DNA, 201 bp, Homo sapiens; identical to SEQ ID NO: 12921

SEQ ID NO: 46543 - DNA, 201 bp, Homo sapiens; identical to SEQ ID NO: 12922

SEQ ID NO: 46544 - DNA, 201 bp, Homo sapiens
ggatgccctgattaccatccttaattctccctactaggtgcatataattggccacattcccccagggcactgtctgaagagctggagctggaattattacygaattgtagccaggtaggacggagatgagggtgggaatagggacagggtgagtgtctgaaggctgaaaattcccttgagcatctcaccatccctgttgtc

SEQ ID NO: 46545 - DNA, 201 bp, Homo sapiens
tcctcactagaacaggttggagaaagagggcatcctatctccccagatgtcttcctacccctccctagaatcttctgaatgtagtaccttctggccaggtrtgagaacaccctggctgctcagttctttggccacactcatgtggatgaatttgaggtcttctatgatgaagagactctgagccggccgctggctgtagcc

SEQ ID NO: 46546 - DNA, 201 bp, Homo sapiens
gagccagagcctgcaaagcatgggcaggatgtgtggcccctccctggagttacccttgctccttgcccctccagtcagccccacatccttgcaggttaccktgtgtaccaaatagatggaaactactccgggagctctcacgtggtcctggaccatgagacctacatcctgaatctgacccaggcaaacataccgggagcc

SEQ ID NO: 46547 - DNA, 201 bp, Homo sapiens; identical to SEQ ID NO: 12926

SEQ ID NO: 46548 - DNA, 201 bp, Homo sapiens
ctcttgttaccactccagtgttatcacttccttgaagggattagatctctccctccccagctcctaggcagggaaccgtagctactggggaggggcatatytgggaggcctgaggcctaggaatagcctctagacccctccctgacccacaccctttagttccctggggcccaacacaagcaggtggagggaaggtggggg

SEQ ID NO: 46549 - DNA, 201 bp, Homo sapiens
ttggaacaagtgttgacctctcatgtttactttgtttcagaattggggggttctatgctctttccccataccccggtctccgcctcatctctctcaatatraatttttgttcccgtgagaacttctggctcttgatcaactccacggatcccgcaggacagctccagtggctggtgggggagcttcaggctgctgaggatc

SEQ ID NO: 46550 - DNA, 201 bp, Homo sapiens; identical to SEQ ID NO: 12928

SEQ ID NO: 46551 - DNA, 201 bp, Homo sapiens; identical to SEQ ID NO: 12929

SEQ ID NO: 46552 - DNA, 201 bp, Homo sapiens
cagaaggaacccaatgtggctcgcgtgggctccgtggccatcaagctgtgcaatctgctgaagatagcaccacctgccgtgtgccaatccattgtccaccyctttgaggatgacatggtggaggtgtggagacgctcagtgctgagcccatctgaggcctgtggcctgctcctgggctccacctgtgggcactgggacatt

SEQ ID NO: 46553 - DNA, 201 bp, Homo sapiens; identical to SEQ ID NO: 12932

SEQ ID NO: 46554 - DNA, 201 bp, Homo sapiens; identical to SEQ ID NO: 12931

SEQ ID NO: 46555 - DNA, 201 bp, Homo sapiens; identical to SEQ ID NO: 12933

SEQ ID NO: 46556 - DNA, 201 bp, Homo sapiens
cctcccttatcctggagttggtgggataggggaaggaggttggagccagagcctgcaaagcatgggcaggatgtgtggcccctccctggagttacccttgytccttgcccctccagtcagccccacatccttgcaggttaccgtgtgtaccaaatagatggaaactactccgggagctctcacgtggtcctggaccatgag

SEQ ID NO: 46557 - DNA, 201 bp, Homo sapiens; identical to SEQ ID NO: 12934

SEQ ID NO: 46558 - DNA, 201 bp, Homo sapiens; identical to SEQ ID NO: 12935

SEQ ID NO: 46559 - DNA, 201 bp, Homo sapiens
tgtgtggcccctccctggagttacccttgctccttgcccctccagtcagccccacatccttgcaggttaccgtgtgtaccaaatagatggaaactactccrggagctctcacgtggtcctggaccatgagacctacatcctgaatctgacccaggcaaacataccgggagccataccgcactggcagcttctctacagggc

SEQ ID NO: 46560 - DNA, 201 bp, Homo sapiens; identical to SEQ ID NO: 12937

SEQ ID NO: 46561 - DNA, 201 bp, Homo sapiens; identical to SEQ ID NO: 12938

SEQ ID NO: 46562 - DNA, 201 bp, Homo sapiens; identical to SEQ ID NO: 12939

SEQ ID NO: 46563 - DNA, 201 bp, Homo sapiens; identical to SEQ ID NO: 12940

SEQ ID NO: 46564 - DNA, 201 bp, Homo sapiens; identical to SEQ ID NO: 12941

SEQ ID NO: 46565 - DNA, 201 bp, Homo sapiens; identical to SEQ ID NO: 12942

SEQ ID NO: 46566 - DNA, 201 bp, Homo sapiens; identical to SEQ ID NO: 12943

SEQ ID NO: 46567 - DNA, 201 bp, Homo sapiens; identical to SEQ ID NO: 12944

SEQ ID NO: 46568 - DNA, 201 bp, Homo sapiens; identical to SEQ ID NO: 12945

SEQ ID NO: 46569 - DNA, 201 bp, Homo sapiens; identical to SEQ ID NO: 12946

SEQ ID NO: 46570 - DNA, 201 bp, Homo sapiens; identical to SEQ ID NO: 12947

SEQ ID NO: 46571 - DNA, 201 bp, Homo sapiens; identical to SEQ ID NO: 12948

SEQ ID NO: 46572 - DNA, 201 bp, Homo sapiens; identical to SEQ ID NO: 12949

SEQ ID NO: 46573 - DNA, 201 bp, Homo sapiens; identical to SEQ ID NO: 12950

SEQ ID NO: 46574 - DNA, 201 bp, Homo sapiens; identical to SEQ ID NO: 12951

SEQ ID NO: 46575 - DNA, 201 bp, Homo sapiens; identical to SEQ ID NO: 13034

SEQ ID NO: 46576 - DNA, 201 bp, Homo sapiens; identical to SEQ ID NO: 13037

SEQ ID NO: 46577 - DNA, 201 bp, Homo sapiens
gtcaatagcttccctccccccttcattgagggcaaccactcctcccgctggctctatgaagcgatggccaaggcttgggagccctggctgcctgccgaagmcctgcgcaccctcaggtacttatcgtccgtggaaacccaggaagggaaaagaaaggtgaatgaaagtgaagggagaagggaacctggggcattgtctctg

SEQ ID NO: 46578 - DNA, 201 bp, Homo sapiens; identical to SEQ ID NO: 12954

SEQ ID NO: 46579 - DNA, 201 bp, Homo sapiens
tcatgtttactttgtttcagaattggggggttctatgctctttccccataccccggtctccgcctcatctctctcaatatgaatttttgttcccgtgagamcttctggctcttgatcaactccacggatcccgcaggacagctccagtggctggtgggggagcttcaggctgctgaggatcgaggagacaaagtgagggcc

SEQ ID NO: 46580 - DNA, 201 bp, Homo sapiens; identical to SEQ ID NO: 12957

SEQ ID NO: 46581 - DNA, 201 bp, Homo sapiens
gctggccttgcttcctgctcctcttgttaccactccagtgttatcacttccttgaagggattagatctctccctccccagctcctaggcagggaaccgtasctactggggaggggcatatttgggaggcctgaggcctaggaatagcctctagacccctccctgacccacaccctttagttccctggggcccaacacaagc

SEQ ID NO: 46582 - DNA, 201 bp, Homo sapiens
agctactggggaggggcatatttgggaggcctgaggcctaggaatagcctctagacccctccctgacccacaccctttagttccctggggcccaacacaakcaggtggagggaaggtgggggcttcttcatggggtatgggcccccagccgtttgggcttcagggagccccacagcgactgaacacccctgcggacagtcc

SEQ ID NO: 46583 - DNA, 201 bp, Homo sapiens; identical to SEQ ID NO: 12958

SEQ ID NO: 46584 - DNA, 201 bp, Homo sapiens
cagcacaggaggaccaggattggaacaagtgttgacctctcatgtttactttgtttcagaattggggggttctatgctctttccccataccccggtctccdcctcatctctctcaatatgaatttttgttcccgtgagaacttctggctcttgatcaactccacggatcccgcaggacagctccagtggctggtgggggag

SEQ ID NO: 46585 - DNA, 201 bp, Homo sapiens
gaggaccaggattggaacaagtgttgacctctcatgtttactttgtttcagaattggggggttctatgctctttccccataccccggtctccgcctcatcyctctcaatatgaatttttgttcccgtgagaacttctggctcttgatcaactccacggatcccgcaggacagctccagtggctggtgggggagcttcaggc

SEQ ID NO: 46586 - DNA, 201 bp, Homo sapiens; identical to SEQ ID NO: 12960

SEQ ID NO: 46587 - DNA, 201 bp, Homo sapiens
ctcaatatgaatttttgttcccgtgagaacttctggctcttgatcaactccacggatcccgcaggacagctccagtggctggtgggggagcttcaggctgytgaggatcgaggagacaaagtgagggccagtagtgggaacacggtggtgctgggggacaagcaggctcctgttgagctggagcacctctgggcacagaag

SEQ ID NO: 46588 - DNA, 201 bp, Homo sapiens
gtcactgttgaaagccttcattcagtccccctttctctagccagggctgcctggacccctggatgccctgattaccatccttaattctccctactaggtgyatataattggccacattcccccagggcactgtctgaagagctggagctggaattattaccgaattgtagccaggtaggacggagatgagggtgggaatag

SEQ ID NO: 46589 - DNA, 201 bp, Homo sapiens
ggagaaagagggcatcctatctccccagatgtcttcctacccctccctagaatcttctgaatgtagtaccttctggccaggtatgagaacaccctggctgytcagttctttggccacactcatgtggatgaatttgaggtcttctatgatgaagagactctgagccggccgctggctgtagccttcctggcacccagtgca

SEQ ID NO: 46590 - DNA, 201 bp, Homo sapiens
gtaccttctggccaggtatgagaacaccctggctgctcagttctttggccacactcatgtggatgaatttgaggtcttctatgatgaagagactctgagcyggccgctggctgtagccttcctggcacccagtgcaactacctacatcggccttaatcctggtgagtgaggcagaagggagcctcccttatcctggagttg

SEQ ID NO: 46591 - DNA, 201 bp, Homo sapiens; identical to SEQ ID NO: 12965

SEQ ID NO: 46592 - DNA, 201 bp, Homo sapiens
cttctggccaggtatgagaacaccctggctgctcagttctttggccacactcatgtggatgaatttgaggtcttctatgatgaagagactctgagccggcygctggctgtagccttcctggcacccagtgcaactacctacatcggccttaatcctggtgagtgaggcagaagggagcctcccttatcctggagttggtgg

SEQ ID NO: 46593 - DNA, 201 bp, Homo sapiens
agaacaccctggctgctcagttctttggccacactcatgtggatgaatttgaggtcttctatgatgaagagactctgagccggccgctggctgtagccttmctggcacccagtgcaactacctacatcggccttaatcctggtgagtgaggcagaagggagcctcccttatcctggagttggtgggataggggaaggaggt

SEQ ID NO: 46594 - DNA, 201 bp, Homo sapiens; identical to SEQ ID NO: 12969

SEQ ID NO: 46595 - DNA, 201 bp, Homo sapiens
ctttggccacactcatgtggatgaatttgaggtcttctatgatgaagagactctgagccggccgctggctgtagccttcctggcacccagtgcaactaccwacatcggccttaatcctggtgagtgaggcagaagggagcctcccttatcctggagttggtgggataggggaaggaggttggagccagagcctgcaaagca

SEQ ID NO: 46596 - DNA, 201 bp, Homo sapiens
gcctcatctctctcaatatgaatttttgttcccgtgagaacttctggctcttgatcaactccacggatcccgcaggacagctccagtggctggtgggggarcttcaggctgctgaggatcgaggagacaaagtgagggccagtagtgggaacacggtggtgctgggggacaagcaggctcctgttgagctggagcacctct

SEQ ID NO: 46597 - DNA, 201 bp, Homo sapiens
ggatgaatttgaggtcttctatgatgaagagactctgagccggccgctggctgtagccttcctggcacccagtgcaactacctacatcggccttaatcctrgtgagtgaggcagaagggagcctcccttatcctggagttggtgggataggggaaggaggttggagccagagcctgcaaagcatgggcaggatgtgtggcc

SEQ ID NO: 46598 - DNA, 201 bp, Homo sapiens; identical to SEQ ID NO: 12973

SEQ ID NO: 46599 - DNA, 201 bp, Homo sapiens; identical to SEQ ID NO: 12974

SEQ ID NO: 46600 - DNA, 201 bp, Homo sapiens; identical to SEQ ID NO: 12975

SEQ ID NO: 46601 - DNA, 201 bp, Homo sapiens; identical to SEQ ID NO: 12976

SEQ ID NO: 46602 - DNA, 201 bp, Homo sapiens
gctcctgttgagctggagcacctctgggcacagaagttttattttcctggcattcccaacaagtgttccctggggattcagctcatggtcactgttgaaarccttcattcagtccccctttctctagccagggctgcctggacccctggatgccctgattaccatccttaattctccctactaggtgcatataattggcca

SEQ ID NO: 46603 - DNA, 201 bp, Homo sapiens
cagtacccacctcatggggacttccgtgaggactgaatgagacagtccctggaaagcccctggtttgtgcgagtcgtcccggcctctggcgttctactcaygtgctgacctctttgtcctgcagcagttttccagcttgcatgtccgagacaccaaaatcgaggtggcccagtttgtaaaggacctgctcttacatttaaa

SEQ ID NO: 46604 - DNA, 201 bp, Homo sapiens
ccctcccagaaccatgtggcatttgccaactggattttgaccataacaatgcagccattctccccagcaccatcataggcccgcccttacaggaggattcsttagtagagtccgctccttgccccactagtaacagctcacatgtctgagcactgcttacaccaggcctggtgcacgtgctttatgtgtcatttcatcact

SEQ ID NO: 46605 - DNA, 201 bp, Homo sapiens
tcggggaggaagtgggtaggggagaaatcttgacatcaacacccaacaggcaaatgccgtggcctctgctgtgggggtttctggaggacttctaggaaaaygagggaagagcaggaaaaggcgacatggctgcaggggccaagcccaggagccgccctccacagcactcattctgcagaagggaaatttgaggcccccaga

SEQ ID NO: 46606 - DNA, 201 bp, Homo sapiens
cagcagttttccagcttgcatgtccgagacaccaaaatcgaggtggcccagtttgtaaaggacctgctcttacatttaaagaaactttttcgcgagggacrgttcaactgaaacttcgaaagcatcattatttgcagagacaggacctgactattgaagttgcagattcatttttctttctgatgtcaaaaatgtcttggg

SEQ ID NO: 46607 - DNA, 201 bp, Homo sapiens
ctgccaggcctgcctctgtgccacaccagggatgcttgtggggcctgtgctggggcagacctggcctgggctgccagggcaggcccacaacccctgccagyactctgctcactgtcactttgctcccacaggctccgctctgcaatggcagcatggtatggagcatcaacctgacagctggcatggtaaggacctttgggt

SEQ ID NO: 46608 - DNA, 201 bp, Homo sapiens
accagagtgtccatgctcctaactgcagtgttccctcaccatcagaaggcagggcatttaatacaccagatccccaccgcctcccatctgatttgtcttgstcaacagtggcccaggccactcctacttcactcgtccccaccctggcccttcccgcaggcccctgtcctcctgccctgactatggcaagccttgcatgca

SEQ ID NO: 46609 - DNA, 201 bp, Homo sapiens
cctgcgccaggcatctcagccccatcttcctgcagactcacaaaaggcagctgcccaagcagggcctgacccctcggtgtcccctccccacagtactgtgmagccctggaatccctgatcaacgtgtcaggctgcagtgccatcgagaagacccagaggatgctgagcggattctgcccgcacaaggtctcagctggggta

SEQ ID NO: 46610 - DNA, 201 bp, Homo sapiens
cacctcaagaggcaggtacgatgaacccattctgctaaggttcagtgaggttaagtgacagaggctggattcaagccaggcctggccaacaccagagtgtycatgctcctaactgcagtgttccctcaccatcagaaggcagggcatttaatacaccagatccccaccgcctcccatctgatttgtcttggtcaacagtgg

SEQ ID NO: 46611 - DNA, 201 bp, Homo sapiens; identical to SEQ ID NO: 13106

SEQ ID NO: 46612 - DNA, 201 bp, Homo sapiens
aggcagagagggggcctggggaggcgctggttcggggaggaagtgggtaggggagaaatcttgacatcaacacccaacaggcaaatgccgtggcctctgcwgtgggggtttctggaggacttctaggaaaacgagggaagagcaggaaaaggcgacatggctgcaggggccaagcccaggagccgccctccacagcactca

SEQ ID NO: 46613 - DNA, 201 bp, Homo sapiens
cttcgagtgtggacagagagggtgggaatgacgttccctgtgggaagagagggtgggcaagcctgggatgcctctgagcgggaatccagcatgccttgtgrggagggtcacaagcacacccttgtgaggaggttgagccccatcgaggacaggacggagggagcctgagcaggcagagagggggcctggggaggcgctggt

SEQ ID NO: 46614 - DNA, 201 bp, Homo sapiens
agggaagagcaggaaaaggcgacatggctgcaggggccaagcccaggagccgccctccacagcactcattctgcagaagggaaatttgaggcccccagacrgcaggggttgatcctgcagagactggtgagcaaaggggatcaccccaagccccagtggcactaggaacacttacaatctctgacctggactaaggctgcc

SEQ ID NO: 46615 - DNA, 201 bp, Homo sapiens
atttccacatctgtacagtagaggtactaacagtacccacctcatggggacttccgtgaggactgaatgagacagtccctggaaagcccctggtttgtgcragtcgtcccggcctctggcgttctactcacgtgctgacctctttgtcctgcagcagttttccagcttgcatgtccgagacaccaaaatcgaggtggccca

SEQ ID NO: 46616 - DNA, 201 bp, Homo sapiens
cagatgaggtgtcagaaaatgctcccagtcacttggcaggtttctccgaggctggccccctgtcctgcgcaggacgagaaggagcaggccccaaggggacyaggcccgcatcttatttccttgtgaccgaggcagcagcttgaagcctggccttcacctggcccagcggcttatcgctttttcattagggtcaaagagaaa

SEQ ID NO: 46617 - DNA, 201 bp, Homo sapiens
aagggaaagggaactgcaggtgctaaggtcttgagcaagagcgagctggggatgcccttcccagcactcacgggtggccctcgggctggagcagaggccasggcaagggcagcaggagcccagcagggcctcagaggccaggaccgggcttcattctaagtggaatggagtgatgtggtctgactcacattttaacaaagt

SEQ ID NO: 46618 - DNA, 201 bp, Homo sapiens
tgttgaccacggtcattgctctcacttgccttggcggctttgcctccccaggccctgtgcctccctctacagccctcagggagctcattgaggagctggtmaacatcacccagaaccagaaggtgagtgtcggctagccagggtcctagctatgagggctccagggtgggtgattcccaagatgaggtcatgagcaggctg

SEQ ID NO: 46619 - DNA, 201 bp, Homo sapiens
ccaaggcccggcccagccatgagggagagaggagctgggctggggggctcagcactgtggatggacctatggaggtgtctggcagactccccagggactayctgctctcctggcctggccttgtctgccactgccagctcctactcagccattcctgaacagaggacagcagagaagggccagcaccctcccagaaccatg

SEQ ID NO: 46620 - DNA, 201 bp, Homo sapiens; identical to SEQ ID NO: 13104

SEQ ID NO: 46621 - DNA, 201 bp, Homo sapiens
agaggtactaacagtacccacctcatggggacttccgtgaggactgaatgagacagtccctggaaagcccctggtttgtgcgagtcgtcccggcctctggygttctactcacgtgctgacctctttgtcctgcagcagttttccagcttgcatgtccgagacaccaaaatcgaggtggcccagtttgtaaaggacctgctc

SEQ ID NO: 46622 - DNA, 201 bp, Homo sapiens
tgaggctgatgtggggcaaggttcctcgggatcctccaaggccgtgctctgagccacacattcaggacagcctgcgaggcaggtgcacagtgcggatggcygtcccgggccccactaggggtctgcagctcgccacttcctcagccaccgccgagctcctgtccctcacaccttccaggctgctccccaggaagggggacc

SEQ ID NO: 46623 - DNA, 201 bp, Homo sapiens
ccatctccaaaaaaacaaaacaaaacaaaacaaaaaaacaccaaaaaagctcccagaaagacctctgaatctttctggatctctcagtggagacctggaartctgaactttgacaatccctctcacagtggggccaaggaggaattaggcaagccaaaagaagtgaactttactcttctattgcctgtttgaattttgtat

SEQ ID NO: 46624 - DNA, 201 bp, Homo sapiens
agctgaggtggggggatcgcttgagtctgggagttggaggccagcctaggcaggcaacatagtgagaccccatctccaaaaaaacaaaacaaaacaaaacraaaaaacaccaaaaaagctcccagaaagacctctgaatctttctggatctctcagtggagacctggaaatctgaactttgacaatccctctcacagtggg

SEQ ID NO: 46625 - DNA, 201 bp, Homo sapiens
ttaagagtttcccagaaggatggcccatacactttaaattaaaggggccagacacgtgcacactacttccagccactctggaagctgaggtggggggatcrcttgagtctgggagttggaggccagcctaggcaggcaacatagtgagaccccatctccaaaaaaacaaaacaaaacaaaacaaaaaaacaccaaaaaagc

SEQ ID NO: 46626 - DNA, 201 bp, Homo sapiens
aaggtctcagctggggtaaggcatcccccaccctctcacacccaccctgcaccccctcctgccaaccctgggctcgctgaagggaagctggctgaatatcyatggtgtgtgtccacccaggggtggggccattgtggcagcagggacgtggccttcgggatttacaggatctgggctcaagggctcctaactcctacctgg

SEQ ID NO: 46627 - DNA, 201 bp, Homo sapiens
ctattgcctgtttgaattttgtatccaagcaagtgttacttaagtaatttaagagactggttcatcgaaaaaataaaactccccaaattcccatagctggyagactgtggtcacagccacagtgcactaagactatctgctcagcacttctggtgacccaaaagggtctgaggacaggagctcagagttgggtcagctgtc

SEQ ID NO: 46628 - DNA, 201 bp, Homo sapiens
cacagcagggagagtgctgtgttatgcgaggaggttggagaaatcctccccatgagataagatgggaacagagatcgggacgaaacaaggggaggggacamccatgcacagatcggggcaaagtcatcaagggaaagggaactgcaggtgctaaggtcttgagcaagagcgagctggggatgcccttcccagcactcacgg

SEQ ID NO: 46629 - DNA, 201 bp, Homo sapiens; identical to SEQ ID NO: 13105

SEQ ID NO: 46630 - DNA, 201 bp, Homo sapiens
acagaggacagcagagaagggccagcaccctcccagaaccatgtggcatttgccaactggattttgaccataacaatgcagccattctccccagcaccatmataggcccgcccttacaggaggattcgttagtagagtccgctccttgccccactagtaacagctcacatgtctgagcactgcttacaccaggcctggtgc

SEQ ID NO: 46631 - DNA, 201 bp, Homo sapiens
ccatgtgtctgtgctctgggccccatcccctcccctctcaggaacacaggcagagcatatagccgggggctcagggtgaaactagtcccagcttcaagccycagctgtgtccctgacttctagtgttgttacttcagccacgtctcagtggctccgtggaaatggagctccactcattcattcaacaagtatggattgagg

SEQ ID NO: 46632 - DNA, 201 bp, Homo sapiens
ttgcacagaccaaggtagttccccgctccttcccccatcacggagaccctgtgggagatgccgtgggccctctactacagattaggaaacaggcccgtagmggggtcacacggccaagtagcggcactccaggcactgggggccctcgaggggaaggggcagacttctgggagtcagagccagcagctgggctgggaagct

SEQ ID NO: 46633 - DNA, 201 bp, Homo sapiens; identical to SEQ ID NO: 13108

SEQ ID NO: 46634 - DNA, 201 bp, Homo sapiens; identical to SEQ ID NO: 13110

SEQ ID NO: 46635 - DNA, 201 bp, Homo sapiens; identical to SEQ ID NO: 13127

SEQ ID NO: 46636 - DNA, 201 bp, Homo sapiens
atgtaaacacactataacctacctttatagcaatcacagagttttggccaatgaaaggcagcccacttgtcaaaccttgtccaaataaggcaaacgccggsggtgtaaccaatccgggtgtttctgtaccttacttccgttttctgtgggtcactttccttttcctgtccacgaatattatcgaatcatgcagcagccccc

SEQ ID NO: 46637 - DNA, 201 bp, Homo sapiens
ccaatgaaaggcagcccacttgtcaaaccttgtccaaataaggcaaacgccgggggtgtaaccaatccgggtgtttctgtaccttacttccgttttctgtrggtcactttccttttcctgtccacgaatattatcgaatcatgcagcagcccccagagtcactctgaatctattctggttgggggcggggggcactcgatt

SEQ ID NO: 46638 - DNA, 201 bp, Homo sapiens
aatccgggtgtttctgtaccttacttccgttttctgtgggtcactttccttttcctgtccacgaatattatcgaatcatgcagcagcccccagagtcactstgaatctattctggttgggggcggggggcactcgattcgaggttcattgtttgctcagtgaaactcaagttaaatttaatttgtttaaagtttttctttt

SEQ ID NO: 46639 - DNA, 201 bp, Homo sapiens
tggccggccagcgggcgggctccccagccaggccgctgcacctgtcaggtgagggggaggagaggtttggctgccagattcaactggaaaggaaccagtcycagtccagccgcaacctgggagtgggaagctggaggcagcccagacctcctggagccctgcagtcctggggcagagacagaatcaggacacagctcgagg

SEQ ID NO: 46640 - DNA, 201 bp, Homo sapiens
ctgcagtcctggggcagagacagaatcaggacacagctcgaggtcagggccagaggctggagctgagggcctagagtgagagggggcaaggcaaggggggragaggaagagaggcaggattagagagaggaggcaggccagaaagaggagagcaggagagacccaaagagaaacagaaggcagatagagagggagtgagag

SEQ ID NO: 46641 - DNA, 201 bp, Homo sapiens
gctcacctttaattgagatgctaatgagattcctgtcgcttccatccctggccggccagcgggcgggctccccagccaggccgctgcacctgtcaggtgasggggaggagaggtttggctgccagattcaactggaaaggaaccagtcccagtccagccgcaacctgggagtgggaagctggaggcagcccagacctcctg

SEQ ID NO: 46642 - DNA, 201 bp, Homo sapiens
cccagtacacgattttgttctgtttttagtctttgcatttgtttgaggacagaaactaccagctgggaagtaagatggtagcaacacctaagcctgagtcmgcccacacctgtcaccaagttcctctaactgtcacctggacacctgtgctttccctatgccctcacccgatgcctccctttgctctgtgtgcctgcctcc

SEQ ID NO: 46643 - DNA, 201 bp, Homo sapiens
acacccggcctaaatgcaattaattttttttgtgtatttgttgtgtaccctgcaaccttgttcagtttgttagttctatatttgttttgttttggtagatkacatccctcaggccctgctactctggactttcatgatggagatggtaataggaattgtattaagaaggaatgtagggatttacagtgagctgtgtttaat

SEQ ID NO: 46644 - DNA, 201 bp, Homo sapiens
gtgatgttcctgttgagaacctttacccttcaaagtacacacagcaggtgaggcccaacctgattccgtggcagccactcccagccactgccctggctggycctgcaaagctggaggggttgtgtatgtgagagagagagagggaaactggggggtggtggaaagaggatggaggctctgtgcagagaactgctgagttca

SEQ ID NO: 46645 - DNA, 201 bp, Homo sapiens
cagctctctgctggttactcacgatggccctcggtgacatcccaggtagagtgtggggaagggatgggtgggggatgtgtgtgcccatgtaatgctgtggscttctctgggtattatgtgtatgagtgtgtttgacacaaccctatccctgtaagcctgaagcatatgggagtgaccttgatgacacccccattctttcct

SEQ ID NO: 46646 - DNA, 201 bp, Homo sapiens; identical to SEQ ID NO: 13126

SEQ ID NO: 46647 - DNA, 201 bp, Homo sapiens
cacatcctccctgcaccttcagtgcctgctttccctgcctcttcctgggctccgggtctgtgtccacagtgtcctgcgtggccctcgcgctgcctctggtygcccacattcctgcaactctgtgaccacagcaggggcgattacacattcctggcctggcagccaacagtgtaaaaaagaacagaatgtcctagggccccg

SEQ ID NO: 46648 - DNA, 201 bp, Homo sapiens
gtccgccttctcaggtccagtactcccagttcacctgccctcgggagccctccttccttcggaaaactcccggctctgactcctcctcagcccctcccccygccctgctcacctttaattgagatgctaatgagattcctgtcgcttccatccctggccggccagcgggcgggctccccagccaggccgctgcacctgtca

SEQ ID NO: 46649 - DNA, 201 bp, Homo sapiens
agggcactcagggcccagagctcagccttgaccctgacccttgctctccccaatccactccggggctcatgaaggggaacaagctggaggagcaggacccyagacctctgcagcccataccaggtctcatggaggggaacaagctggaggagcaggactctagccctccacagtccactccagggctcatgaaggggaaca

SEQ ID NO: 46650 - DNA, 201 bp, Homo sapiens
tgccatgcccaccctcttcctttccagcgctggccacatcctccctgcaccttcagtgcctgctttccctgcctcttcctgggctccgggtctgtgtccasagtgtcctgcgtggccctcgcgctgcctctggttgcccacattcctgcaactctgtgaccacagcaggggcgattacacattcctggcctggcagccaac

SEQ ID NO: 46651 - DNA, 201 bp, Homo sapiens
cttccgttttctgtgggtcactttccttttcctgtccacgaatattatcgaatcatgcagcagcccccagagtcactctgaatctattctggttgggggcrgggggcactcgattcgaggttcattgtttgctcagtgaaactcaagttaaatttaatttgtttaaagtttttcttttaacaattaaataatgtacattct

SEQ ID NO: 46652 - DNA, 201 bp, Homo sapiens
aaactcccggctctgactcctcctcagcccctccccccgccctgctcacctttaattgagatgctaatgagattcctgtcgcttccatccctggccggccrgcgggcgggctccccagccaggccgctgcacctgtcaggtgagggggaggagaggtttggctgccagattcaactggaaaggaaccagtcccagtccagc

SEQ ID NO: 46653 - DNA, 201 bp, Homo sapiens
agtgaaactcaagttaaatttaatttgtttaaagtttttcttttaacaattaaataatgtacattctaataccacagtgcctggctcataataagtgctcrataaacgctagctatgcttgccattcttttaattataaataacgagcaagtctcttagaatgccaaacacaccttcaaccagagctacattttctcctgt

SEQ ID NO: 46654 - DNA, 201 bp, Homo sapiens
gcactgttgacctgcccaggtgcctgacctttacgtgcttgggtgtgtcctgaacttttgggtttcatcggtgctctttgccaatgttgggtctggaaacyggagcaggtggtaagcgtggagaagagaggagggcagggctgagtgcttttgtataccttttatttgtattcactcagccatgccacaccttgggaacac

SEQ ID NO: 46655 - DNA, 201 bp, Homo sapiens
tgtctgacttattttgcttaatgtttctggaattcttccctgtgttttttgcacgtatcagttcctttttattgctgagtggttttgatgagcctattctrgttgaggggctgcctgatttgagcatcgttctttgctcaagtcaactctgttaaatttaattttgcctaacgttcttcttttaacaattaaataatgcac

SEQ ID NO: 46656 - DNA, 201 bp, Homo sapiens
gaagggagagtggatttccatctcctaactcttttctaggattcccgcctctgccaactctgctctctctgcacccctaggtctgtccctgatgctgcgcrcagagcagaatgacttcattcccctgctgtccacagtgactggggcccgggtaatggtgcacgggcaggatgaacctgcctttatggatgatggtggctt

SEQ ID NO: 46657 - DNA, 201 bp, Homo sapiens
ggctcactgtagcctcaaactcccaggatcaggcaattcttctgcctcagtcttctgagtagctgggactacaggtgtgcaccaccacatctggctaattkttgtattttttgtagatacaaggtttcgtcgtgttgcccaggctggtctcaaacttctgagctcaagtgatccacccacttggccttccaaaattctgga

SEQ ID NO: 46658 - DNA, 201 bp, Homo sapiens
gaaagccctgagctagggaggccgtccctgcctgtggtccccagacgtggcgggcagaccctgcattccctgggcagtctggacaccaggctgtgctcagyagggctggcaggaaaaaaagcctggactgttgagagttgacatccctctaaccctgccatggtggttggatccttctcatcccaggtgggatggggccta

SEQ ID NO: 46659 - DNA, 201 bp, Homo sapiens
tcgtgttgcccaggctggtctcaaacttctgagctcaagtgatccacccacttggccttccaaaattctggaattacaggtgtgagccaccatgccccgcrgattaccattcttttaattagcagtaatgagcaagttttctagaatgccaaacacacaccttcaacacacctttgagttgcttcaggctttttggctatt

SEQ ID NO: 46660 - DNA, 201 bp, Homo sapiens
tttatagtaaatactaaagtcaggaggaatacattttccaacttggctcttcttttctaaaattttctagctattctagattgtttgcatttccagataartcttagaagcagtatgtcaatttctttaaaaatacctgctggggccgggtgcagtgagtggctcacgcctgcaatcccagcactttaggaggctgaggct

SEQ ID NO: 46661 - DNA, 201 bp, Homo sapiens
ccaggattcaaatacaaggaatttaattctggagtctgtgctctttttttttcttttggagacggagtttcactcttactggccaggctggagtgcaatgkcgcaatctcagctcatgacaacctccacctcccaggttcaagtgattctcctgcctcagcttcctgagtagctgggattacaggcatgtgccgccgtgcc

SEQ ID NO: 46662 - DNA, 201 bp, Homo sapiens
aatcacctcaggaggccgaggctgcagtgagccgagatcacgccactgcattccagcctgagccacagagtgagacacagtctcaaaggaaaaaaaaacartaataatgtttgtatatatttatgggccagactttttacaaatgaatctaaatcaaatgattctgctttaaattatttaattctcacaacacaccttgga

SEQ ID NO: 46663 - DNA, 201 bp, Homo sapiens
tcctttaaccctgctcccctcctccccttcattcattcattcattcattcattcattcattcctcactcaacaactatttattaatcatctcctctatctsctagatgacaggatctatgcaactaacccagagatgacacagagatgaatgagatgtggctcctgtcatcaaggagctcatgattcaatggggaactaac

SEQ ID NO: 46664 - DNA, 201 bp, Homo sapiens
cgggcgtggtggcacgcacctgtagtcccagctactagggaggctgaggcaggagaatggcgtgaacccggaggcggagcttgtgagccgagatcacggcmctgcactccagcctgggcaattgagactccgtctcaaaaaaaaaaatgtaggtctgttcataaagtgcctactacatacggttgttctagggattatttg

SEQ ID NO: 46665 - DNA, 201 bp, Homo sapiens
agacggaaatgcaattaatttttttttttttttgagacggagtctcgctctgtctcccaggctggagtgtagtggcgcgatctcggctcactgcaagctcygtctcccgggttcacaccattctcctgcctcagcctcccgagtagctgggactacaggcgcccgccaccaagcccggctaattttttgtatttttttttt

SEQ ID NO: 46666 - DNA, 201 bp, Homo sapiens
cagcactgccgctgccacactgccctgagcccaaatgggggagtgagaggccatagctgtctggcatgggcctctccaccgtgcctgacctgctgctgccrctggtgagaccagggacaaagggaagagtgggctggtgggcgaggcaccttccggctggcgtgggccctctccgggagggggccgagcctctcctgcccg

SEQ ID NO: 46667 - DNA, 201 bp, Homo sapiens
ccaaaggctggaagcatggatcttggtcttttttgtttttcttttttttgagatggagttttgctcttgttgctcaggctggagtgcaatggcgcgatctyggctgtctgcaaccttcacctcctggggtcaagcaattctcctgcctcagcctcctgagtagctgggattacagtcatgcgccaccacgcctggctaatt

SEQ ID NO: 46668 - DNA, 201 bp, Homo sapiens
agccctgcagtcctggggcagagacagaatcaggacacagctcgaggtcagggccagaggctggagctgagggcctagagtgagagggggcaaggcaaggkggggagaggaagagaggcaggattagagagaggaggcaggccagaaagaggagagcaggagagacccaaagagaaacagaaggcagatagagagggagtg

SEQ ID NO: 46669 - DNA, 201 bp, Homo sapiens
atgttatttaatattgctgttgtatttctggttttccaattttctgttgccagcatgtagaaatgcaattaatttctttttgagacggaaatgcaattaatttttttttttttttgagacggagtctcgctctgtctcccaggctggagtgtagtggcgcgatctcggctcactgcaagctctgtctcccgggttcacacc

SEQ ID NO: 46670 - DNA, 201 bp, Homo sapiens
ttttccgaagtgacatcaccattgtacatccctagcagcagtataagaggttttcagtttctccacatcctgccagttcttgttattgtctttttaaatttttatttatttatttatttatttatttattatttattttgagaagactctcactctgttgcccaggctggagtgcagtggcacgatcttggcaaactacaa

SEQ ID NO: 46671 - DNA, 201 bp, Homo sapiens
gagccctgcagtcctggggcagagacagaatcaggacacagctcgaggtcagggccagaggctggagctgagggcctagagtgagagggggcaaggcaagrgggggagaggaagagaggcaggattagagagaggaggcaggccagaaagaggagagcaggagagacccaaagagaaacagaaggcagatagagagggagt

SEQ ID NO: 46672 - DNA, 201 bp, Homo sapiens
attactctcacttccaccacccgatgtatggaaactgctatactttcaatgacaagaacaactccaacctctggatgtcttccatgcctggaatcaacaayggtgagaagctccctgcttgctccatggcgccctctgcttcagccactcacctgtacttaccttgagctcacctcctagagctgctgggaggggtcctgc

SEQ ID NO: 46673 - DNA, 201 bp, Homo sapiens
tttccgaagtgacatcaccattgtacatccctagcagcagtataagaggttttcagtttctccacatcctgccagttcttgttattgtctttttaaatttttatttatttatttatttatttatttattatttattttgagaagactctcactctgttgcccaggctggagtgcagtggcacgatcttggcaaactacaac

SEQ ID NO: 46674 - DNA, 201 bp, Homo sapiens
ttccgaagtgacatcaccattgtacatccctagcagcagtataagaggttttcagtttctccacatcctgccagttcttgttattgtctttttaaatttttatttatttatttatttatttatttattatttattttgagaagactctcactctgttgcccaggctggagtgcagtggcacgatcttggcaaactacaacc

SEQ ID NO: 46675 - DNA, 201 bp, Homo sapiens
ccctgggtcagcctcacgccctgcatgggcagggcccaggaaatgcttgttgactaaaaaaatgccagtgccagcaggccagggggaagcactggctttgkgcccacaccctgccccagagagcgccctacgaactcctgctgctccctgcactgctggatctgagggaagtggcctcacaggatgccttgggaagactgg

SEQ ID NO: 46676 - DNA, 201 bp, Homo sapiens
tccgaagtgacatcaccattgtacatccctagcagcagtataagaggttttcagtttctccacatcctgccagttcttgttattgtctttttaaatttttatttatttatttatttatttatttattatttattttgagaagactctcactctgttgcccaggctggagtgcagtggcacgatcttggcaaactacaacct

SEQ ID NO: 46677 - DNA, 201 bp, Homo sapiens
ttcatttagcataacgttttcaaagcttatccatgttgtagcatggatcagaacttcatttttatggctgaatactatgatattgtgtagatacaccaccttttttttttttttttttttgagacaggttctcactctgttacccaggctggagtacagtggcacaatcagacctcactgtagctttgatttcctgggctg

SEQ ID NO: 46678 - DNA, 201 bp, Homo sapiens
cattctttcctaggaatgggtcttccagatgctatcgcgacagaacaattacaccgtcaacaacaagaggtcagtcctgccctggtcccagccacaagaarggaatctttgggagggaaaatagacctaagaagagggatcgatatggttgattagaggaaggtccaggaaattcatcctctaccatttcttcccaccctc

SEQ ID NO: 46679 - DNA, 201 bp, Homo sapiens
ggttacaacacacgagctacaaactacaatgctggagacagaagcactgattatgggatatttcagatcaatagccgctactggtgtaatgatggcaaaamcccaggagcagttaatgcctgtcatttatcctgcagtggtaagacaagctaatatttgaccaatctggttatacttacaagaattgagactcaatacaaa

SEQ ID NO: 46680 - DNA, 201 bp, Homo sapiens; identical to SEQ ID NO: 13154

SEQ ID NO: 46681 - DNA, 201 bp, Homo sapiens
cagcatgaaatgttttattatttttatctactctacttgattaactatctttcattttctcccacacaattcaagatgtgccatgaggaaaagttattttrtagtttagtacatagttgtcgatgtaataatctctgtagttttcagattgaattcagacatttcccctcaatagctatttttgaatgaatgagtgaaggg

SEQ ID NO: 46682 - DNA, 201 bp, Homo sapiens
atgaatttacaaaatctactcaacagctctgttgatttttctgttcttggctgaatgttgcctgagggatgggagcacgggaagggtaaaagcaatggaasaaacatgtattttaatattttaaaagtatgttatattgttcgttggtgttacaagatgatttgcattacaaaaggattctcttacaagtcccttatctta

SEQ ID NO: 46683 - DNA, 201 bp, Homo sapiens; identical to SEQ ID NO: 13155

SEQ ID NO: 46684 - DNA, 201 bp, Homo sapiens
gatggcaaaaccccaggagcagttaatgcctgtcatttatcctgcagtggtaagacaagctaatatttgaccaatctggttatacttacaagaattgagaytcaatacaaatgaaaaagccttgaaaggttcatgagggacctagaaaaactacatctcaacttccagaaagtcattattattttcctcataattccctga

SEQ ID NO: 46685 - DNA, 201 bp, Homo sapiens
tggaatcctcagtgtcaaaaatattgcagaaatcttgcaaagttgatattattaaattgttaaatattaaaattcccaataaagaacattaatcttatttytaaaatccagttaattaaaaaaatttatattatataataatatttggtcattaaataaaaattagaaaatacaaataagaaaaataacacccataatctt

SEQ ID NO: 46686 - DNA, 201 bp, Homo sapiens
gtaaaatatcactaggtgtttttttacagtgtctagtgcaaagaagacctttaatcattttgttaatacttccagagcttccaatgactttggtaaatgamgaaaaaaatgcttcatttcatgctgaatgggagagaatgaagagagttttccccaacaattacacatatatggactcatagaaaataatatcttaccatt

SEQ ID NO: 46687 - DNA, 201 bp, Homo sapiens; identical to SEQ ID NO: 13158

SEQ ID NO: 46688 - DNA, 201 bp, Homo sapiens
tttacttttttttttatgaaatgttctaaatgtatagaaaattagagacattagtataataaacagccatatgcccattatgcactttaaaagttgttaayattttgccatagttgcttcttctatgcctttttttttttttttttttttttttgctgagagttttttgtttggttttgttttgttttattttgagacagg

SEQ ID NO: 46689 - DNA, 201 bp, Homo sapiens
gttaatacttccagagcttccaatgactttggtaaatgaagaaaaaaatgcttcatttcatgctgaatgggagagaatgaagagagttttccccaacaatyacacatatatggactcatagaaaataatatcttaccattctttccacagcctaacagaaaaaagctggctaaacctaaatttaaaataaaatatctatta

SEQ ID NO: 46690 - DNA, 201 bp, Homo sapiens; identical to SEQ ID NO: 13148

SEQ ID NO: 46691 - DNA, 201 bp, Homo sapiens
gatttctagagttttaagatgcttcacactctatcagttccttgtcatatcttgaaattctttttagaataagtaagtgtgggccgggcacagtggctcaygcctgtaatcccagcactttgggagaccgaggcagatggatcacctgaggtcaggagttcgagaccagcctgcctaacatggcaaaaccccatctccact

SEQ ID NO: 46692 - DNA, 201 bp, Homo sapiens; identical to SEQ ID NO: 13160

SEQ ID NO: 46693 - DNA, 201 bp, Homo sapiens
tttgtttgtttatttatttagaggcaggatttcactctgtcgcctaggctggagtgcagtggcgcgatctcagctcactgcaacctctgcctcccaggctyatgcaatcctcccgcgtcagcctcctgagtagctgggactactcgcacgcgttaccatgcctggctaatttttgtatttttagtagagatggggttttgc

SEQ ID NO: 46694 - DNA, 201 bp, Homo sapiens
atgggagagtggttacaacacacgagctacaaactacaatgctggagacagaagcactgattatgggatatttcagatcaatagccgctactggtgtaatsatggcaaaaccccaggagcagttaatgcctgtcatttatcctgcagtggtaagacaagctaatatttgaccaatctggttatacttacaagaattgagac

SEQ ID NO: 46695 - DNA, 201 bp, Homo sapiens
tgccttctgggctcaagtgattctcgtgcttcagccttctgagtagctgtgactacaggtgtgtaccaccacacccagctaattttttgtattttcagtasagatggggtttcaccatgttggccaagctggtcttgaactcctggcctcaaatgatctgcccacctcagcctcccaaagtggtaggattacaggtgtgaa

SEQ ID NO: 46696 - DNA, 201 bp, Homo sapiens
gtgatgtgactgcagccgccaggcgcgtgcgcagtgtacactgcgtgcgcatacgcgagcccgttgcgcctgcgcgcggtgccgccgtcgcccctcttttmgcggcgttctccacctgcgcgggcctgaatggccttcaggagcacagtcggcctgaggagttgatggttactcaccgccgtgagcccaagtaactcgccc

SEQ ID NO: 46697 - DNA, 201 bp, Homo sapiens
aataagttcttttcagggatgtgtttggccaaatgggagagtggttacaacacacgagctacaaactacaatgctggagacagaagcactgattatgggayatttcagatcaatagccgctactggtgtaatgatggcaaaaccccaggagcagttaatgcctgtcatttatcctgcagtggtaagacaagctaatatttg

SEQ ID NO: 46698 - DNA, 201 bp, Homo sapiens
tttggccaaatgggagagtggttacaacacacgagctacaaactacaatgctggagacagaagcactgattatgggatatttcagatcaatagccgctacyggtgtaatgatggcaaaaccccaggagcagttaatgcctgtcatttatcctgcagtggtaagacaagctaatatttgaccaatctggttatacttacaag

SEQ ID NO: 46699 - DNA, 201 bp, Homo sapiens; identical to SEQ ID NO: 13140

SEQ ID NO: 46700 - DNA, 201 bp, Homo sapiens
gtggagcccccaaaccacaaggggaagaaggaagttaaaagatgttaaatactggggccagctcaccctggtcagcctagcactctgacctagcagtcaayatgaaggctctcattgttctggggcttgtcctcctttctgttacggtccagggcaaggtctttgaaaggtgtgagttggccagaactctgaaaagattgg

SEQ ID NO: 46701 - DNA, 201 bp, Homo sapiens
ttgagggtctttctccattgtctctcggcttccaggattgctactgagaagccagaagcctttcttttttttttttttttttttttttgagacggagtctygctctgtcgcccaggctggagtgcagtggcatgatctcggctcactgcaagctctgcctcccaggttcacgccattctcctgcctcagcctcccgagtag

SEQ ID NO: 46702 - DNA, 201 bp, Homo sapiens
acagaaactgtgaggatgctggtactgggaaaaaggatctgcacagcctctagaggcctcccagcaaatgcggggagccatgcccccagggtctacacacwctcgttcatcaacatcacaactggaattcgggatttgtgaagtttagagctgaacagactgttacagattatgagtcaacacgtatattttctctttcaa

SEQ ID NO: 46703 - DNA, 201 bp, Homo sapiens
aaatgtcatcatttgacagagctactatgaggaaaaatatttttatttttaaaaaagttttattgatcgattgatttgagatggggtcttgctctgtcacytaggctggagtgcagtggcttgatcatggctcactgcagcctcgaactcccgggctcaatggatcctccaggttcagtcgatcctccgggctcaattgat

SEQ ID NO: 46704 - DNA, 201 bp, Homo sapiens
catgatctcggctcactgcaagctctgcctcccaggttcacgccattctcctgcctcagcctcccgagtagctgggactacaggcgcccgccaccacgccyggctaattttttttttttttgtatttttagtagagatggggtttcaccgtgttagccaggatggtctcgatctcctgaccttatgatctgcccgtctcgg

SEQ ID NO: 46705 - DNA, 201 bp, Homo sapiens
tttagtagagattaggtctcgagctactgggctcaggcaattctcctgcctcagtgtctcatagaactgggattataggtgtaagccactgtgctcggcctttttttttttttaattgaatttttttttatttttttgatacgtagtttcactctttttgcccaggctggagtgcaatggcgcaatcttgactcaccgcaa

SEQ ID NO: 46706 - DNA, 201 bp, Homo sapiens
acaaaggaccggagatgctgagcatggacagaggctgcccaaggaccagggcagggcggcagtcttgtgccgcggcctggtcaacgcagatgttgcctgcscggcagcacattcgggaggacagctgtgcctagaggagaggggcctcagctgagccaggatggtgagggcagcacaggcaggtggcaggggctcctgggc

SEQ ID NO: 46707 - DNA, 201 bp, Homo sapiens
gctgtctgtgaggcagcctttgtgctggggctgtgctgtcgccgctgcttcctgggccaggggacaagcctcccatcatgttccttatcaggggaacccargccgtcctgctggtgcttttgtgggagggcagtttgcacactgcccaggcccttctgtcctttgacttctggctttcggtggctttgctggccctgccaa

SEQ ID NO: 46708 - DNA, 201 bp, Homo sapiens
aaaacaccattttatagctagaatttgttagccagaacacactccttacatatcaacgtggtctataaagggaattaaaatttttttaggtaatcaatgasgtttttggaaatcatctctaccgaaattaagaaattatattaatttgtttatgattttagaatcctgcaatacttagaccttaaaagttggagcttcagt

SEQ ID NO: 46709 - DNA, 201 bp, Homo sapiens
gatcgccaagagaaattgattgacaggaaaggcagaggaagagattatgggctcccttgctggaattcctctggttcgctctatttagaggacatctccaraacaaacccaccaaaggcagtaatcagatacgatgctgttgatagagttgtccataaaagatccacgatgtcaaaacacccttggttcgtcctaacgatc

SEQ ID NO: 46710 - DNA, 201 bp, Homo sapiens
ttagttactgaggtgccagagggacctagtgagattctggtgtgcgaagaaaccccgcaaataactatctgtttgcctatgtgggtgggccctgggggtgscctctagggttgggtgtgctgctgtgtgcagggagtgtgggaacaggcacagcacaagttggccgaggtctggtggggaagcagtggcacggaggcagct

SEQ ID NO: 46711 - DNA, 201 bp, Homo sapiens
tggggcttgtttcatgtttctttcaagaaggctgggtgctgagttggaatgaatatagtatctatctcctagacacagtcaaccaggtaagtgaagggackccaccatatcttctgtgtctataggcaagagaatgtatctctataaactgttctactcagggacctcagaatgctaccaggagcagtattgacttacact

SEQ ID NO: 46712 - DNA, 201 bp, Homo sapiens
ggatggactaggacagatccgatgacttagtgtccaagttcaattgcaaatgcagcctcatttctttctttgaagtagaaaatcaaagttcatagattagrtgaaagaatagtcattgtacaaaagtaattatagtgtgtgtacttttctttatctacaggagctgtaaaattgacaagcttggcatgtggaaatcagcac

SEQ ID NO: 46713 - DNA, 201 bp, Homo sapiens
ggcttgtttcatgtttctttcaagaaggctgggtgctgagttggaatgaatatagtatctatctcctagacacagtcaaccaggtaagtgaagggacgccrccatatcttctgtgtctataggcaagagaatgtatctctataaactgttctactcagggacctcagaatgctaccaggagcagtattgacttacacttta

SEQ ID NO: 46714 - DNA, 201 bp, Homo sapiens
gcactaggggcaggacgtggcctctctgcctcctgcggggcccacactggctgctgcatgctgccactaacatgtccccagttccggaagtctcctgtcckttctcttgtcacccaactcctgccttccctgaaagtcccttcccgcttccagcccgccggggtcagcttggtcagcgtccattccagccccaacgaccag

SEQ ID NO: 46715 - DNA, 201 bp, Homo sapiens
ggcctccacgaccctggactgggtgtggctctgcctggcagtattcagagggagatgaatgttaggctgtgattgctcatgtcgctttatttagggacacyctagaattatctggagaaagggtttgaaggccagctgtcgtccagaactaagatctgaagtggttttgtctatgctttctttctttaacacattcttcct

SEQ ID NO: 46716 - DNA, 201 bp, Homo sapiens
ggtgacagagcaagacttcatttgaaaaaaagaaaagaaagggttttcttctttggtgtgtgtcagcagaacatgaagttcatcttctcctcattgaagtyttatgaattattatcagccgtacctggtaacactggtttggcagaaagaaaactggcccggggtggggggcagaactagactcgactcttctagcctggt

SEQ ID NO: 46717 - DNA, 201 bp, Homo sapiens
tggtcctttcacaagcgcacacgtgcacatttgtgtttggatggtcatcttgttactagaaatgcagaggtgtggacctgagctagaaccttccctcaagrcagagagtctacacttgtaactgctctgacagcagggcttttgcttgtctcctccttccaggtgagcatcacggactatgtggtgtttgaccagtgcagc

SEQ ID NO: 46718 - DNA, 201 bp, Homo sapiens
ttttgccatgactaggcattgaaaggattgtaatgctttgttctgtagcccccaggtttccctagatgacaaataaacattccttttcctgcgtgaagatmgtctgtggaaaccttggccatggcatcgatatcagagcctgttacattcagagagttctgcccgttgtactatctcctcaatgccattccgacaaagatc

SEQ ID NO: 46719 - DNA, 201 bp, Homo sapiens
gcagaactagactcgactcttctagcctggttctgcctttaaccaagagtctcttatcggccggagcctggtttgttttcctgtaaaatggggtgggggtrgaagaagcatcgacttaggggaatcaccaaggtgccttgagtttgttcattttataagggatattctgaaaggtatttttgcaccctttcctcagttaca

SEQ ID NO: 46720 - DNA, 201 bp, Homo sapiens
gctctctgtgggttttgaaggtgactagacagatggaactttgtgcagggttctgcttggaaaacgagattgggaaaaccagctcttccctaactaggagygattgtataccttttccatgtagccccagctcacagcatttatcctttttttttcttgtgtatatttttatcccttgttcatagcttcggagatttgatg

SEQ ID NO: 46721 - DNA, 201 bp, Homo sapiens
agtgatgggattacaggcatgagccaccgcgcccagcctaaattttgttcaattttgatcaatttgaatttcaatacttacaagtagctggtggctgcctrttggacagggagctctaggcaagatctgccattaagttatgtaatcttcagcaagtcgcttcacagcagagtcctcccctccagtctccagtgtacactt

SEQ ID NO: 46722 - DNA, 201 bp, Homo sapiens
agagaggatggcgaatggatcaaagtgggctgtggtcttgtgttgagggtactgtagctggaactgctctggccttgtgccctgtggtgtcgtgttgcagraaagatgagtccactgcagtgggaagctcactggcccttgggcttggggacaggagacaggtactcacatgcctgttctcactctgcggtctactggcct

SEQ ID NO: 46723 - DNA, 201 bp, Homo sapiens
tctcttaagagtgttcccggccatcctgggtcatcagtgtgtctttcaaaagctgccacccacttgaaccatatctcttgcacagtaatttaactcagacycaaacttccttccctggcacctgctgatccgctccagggccacgtctcttctcccagccacgcctgccgggagaccctggatgtccgcagtccagacaca

SEQ ID NO: 46724 - DNA, 201 bp, Homo sapiens
ggacccccggcgcccgccaccatgcccggctaattttttgtatttttagtagagacggggtttcactgtgttagccaggatggtcttgatctcctgacctygtgatccgcccgccttggcctcccaaagtgctgggattacaggcgtgagtcaccgtgcccatcctagttttgctggtttctatgaatttagaatcattca

SEQ ID NO: 46725 - DNA, 201 bp, Homo sapiens
ggcgcccgccaccatgcccggctaattttttgtatttttagtagagacggggtttcactgtgttagccaggatggtcttgatctcctgaccttgtgatccrcccgccttggcctcccaaagtgctgggattacaggcgtgagtcaccgtgcccatcctagttttgctggtttctatgaatttagaatcattcagttcttta

SEQ ID NO: 46726 - DNA, 201 bp, Homo sapiens
ccatgcccggctaattttttgtatttttagtagagacggggtttcactgtgttagccaggatggtcttgatctcctgaccttgtgatccgcccgccttggsctcccaaagtgctgggattacaggcgtgagtcaccgtgcccatcctagttttgctggtttctatgaatttagaatcattcagttctttagctggctggtg

SEQ ID NO: 46727 - DNA, 201 bp, Homo sapiens
cacataggaaaaggtctgaaggaattttcacatgattacttaactctaggtagggattaagattgggatgggctgagggaggaagagtgaaagggaattaygtatttttttaactttactgaggaattactagaaatttttggtacatattacacgcataaacacagcaacacaaagatttgttttgagctttggctgcca

SEQ ID NO: 46728 - DNA, 201 bp, Homo sapiens
tcataaaacaccattttatagctagaatttgttagccagaacacactccttacatatcaacgtggtctataaagggaattaaaatttttttaggtaatcartgaggtttttggaaatcatctctaccgaaattaagaaattatattaatttgtttatgattttagaatcctgcaatacttagaccttaaaagttggagctt

SEQ ID NO: 46729 - DNA, 201 bp, Homo sapiens
agtggtaaaaccagactcttctttcttagtgagagatggtctggagatgtctggatgctcagagcgtgtccacgtgcagcaagcggagaagctgccagggrccacagtttctgagacgaggctcagaggctcttccatggccagctccgtggccagcgagccaaggagcaggagcagctcgctcaactccaccgacagcgg

SEQ ID NO: 46730 - DNA, 201 bp, Homo sapiens; identical to SEQ ID NO: 13183

SEQ ID NO: 46731 - DNA, 201 bp, Homo sapiens; identical to SEQ ID NO: 13167

SEQ ID NO: 46732 - DNA, 201 bp, Homo sapiens; identical to SEQ ID NO: 13166

SEQ ID NO: 46733 - DNA, 201 bp, Homo sapiens
atggtttataattgcatttttgtgttctacatgatttaagagactaaaatgcttttttaaaattagtctaaaagctagtagtattgtaatgttggtttgtraatccacattttcttttcttttcttttttttttttttttagatggtgtcttgctctgtcacccaggctggagtacagtggtgtgatatgggctcactgca

SEQ ID NO: 46734 - DNA, 201 bp, Homo sapiens; identical to SEQ ID NO: 13163

SEQ ID NO: 46735 - DNA, 201 bp, Homo sapiens
tgtttcaaaactgtgtcttgccctgtctcctactaactgtcgatgtgaggtatgaattatggctgcgcacttacagccacgtgtgctttccacagtctacrctggcttctgtcagtgctagcagtgtgacgctttgtcagtgctcaccatgtgcaggtatcccacaaagcactttagaggtttaactcttttacttctcta

SEQ ID NO: 46736 - DNA, 201 bp, Homo sapiens
tttgagacaaaacgccataagtctggcttttttttcttctttctttcttttttttttttttttctgagacagggtctcactctgtcacccaggatggagcrcagtggcgcaatcatggctcattgctgcctcgacctccccaagctcaagtgatccacctgcctcagcttcctgagtcactgggactacaggcatgtgcca

SEQ ID NO: 46737 - DNA, 201 bp, Homo sapiens; identical to SEQ ID NO: 13178

SEQ ID NO: 46738 - DNA, 201 bp, Homo sapiens
ctctcttaagagtgttcccggccatcctgggtcatcagtgtgtctttcaaaagctgccacccacttgaaccatatctcttgcacagtaatttaactcagasccaaacttccttccctggcacctgctgatccgctccagggccacgtctcttctcccagccacgcctgccgggagaccctggatgtccgcagtccagacac

SEQ ID NO: 46739 - DNA, 201 bp, Homo sapiens
tagtggacacggggtttcactgtggtagccaggatggtcttgatctcctgacctcatgatccgcccgcctcagcctcccaaaatgctgggattacaggtgmgagccactacgcccggctttgcttgttttttcttaaggttgtgttggccacgtcggcacctacgccagtggggacacttttgccttgaagcagcctggtt

SEQ ID NO: 46740 - DNA, 201 bp, Homo sapiens
aaaaaagtgaggaaatgataaaggcaaaatgcagtccagtggttccatctggggcacaagggggcaggaagtgttaggagcacaggagaacattggttggrtgactgatgatttctttcctaagtttggggatgggttcccaggtgtacctttccttgctaggcttcataactgcatggatatatgtacatatacacagtg

SEQ ID NO: 46741 - DNA, 201 bp, Homo sapiens
ccggcagcgtgtcgtgtttcacaggcaggtgcccggggccagtgggcttaaggccccttggggttcccagggctcctgtggacgatgtcggggggctctcraagaagccgaccccactgggctccaatctctcaaagcaagaactgagggcaaagccaggagtgtgtcccagggagggaaggggctggacacctgggctct

SEQ ID NO: 46742 - DNA, 201 bp, Homo sapiens
tggacctctcccagctaggtacggccacctcgtgagtacacctgccggtgccctgactgccctaaaccggcatcacaacgtgatgtcggacaaaactgccyggcctgtgtccaacctgtgagagttctgagggggtgtttataagctgctgaatttcaggagctcagttggccactctttcagactagacaggctctgggt

SEQ ID NO: 46743 - DNA, 201 bp, Homo sapiens; identical to SEQ ID NO: 13169

SEQ ID NO: 46744 - DNA, 201 bp, Homo sapiens
tgttttgctacactccgtgggctgtcatctgataccagtgacaactgtgcaagggtggtacctcccgattctgcacccagtgtggggcgtcctccacctgyccctctccagcagcaccaccagctaatggagctgcacaccttttattccccggttgaaagtcaaaataacccatcaaaattaaaaacttctcatccaaaa

SEQ ID NO: 46745 - DNA, 201 bp, Homo sapiens
cagaacccgcagacacggctgtgggtgtggagcacaggatctccattggggaaactggcggtttctttaaaaatgaaacaggccgggcgcagtggctcacrcctgtaatcccagcactttgggaggccgagacggatcacctgaggtcaggagttcaagaccagcttggccaacatggcaaaaccctgtctctactaaaaa

SEQ ID NO: 46746 - DNA, 201 bp, Homo sapiens
atcatggtaggaaataatttctgcttaaaccaagatgataacagattatcatcagagacagatttagaaactttaaacaaagctgtttagtttcagtttcyccttgtcttaagagcagagcttttgctctttttaaaataaactccctgccttaccctcccgactcctcacccccagactctagaccaggccctgtcctgt

SEQ ID NO: 46747 - DNA, 201 bp, Homo sapiens
tcagtgcatgtaaagttaagcacggtgcctgccgctgtacatttcagtaaaggggagcccctgctgtcatctgtgctagcctgcgttctcgccctctagtyccttctgatatgtctctgacttctcatgactttagtttctccttctctacctccatttctcttccctgcacttttttcttcctctcttattgggattcag

SEQ ID NO: 46748 - DNA, 201 bp, Homo sapiens
agttcttacagggcacatgtgggggaatagggaagagtggaaagggactttgttctgcagagacatacaggttatggtgtgtgcagggactgtgatggaargctgatggatgcacaaacaaaacgtggcctgtctacacaatggaaggctgttcagcaataaaaaggaacgaagtactgatttgtgctacaacatggagga

SEQ ID NO: 46749 - DNA, 201 bp, Homo sapiens
gaagtactgatttgtgctacaacatggaggaaccttgagaacattaggctaagtgaaagcaaccagacacaaaataccacatattatatgattcaattttratgaaatctccagaataggcgaactgtagacagagaggagatcagtggttgcccagggctgagagaagaagcgtgtagaggggtgattgctaaagggtag

SEQ ID NO: 46750 - DNA, 201 bp, Homo sapiens
tgtttcttagactttgcccattgtaaaattgtcttttgttgttgttttgagatgaagtcttgctgtgttgatcaggctggtctcaaattcctgggttcaakcgatcttcccaccccagcctcccaagtagctgagactatagccacgtgccactgcacccagcttttaaaattgtctttttattattgagttataagagct

SEQ ID NO: 46751 - DNA, 201 bp, Homo sapiens
ccatgaagtggaggtaacattcatgtctaatgtttggggattgcaggaaaaaaaaatggaagtaactatgatgcctacttcatgtttgttttttttttctytctttttggtgaggatttaatgggtttgtgtgctaagaacagtttgtattaagtacagacggttttcaacttacagagtttcaacttactattttttgac

SEQ ID NO: 46752 - DNA, 201 bp, Homo sapiens
acatgggactctattctgtctgtggttagggggcttttatggaccaagatacagcttttgtatctaagagaaatgtttacaaatacttgtgttttaatcartattcaatatattaaagttttcatttaaaacgtaactaatttaagcctctgtgctcattttaaaataatcaaaatggttcatacacatacagccctttct

SEQ ID NO: 46753 - DNA, 201 bp, Homo sapiens
ttattgactcacagttacgcatggctgcggaggcctcaggaaacttacagtcatggtggaaggcacctcttcacagggctcactgtcacaagaacaggagkggggaaaccatgcccatgattcagttatctctacctggtccctcctacgacatgtggggattatgggaactacaattcaagatgaaatttgggtgaggac

SEQ ID NO: 46754 - DNA, 201 bp, Homo sapiens
caggctggtctcgaactcccgaccccaggtgatccacctgcctcggcctcccaaagtgctgggattacgggtgtgagccactgcatccggccggaagttgyttttatttttttactatttttaatttttttaaagaggtttatttggcccacaattctgtagctggaaagtccaagattgggcagctgcatctggtgggga

SEQ ID NO: 46755 - DNA, 201 bp, Homo sapiens
gtaacaaaacttatagagctttagtaattaagggagtgtggtattagcacaagaaaagatacatagatcactggaacagattagagaagtcagaagaccarcatgtatatggatacttgagtaattgcaaaggtgatacgacaaagtctttttcagtaaatgatgtgggacagctggatatgaatgggaagaaaaatgaaa

SEQ ID NO: 46756 - DNA, 201 bp, Homo sapiens
ctaaaactatggtttttaaagatatacacgcatgtggtaaagctatgaatcaaagcaagagaatatttcatctcaatgttaggagagtggttttggtgggrtggggtatgtagtcaggcagaggcacacaagagcttcaaaggtgctgttaatggtccctttcccaagctagatggggattccatgggtgctcatttttta

SEQ ID NO: 46757 - DNA, 201 bp, Homo sapiens
acaggagaattgcttgaacctgggagatggaggttgcagtgagccaagatcacaccactgcactccagcctgggtgacagagtgagactccatcttaaaaraaagaaagaaagaaaaaaagagaacattttagtatttaaaacttactacaacactttgaaagcagatatttttttcctaagtgtttacaggagcaggcac

SEQ ID NO: 46758 - DNA, 201 bp, Homo sapiens; identical to SEQ ID NO: 13174

SEQ ID NO: 46759 - DNA, 201 bp, Homo sapiens
acctgggagatggaggttgcagtgagccaagatcacaccactgcactccagcctgggtgacagagtgagactccatcttaaaaaaaagaaagaaagaaaaraagagaacattttagtatttaaaacttactacaacactttgaaagcagatatttttttcctaagtgtttacaggagcaggcacatgcctgtttttcaaag

SEQ ID NO: 46760 - DNA, 201 bp, Homo sapiens
acctgaggtcaggagttcaagaccagcttggccaacatggcaaaaccctgtctctactaaaaatacaaaaattagctggacgtggtggcaggtgcctgtartcccagctacttgggaggctgaggcaggagaatggcgtgaacccgggaggcggagcttgcagtgagccgagatcccgccactgcactccagcctgggcga

SEQ ID NO: 46761 - DNA, 201 bp, Homo sapiens
gagttcaagaccagcttggccaacatggcaaaaccctgtctctactaaaaatacaaaaattagctggacgtggtggcaggtgcctgtaatcccagctactygggaggctgaggcaggagaatggcgtgaacccgggaggcggagcttgcagtgagccgagatcccgccactgcactccagcctgggcgacagagcgagact

SEQ ID NO: 46762 - DNA, 201 bp, Homo sapiens
tgggagacttagttttgtttttttttgtttttttgagatggggcctcgctctgttgcccaggctggagtgcagtggcaccatcacaggtcactgcaacctygacttcctgggcccaaccgatctcagcctcccgagtagctgggactacaggtgtgtgccaccacacccaactaatttctgtgtattttgtagagacagga

SEQ ID NO: 46763 - DNA, 201 bp, Homo sapiens
ttgagatggggcctcgctctgttgcccaggctggagtgcagtggcaccatcacaggtcactgcaacctcgacttcctgggcccaaccgatctcagcctccygagtagctgggactacaggtgtgtgccaccacacccaactaatttctgtgtattttgtagagacaggatctcactatgctgcccaaactggtcttgaact

SEQ ID NO: 46764 - DNA, 201 bp, Homo sapiens
gcagctgagagatgaattttacattttgtttaatttttattttattttattttattttttgagacagagtcttgctctgtatcccaggctagagtgcagtrgtgcagtctctggtcactgcaacctccacctcctgggttcaaacgattctcctgccttagcctcccgaatagctgggattacaggtgtgcaccaccacac

SEQ ID NO: 46765 - DNA, 201 bp, Homo sapiens
gtggctcatgcctataatcccagcactttgggaggccaaagtgggaggatcacttgaacccaggagttcaaaatcagcctaggcagcgtagtgagaccccrtctctacaggtaattttttaaattagccaggtgtgttggcgtgcacctgtggtcccagctactccagctactcaggaggctgaggtgggaggatcacttg

SEQ ID NO: 46766 - DNA, 201 bp, Homo sapiens
tacatattacacgcataaacacagcaacacaaagatttgttttgagctttggctgccagttattagtggtttaaccccagagatgaattaaatatttatgytgttgttgttgtcattttcatcatgagagctggctgggtcttagaatcatttggtacaatccccactttttatagataaagaaattctaagattcctgct

SEQ ID NO: 46767 - DNA, 201 bp, Homo sapiens
tgtagagttgttttaaatattaaagtgtacaaaaaaaaaatttaaatgggccgggtgtggtggctcatgcctataatcccagcactttgggaggtcgaggsgggtagattgcttgagctcaggagttcaagaccagcctgggtattattgtgaaatcccatctctatgaaaaatacaaaagttagccaggtgtggtggcat

SEQ ID NO: 46768 - DNA, 201 bp, Homo sapiens
ggatttaatgggtttgtgtgctaagaacagtttgtattaagtacagacggttttcaacttacagagtttcaacttactattttttgactttaagattgagygaaaacgataccattcagtagaaactgtatttccagtaaccatacaaccattctgtttttcactttcaatatggtattaaataaattacatgagatatgc

SEQ ID NO: 46769 - DNA, 201 bp, Homo sapiens
aaattttagatcacctactactttttttttgtttttttagtagagattaggtctcgagctactgggctcaggcaattctcctgcctcagtgtctcatagarctgggattataggtgtaagccactgtgctcggcctttttttttttttaattgaatttttttttatttttttgatacgtagtttcactctttttgcccagg

SEQ ID NO: 46770 - DNA, 201 bp, Homo sapiens
tgaactcctgacctcaggtgatctgcccaccttggcctcccaaaatgctgggattacaggcataagccactgcacccggcccatcttttaataagagctcrgcatattcatacttgattgatcagcattttcgtcattagaaatgaggtggggtttttttgtttttgtttttttgtgttttcatttcaaagattaaaaacc

SEQ ID NO: 46771 - DNA, 201 bp, Homo sapiens
cttcctctttaggaattctgttttaatgagctctctgctgtgggtgaacagtctactccctgactctaaaaggaaagtccattcattctttcatgctgctsttaggccattgttagtgaactggagctggtgtttcctgaacgatgttctcctgagctggaagacctcccatatctgcatggaatcatttgcttgcttttt

SEQ ID NO: 46772 - DNA, 201 bp, Homo sapiens
gaagagggagcaccagtcatctgtctccacacctagacatcaattgtactggcaggatctgtctgatctaactattttggaactcggaagtctactgaggyttacacattcttgctgggatggcaaactgtggttaattttggtcagtttcaactcttagcacagtagcagctatgcactccccaaccccagttctgtgga

SEQ ID NO: 46773 - DNA, 201 bp, Homo sapiens
ctaaaaaaacaaacttcagagaggagagaaatgcctcctcatatacaagggacccccaataagattataagcagatttctcatcaaaaactttggaggggycaggtgcagtggctcacatccataatcccagcactttgggaggctgaggcaggtggatctcttgaggccaggagtttgagaccagcctggccaacatggc

SEQ ID NO: 46774 - DNA, 201 bp, Homo sapiens
tgtcattttcatcatgagagctggctgggtcttagaatcatttggtacaatccccactttttatagataaagaaattctaagattcctgcttcaaggcacrtatctctgattgcctaaccattgtgcttacttcttgtgagaggaggtaggccctctgtgcagtctgtggatttcaaggatatggaatacagatgcgtggt

SEQ ID NO: 46775 - DNA, 201 bp, Homo sapiens
gataaaccaactagatttaacagacatttatagaacactctacccaataacaatagcatacattttctcaaatgtagatgggatgttttccaggatagacyatatgttaagccacaaattagtgtcaatagattttaaaagatatacaaagtatgttcttattgcaaccacaacaggataaagttagaaatcagtaacaga

SEQ ID NO: 46776 - DNA, 201 bp, Homo sapiens
cctgagatctaacacttacagtggtttgatcagaaattgcaccatgcttgccaagcaacttttggactaaaagttgctgcccacgtatatcaggggaagaatatatatatatatatatatagtacctatcttagcatctgatttgtatgaccattacttcaatgtaaaataataaattggctttccagcttaaacttcaat

SEQ ID NO: 46777 - DNA, 201 bp, Homo sapiens
aaagtatctctgtttgcagatgacatgatcttgtatgtagaaaccctaaagattccacaaaaaattgtttgaactaatacatgaaactgacatagtagcarcatacaaagtcaatgcacaaaaatcagttgcatttctaaacaccaacaatgaataatatgaaaaagaaattaagaggaaaattccacttaaaatggcatt

SEQ ID NO: 46778 - DNA, 201 bp, Homo sapiens
ctgagatctaacacttacagtggtttgatcagaaattgcaccatgcttgccaagcaacttttggactaaaagttgctgcccacgtatatcaggggaagaatatatatatatatatatatagtacctatcttagcatctgatttgtatgaccattacttcaatgtaaaataataaattggctttccagcttaaacttcaatt

SEQ ID NO: 46779 - DNA, 201 bp, Homo sapiens
gaattttggaaaacgtttagcctttatctctgaagataccacttttcattaccctctcttttcatttcctgctgaaacccctttttttgtttgttttttgytttgttttgttttgttttagacagagtttcactcttgttgcccaggctggagtgcaatggtgtgatcttggctcaccgcaacctctgcctcccacattca

SEQ ID NO: 46780 - DNA, 201 bp, Homo sapiens
tgaggcaagagaatcgcttgaacctgggaggcagaggttgcagtgagccgagattgtgccattgcactccagcctgggtaacagagtgagactccttctcwaaataaataaataaataagatgtggaaaaaggtaaaacagcgtatgaaggctgggtgtggtggcttacgcctgtaatcccagcattttgagaggcagatc

SEQ ID NO: 46781 - DNA, 201 bp, Homo sapiens
gaggcaggagaaatgcttgaacctgggtgacagaggttgtagtgagctgagattgcaccattgcactccagcctgggcaacaagagcaaaactccatctcaaaaaaaaaaaaaaaaacaaaaaacaatcctactatatgctatatataagagactcacggccaggtgcagtggctcaagcctgtaatcccagcagtttggg

SEQ ID NO: 46782 - DNA, 201 bp, Homo sapiens
gtaaacaaatgaccaataagcatatgaaaaatgaccatcactaattattagggcatgcatgtcaaaactataccccacacccattaggatggctactgtcaaaaaaaagaaaaaaaggaaataacaagggttggtaaggatgtgagaaatgggaaccctggtgcattgttcacaggaatgagatgatgcagccaatactag

SEQ ID NO: 46783 - DNA, 201 bp, Homo sapiens
gagggcgtgagcagcttctgtccggaaggcgagcagtggaagtgtgacattgtcaggtactggcgggccagagactcctttcacatcgtgcttgtcctacycttcgttcttgtccacttgacaccacaaggcaccatgaggccgttcctgggaggcagcacctgcagcctccatggctataggctaagcttgaatctctgc

SEQ ID NO: 46784 - DNA, 201 bp, Homo sapiens
tcataaagacggaaagtagaatggtagttgccaggggctggggggagggatgaatggggaattattgtttaatagagtttcagttttacaagattaaataktcgtggagatggataatggtgatgattgaagagcattatgaatgtattgaataccactgaaatgtatactttaaaaagggatactggtaattttacgtta

SEQ ID NO: 46785 - DNA, 201 bp, Homo sapiens
agtttgagatcagcctgggcaacgtagaaaggccccgtctatatttttaattaattaattaattaaagtttttttttaaagcactcatcataaaagaatayagcaaaataccaaaaaaggaaaaataagccaataaccaagtcaaaatgaggtgtggagttctgactgtgtgtctttggggcttcttcccatcttcctggc

SEQ ID NO: 46786 - DNA, 201 bp, Homo sapiens
ttaccatgttggtcaggctggtcttgaactcctgaccttagatgatctgcctgcctcggccttccaaagtgctgggattacaggcgtgagccaccacgccyagccaagaattcagcaattattagctgcatgactttcagtccctctgatccaagactgacctagtacaaatattctctagtagtagttctcaagctttgt

SEQ ID NO: 46787 - DNA, 201 bp, Homo sapiens
tttcactatttcatctgcctccctgtctagatcataagctacttgggagtaagaactgttttgttttttgtattctttccactcctccatggcattcactrcaacataaatcatagaggtcagaacatactgaagtgcattttgagttaaaatgctcaaaagtgatcttagtgacacgtgtttactttccctgtttattta

SEQ ID NO: 46788 - DNA, 201 bp, Homo sapiens
gcagtgctcagggagactgcagcatcctggagccctgccagccaggagggactgttcccattgcgggcagaatctgttacttgcaatcagaagaacttcarctaatacttgttttttgcctgtagattcaattgaccttgggaatgttgcttaaactcgcctttcactttcattttcctatcagtaaagtgaagggtcata

SEQ ID NO: 46789 - DNA, 201 bp, Homo sapiens
gacctctccctctgggctgcactcatccagaaggtgcttccccgagcctgtctgtagagtcagccacagagcagggcgatgagctatcagagaccagggtrtgtgccactgggtccagcttctgctcttcttgtctcacagcaatatttgagtcctggtgctagccatggcgcagtcgttgggctggtatcagtgacaagg

SEQ ID NO: 46790 - DNA, 201 bp, Homo sapiens
ttttgaactcctgggctccagcaatcctgccaccttggcctcccaaagtgctggattccaggcatgagcaactgcacctggcacccctcctgttttctgtytgctctggctgaaggcctccttttccttttcttttttttttttttttttgagttggtgtttttgcccttgttgcccaggctggagtgcagtggcgcaatc

SEQ ID NO: 46791 - DNA, 201 bp, Homo sapiens
aatgaggttggtgagttcaaaaaacagaaaacaaaacaaaacaaacaagcaaacaaaaaaaccagtgtgctggaatgaaatagacagaaaaggactagtgygtgagtaggtgatcagacaactagaacctaataggccaagataagaagttggaccgagggcagtggctcacgcctgtaatcccagcacttcaggaggcca

SEQ ID NO: 46792 - DNA, 201 bp, Homo sapiens
gagtgcagtggcgcaatctgggctcactacagcctccgccccccgggttcaagcgattctcctgcctcagcctcccacgtagctgggattacaggcacccrccaccacgcccggctaattttgtatttttggtagaaatggggtttcaccatgttggccaggctggtttcgaactcctgacctcaggtgatccacctgcct

SEQ ID NO: 46793 - DNA, 201 bp, Homo sapiens
tctcctgcctcagcctcccacgtagctgggattacaggcacccgccaccacgcccggctaattttgtatttttggtagaaatggggtttcaccatgttggycaggctggtttcgaactcctgacctcaggtgatccacctgccttggcctcccaaagtgctgggattacaggcattagccactgtgcccagcctggaggct

SEQ ID NO: 46794 - DNA, 201 bp, Homo sapiens
aggctttcttcagatgttggcagtcccctggttggaagagtgaggcccagcaaggctgactggaagccctgagcacatgcatggagcctgtgggccccgcrggtctctgacagcaatctggctgggctgctgggtggggagtcgttgcttttagccttccagggcccgctgagtccttgccatgcatcccccactttccag

SEQ ID NO: 46795 - DNA, 201 bp, Homo sapiens
atcatataatatgtggccttttttatctgacatctttcactttgtatcatgtttcggagttcatccacgttgtaggtgtatcagttcttaattcctttttrtgactacatcacagctctgttgtatggataggccacattggtttatcatttcaccagtggatggacatttggattgtttctgcttattggctactgtgaa

SEQ ID NO: 46796 - DNA, 201 bp, Homo sapiens
ctttatatttttccttttaagttacaacccgcataacataaaatttcagccttctacagtgtgcagctcagtggctttagcatcagttagcagcagttagyaccatccaattccagagggttcccatcactccaaaacagagagaacacccttacccattagcagtcacttcctgttctcacagaaccagcccctccgccc

SEQ ID NO: 46797 - DNA, 201 bp, Homo sapiens
ccagggagaaataaacaggtgagtactcatgatcttaacacgtgttaacttcttggcacattcctcatggatttttaaaattagaaatcctcatctgcttrgaaagtttatgctcagagaaagccgggcacgactttctctgcccaggctcatgcctgtaatcccagtactttggaaggccaaggcgggctgatcacgagg

SEQ ID NO: 46798 - DNA, 201 bp, Homo sapiens
ttgcagacaggtaaccgcgggccacgcttagaggcctgccagctctgccgtcactgcctctgctgcaccctgctttgctagtaacatgcttaccacaatcrctatgattaagaggctaaatccattcgaattaagacacttctgggaagagagtatttgccatttggcatgtattagcagtttcctgcattgacacaaact

SEQ ID NO: 46799 - DNA, 201 bp, Homo sapiens
atagacttatgttttataagcttccacttctatgactaaggagttggcctactggaacattcacttttttcattccactgttgtgtattacttttacttgraaaagaagctattatcattcctacttccttgaaaggttagtaggagtgatgccaagcacttctgaatcctaactgtggacaagtcagtgatttcaatgga

SEQ ID NO: 46800 - DNA, 201 bp, Homo sapiens
cgcctgccgggagaccctggatgtccgcagtccagacacactgggcactctgcctatgggtgctgacccccctgttctcctccttattttcagcgaaaggmaagctttagaacccgtctgcataacgctcggggatcagcagactctctgggccctggacatccatgggaacctgtggttcagaactggcattatttccaa

SEQ ID NO: 46801 - DNA, 201 bp, Homo sapiens
attacagcatttcaaataaaaatggtgttttgtgaaaaaagcagctggctcagctcatagctgcaacagttgcacaagtggtttccttgagagaaccactragtgtatttcagtgtgcagcagaagggagaatacaaaagtacctatcctctggccaggtgtggtggctcacacccgtaatcccagcactttgggaggcca

SEQ ID NO: 46802 - DNA, 201 bp, Homo sapiens
tttttttttgagacatggtcttactcctctcacccaggctggtgcacagtggtgcaatcacggctcactgcagctttgacttcccaggttcaggtgattcycccaccttggcctcccgagtagctgggactatgggtgcacaccaccatgcccagctgatttttttgtatttttatagagacagggcttcgccatgttgca

SEQ ID NO: 46803 - DNA, 201 bp, Homo sapiens
gcagtatttctgaaataattgatgaaacttttcatatatatattggatttcatatatatgaaatatacatatatttcatatatatataatgtatatatatwtatattttttgagacagagtctcactgtgttgcccaggctggagtgcagtggtgcgatcttggctcactgcaacccttgcctctgggttcaagtgattct

SEQ ID NO: 46804 - DNA, 201 bp, Homo sapiens
agtatttctgaaataattgatgaaacttttcatatatatattggatttcatatatatgaaatatacatatatttcatatatatataatgtatatatatatwtattttttgagacagagtctcactgtgttgcccaggctggagtgcagtggtgcgatcttggctcactgcaacccttgcctctgggttcaagtgattctcc

SEQ ID NO: 46805 - DNA, 201 bp, Homo sapiens; identical to SEQ ID NO: 13173

SEQ ID NO: 46806 - DNA, 201 bp, Homo sapiens
tatttctgaaataattgatgaaacttttcatatatatattggatttcatatatatgaaatatacatatatttcatatatatataatgtatatatatatatwttttttgagacagagtctcactgtgttgcccaggctggagtgcagtggtgcgatcttggctcactgcaacccttgcctctgggttcaagtgattctcctg

SEQ ID NO: 46807 - DNA, 201 bp, Homo sapiens
ctgtaacctgaactcctgggctcaaatgatccttctgtctcagcctcccaagtagcggggaccataggcacgtgccaacatgcctggctaataaaaaaaawttttttgtagagacatgatctcacaatgttgcccaggctggtcttgtaaagtatcattttatgttaatagcattttatatatttaatatcatttaatttc

SEQ ID NO: 46808 - DNA, 201 bp, Homo sapiens
catggatggacacccattagcacagatggccctaaacaggagtgtggagcatgcagcactgagggaaccatggactccatgcagagatcaggaaggcagcrtgcagagtggaccaacagctaagccttgaagctgacgaggacttccccatatggaaggagggggagggcgtctccagcaaagagggcagtgtctgcctag

SEQ ID NO: 46809 - DNA, 201 bp, Homo sapiens
gcgccaccatgcctggctaatttttgtatttttagtagaggcatggtttcaccatgttggccaggctagtctcaaactcttgacctcagatgatctgccgycttggcctcccaaagtgctgagattgcaggcatgatgcatccagcctgaatacaatgttatgtgatgcgtgactgtatctgccactcatggttgttgtaa

SEQ ID NO: 46810 - DNA, 201 bp, Homo sapiens
ttgaaaaaaaaaatttggttttgacatttaggtccaattttctgccgagaaatgatgtatgttttttgtatgtaaacacaaaattaaacttgttctttttkttgttgttgttgttgttgttgttgttgagaaagagtctcgctctgtcacccaggctggagtgcagtggcatgatctcggcttactgcaacctccacctcc

SEQ ID NO: 46811 - DNA, 201 bp, Homo sapiens
tgaagtataactaagctgttttgttatacacaggcatctctcatttgtaaataatttgtaaattgaagcgagaaatgctgtattcttagtatttttttactttttttttttttttttttgagacaggtttcactctgtcgtgcaggctggagtgcagtggcatgatctcagctcactgcaacctccacctcccaggctcaa

SEQ ID NO: 46812 - DNA, 201 bp, Homo sapiens
cccaggctcaaatgattctcccacctcagcctcccaagtagctgggactatgggcgtgcaccaccacaccctgctaaattttgagactccgtctcaaaaawaaataaataaataaatataaaaagaaagctatggcaaattattttactgattttaatatatgagcttcttgaagaacaaaaactatttcttagagtcttt

SEQ ID NO: 46813 - DNA, 201 bp, Homo sapiens
ccaaaaaaggaaaaataagccaataaccaagtcaaaatgaggtgtggagttctgactgtgtgtctttggggcttcttcccatcttcctggcaggtctgagygtggatcgcccttgtgccagagccgtaaaggtggactgtccctacccgctgtcccagatcacagcccggaacaatgtggtgtgggcgctgacagagcaga

SEQ ID NO: 46814 - DNA, 201 bp, Homo sapiens
ctcccaagtagctgggacccccggcgcccgccaccatgcccggctaattttttgtatttttagtagagacggggtttcactgtgttagccaggatggtctygatctcctgaccttgtgatccgcccgccttggcctcccaaagtgctgggattacaggcgtgagtcaccgtgcccatcctagttttgctggtttctatgaa

SEQ ID NO: 46815 - DNA, 201 bp, Homo sapiens
atattaatatactaactcttcataaaaataatacgtgtttctctttctcattgttgctttaaagcaaccgaactaacgaagacgggcctatggatatgttrgatatattccaattatttggcttcctctttaggaattctgttttaatgagctctctgctgtgggtgaacagtctactccctgactctaaaaggaaagtcc

SEQ ID NO: 46816 - DNA, 201 bp, Homo sapiens
taatgagctctctgctgtgggtgaacagtctactccctgactctaaaaggaaagtccattcattctttcatgctgctgttaggccattgttagtgaactgsagctggtgtttcctgaacgatgttctcctgagctggaagacctcccatatctgcatggaatcatttgcttgctttttctttctttctttctttttttttt

SEQ ID NO: 46817 - DNA, 201 bp, Homo sapiens
ccgcccgcctcagcctcccaaaatgctggcattataggcgtgagccaccggcctcaggagcatgttttaatcactgctgtgagtcgtcagctggggatgartcttcaggttgaagctcttgcacagctggctctctcctagctgtgtaagaacctctggcctgggtgcacagccatgctggcttcataggccatatgctgg

SEQ ID NO: 46818 - DNA, 201 bp, Homo sapiens
tggcaggcgttgatgaggccctgcggctggtggtgccgttggggacaggccgtcctggagagtcgggtgaggcggagccagcccctgtggtcgtagtcacygcccgttattctgtgttctgggctttgcggcaacacacaagtttattctcttttctgcatggcagccctccggctgttaaaagacgctctcaaacctccc

SEQ ID NO: 46819 - DNA, 201 bp, Homo sapiens
aaagcaagaagagggctgggcacagtggctaatgcctataatcccagcactttgggaggccaaggagggcggatcacctgaggtcaggagttcaagaccarcctggccaacatggtgaaaccccgtctttactaaaaatacaaaaattacctgggtgtggtggcacatgcctgtaatcccagctacttggttgggaggctg

SEQ ID NO: 46820 - DNA, 201 bp, Homo sapiens
cctcctgtttgcaaacccacagcgcctctaagcctggggttcctggtggggccctgtgcctgcttaggatttctcctcccagaggcagacaagaagagtgkgttcttcttgtcgcagagctgtaggagcctgcacacacagccactctgcctctcagggtgccacagtcagcgcagagaagcctcaggggtggcctggtct

SEQ ID NO: 46821 - DNA, 201 bp, Homo sapiens
tgggctcaagtgatcctcttacctcatcctcctgagtacctgggactacaggtgtgtgtacaaaatacaaaaaacactcccagctgtccagccttaaatamaatcttgtacataagccagatgtgttcaacaagtaacagcaaaactggtcccatgaaactgccccttccacaggggccctgaggcacctctgcaaggcca

SEQ ID NO: 46822 - DNA, 201 bp, Homo sapiens
cacagtcagcgcagagaagcctcaggggtggcctggtctatctgttccttgtggagccacctcctccacacagccctggtgaggggtcagggttgtggggstcactcgttattcagcacgtgtttaccatgcacccctgtgcactgtggcaggctcagcagtgacatggtaaacacggcagatctgagccctccgttgtgg

SEQ ID NO: 46823 - DNA, 201 bp, Homo sapiens
agccagatgtgttcaacaagtaacagcaaaactggtcccatgaaactgccccttccacaggggccctgaggcacctctgcaaggccagggccccacaggcrctgctggaaaactgctggtcttcgggccagtgaggacagagagagagctcagcacagcaggccccgggcagccatacccacctcgtaccacggtcagagt

SEQ ID NO: 46824 - DNA, 201 bp, Homo sapiens
tttagggaacattgattgaaagcgtgctctgctccccaggaacgttttaggatgcagaaacaaataaatgtgtccccttctcagaaggagagagattttaytgagccttggggaaatgagggctaacagaataagaggaaatgtttttaacatctgtgtcttaaagacttgctttctgctgtagactattgtgtgcgtcta

SEQ ID NO: 46825 - DNA, 201 bp, Homo sapiens
gctggcagatttgctgccacgttggttctgaggtgtgagagggatgagttggagatgattcctaggtctgtggtctatgcagctgggtgagtggacatgcygtggattgacgcagagaatcctggaggcacggggagaaggaggagatggaacagcctgctgtggccccgccatgtcctctccctgcagtggagagctggc

SEQ ID NO: 46826 - DNA, 201 bp, Homo sapiens
gcgggtgtacctctcggggagctgtgcgctggcagccactggcatgcagacaggagctcgcctagggagatttgggcaggcttgtgttctgaagaggaaasggcatcaggagagaacaggagttggggggtcagaggagtcggaggccatatggagggacatagcagctgctgcgagaccgggggctgaggcagcttcgac

SEQ ID NO: 46827 - DNA, 201 bp, Homo sapiens
agaggagtcggaggccatatggagggacatagcagctgctgcgagaccgggggctgaggcagcttcgacgggcctgagtctgtagcatggaggctgtgcasagccctcctcatcagcagggccaagggattggaagggctgaaagaggagttgacggcgagtatggagagcttttaggaggagtgtttttgtagaagagaa

SEQ ID NO: 46828 - DNA, 201 bp, Homo sapiens
ctcctgggctcaagcagtcctccctccttggcctccaaaagtgctgggattacaggtgtgagccaccatgcccagctattcagcagttttagaggcagccmctcccaggaccttgctcagcagggctcctttcccttcctccagggtaagagtccacctggtgttcaggacctcgccttctcatgcccactcagatgcacc

SEQ ID NO: 46829 - DNA, 201 bp, Homo sapiens
tttagtagagacggggtttcactgtgttagccaggatggtcttgatctcctgaccttgtgatccgcccgccttggcctcccaaagtgctgggattacaggygtgagtcaccgtgcccatcctagttttgctggtttctatgaatttagaatcattcagttctttagctggctggtgcctctgtgacaactggtatttaggg

SEQ ID NO: 46830 - DNA, 201 bp, Homo sapiens
ccgtgtgggaatgggcaggtgagtgagctggcatctgtggccaggtggctagcgtctgctgaaaggcaaaggctgccttgtgcatttagggcaggcggctyggtgcagacaacacctcgatgacaaacatgacccctttctgcaggaagcttcctgtggctgtgccagagcagcaaggacctgtgcagcgtcagcgcccag

SEQ ID NO: 46831 - DNA, 201 bp, Homo sapiens; identical to SEQ ID NO: 13171

SEQ ID NO: 46832 - DNA, 201 bp, Homo sapiens; identical to SEQ ID NO: 13189

SEQ ID NO: 46833 - DNA, 201 bp, Homo sapiens
tcactgagtgagcaatgctccatacatccaaaagcagagaacacatacatttcttccccaaaggagttttactgcaaaatacttcacattaacggaaaatmcacacacacacacacacacacactgtaaggtctaaatgatgacagaacacctgtgtgtactcaccaccctgcttaaagggtctcagttttgtacttttca

SEQ ID NO: 46834 - DNA, 201 bp, Homo sapiens
ttgaaaggattgtaatgctttgttctgtagcccccaggtttccctagatgacaaataaacattccttttcctgcgtgaagatagtctgtggaaaccttggycatggcatcgatatcagagcctgttacattcagagagttctgcccgttgtactatctcctcaatgccattccgacaaagatccagaagggtttccgctct

SEQ ID NO: 46835 - DNA, 201 bp, Homo sapiens; identical to SEQ ID NO: 13190

SEQ ID NO: 46836 - DNA, 201 bp, Homo sapiens
ttatttatttattttttgcgacagagtttcgctcgtcgcccaggctggagtgcaatggcacgatctcggctcactgcaacctcacctcctgagttcaagcrattctcctgcctcagcctcccgagtatgcatgcccagcgaattttgtatttttagtagatacagggtttctccatgttggtcaggctggtcttgaactcc

SEQ ID NO: 46837 - DNA, 201 bp, Homo sapiens; identical to SEQ ID NO: 13193

SEQ ID NO: 46838 - DNA, 201 bp, Homo sapiens
ttcttttttttttttttttgagacagagtcttgctgtgttgcccaggctggagtgcagtggtacaatctcagctcactgcgagctccacctcccaggttcrcactattctcctgcctcagcctccccagtagctgggactacaggcacccgccaccacgcccagctaatttttttgtatttttttagtggacacggggttt

SEQ ID NO: 46839 - DNA, 201 bp, Homo sapiens; identical to SEQ ID NO: 13195

SEQ ID NO: 46840 - DNA, 201 bp, Homo sapiens
catcaccacgcccagccaatttttttgtatttttagtagagatggagtttcactatgtcggccaggctggtcttgaacttctgacctcaagtgatctgccygcctcagcctcccaaagtgctgggattacaggtgtgagccaccacaccaggccataatttgctctaaatagcagttcaggccaggtgtggtggctcatgc

SEQ ID NO: 46841 - DNA, 201 bp, Homo sapiens
cccgccccagcctccctgctgtgacaggggcaggggctgcggtgaccctgcagcacaggcgcggctccctcggatcccttggatctcaccggtgcatctgrggttctgcgtggaaagtggctcgggcttccaatgccgctctgctttaagctgggaccgctgtccagggtggtgcccagccttctggcatctgccatccaa

SEQ ID NO: 46842 - DNA, 201 bp, Homo sapiens
gaaatcccgtctctattaaaaatacaaaaattaaccgggcatctcaggaggctgaggcaggagaatcacttgaacctgggaggcggaagttgcagagagcygagatcgcaccattgcactccagcctgggtgacagagcaagactccatctcaaaaaacagacagacaaaaaaaagcaacaacaacaaaaagccagaatgg

SEQ ID NO: 46843 - DNA, 201 bp, Homo sapiens
tgtgatacctttttagatgcatattatgtttctaagtaccgtatactgttgtccattggaaatacctgatttaaaagcaaaattaaagctgggcatagtgkttcatgccagtaatcccaacactttgggaggccaaggcagggagatcacttgagcccagaagttcaagaccagccctgggcaacacagggagacctgtct

SEQ ID NO: 46844 - DNA, 201 bp, Homo sapiens
tacacatcctggggtttgtttctgtgagtgaaccccttgcttttctccagccctctccctgctgcatggcctccacgaccctggactgggtgtggctctgcctggcagtattcagagggagatgaatgttaggctgtgattgctcatgtcgctttatttagggacactctagaattatctggagaaagggtttgaaggcca

SEQ ID NO: 46845 - DNA, 201 bp, Homo sapiens
gagtagaatagtgcacttgctctgcaaatgcacttttgaggcaaatctcttgactcccttctagctagactgcagtctcaaagcccttcttgtgtagagcytgcgagctgtcagtggatagcatcaaatcaagcggatggattcttgaaagctaaatgtcatcatttgacagagctactatgaggaaaaatatttttattt

SEQ ID NO: 46846 - DNA, 201 bp, Homo sapiens
gcgcctgacccaagagaccttttaataattacttatttaagtgaaaattttgaatgcaggtgtgctgtctgcccaggagcccgtgtatgactgtgcatggyggctgtcatcaggtggcatgcattgaatggggattattgactgtaaaggagagtcatcaagctgacatggctgctgcctgtgttacttatctggaattaa

SEQ ID NO: 46847 - DNA, 201 bp, Homo sapiens; identical to SEQ ID NO: 13177

SEQ ID NO: 46848 - DNA, 201 bp, Homo sapiens
atgtgatgtatggaaagggggttccatagccaaacaagttaagctaagttcagagggaaggtggtgaatagaaatcccaaacatctgatcccagcacagcyagcggtggggacttgccttgagtgcgctccaggtggtccctggggactcggtcctggcacccctgccctcctggattgcatcccacagccctgctggccg

SEQ ID NO: 46849 - DNA, 201 bp, Homo sapiens
tctttctttgaagtagaaaatcaaagttcatagattagatgaaagaatagtcattgtacaaaagtaattatagtgtgtgtacttttctttatctacaggagctgtaaaattgacaagcttggcatgtggaaatcagcacatctgggcctgtgattccaggggtggagtttacttccgtgtagggactcagcctctcaatcc

SEQ ID NO: 46850 - DNA, 201 bp, Homo sapiens
cactctctgttcacctgggccatccctgcccttcttggcctcctgctggagtccatgctggtatctgctgggctgtccctcagtctggcccacctgacatyctggagacaagtgaccatctcccccgtgagactggcactaggggcaggacgtggcctctctgcctcctgcggggcccacactggctgctgcatgctgcca

SEQ ID NO: 46851 - DNA, 201 bp, Homo sapiens; identical to SEQ ID NO: 13179

SEQ ID NO: 46852 - DNA, 201 bp, Homo sapiens; identical to SEQ ID NO: 13181

SEQ ID NO: 46853 - DNA, 201 bp, Homo sapiens
gcccagacctgcgcccaagctcccagctccatctgtgcccaagctcccagctccatctgtgcccaccccacaggctgtgtgattgacaagtatgtgattgrctcttgtccctgcagtgactgcgtcagatgagctgtgggctgtgggcccgcccggctacctcctccaacggctgacaaagacgttcagccactcgcacgg

SEQ ID NO: 46854 - DNA, 201 bp, Homo sapiens
cctcagcctcccaagtagctgggacccccggcgcccgccaccatgcccggctaattttttgtatttttagtagagacggggtttcactgtgttagccaggmtggtcttgatctcctgaccttgtgatccgcccgccttggcctcccaaagtgctgggattacaggcgtgagtcaccgtgcccatcctagttttgctggttt

SEQ ID NO: 46855 - DNA, 201 bp, Homo sapiens
actccgtctcaaaaataaataaataaataaatataaaaagaaagctatggcaaattattttactgattttaatatatgagcttcttgaagaacaaaaactrtttcttagagtcttttgtatgattcttttagttttggtggattttttttttttttttttttgagacggagtctcactgtgttgcccaggctggagtgcag

SEQ ID NO: 46856 - DNA, 201 bp, Homo sapiens
cgcaggacctcaccgcgccagcgtgaagttcccgggcatggtcatgaaagcgtggttctgtaagaaatcagagggagaaagggagagaagggggagggagrcaacccaaacgttggagggtatttgttgtaaacttcaaacttttggcaggtttgaaatttttcataactccggggaggagcaagaggggtgaaaagaaac

SEQ ID NO: 46857 - DNA, 201 bp, Homo sapiens
ttattactctcttgagttacggtgttctcaagcccagctgagtccacacagccgatgtggatggactaggacagatccgatgacttagtgtccaagttcarttgcaaatgcagcctcatttctttctttgaagtagaaaatcaaagttcatagattagatgaaagaatagtcattgtacaaaagtaattatagtgtgtgta

SEQ ID NO: 46858 - DNA, 201 bp, Homo sapiens
gtacaatctcagctcactgcgagctccacctcccaggttcgcactattctcctgcctcagcctccccagtagctgggactacaggcacccgccaccacgcycagctaatttttttgtatttttttagtggacacggggtttcactgtggtagccaggatggtcttgatctcctgacctcatgatccgcccgcctcagcctc

SEQ ID NO: 46859 - DNA, 201 bp, Homo sapiens
gcaaactggacgttgagtcagagctcgctttttaaaaatgctgccgccctctgcgcagccctgagcatcacagcgtcatgagtctgtcatgacggtctctrttcagaattgcccaccgtcaggtagttctggtttagtgtctgtgacggcttaggtccaaatatttttctttattttcatgctaatcgaagttgatctctg

SEQ ID NO: 46860 - DNA, 201 bp, Homo sapiens
gcaatgagccaagatcacaccactgcactccagcctgggtgacagagcaagacttcatttgaaaaaaagaaaagaaagggttttcttctttggtgtgtgtyagcagaacatgaagttcatcttctcctcattgaagtcttatgaattattatcagccgtacctggtaacactggtttggcagaaagaaaactggcccgggg

SEQ ID NO: 46861 - DNA, 201 bp, Homo sapiens
ctctgctcactgcaatctctgcctcctgggttcaagcgattctcttgcctcagcctgctgagtagctgggattacagacatgtgcctccacgcctggctatttttttttttccatatttttttagtagaggcagggtttcaccatgttggccaggctggtctcaaactcctggcctcaggtgatccgcccacctcggcctc

SEQ ID NO: 46862 - DNA, 201 bp, Homo sapiens
gacattggatgaatccacgcagggaatgtctgttcattcagcgctggagctttgcgccaagcctctgccctgctccagtactcctcatcgggggatatctrtgaacaaggcagaacagatctctaatctcagggagctgtgtgcagagtagtgaacagataaacatgtcagagggtgcagagccagagagggaggagcagg

SEQ ID NO: 46863 - DNA, 201 bp, Homo sapiens
ctcactccgctccagtttcatcaccagtggaatggagatgagaatagtttctacctctggcttggtaagaggattaaatgggtcagtgcatgtaaagttargcacggtgcctgccgctgtacatttcagtaaaggggagcccctgctgtcatctgtgctagcctgcgttctcgccctctagtcccttctgatatgtctctg

SEQ ID NO: 46864 - DNA, 201 bp, Homo sapiens
tgtttgtctggatttggtatcaaggtaatgctgctggcctcatagaatgcactgggaagtgttttcttcttttctactttttggaagagtttttgaaagawtggttttattttttacaccccatttgttagaattcgtcatcccatccatgaattcatgtagccatgtaggcctgaactttttttgtgggaagtttttttg

SEQ ID NO: 46865 - DNA, 201 bp, Homo sapiens
atccatgaattcatgtagccatgtaggcctgaactttttttgtgggaagtttttttgactactggttcaatctctttattcattataggtctattcagaattttttttttttttttctgacatggagtctcgctctgtcacccaggctagaggatgttggcgcgatctcggcccactgcaacctccgtctcctgggttctt

SEQ ID NO: 46866 - DNA, 201 bp, Homo sapiens
agctataatgtttacctgcctaaaagttccatgttgccagtattaaacatacttctttttgccatgactaggcattgaaaggattgtaatgctttgttctrtagcccccaggtttccctagatgacaaataaacattccttttcctgcgtgaagatagtctgtggaaaccttggccatggcatcgatatcagagcctgtta

SEQ ID NO: 46867 - DNA, 201 bp, Homo sapiens
cctccacctcccaggttcaagcaattctcctgcctcagcctcccaagtaactggggttacaggcgtgcaccaccatgcccggctaattttgtttcttgtgttttttttttttttttgagacggagtctcgctctgtcgcccaggctggagtgcagtggcacgatctcagctcactgcagcctccgcctcctgggttcaagc

SEQ ID NO: 46868 - DNA, 201 bp, Homo sapiens
aaaattcccggcagcgtgtcgtgtttcacaggcaggtgcccggggccagtgggcttaaggccccttggggttcccagggctcctgtggacgatgtcggggkgctctcgaagaagccgaccccactgggctccaatctctcaaagcaagaactgagggcaaagccaggagtgtgtcccagggagggaaggggctggacacct

SEQ ID NO: 46869 - DNA, 201 bp, Homo sapiens
ataaggaggacctgggaagcatttgctgcacttctgaatctagcgcatgcagactcgaccctgtgggtcgagctttggtgagaagtggttggatttggaaygtatcttgaagacgaagctgactgtctttgctgatggattggatgtatggcatgtgaggaagggggtcctttatgatctaaggaattggatggtgccatt

SEQ ID NO: 46870 - DNA, 201 bp, Homo sapiens
ttggcttattgtgcttttggtatccttttcttttcttttctttctttttctgagacagaatctcgcactgttggccaggctgtagtgcagtggcacaatcrtggctcactgtagcctcgacctctagagctcaagggagcctactgccttagcctcctgagtagctagggctacaggcggtaccattatgcctggttaatt

SEQ ID NO: 46871 - DNA, 201 bp, Homo sapiens
cttttaagtaggagaatgtcaatgtcataaattagagttaattgtgagaaattgaaataagtattccatttttttctgagatgtgctctcctgaacttatraagtagttcttcagaagtgtttgcagtgttcacaagacactggctctgtggtatttgacatgcagatgggcccagaattcctgacttaaggctaaagatt

SEQ ID NO: 46872 - DNA, 201 bp, Homo sapiens
aggcagtccttccgaagattgtccaatttagacccagactcttcaaaggaaatgtcagcatgttttgatgtcatggttcaaaacctcactgggatggtttrtgtgagtacatacctgttttacttttagtttcactagaggatgtcatttggactagttgtttttaagtgaacatttcaaacttaactaaatttgattcct

SEQ ID NO: 46873 - DNA, 201 bp, Homo sapiens
tgtgctgaggatgcatggaaaccctggaccattgcagttcatataaggatttcttttctacgtttaaactgtggtgtagacagtatgccagctattttcargttttattattactttttaaatttataggttagcataatttaaagtgtcaggaaacaaaccttttagatttaatctagaaattctggaccatcattcttt

SEQ ID NO: 46874 - DNA, 201 bp, Homo sapiens
attttcagtagcgacggggtttcaccatgttggccaggctggtttcaaactcctgcccccaggtaatccgcctgtctcggcctcccaaagtgctgggcttscgcacccggcctgtgcttttcaactcacacatgtgtgcacatatatgtttgtgtgatcagaattacatttaatttcatagataggactgatttcattaat

SEQ ID NO: 46875 - DNA, 201 bp, Homo sapiens
cacattctgaggttccagatagacatgaattttggaggacattattgaactcactgtagtagtcaaaagctgtgaaaatgccttttcacaggaaaagaaayagaaatgattaatagagaaatagaaatgattaatatcaaaaatatgcttaagactgggtgcagtggctcacacctgtaatcccagcactttgggaggccg

SEQ ID NO: 46876 - DNA, 201 bp, Homo sapiens; identical to SEQ ID NO: 13251

SEQ ID NO: 46877 - DNA, 201 bp, Homo sapiens
tccctattctgccgcaaaaccactgtgggtgcctgcagagttgggccttagaaacatgccgaggaaagcaagctcctgggggagaggagcaaccacgttcygaggacgagcttccctcgggtgggccgctgccctcctcagccctcagacccgccagtcagactctggctctcagcaaatccctccccagttccttcagca

SEQ ID NO: 46878 - DNA, 201 bp, Homo sapiens
agaaaatagaatgtttgagcgggttcacaaagactgatcctcagctgggcgcggtggctcatgcctgtaatcctagcactttgggaggccgaggcgggcarattgcctgagctcgggagttcgagaccagcctgggcaacacggtgaaaccccgtctctactaaaatacaaaaaattagctaggagtggtggtgtgcgcct

SEQ ID NO: 46879 - DNA, 201 bp, Homo sapiens
caacctcctgggctcaagtgatcctcccacctcagcctcccaagtagctggaactacaggtgcaagccaccacactggataatttttgtattttttgtagygacagggttttgctatatcgcccaggctggtcttgaactcctggcctcaagtaatcatcctgccccagcatcccaaagtgctgggactacaggcatgaga

SEQ ID NO: 46880 - DNA, 201 bp, Homo sapiens
tttgcggagtaaaatcctaggaaagtgaagttatattttgcccatgagacattgcaagttttgtattccttagtaaatacatacttgttttaaaataagayggtgattgcttcaaaagatgtctcttgacttggccaactgtgccgaatatgaaaaggacacccatctttaggctggctaccctttagatggacagcatcg

SEQ ID NO: 46881 - DNA, 201 bp, Homo sapiens
gagacattgcaagttttgtattccttagtaaatacatacttgttttaaaataagacggtgattgcttcaaaagatgtctcttgacttggccaactgtgccraatatgaaaaggacacccatctttaggctggctaccctttagatggacagcatcgggagtcagctctttatcacatctggttttgtgccgagatgccctc

SEQ ID NO: 46882 - DNA, 201 bp, Homo sapiens
gggccatcacctttgtgaccattggtccccacgcattggtggttttagagcgtacatcgttggagaggcacacatcggatctggcacagagcttagggtcytctggggtggagaccaccaccccaatggatagacagagacactcgttaatagatgggggatcaagatgccctttgtaaaaatcttgtgagaaagaaaccc

SEQ ID NO: 46883 - DNA, 201 bp, Homo sapiens
ctggcacagagcttagggtcttctggggtggagaccaccaccccaatggatagacagagacactcgttaatagatgggggatcaagatgccctttgtaaamatcttgtgagaaagaaaccctcgttggagttacccttgaacttttcatctttgagaccaggtgttaatttgtctttgggagctaattatctttcagaaag

SEQ ID NO: 46884 - DNA, 201 bp, Homo sapiens
ttttgtattctcgtcacgctctcattatgttggcagagctgttcaaactgcagggtgtggcccctgggtggatgtgaaataatttagtaggttgtgaccarcattgtttatatttatggggtacagtgtaatgttttggtatatacacacacacattgcggaataattaaatcgagctaattaacatatccatcacatcac

SEQ ID NO: 46885 - DNA, 201 bp, Homo sapiens
ttttgtccagaaacatttctagatgattgtaagtcatgcctgtgtaatgaagccaccataaaaactcaaggacaggccgggcatggttgctcacgcctgtwatcccagcactttgggaggctgaggcgggcggatcacctgaggtcaggagtttgagaccagcctggtcaacatggtgaaaccccatctctactaaaaata

SEQ ID NO: 46886 - DNA, 201 bp, Homo sapiens
tagagtgactttcttaaagctctgtgtctcctggaaatggaatgtatcccaaatgaggattatttttaagctttataataaaatctttcacagcatagacttttttttttttttttttttgagacggagtcttgctctgttgcccaggctggagttcaggggcgcaatctcggctcactgcaagcgccgcctcccaggttc

SEQ ID NO: 46887 - DNA, 201 bp, Homo sapiens
ttttttttttttttttttgagacggagtcttgctctgttgcccaggctggagttcaggggcgcaatctcggctcactgcaagcgccgcctcccaggttcaygctattctcctgtctgtctcctgagtagctgggaccacaggcgctcgccaccacacccggctaattttttgtatttttagtagagatggggtttcaccat

SEQ ID NO: 46888 - DNA, 201 bp, Homo sapiens
aggaaattccatactgctctccatagtggctgtactagtttacattcctaccaatagtgtgtaagagttgccttttctcaggccgggcgtggtggctcacrcctgtaatcccagcactttgggaggccgaggggggcggatcacgaggtcaggagatcgagaccatcttggctaacacggtgaaaccctgtctttactaaa

SEQ ID NO: 46889 - DNA, 201 bp, Homo sapiens
gatgcattttgatgtaggtaggtacctttacattttaaaaatttatttgctttctgaaatgggaccagcatatatatatatatatatatatatatatatattttttttttttttttttttttttttgacaggttcttgctctgtcacccaggccagagcacagtggtgcaatcacagcgcactgcagtgcagcctcaatct

SEQ ID NO: 46890 - DNA, 201 bp, Homo sapiens
atgtctgtggtttttagtatattcacagagttgtgcagccattgcctactttggacattctatggaaatgcggttgacaggatgtgttttctgtgtgcagcctcagcctctgtcactaagcaccatattttcattcatattgtgcatgtatgcatcggttgttccttgttaatgtcgaatattattccattgtgtggatgt

SEQ ID NO: 46891 - DNA, 201 bp, Homo sapiens
aacggaatgcagccagacactgaggccactaggtcaggtccttgggatgacagagggtagatttctttgttcttagacctaagttggcccttgttgggtgraggtggtggcgtgagagccttccctgccttctccaggttgaaggatatttctgtgcatctgggataggtctctagggttgagacgacaagcttctcaagg

SEQ ID NO: 46892 - DNA, 201 bp, Homo sapiens
agcagctccacaagcctacccccactacccacctccaccagcccgggtaaccaccattccctgcttctgtgagcttgacttttttagatcccacgtctaartgagagtgcatcgtgtttgcctttctgtgcctggcttatttcagttagcataacatcctccagggactagtattttcttaaatgaaatggaataaaaaaa

SEQ ID NO: 46893 - DNA, 201 bp, Homo sapiens
aaacacaatgaaacattagattgtattagaaaaggcacaagtcattagcattaaatcaagccaaataaagtacaatgtttcttaaaacaccaagcctccckctggaagcccctagcattttgctgagggcccagtgatgtgtcagtcatcagactggccaaggcgactggtcaggccactgctgcggggccctggccatcc

SEQ ID NO: 46894 - DNA, 201 bp, Homo sapiens
cgtctctactaaaaatagaaaaattagctgggcgcagtggcaggcatctgtaatcccagctactcgggaggctgaggcagaagaatcacttgaacccaggyggcagaggttgcagtgagcaaagattgcgccattgcactcgagactgggtgacagagcaagactgtctcaaagaaaaaaaagaagatagcataggtgcga

SEQ ID NO: 46895 - DNA, 201 bp, Homo sapiens
ctcgggaggctgaggcagaagaatcacttgaacccaggcggcagaggttgcagtgagcaaagattgcgccattgcactcgagactgggtgacagagcaagrctgtctcaaagaaaaaaaagaagatagcataggtgcgagcatgacccaggcttctggtgtcagtggactagatgaactggtggttcttacagtcaggggg

SEQ ID NO: 46896 - DNA, 201 bp, Homo sapiens
gcacaatcgcggggaggggtggctcggtgccatccccctcttaacctcgggggcctgaggctcagcgtgaggcgcagcttgtcttgggccaccctgcctgrgactcatgcttcatttcggggtttgctaagttacaaagggcgtctctcagacctctgttgatcaggttttcattaactttcccctgccactcgcgagcac

SEQ ID NO: 46897 - DNA, 201 bp, Homo sapiens
taacctcgggggcctgaggctcagcgtgaggcgcagcttgtcttgggccaccctgcctgggactcatgcttcatttcggggtttgctaagttacaaagggygtctctcagacctctgttgatcaggttttcattaactttcccctgccactcgcgagcacccctgccagctcagtgtgcgtgttagaaggtggagatgcga

SEQ ID NO: 46898 - DNA, 201 bp, Homo sapiens
tctgaggaatttaataacattttgtggtcattgctggaatcttcctagactcctttgatggaaagtagggactccaaggggaactcctgactgggcttgcrggctgccttctcagagccctactttattagtgatttatttctcttaatgggctattagaaatgaccacaaaaactgaggcccccacccatacaatttcta

SEQ ID NO: 46899 - DNA, 201 bp, Homo sapiens; identical to SEQ ID NO: 13241

SEQ ID NO: 46900 - DNA, 201 bp, Homo sapiens
tcccgacagaactcctctttcctaaaatggagtcgagtaaaaagatggactctcctggcgcgctgcagactaacccgccgctaaagctgcacactgaccgyagtgctgggacgccagtttttgtccctgaacaaggaggttacaaggaaaagtttgtgaagaccgtggaggacaagtacaagtgtgagaagtgccacctgg

SEQ ID NO: 46901 - DNA, 201 bp, Homo sapiens; identical to SEQ ID NO: 13244

SEQ ID NO: 46902 - DNA, 201 bp, Homo sapiens
ggtgcacataaggaggcagcgtgaggtggggtggtggctaagggcgtgagtgctggtggcaggctgcctggtctgagtgaccctgggtcttgggcagttamcttccgtgtgtctcagttcttttacctagaaataaggataatggtacttaccccctggagtgtgagatggaaagcatttagcataggtaagctcagtaaa

SEQ ID NO: 46903 - DNA, 201 bp, Homo sapiens; identical to SEQ ID NO: 13246

SEQ ID NO: 46904 - DNA, 201 bp, Homo sapiens
aagtaatcatcctgccccagcatcccaaagtgctgggactacaggcatgagacatcacacctaaccctgttcttgatacctggtttttgtggtcctttttwtctaaaattcatatgaattttgagttctgctgtatgatatgtaatatatatgttctaatattacaaacttctaaaaatctttctgtgcaccaaaattgat

SEQ ID NO: 46905 - DNA, 201 bp, Homo sapiens
gtctcattatcagacattttactctggacaccccatcaccagtcccatcatgggggagtttggaggccaggagattcactggatgcttcttttctagtgtrtgctcttcttagatgggaaggaaaaaggtaaaacctcaaaaactctgtggtaaactgatgtgggaatctgatactaaaaatgtcccaagtgatttaaagt

SEQ ID NO: 46906 - DNA, 201 bp, Homo sapiens
tgtctgtggtttttagtatattcacagagttgtgcagccattgcctactttggacattctatggaaatgcggttgacaggatgtgttttctgtgtgcagcctcagcctctgtcactaagcaccatattttcattcatattgtgcatgtatgcatcggttgttccttgttaatgtcgaatattattccattgtgtggatgtt

SEQ ID NO: 46907 - DNA, 201 bp, Homo sapiens
caccctgttttcccacgtccctggtccccagcccaggcaagccttctgctgatgccggtggccccaacttgtctatccacttcaccccagttttctccagrcctttctccatgctgctgtcagagagatctaaacataggtggcctcctgcccttccctgaaaaccctttacggcctctgactgcattcagtgcaccctgc

SEQ ID NO: 46908 - DNA, 201 bp, Homo sapiens
tctgtggtttttagtatattcacagagttgtgcagccattgcctactttggacattctatggaaatgcggttgacaggatgtgttttctgtgtgcagcctcagcctctgtcactaagcaccatattttcattcatattgtgcatgtatgcatcggttgttccttgttaatgtcgaatattattccattgtgtggatgttcc

SEQ ID NO: 46909 - DNA, 201 bp, Homo sapiens
ctgtggtttttagtatattcacagagttgtgcagccattgcctactttggacattctatggaaatgcggttgacaggatgtgttttctgtgtgcagcctcagcctctgtcactaagcaccatattttcattcatattgtgcatgtatgcatcggttgttccttgttaatgtcgaatattattccattgtgtggatgttcca

SEQ ID NO: 46910 - DNA, 201 bp, Homo sapiens
tgtggtttttagtatattcacagagttgtgcagccattgcctactttggacattctatggaaatgcggttgacaggatgtgttttctgtgtgcagcctcagcctctgtcactaagcaccatattttcattcatattgtgcatgtatgcatcggttgttccttgttaatgtcgaatattattccattgtgtggatgttccac

SEQ ID NO: 46911 - DNA, 201 bp, Homo sapiens
gtggtttttagtatattcacagagttgtgcagccattgcctactttggacattctatggaaatgcggttgacaggatgtgttttctgtgtgcagcctcagyctctgtcactaagcaccatattttcattcatattgtgcatgtatgcatcggttgttccttgttaatgtcgaatattattccattgtgtggatgttccaca

SEQ ID NO: 46912 - DNA, 201 bp, Homo sapiens
gtcagaatcagacctaggatcagaaacctggctcctggctcctggctccctactcttctaaggatcgctgtcctgacagaagaggtttgctctcagttaaktgatgttgttgttgttttgctttccttttgtcagaaagaggcctgtaataacaacaggcatctaatttagactctgtaatttagaattttaaaaattctt

SEQ ID NO: 46913 - DNA, 201 bp, Homo sapiens
gactgaaatgtaaaacccaaaactataaaaaccctgcaagacaacctaggcaataccattctggacacaggaactgacaaaggtttcatgaagaaaacacmaaaagcaattgcaacaaaagcaaaaattgacaaatgggatctaattaaacttaagagcttctatacagcaaaagaaattatcgacagagtaaacatacat

SEQ ID NO: 46914 - DNA, 201 bp, Homo sapiens
ggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaag

SEQ ID NO: 46915 - DNA, 201 bp, Homo sapiens
atgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagcc

SEQ ID NO: 46916 - DNA, 201 bp, Homo sapiens
ttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagccatcctcccg

SEQ ID NO: 46917 - DNA, 201 bp, Homo sapiens
cagccagcgcgatgtgccgatgaatggggaatgtcagctggaggcttgagggattgcagaaactggattccttttttttttttggagacggagtttcactygtcacccaggctggagtgcagtggcgcaatcttggctcaccacaacctctgcctcctgggttcaagcaactctcctgcctcagcctcccaagtagctggg

SEQ ID NO: 46918 - DNA, 201 bp, Homo sapiens
caggagatcgagaccacggtgaaaccccgtctctactaaaaatacaaaaaattagccgggcgcagtggcgggcgcctgtagtcccagctactcgggaggcygaggcaggagaatggcgtaaacccggaaggcggagcttgcagtgagcggagatcgcgccacggcactcccgcctgggcgacagaacgagactccgtgtct

SEQ ID NO: 46919 - DNA, 201 bp, Homo sapiens
tgccacctggtgctgtgcagcccgaagcagaccgagtgtgggcaccgcttctgcgagagctgcatggcggccctgctgaggtaggcgccctcgcccggccygtcgcccggccccttctcagccctcggcctcaccctctccttcattcgtttctctaaaaataaacctctagaggtttaaagccctaaagaagtccataaa

SEQ ID NO: 46920 - DNA, 201 bp, Homo sapiens
ttcttacggcacaagtcagtgagcctgtctttgttgaggtagtcgcggtgtgataacagacatagtagttaagaacactgactcgaggtagaccgctgtgccgcttagtaacgtatcgtgttgtgaagctgctgaatcttcgtactctagtttcctcatctctataacaggcaaatttgtaattgtgacaaataataacta

SEQ ID NO: 46921 - DNA, 201 bp, Homo sapiens
tggaagaacaaaaacacagaaggagacagtcgttgcggctggagcagagtttgcaagtccactcctggtgagggaggggatgctgagccagcagggcaggktctactcacacccagaggctggctcggaagcagcagatgtaaagggaagtgtgtattggagggggtatgttgtgaatttgatgacgtctgattgttacat

SEQ ID NO: 46922 - DNA, 201 bp, Homo sapiens; identical to SEQ ID NO: 13248

SEQ ID NO: 46923 - DNA, 201 bp, Homo sapiens
gaaagaaaataatatttgatgggaaaaatttttatttatatatattttggagacaggatctcactctagtgtccaggctggagtgcagtgggtgtgatctyggctcactgcaatctctgtctcccgggctcaagcagtcctcctgcctcagcctccctagtagctgggactataagcgtgtgccaccatacccagctaatt

SEQ ID NO: 46924 - DNA, 201 bp, Homo sapiens; identical to SEQ ID NO: 13249

SEQ ID NO: 46925 - DNA, 201 bp, Homo sapiens
gggtttcaccgtgttagccaggatggtcttgatctcctgacctcgtgatctgcccgcctcggcctcccaaagtgctgggattacaggtgtgagccactgckcccagccaaaaaaagttttgaatttgctgggtgtggtggcacatgcttgtaatcccagctactggggaggctgaggtgggaggatctcttgagcccagga

SEQ ID NO: 46926 - DNA, 201 bp, Homo sapiens; identical to SEQ ID NO: 13250

SEQ ID NO: 46927 - DNA, 201 bp, Homo sapiens
aggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaatactattataccgctgttcagttagcaggaattaaaaagtttggcaattgttgttgaaaaagttaagcaacaga

SEQ ID NO: 46928 - DNA, 201 bp, Homo sapiens
ggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaatactattataccgctgttcagttagcaggaattaaaaagtttggcaattgttgttgaaaaagttaagcaacagaa

SEQ ID NO: 46929 - DNA, 201 bp, Homo sapiens
tggctttagcaatttcattcttcagcagatgtatttgactttctatatacatggcactttggtttggtttgtgtctgaccttatttttatttttcattttktttcaaaccagtattaaactgaaaataatagacgtcatacctcatggcccaggaatgagtgaataagttggaaaaccaagagtagtggcctgcatctctt

SEQ ID NO: 46930 - DNA, 201 bp, Homo sapiens
caggaagtgggaggggagggcacagagagtcactttggccacgtccctggtttgccacaggctgatactggagcattcctaagtttcgcaatggagatggrtgtgaaagaagaacacactaggccaggtgcggtggctcacacctgtaatcccagcactttgggaggctgagacaggcgaatcacctgaggtcaggagttt

SEQ ID NO: 46931 - DNA, 201 bp, Homo sapiens
tgaggcagcagaattgcttgggcccgggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactc

SEQ ID NO: 46932 - DNA, 201 bp, Homo sapiens
tccggcccttccggcagaactgggaggaagcagacagcatgaagagcagcgtggagtccctccagaaccgcgtgaccgagctggagagcgtggacaagagygcggggcaagtggctcggaacacaggtgaggcaggggccggggccgggccagcagtgtgcatctgggccccgggcgagtgctggggcggggtccgtggga

SEQ ID NO: 46933 - DNA, 201 bp, Homo sapiens
ctgtagatatgcaggttaattcctgggttttctattcttttccattggtctgtgtatctgtttttatagacacataccagttgttttatagaccagtaccrtgtcgttttgcttactacagctttgtagtatattttaaggtttggtagtgtgatacctccagctctgttcttcttgctcagcattgctttggctatttgg

SEQ ID NO: 46934 - DNA, 201 bp, Homo sapiens; identical to SEQ ID NO: 13240

SEQ ID NO: 46935 - DNA, 201 bp, Homo sapiens
gtcttacttttgtgttgcccaggctgcagtgcagtagtgcaaacatggctcactgcagcctcacctcctgggctcaagtgattcccacctcagccccccaratagctgggactacaggtgtgcaccaccacacccagctattttttgtatttttttgtagagatggggttttttactgtgttgcccaggcatgtcttgaac

SEQ ID NO: 46936 - DNA, 201 bp, Homo sapiens; identical to SEQ ID NO: 13242

SEQ ID NO: 46937 - DNA, 201 bp, Homo sapiens
ttgggaggattgcctgagcccaggagttcaaggctgcagcaagtcacgttcacaccactgcactccatccagcctgggcaacagagtaaaaccctgtctcmcaaaaaaaaaaaaaaaaaaaaaaaattacagccatcctagtgggtgtgaagtgggaactcactgtggttttgatttgtattttcttttttaagtgaaagc

SEQ ID NO: 46938 - DNA, 201 bp, Homo sapiens
tgctcagcagggactgttcagcgtggctccatctctggctcttcctcatcagtctctccccaggggccctgcagttgatgtccttgtggggagtccttgcycttgctctgctcatggacaggcacccagcaggtgcccatgggatagggcttaatagtcgccatcatccagccttagcaaaggtgaagtttgtgctattag

SEQ ID NO: 46939 - DNA, 201 bp, Homo sapiens
aaaccattgcctaatccaaggtcgtgaagatttacatctttcttctaagaattatatagttttagttcttttctgctgtgatcatgtgtgtatgtgttggktttttatttttatttttttgagactgggtcttgctgtattgccaggctggagtgcagtgcttatccatagccatgatcatagtgtactgcagccttgaac

SEQ ID NO: 46940 - DNA, 201 bp, Homo sapiens
gtctcacccaagtgagtatttaaccttaaagagtttgagattcacttgcctattttgttatccataatagagcttttgcagctgctccaaatatccctccrtttgtgcatcttaatagttgtttggcaatcaccttattctgcactgggaaggctggagaggggtggggagctgcggggtgtctggaggcagtatggcgag

SEQ ID NO: 46941 - DNA, 201 bp, Homo sapiens
agtgtggcctttaaatactcagggttttgtggccgggcacggtggctcacgcctgtaatcccagcactttgggagcccgaggcaggcagatcatgaggtcrggagttcgagaccagcctggccaatatggtgaaacccagtctctactaaaaatataaaaattagccgggtgtggtggcgtgtgcctgtaatcctagctat

SEQ ID NO: 46942 - DNA, 201 bp, Homo sapiens
gcaagtcacgttcacaccactgcactccatccagcctgggcaacagagtaaaaccctgtctcacaaaaaaaaaaaaaaaaaaaaaaaattacagccatccyagtgggtgtgaagtgggaactcactgtggttttgatttgtattttcttttttaagtgaaagcaagtttattaagaaagcaaaggaataaagaatggctat

SEQ ID NO: 46943 - DNA, 201 bp, Homo sapiens
tcttttccccactgaaagtgaatggtttgcatcattggaaaccccaggacataccagagcagcctgcccacacacagtgcagcagtttctcactctgtcartgcctcatgtgtttaaactatctccagccaagtcacgatggaagccccgagagtgcaggatgcataactgtgcacttccctcttggacgttgccaaagga

SEQ ID NO: 46944 - DNA, 201 bp, Homo sapiens
ccagggagctcccaggaggcctgatgcagagccccactcctggagtcagagccgcgggtggcaggcctcatacaggggcctctgactgttctgctcctagsctgtctgtatttgatggaaggtggtgcagcattttccgagtcctaactgtgttttgctttttaacacctttggtttggaagcgagtgatagacagccaag

SEQ ID NO: 46945 - DNA, 201 bp, Homo sapiens
cctgtaatcccagctactcaagaggctgaggcaggagaatggcctgaacctgggaggctgaggttgcagtgagccgagatcatgccattgcactccagtcygggcaacagagcgagactccgtctcaaaaataaaggaaagaaagaaaggagggaaggaaaggaaggaaggaaggaaggaaagaaggaaggaaggaaggaa

SEQ ID NO: 46946 - DNA, 201 bp, Homo sapiens
ccttccgctgagttcataaataatccattccacaggccttctgctcaattaatatatacttcttccactgtacagcttcttaaagactattctaataggamtaaagagaaaagataggaataaatagcactttttatctgactttatttcagaattaagctttgttttgcctattttgatttatgtagttaacattttcca

SEQ ID NO: 46947 - DNA, 201 bp, Homo sapiens
cctgccggcacaagcacttgatcccagggagctcccaggaggcctgatgcagagccccactcctggagtcagagccgcgggtggcaggcctcatacagggrcctctgactgttctgctcctagcctgtctgtatttgatggaaggtggtgcagcattttccgagtcctaactgtgttttgctttttaacacctttggtttg

SEQ ID NO: 46948 - DNA, 201 bp, Homo sapiens
tcgaaataatgaatccaaaatccttcatttacaggtaagaatcttaggactacggccagatcaaagggtggaggagcttgcctgtgttccccttaagggtktcttagcaaactctttgagctgagtccttgacctttgcaagcagaaaggcaactgatttctctggcctaagtgaaggcttagaaaaggcagctggactag

SEQ ID NO: 46949 - DNA, 201 bp, Homo sapiens
agtgagacattgttctgatggatcttgtagatttttgaacatggttttctttagttctttgaacatatttaaaatagcatatttaaagtcttcatccatamgtctaatgcctgggcttcctcttaaacaatttctgttagttgccttttttctgcatgtgaaccatactttcttgtttctttgcatgccttgtgatatttt

SEQ ID NO: 46950 - DNA, 201 bp, Homo sapiens
cgtatatgtgtatacacgtgactagaccgtatatttactgcatagaagtctaggcagcagatgatatatacacacctgtagcgataaacaccattcttaayagtacagctcagatgctatctgtgccctaatatgtttgaacattttcatgcaaacgtttgtgccacaactcacgtctctttcccgttgcagttgagtgca

SEQ ID NO: 46951 - DNA, 201 bp, Homo sapiens
caggcgttagccactgcacccggcctaagaacctctattctaatgtcacaatctccaaagttattagaaacctgcatccaagagcacctgttgaagtcctataatagctgactataaaccaccttttgaagaggatcaacacagcagttgtctgtggttgacagaaagtcttaaggcagccactattaaaggcacaattga

SEQ ID NO: 46952 - DNA, 201 bp, Homo sapiens
aggcgttagccactgcacccggcctaagaacctctattctaatgtcacaatctccaaagttattagaaacctgcatccaagagcacctgttgaagtcctataatagctgactataaaccaccttttgaagaggatcaacacagcagttgtctgtggttgacagaaagtcttaaggcagccactattaaaggcacaattgac

SEQ ID NO: 46953 - DNA, 201 bp, Homo sapiens
ggcgttagccactgcacccggcctaagaacctctattctaatgtcacaatctccaaagttattagaaacctgcatccaagagcacctgttgaagtcctataatagctgactataaaccaccttttgaagaggatcaacacagcagttgtctgtggttgacagaaagtcttaaggcagccactattaaaggcacaattgact

SEQ ID NO: 46954 - DNA, 201 bp, Homo sapiens
ttcttttaaaagattaatttttcacaaaatttccacaacttttgcaaaccttcagctttatcctaacttaaaacaatcccttaaccctttaatttaggccaaaaaaaaaaaaaatccacattcacatgtctccttctcttttaccaaaaacacatttcactttccctacacaccttgcatgtaaaactgtttttccagtag

SEQ ID NO: 46955 - DNA, 201 bp, Homo sapiens
tggaggagaagattccagagcctgagatgtgaagtaggttaggtagccagagacaaggcaaagaagggccattttcatcagagaacagcataacattggcrgaggtctgacatgtcatttcctgttactagaattggggagtgaccagtagattctttaatttgtttattcattcgtgcagtccttcacctcacacctgtt

SEQ ID NO: 46956 - DNA, 201 bp, Homo sapiens
gaaggtggctgggtgttcagtgattgctgcccacagaggacctggaagtgcttgctgtacttggttttctggaatggaaatcatggctcattcccaggagyccctcagcaggggctttgagtctggtgctaagcagcagatgtgcagattcccgcagggcgtacctgagcccggagagggggcgtcgtagcgcacagcgca

SEQ ID NO: 46957 - DNA, 201 bp, Homo sapiens
gactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattct

SEQ ID NO: 46958 - DNA, 201 bp, Homo sapiens
aaaattaaaagttgaaaggttttttcttcttcttttttttttttttaaagaaatgggggtctcccactgtcgcccagtctggagtgcagcagtgcgatcayggctcactgcatcctctacctgccaggctaaagcagtcctcttgcctcagcctcctgagtagctgagactgcaggcgcatatgctgccttgcccagctaa

SEQ ID NO: 46959 - DNA, 201 bp, Homo sapiens
cagggtcccctgcagccaccacagcgccctgctcagtccctccccatccttcaaggcactgcatggggccacatccagaacagatgccatcggtccccacrtgtggcccactgagcagggaggagtggacctaggagcagcaccccagggtcctccctcagggtctcagggcctctcctgagggtcccttgccagcgcagc

SEQ ID NO: 46960 - DNA, 201 bp, Homo sapiens
aggcggaggtaaaacatttttcaaagaaaagggtaagataggctcttggtttaccacatggtgaagagaggcctctggctcttccaaactgttgcagatasagcgtggagtgctgggacttcggtcaggccaggtcctgccgcctcactgtccagctctcctgagtgctcctggtctgccttgctctctgcccagtgctgc

SEQ ID NO: 46961 - DNA, 201 bp, Homo sapiens
taaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgttt

SEQ ID NO: 46962 - DNA, 201 bp, Homo sapiens
ctcttagcagtgtttatttttagtgaaaaacttggtaagcaattttaattatgtactaggtatggagcctaggacaccaggcagaagtgcagataaggtckgacacttactagcatagctaggaggcatggctaactccacatgtccctaggccttacctagaatctaatggctgtaggtaagtttaacaattttcaaaag

SEQ ID NO: 46963 - DNA, 201 bp, Homo sapiens
gagactgcgccactgcactccagcctgggtgacagagcgagactccgtctcaaaaaaaaaaaaaaaaaaaaaggaaattggaccccttccctacaccatgyacaaaaatcaacaaaagatggattaaagactgaaatgtaaaacccaaaactataaaaaccctgcaagacaacctaggcaataccattctggacacaggaa

SEQ ID NO: 46964 - DNA, 201 bp, Homo sapiens
gcatggaagagtcataataactgacttcagatacagagaaagtgggaagagtgagaaagaaggaggtgaggccagaggatttggaaggctaccagagagargcagccgaggcctgattgtggaaatgatgcttagacttgctttcagcaggagtgatgaagccagaatgagggaggcccagacgcccgggagaggtacagg

SEQ ID NO: 46965 - DNA, 201 bp, Homo sapiens
gccaccgcaccctgtcttggctctaaaatttaaaaaaagtcctttccccaacctactcctctgtcatccatgtttaaatgacctaagtctccttaattctyaagatctgaaaaattgggggccctacatttcatttcacaatttacttttttactacgatttgttccatgctgatttcgagcattaaaaaaaaaaaaaatt

SEQ ID NO: 46966 - DNA, 201 bp, Homo sapiens
cgcaccctgtcttggctctaaaatttaaaaaaagtcctttccccaacctactcctctgtcatccatgtttaaatgacctaagtctccttaattcttaagawctgaaaaattgggggccctacatttcatttcacaatttacttttttactacgatttgttccatgctgatttcgagcattaaaaaaaaaaaaaattaaatg

SEQ ID NO: 46967 - DNA, 201 bp, Homo sapiens
atttgtccttcccagtcactgacattctgccatgagagaaagttattatattaacattttaacatgcaagctctggactccttattctttgtcatgaaacygaaacaccctgttgcatgggtgacgaaagccacatgcagcaggtgggatgctcgctttccagttggtggtgctttgagacttcagggagacactgtgctg

SEQ ID NO: 46968 - DNA, 201 bp, Homo sapiens
caagtgggactgaactaaactgttctacttggtaacttccttttgaaaaatcagcattttaaaaaatgtagcccttttctcccatggcttcctatgtaaartgaatcaccagggcgtcctgaagctctgctggttgctgtgagccactgtgcagacctgaccataaagtgaatgctcccagaatctcctgagtcctctcaa

SEQ ID NO: 46969 - DNA, 201 bp, Homo sapiens
gactttttgttaaagccaagcccagccatgggtttgtaccctcaaataacctgtgagttgggaaattcctctcctcttgaggtcccaagatggcgtggggytcctgggcctgtcggaaagtgacattctttactaaccacaggtcaggaaccctgcacaggaactgtgtagacaaggtatgaggccagttttcccaaggaa

SEQ ID NO: 46970 - DNA, 201 bp, Homo sapiens
aaataaaatttcacttttacattaagtggaaggggctttccaagtgggactgaactaaactgttctacttggtaacttccttttgaaaaatcagcattttraaaaatgtagcccttttctcccatggcttcctatgtaaagtgaatcaccagggcgtcctgaagctctgctggttgctgtgagccactgtgcagacctgac

SEQ ID NO: 46971 - DNA, 201 bp, Homo sapiens
aaacttcattccataaaaggaagcttagataagactttttgttaaagccaagcccagccatgggtttgtaccctcaaataacctgtgagttgggaaattcytctcctcttgaggtcccaagatggcgtggggttcctgggcctgtcggaaagtgacattctttactaaccacaggtcaggaaccctgcacaggaactgtgt

SEQ ID NO: 46972 - DNA, 201 bp, Homo sapiens; identical to SEQ ID NO: 13247

SEQ ID NO: 46973 - DNA, 201 bp, Homo sapiens
ccatctctactaaaaatacaaaaaaattagctgggcatggtggcacactcctgtaacctcaggcaattgggaggctgaggcagcagaattgcttgggcccsggaggcggaggttgcagtgagccgagattgcggcactgtactctagcctgggcgacagaggcaagactccgtctaaaaaaaaaaaaaaaagaatgttatg

SEQ ID NO: 46974 - DNA, 201 bp, Homo sapiens
gtcctcctccttcctcccattgtccatggatggagaagggaccaacggttcctccggggctgagctctcgtctcctggtgctcctgcttccctaccccccmacccccaggccagggctgcagcctgaaggggcactgggtccctgcgccctgtgagatgggcgctgccacccttgctctgcaggtgacgaatggaggcgaa

SEQ ID NO: 46975 - DNA, 201 bp, Homo sapiens
tcacactgaagagctgctctgcagacagctagctttggtttctgaaataaaatttcacttttacattaagtggaaggggctttccaagtgggactgaactmaactgttctacttggtaacttccttttgaaaaatcagcattttaaaaaatgtagcccttttctcccatggcttcctatgtaaagtgaatcaccagggcgt

SEQ ID NO: 46976 - DNA, 201 bp, Homo sapiens
ttacatatgttaatatgttgccatctcatgccagtcagaatggcgattattaaaaagtcaaaaaacaacagatgctggcaaggttgcagagaaaaaggaaygcttttacactgttggtgggagtgtaaattagttcaaccattgtggaagacagtgtgacgattcctcaaagatctagaggcagaaataacatttgaccaa

SEQ ID NO: 46977 - DNA, 201 bp, Homo sapiens
acaaaaagttagccgggcatggtggcgggcgcctgtagtcccagctactcgggaggctgaggcaggagaatggtgtgaacccgggaggcggagcttgcagygagccgagattgtgccactgcactccagcctgggcgacagagcgagactccatctcaaaaaaaaaaaaaaaaaaagagccaggcacggtggctcacgcct

SEQ ID NO: 46978 - DNA, 201 bp, Homo sapiens
tgaggcaggagaatggtgtgaacccgggaggcggagcttgcagcgagccgagattgtgccactgcactccagcctgggcgacagagcgagactccatctcaaaaaaaaaaaaaaaaaaagagccaggcacggtggctcacgcctgtaatcccagcactttgggagatcgaggcaggtggatcacctgaggtcagaagttcg

SEQ ID NO: 46979 - DNA, 201 bp, Homo sapiens
gaggcaggagaatggtgtgaacccgggaggcggagcttgcagcgagccgagattgtgccactgcactccagcctgggcgacagagcgagactccatctcaaaaaaaaaaaaaaaaaaagagccaggcacggtggctcacgcctgtaatcccagcactttgggagatcgaggcaggtggatcacctgaggtcagaagttcga

SEQ ID NO: 46980 - DNA, 201 bp, Homo sapiens
tcaattttcatattagagtagctagaaattaagcaagtaatttgtgtgtgtgtgtgtgtgtgtgtgttttttttgggggggggtgaaggtcttgctctgtygcccaggctggactgcagtggtataatgacagctcgctatagcctcaacctcctggacttaagccatcctcccgcctcagcctcccgagtagctgggacc

SEQ ID NO: 46981 - DNA, 201 bp, Homo sapiens
catctgtttcttactatgttacctggtcaacaattgaaaaatactctgataaaagatttgctagtttttagcaaaaacttgaaaaagcatctgatttattytgaaattcaatcagccgctgcactttgcctcaccctaattactggaagagattctgagaaacactgtttatagcattccctattaaattaggactggctg

SEQ ID NO: 46982 - DNA, 201 bp, Homo sapiens
gtaggattgggagttcggaacgcctacaaaatgagcaggctaatttcgaacggatgctaatcctgcaaaaccaagagagatgcttattggttgatttgccyttttttttttttttttttttttttttttgaaacagtctcactctgtcacccaggctgtagtgcagtggcgcgatcttcgctcactgcaacctctgcctcc

SEQ ID NO: 46983 - DNA, 201 bp, Homo sapiens
agagggagactccatctcaaaaaaaaaaacccaaaaacaaaaataaatttttaggccaatagacatcagaatttattgccagcagaatggcactaaaggartattaaaggaaattcagatagaaagaaaataatatttgatgggaaaaatttttatttatatatattttggagacaggatctcactctagtgtccaggctg

SEQ ID NO: 46984 - DNA, 201 bp, Homo sapiens
tttcaaggctgtagtaagtcatgatcatgccactgcactctagcctgggtgacagaggtcgaccgtgtctcaaaaaaaaaaaaaaaaaaaaaaaaaaaatmctattataccgctgttcagttagcaggaattaaaaagtttggcaattgttgttgaaaaagttaagcaacagaaactctctcatacccttctgatgggagt

SEQ ID NO: 46985 - DNA, 201 bp, Homo sapiens
gaatgttacggccgggcgtggtggctcatgcctgtaatcccagcactttaggaggccgaggcgggcagatcacctgaggtcaagagttcgagaccagcctygccaacatggtgaaacccccatctctactaaaaatacaaaaaaattagctgggcatggtggcacactcctgtaacctcaggcaattgggaggctgaggca

SEQ ID NO: 46986 - DNA, 201 bp, Homo sapiens
gatcacctgaggtcaagagttcgagaccagcctcgccaacatggtgaaacccccatctctactaaaaatacaaaaaaattagctgggcatggtggcacackcctgtaacctcaggcaattgggaggctgaggcagcagaattgcttgggcccgggaggcggaggttgcagtgagccgagattgcggcactgtactctagcc

SEQ ID NO: 46987 - DNA, 201 bp, Homo sapiens
tgaatcacccacactttctttgagaactttctaagtgctaggggctatgctcgttgctaaagctaaaaagtcagataggatgccgtctgatctctgttttyaaggagcttccatgtgatgaatgagccagaagaataatttcattatggcaccatgtagtaggtgccacaacagtggaacagaggctctggtgcattgtgg

SEQ ID NO: 46988 - DNA, 201 bp, Homo sapiens
gcagatgaggaaaaggaagagcaacaggcctgttggaccccagagttcatggtttcaccacagctgaattacagtgcagttttagattttcttcagattckaaacttcttagttttgctttcagagtagacttagttttgctgctgtagagtgctttttaaacaaattgtgtatttttcatgcagcctttcccttccatcc

SEQ ID NO: 46989 - DNA, 201 bp, Homo sapiens
tgtgtttccctgcagctcttcaagtccaaaatgtacagcgtgtcaagagagcatcgttaaagataaggtattctggggttttttttaatcattttgtcacrtgttttcagctgggtaatacttttcacatagtttgcattcggcactctggcacaacacattctctcagttttggcagctgatgcggcaggctcccaggca

SEQ ID NO: 46990 - DNA, 201 bp, Homo sapiens
gcagccagacactgaggccactaggtcaggtccttgggatgacagagggtagatttctttgttcttagacctaagttggcccttgttgggtggaggtggtrgcgtgagagccttccctgccttctccaggttgaaggatatttctgtgcatctgggataggtctctagggttgagacgacaagcttctcaagggttggctc

SEQ ID NO: 46991 - DNA, 201 bp, Homo sapiens
ttaacggtgtgttcctggaggtcaggcttccatcctcccgttctgataatgcttagctccaggatttgttgcattatgggggttctttgatggaaagtttyatttgacaatgtaattttcttggatgcttttaatgacttaaaagctggaagaacaggaaaactagttctcttgagctctttcatgtccagtaattcccag

SEQ ID NO: 46992 - DNA, 201 bp, Homo sapiens
aacttgtctatccacttcaccccagttttctccaggcctttctccatgctgctgtcagagagatctaaacataggtggcctcctgcccttccctgaaaacmctttacggcctctgactgcattcagtgcaccctgcattcctcctgataaggtcttgcgtctccctgctgccccagcttcagccccaggagcctgcctgcc

SEQ ID NO: 46993 - DNA, 201 bp, Homo sapiens
ctactaaaaatacaaaaaaattagctgggcatggtggcacactcctgtaacctcaggcaattgggaggctgaggcagcagaattgcttgggcccgggaggyggaggttgcagtgagccgagattgcggcactgtactctagcctgggcgacagaggcaagactccgtctaaaaaaaaaaaaaaaagaatgttatgcaacca

SEQ ID NO: 46994 - DNA, 201 bp, Homo sapiens
ctcctcatccagatgcatttggatgatactgttcaaaagtaagataaataattgtactcaattttcatattagagtagctagaaattaagcaagtaatttktgtgtgtgtgtgtgtgtgtgtgttttttttgggggggggtgaaggtcttgctctgttgcccaggctggactgcagtggtataatgacagctcgctatagc

SEQ ID NO: 46995 - DNA, 201 bp, Homo sapiens
agtgcagtagtgcaaacatggctcactgcagcctcacctcctgggctcaagtgattcccacctcagccccccagatagctgggactacaggtgtgcaccaycacacccagctattttttgtatttttttgtagagatggggttttttactgtgttgcccaggcatgtcttgaactactggcttcaagtgatctgcccacct

SEQ ID NO: 46996 - DNA, 201 bp, Homo sapiens
gagaccaccctgggcaacatggtgaaaccccatctctactaaaatacaaaaaattagccaggcgtggtggcaccagcctgtagtcccagctactagggagsctgaggcacgagaatcacttgagcctgagggatggaggttgcagtgagccaagatcatgccaccgcactccagcttgggctacagaatgagactttatct

SEQ ID NO: 46997 - DNA, 201 bp, Homo sapiens
cattccccaatcctcccatcccttgataacctctaatctgcttttggtctctgtggatttgcctattttagatatagcatctaggaatcatataacttgtyttttgtatctggctgctttcacttagcatgatgtttttgaggtacatccaaattgtagcatgtgccagtatttgttcctttttattgctgaatcataatc

SEQ ID NO: 46998 - DNA, 201 bp, Homo sapiens
gcaagtttattatagaagtaaataaaaaagtggctactcaataggcagagcagccgatttgtattttcttaatgatattgatattggacatctttttatgygcttgttgaatatttcagtatcttccttggagaaacgtttatacagatcctttgctcattttaaaattgggttgtctttttgtggttgagttataagagt

SEQ ID NO: 46999 - DNA, 201 bp, Homo sapiens
ccgcgcccggcctagtttttgccagtttttaaaatgtgtatattgaaggatggactttgagttccttactcagccatttttgtggacatgatttactagtyataatttaaattgaatattttaggacatattaaattatgatcagtttcgaggttgccaaatttacgtacaccttacttggttacacaagagatttaagat

SEQ ID NO: 47000 - DNA, 201 bp, Homo sapiens
tttggagggaagacaatgtttgttgagttctttatatattctgaatgttaaactttttttttttcttcttttttttgagaccgagtctccttctgttgccsaggctggagtgcagtggtgcagtggcatgatcttggctcactgcaatctccgcctcctgggttccagcaattctcatgcctcagtctcctgagtaactgg

SEQ ID NO: 47001 - DNA, 201 bp, Homo sapiens
aacctgagacttgtccatcccctggttctggtgcctgttgaggtgtctgtctcctgctttcccaggagccagttcagtcctgtggccacctcattgatatwgaaggtcacggggctgccggctgggctctgctcagggttcgtgtcatttctttcttcagcttttgtttagaaagcatattttccttgagcaatgtctgtc

SEQ ID NO: 47002 - DNA, 201 bp, Homo sapiens
tttcattttcaggtgtttaaggataattgctgcaagagagaaattctggctcttcagatctattgtcggaatgaaagcagaggttgtgcagagcagttaaygctgggacatctgctggtgagtagcaaagggacactggaaccttttacatgaaggaattcgagtcccttacatccagctgatgaagtggtcagtaggatg

SEQ ID NO: 47003 - DNA, 201 bp, Homo sapiens
ccatccttgatcatgtgtttgtcaagtttttcaagtacagctttgggtccatacgttttttcttcctattactagttcattttaaaaatttgttgaaaccytcccttttattttaaataatattgtggggttttaatatttctctctgttcttaaaaaaagcttcattgagaaaatataagtaagcctatatatcctaaag

SEQ ID NO: 47004 - DNA, 201 bp, Homo sapiens
cgcaattcttctgcattggcgattgttgtcaggttgtgagagcaggggaaaaacacaggttgagagagtttttccccaaacagcccctggtcgatgccccrgaatgactggctgctgcatggaattgcagaggcctgagtgcctctgcttctaccgtgattcctgaggccaagacctctggtctgcatggtctgaagtctc

SEQ ID NO: 47005 - DNA, 201 bp, Homo sapiens
aagaagggtaatgagtcttgaggcctacagagggtagtaggcaaggcgggagggcaagggccagggggcagcatcattcacacagttgaaaacgtgccctyggcctgtctcctctctgtgttctgcatcttagaaaatagatattgtcttgtgttaagatgaatcaatatagttacccctttttatattgtcttaagcttc

SEQ ID NO: 47006 - DNA, 201 bp, Homo sapiens
tgggaggagcttagcagacatcagaggacctgcagagagttgacacagcgggaggaaccagctgcactaccactcatgttcttttccatcttagcatctcrtgagcataattcagaatacacagtttgattaagtatgtgcagattccattcagttcatgaattcattcccacagtgtagcctagcccaagtgttagcact

SEQ ID NO: 47007 - DNA, 201 bp, Homo sapiens
agcctagcccaagtgttagcacttctttacttgtttttgttgttgttgttgtttgtttttttgagacggagtttcactctgtcgcccaggctggagtgcartggtgcgatctctgctcgctgcaacctccgtctcccagattcaggcagttcttctgccccagcctcctgtgtagctgggactacaggcacatgccaccat

SEQ ID NO: 47008 - DNA, 201 bp, Homo sapiens
tctttacttgtttttgttgttgttgttgtttgtttttttgagacggagtttcactctgtcgcccaggctggagtgcaatggtgcgatctctgctcgctgcwacctccgtctcccagattcaggcagttcttctgccccagcctcctgtgtagctgggactacaggcacatgccaccatacctggctaatttttgtattttt

SEQ ID NO: 47009 - DNA, 201 bp, Homo sapiens
ttggatatcttggggatgagacttaagtgtaaacacaaaattcttttcatatacaccttatacacatagcctgaaggtaattttatgcaatattcttaaayattttgtgcatgaaacagagttttgactgtgacccgtcacgtgaggtcagttggggaattttcctcttgtggtggtatgttggtactcagaaagtttcgg

SEQ ID NO: 47010 - DNA, 201 bp, Homo sapiens
cttggctttcttcttgtggacagatcaggtggctgaggcctggagggagcttgatttgagatgagtagtttgtatgcctgactaagtcaagtagccacttrcttcccttcacacttaatcaaatcctaactctctaactgaaactttgtaccatttgaccagtacctctcctttccccattcccccgctcccagcctccgt

SEQ ID NO: 47011 - DNA, 201 bp, Homo sapiens
cagttattttgcagtcacaacatctttgtgtgtttgtatttatttagtaattagaagaaagtttttatgttctcatagtatcttcctgtctacacagtgcwtttgtttactaatttatatccatttgatacacatctaatgattgcctctgatgggtatatgtgggaacatgtacattccctactgttagctgcaaatagt

SEQ ID NO: 47012 - DNA, 201 bp, Homo sapiens
ctaatttatatccatttgatacacatctaatgattgcctctgatgggtatatgtgggaacatgtacattccctactgttagctgcaaatagtgagaagtarttagagcataatgtttcacatcgaagtaatctctttttcaaagacatctctgagaatgaaaacattaagtttggcagttccgacaaactcttatagtgat

SEQ ID NO: 47013 - DNA, 201 bp, Homo sapiens
gagcacagccctccttaggcgcagagattccctgttcacttgacgcaaataggtctcccctctttgtgtttagtgctgcttttagggtcgtatgttagcckttctgccctttgaaatgcagcgaggttcgctgaatgcctcacatgtttgctctcgcaggggacaaaccagcagatcaaggcccacgaggccagctccgcc

SEQ ID NO: 47014 - DNA, 201 bp, Homo sapiens
cccctggttctggtgcctgttgaggtgtctgtctcctgctttcccaggagccagttcagtcctgtggccacctcattgatatagaaggtcacggggctgcyggctgggctctgctcagggttcgtgtcatttctttcttcagcttttgtttagaaagcatattttccttgagcaatgtctgtcaatttgacatagtggctc

SEQ ID NO: 47015 - DNA, 201 bp, Homo sapiens
tctaatgcagtcacttgtgtttccctgcagctcttcaagtccaaaatgtacagcgtgtcaagagagcatcgttaaagataaggtattctggggtttttttwaatcattttgtcacatgttttcagctgggtaatacttttcacatagtttgcattcggcactctggcacaacacattctctcagttttggcagctgatgcg

SEQ ID NO: 47016 - DNA, 201 bp, Homo sapiens
agacagtggattcagatccacttggccacttccctactgtgtgaactctgtgagctacttcaccccctcacctgtaataatcatatcacctgctaagaccrcagggagctggtgtgaggagtaaggggttgatgtgagcaaagtgctgagatgcctgtctgtggcagggctgtctgtggttgggtcacttccgtcattgca

SEQ ID NO: 47017 - DNA, 201 bp, Homo sapiens
catggctcactgcatcctctacctgccaggctaaagcagtcctcttgcctcagcctcctgagtagctgagactgcaggcgcatatgctgccttgcccagcwaattttttaaaaaaatttttgtagagatagggtctcattgtgttgcctaggctggtctcaaactcctggactcaagcaatcctcctgcctcggtttccca

SEQ ID NO: 47018 - DNA, 201 bp, Homo sapiens
ggggtttcaccatgttggtcaggctggtcttgaactcttgccctcaaaggacctgcgtgccttggcatctcaagtgctggaattacaggctgagccactgytcttggccaagcacttcttttctcatagtcttctgctaagtatttccttctgtcagctgccaggcagcaatagttttcacatttgtttgtggttgtcctc

SEQ ID NO: 47019 - DNA, 201 bp, Homo sapiens
atgggcttgggggagaatggggagtggagccatgcaggctgcagatgggggtgagtttggtggctcgcaggatcatggggctggagcgagtggagaggagracagagctcgtgggggcctgggcacaccctcagaggctgcctagaggctggggtgggcttggccatgaagtgactgaagggaggcaccagggcagctcag

SEQ ID NO: 47020 - DNA, 201 bp, Homo sapiens
tgaaacaagttgaaaaccgtttgagcagtgttgacagtagagtgcattttaaggtgtgtgtcagcttctctcagggcctgcagacatttcagcaagcacgsgtgtttggggtcctgccagtgcatctgcccctgcctctcagcctgaccaggggagagcagttgctggttggctgcctttgctccaggcctggttctgtga

SEQ ID NO: 47021 - DNA, 201 bp, Homo sapiens
gccggggttgcagcccagccgggactttccagccggcggcagccgcggcggccgccggctcttccccgccccccgccatggggcagcccggggagcagaaygctgcggaccgcggcggaggacgcgcccggcgcccctgagccggccgagcggcgacggaccgcgaggtaaggggccgcggcgggcgggcgggcctccggc

SEQ ID NO: 47022 - DNA, 201 bp, Homo sapiens
aagggttaagatgtaaggtgtctcacccagacgccatctgttccagctgtcaatgcagaagccaggaaaggagagagagctggccagggagaattccagctttttttttttttttttttttttttttttgagacattcatgtgaatttctctgcgaggggaaagaagaccaattattttccttggatgctgtcccttcttt

SEQ ID NO: 47023 - DNA, 201 bp, Homo sapiens
agtctccttaattcttaagatctgaaaaattgggggccctacatttcatttcacaatttacttttttactacgatttgttccatgctgatttcgagcattaaaaaaaaaaaaaattaaatggaggctatttggtggtaacttctcatgaggccattctaccaagaaagatatggcgacctgctgcttcgacattctgattt

SEQ ID NO: 47024 - DNA, 201 bp, Homo sapiens
aatacctgcagatagtagggttgccctttagcattttaagtgtctaaatgagacctattgggatgtttccatagtttgcatcaaattcatgtaaatgcgcrttaatgatgttagctagtctgcctgagctaaattactaatttcattactactatttaataaaggggcaggatttgccatggtcattctagttaatggtaa

SEQ ID NO: 47025 - DNA, 201 bp, Homo sapiens
atttgtctatgttttcccttcaggcggaatgccgattacttggattttttcttgttaattttggtgactgagttgcctgtttttgaagtgaaaaatacctkcagatagtagggttgccctttagcattttaagtgtctaaatgagacctattgggatgtttccatagtttgcatcaaattcatgtaaatgcgcgttaatga

SEQ ID NO: 47026 - DNA, 201 bp, Homo sapiens
agcaggataattgcttgaacccgggaggcagaggttgcagtgagccaagatcgtgccattgcactccaccctgggcaacaagagtaaaactgtctaaaaawaaaacgagcctgtgccaggtgcagtggctcatacctatagtcccagcactttgagaggatgaggcggggggatcgcttgaatccaggagttctcaaccaa

SEQ ID NO: 47027 - DNA, 201 bp, Homo sapiens
atatgggtaatgtgccgacgtcataacaaggtttcagagtggcacctctcacaccttcatttgaatacccaatcacacttatgaactacaaaaggatatakgtgtgtgtgtgtgtgtgtgtgtgtgtgtggtatgtgtatatgtatgtatatatttttgtttaaagctattctagttaaagtggtatctcgtggtttgggt

SEQ ID NO: 47028 - DNA, 201 bp, Homo sapiens
ttcctcaccttgagcagttctcctgccttagcctcccaggtagctgggattacaggtgtgcaccaatatgcccagttaattgatttttttttttttttttyttttagtgatggggtcttgctgtgttgcctaggctgatctcaaactcctggcctcaagcagacctcctgcctcagactcccaaaatgctgggattacagg

SEQ ID NO: 47029 - DNA, 201 bp, Homo sapiens
ttattaagggttttgtattaagcattgttggatttcacaaaattttaaagttagcaatgcacatgttcatctgctggcatttcactcctattcctcgctayttttcttccttatttcttagagttaaatgagtggacctctcattttgtgacaaaagagacacatttatatcttagggtaggccgtataaaatggccattt

SEQ ID NO: 47030 - DNA, 201 bp, Homo sapiens
tcccatcagatttgaccaactgtacccaacttggccaaattcaaatgagaattccaaattatgagcagccagacctctgaagctgctaaaattcctcatarctgaaaaaaagaaaacaaacaaattatgcgcttggtttctgttgcagcttcctgtcttaaaaacacaattgttctttcattttcttttcttccacactat

SEQ ID NO: 47031 - DNA, 201 bp, Homo sapiens
acaaatttactattcatatttagaaaaatataccgtttttctgaaatcacccttccagttttgttatatggtgtaatcttgagagacatcataatggagayggagtaaagggaacaagcagtctccatcttgatccaactggctgtgtagaaaatgtttaaaatttgtgttcaagatttttacttcttagtataatatgtt

SEQ ID NO: 47032 - DNA, 201 bp, Homo sapiens
gtatatacagcctctaagccaaaaataaaattcaaccctcccaccccctgctcccagcactgaatggacctcctcttggtcaagagccttccaaagttagyctaaaaaacaagtttaggctgttatgggaaggaggtgttggacatgcctctttataccctcctctcttttggaattcaggaataaccaaccatcattaac

SEQ ID NO: 47033 - DNA, 201 bp, Homo sapiens
tttgattcttattaagacctggaaacatgtaacaattcaaaaaaggttgacaattctttttttgaaagaaactatttcttttcttttcttttttttgagayggagtctcactctgtcgcctaagctggagtgcagtggcatgatctcggctcactgcaacctccacctcccaggtataaacgattctcctgcctcagcctc

SEQ ID NO: 47034 - DNA, 201 bp, Homo sapiens
ataaaatctgatttataaaactaggtgaaaatagtttgctcttaagaatacactctgagaaggtttatagtgggaagagagaatatccacaaatggtattyaatataaaaaatagctagagatatggccatactatgctgtagtcaatcagttttgattcatattaagaatgctattcaaatttctaggtccttttcacat

SEQ ID NO: 47035 - DNA, 201 bp, Homo sapiens
gagtgaggatcacttgaggccaggagttcaagaccagcctggacaacatagcaagactttgtctctgcaatttttgtttttaaattagccaggtgtggtgktgtgcacctgtagtcccagctacttagagggctgaggtgggagcatctcttaagcccaggaagctgaggctccagtcagctatgatcatatcactgcact

SEQ ID NO: 47036 - DNA, 201 bp, Homo sapiens
atttttccaaatttgatttgtacttgatttagtaggacttgcttttaaatataaaatctgatttataaaactaggtgaaaatagtttgctcttaagaatayactctgagaaggtttatagtgggaagagagaatatccacaaatggtattcaatataaaaaatagctagagatatggccatactatgctgtagtcaatcag

SEQ ID NO: 47037 - DNA, 201 bp, Homo sapiens
acagagattatttagcactagacatgagtcagaatagccactgatttctttcactctgcgaataaaaccaaactagttaggcaacccatgtgttttagggraaaagcaatgaggtcatgatccatctaatttcttttcttaacatgtaaagtagaataaattatttttccaaatttgatttgtacttgatttagtaggact

SEQ ID NO: 47038 - DNA, 201 bp, Homo sapiens
atctttctaatgggtatgtttgtttttctctgccttactagcacactttcccccccacgaacagtgtgatggcgggtgtagcaaactcctaagttgaagtsttttaggatattttttgactctggtggatttcttccttctaatctcaagaaagaaagaaagaaagagaaagaaagaaagaaagaaggaaggaaagaagga

SEQ ID NO: 47039 - DNA, 201 bp, Homo sapiens
tattttggtcactttgtagttttgcttactgatctttaagactcaacagtgacttattgagggcaaaactgttgtgttctgatccctacccagtcagctayatcactgacttccagaagccaccaaaacattgctatgacttcagctttcaaggggaaaaaagaattagcaaacaatacatattacaaaatagtaaaaaac

SEQ ID NO: 47040 - DNA, 201 bp, Homo sapiens
acttgagaacattcatatctcattaattcccacacatctttatttcaaatgttcagggagtgataaaataaatatttgtgtgaaatcttctttatcaactygattttcctccagactttacagaacagaacaagcatctttcattctaatgagctgtagaaaaaagaatatattaatagaagaacaaaaggttagtaataa

SEQ ID NO: 47041 - DNA, 201 bp, Homo sapiens
gaatctgacaattatgtgtcttggagttgctcttctcgaggagtatctttgtggcgttctctgtatttcctgaatctgaacgttggcctgccttgctagaytggggaagttgtcctggataatatcctgcagagtgttttccaacttggttccattctccccatcactttcaggtacaccaatcagacgtagatttggtct

SEQ ID NO: 47042 - DNA, 201 bp, Homo sapiens
ctttctctctggctgcccttaacattttttccttcatttcacctttggtgaatctgacaattatgtgtcttggagttgctcttctcgaggagtatctttgyggcgttctctgtatttcctgaatctgaacgttggcctgccttgctagactggggaagttgtcctggataatatcctgcagagtgttttccaacttggttc

SEQ ID NO: 47043 - DNA, 201 bp, Homo sapiens
tctccttcacttatgaagcttagtttggctggatatgaaattctgggttgaaaattcttttctttaagaaatttgaatattagcccccactctcttctggsttgtagggtttctgctgagagatccacttttagtctgatgggcttccctttgagggtaacccgacctttctctctggctgcccttaacattttttccttc

SEQ ID NO: 47044 - DNA, 201 bp, Homo sapiens
tgtcacttattactgctttccagaggcaagtgcttataacttttagctctttcttgtatttgccaccaatttctttcttttttttctgtttttttttttttattatttattattatttttttgagacagtcttgctctgtcacctaggctggagtgcagtggtgtgatctcgggtcactgcaacctccacctcccaggttc

SEQ ID NO: 47045 - DNA, 201 bp, Homo sapiens
ccttctgctagcttttgaatgtgtttgctcttgcttttctagttcttttaattgtgatgttagggtgtcaattttggatctttcctgctttctcttgtggrcatttagtgctataaatttccctctacacactgctttgaatgcgtcccagagattctggtatgttgtgtctttgttctcgttggtttcaaagaacatctt

SEQ ID NO: 47046 - DNA, 201 bp, Homo sapiens
ttgtcacttattactgctttccagaggcaagtgcttataacttttagctctttcttgtatttgccaccaatttctttcttttttttctgtttttttttttttattatttattattatttttttgagacagtcttgctctgtcacctaggctggagtgcagtggtgtgatctcgggtcactgcaacctccacctcccaggtt

SEQ ID NO: 47047 - DNA, 201 bp, Homo sapiens
accagttcctccttgtacctctggtagaattcggctgtgaatccatctggtcctggactcttttttgttggtaagctattgattattgccacaatttcagmtcctgttattggtctattcagagattcaacttcttccttgtttagtcttgggagagtgtatgtgtccaggaatttatccatttcttctagattttctagt

SEQ ID NO: 47048 - DNA, 201 bp, Homo sapiens
cttgtcacttattactgctttccagaggcaagtgcttataacttttagctctttcttgtatttgccaccaatttctttcttttttttctgtttttttttttttattatttattattatttttttgagacagtcttgctctgtcacctaggctggagtgcagtggtgtgatctcgggtcactgcaacctccacctcccaggt

SEQ ID NO: 47049 - DNA, 201 bp, Homo sapiens
cctcataaaatgagttagggaggattccgtctttttctattgattggaatagtttcagaaggaatggtaccagttcctccttgtacctctggtagaattcrgctgtgaatccatctggtcctggactcttttttgttggtaagctattgattattgccacaatttcagatcctgttattggtctattcagagattcaactt

SEQ ID NO: 47050 - DNA, 201 bp, Homo sapiens
aaatgttggtgtttcagagatatctgtttctgtatctgtctacattgcaaaacagaacccttcttcggggcagggattgtgttatattcatttattatttaatgcaaccctagcacaaatccaagtatttaagatagttgttatgcagtaaatgctagaatgtaaatgattgggtgaggctcttaattaagactttgttca

SEQ ID NO: 47051 - DNA, 201 bp, Homo sapiens
tttctcattttcttgtattagctaatgcaagaaataccacaacagtgatgaataataatgatattagctgggaacctttatttgttcctgattttttttttgtctttttttttattattatactttaagttttagggtacatgtgcacattgtgcaggttagttacatatgtatacatgtgccatgctggtgagctgcacc

SEQ ID NO: 47052 - DNA, 201 bp, Homo sapiens
taaatgttggtgtttcagagatatctgtttctgtatctgtctacattgcaaaacagaacccttcttcggggcagggattgtgttatattcatttattatttaatgcaaccctagcacaaatccaagtatttaagatagttgttatgcagtaaatgctagaatgtaaatgattgggtgaggctcttaattaagactttgttc

SEQ ID NO: 47053 - DNA, 201 bp, Homo sapiens
acaatttttttccattatagtttcttggttttttttttttgtcttttttaaaaaagtttttctttaacctaacattactcttatttttcacataatttttwcattttattttaacattaaaatccctaatccattgctctttttcatctttaaacatggattatgcaggaatattactattttcttgctgaatgaagatct

SEQ ID NO: 47054 - DNA, 201 bp, Homo sapiens
gtaaatgttggtgtttcagagatatctgtttctgtatctgtctacattgcaaaacagaacccttcttcggggcagggattgtgttatattcatttattatttaatgcaaccctagcacaaatccaagtatttaagatagttgttatgcagtaaatgctagaatgtaaatgattgggtgaggctcttaattaagactttgtt

SEQ ID NO: 47055 - DNA, 201 bp, Homo sapiens
ttaaagaagtagactccacaatttttttccattatagtttcttggttttttttttttgtcttttttaaaaaagtttttctttaacctaacattactcttayttttcacataattttttcattttattttaacattaaaatccctaatccattgctctttttcatctttaaacatggattatgcaggaatattactattttc

SEQ ID NO: 47056 - DNA, 201 bp, Homo sapiens
tgtaaatgttggtgtttcagagatatctgtttctgtatctgtctacattgcaaaacagaacccttcttcggggcagggattgtgttatattcatttattatttaatgcaaccctagcacaaatccaagtatttaagatagttgttatgcagtaaatgctagaatgtaaatgattgggtgaggctcttaattaagactttgt

SEQ ID NO: 47057 - DNA, 201 bp, Homo sapiens
taaacagtctagagtctagaccattcttctaaacagctttgtggtagctagagtagctaaccatcaaggctgagggaaggtgttttgttttgtttcatttygtttttttctcaaaaggcaagaaatgccttggatatattaataagctagtggggaaacaagcaataaagggtgtgaggttgaaaatagagagaaaagcct

SEQ ID NO: 47058 - DNA, 201 bp, Homo sapiens
acaagcccttattataacccagatattattttctattgataataactcttccaaccaattgccaatcagcacattttaaaactttaaaactacctatgacygggaaccccctgcttcgggttgtcctgcccttccagattaaaccaatgtaaatcttacatgtactgactgacgtattatgtctctctaaaatgtataaaa

SEQ ID NO: 47059 - DNA, 201 bp, Homo sapiens
tttagttgaatccctaatgagatagcttccattttccattctgacacacaaatactcttttgattgtcaaaatattaatgttatttatctctccttggttyacttccaaggaaactggaatgatggtattctcaagactagagatgcaaatctctctcatttgtcatcccactgagcccgatctgtttttcactgcaaatg

SEQ ID NO: 47060 - DNA, 201 bp, Homo sapiens
cccttactgtgtattttcaaacagcctatcttcaagctcactaaatctctcttctgcttgataaattctgctattaagagattctgaggcattctttagtwtgtcattgcatttttttaactgtagaatttctgcttgattctttttatttatgtcaacctctttgtaaaattcatctaatagtgttctgcattttttctc

SEQ ID NO: 47061 - DNA, 201 bp, Homo sapiens
agatggatgaaaacagtatatttaatcttatttgattttattttactttcagctctgatttcttcaagatgtttttgatacttattctgtcattaattcartaaacttgtattgggtgcctgctatttgtcaggcacttagtaggcaccagggccacaggggtaaataacatatggctcctgtatctgacttgctctcaga

SEQ ID NO: 47062 - DNA, 201 bp, Homo sapiens
ctttataaatacagagattatttagcactagacatgagtcagaatagccactgatttctttcactctgcgaataaaaccaaactagttaggcaacccatgygttttaggggaaaagcaatgaggtcatgatccatctaatttcttttcttaacatgtaaagtagaataaattatttttccaaatttgatttgtacttgatt

SEQ ID NO: 47063 - DNA, 201 bp, Homo sapiens
attcattaggaagcatgaaagaactatttttaacaaatttgctttaaactttgttgttgaaataagttgaaagggcattattgctagaagctagtaggacyagctttataaatacagagattatttagcactagacatgagtcagaatagccactgatttctttcactctgcgaataaaaccaaactagttaggcaaccca

SEQ ID NO: 47064 - DNA, 201 bp, Homo sapiens
taacaataatttcctgtaagaaaaatggccattttgtcagctgttctgatttttttttctatttcagagaaaattctgttttctagcttcaaagtcatttmtattcaaacaaatttgaatttatgataaaccaagggatctggacatttgtcctgattctatagctagtgcctgcaagtggtttcaaaactaagacactgt

SEQ ID NO: 47065 - DNA, 201 bp, Homo sapiens
tgggacctggatgttggtattttaaaaaatatctccaggtagatcttgctgagaaccaatggcagaaccactgaaactgttgttctgaagaagcaaaaaaraattccggatacttgagaacattcatatctcattaattcccacacatctttatttcaaatgttcagggagtgataaaataaatatttgtgtgaaatcttc

SEQ ID NO: 47066 - DNA, 201 bp, Homo sapiens
aaaatggctcattgcacagaaatgctttgttgatttgtatgcaattacccagcaaaacaaatgttttctttaagctttggcaacataacaataatttcctrtaagaaaaatggccattttgtcagctgttctgatttttttttctatttcagagaaaattctgttttctagcttcaaagtcatttatattcaaacaaattt

SEQ ID NO: 47067 - DNA, 201 bp, Homo sapiens
tagaggcaggccacacattactagaagcaggccaaacattactagaggcaggccacacatttggctctgtgctttttctaacaggaatcatttttgattamatcatttacatagtccttagaatgtaccaaatgaatcagcatctctgagggtgggacctggatgttggtattttaaaaaatatctccaggtagatcttgc

SEQ ID NO: 47068 - DNA, 201 bp, Homo sapiens
cacccaagaggctgttcttgtctcacagagctaggagccatttcaagatcctggaaataagtgattttcataagatttttgctagtgtaaattttttttttccctagggaaaggatgatctcctaagtcttcttcatgtatgtactactagctttgctgtaaagtaaggcctttatttcattaatttgagagtagagaata

SEQ ID NO: 47069 - DNA, 201 bp, Homo sapiens
aaaacagcatataaccacaaatatagatcatttaaaattgtctaatgatccaaaccaccatgctgacaaacggtattcagctgagtggcaaagggaaggakaggtgagtcatatgcacatgctcatcgattaaacctcatcccatgcctcatttatacatacacagagctccaaactgttccctttacatgatttaaatca

SEQ ID NO: 47070 - DNA, 201 bp, Homo sapiens
tagataattataaaatttacttatttattacatttggtaatattaaacatgaagacaatattctttgtcttatatatcgtgctatttaatttgtgacatayaccccttatgttaaattaatgttgagagaaaaagcgtggcctgttaagaaataaatttatagatgacattatgtcatatttgtagattggagtttactat

SEQ ID NO: 47071 - DNA, 201 bp, Homo sapiens
tggtattgctttagaattcctcccaaaacatgcctgtgggatgaattaacaggaccttggttatatcacgacctagtcaatggcatgatcccagctgggaytgcctgtgctgttacagcaaatctctacctgtgacccagcatgaaagggaatttggaggccagggaaagtggctttaaattatgaggcttctttttcaac

SEQ ID NO: 47072 - DNA, 201 bp, Homo sapiens
ccctaaaaatcccctgtgctccatggaagatagtatgactattaataacaaatggctgaattgaatagatattaaatttaaatgataaagatgtcttctgsctttgattccttgtggttgataaatggctcaaagtgcaatggaaaatgagggtgaggatgatacagaatgtggtgttatagaagccaagggaagagaacc

SEQ ID NO: 47073 - DNA, 201 bp, Homo sapiens
aataatgaggacatagccagaaggaagtttcaagttgcagatctgagagtgaaacttttttgaggaatgtgccatgagaaatccactataagatggtattrctttagaattcctcccaaaacatgcctgtgggatgaattaacaggaccttggttatatcacgacctagtcaatggcatgatcccagctgggactgcctgt

SEQ ID NO: 47074 - DNA, 201 bp, Homo sapiens
atttgagtaaagtgagtgagaggtgaggaagtagaggcagagagtatagtgaaaggagagaaagcagggtggatttgagattttgtagaatcattggctayggggaaattgaacgcgcacaagagagggagtatttggtagagcaaaaccttagagaagatagaaggggttggaaccaagaagttaggtgtgtatagggcg

SEQ ID NO: 47075 - DNA, 201 bp, Homo sapiens
gtatcaccagcagaggctgaagaacagctaatattgcagaacagcagatgttgctgtctgatccttcctctggaagctttgtcttagaggggcatccccctgtatgaggtgtctgtcggcccctactgggaggtgcctcccagttaggctactcaggggtcagggacccacttgaggaggcagtctttcctttctcagatc

SEQ ID NO: 47076 - DNA, 201 bp, Homo sapiens
gacaacctacagaatgggagaaaatttttgcaatctatgcatcttacaaaggtctaatatccagactctacaaggaacttaaatttacaaaaaaaaaaaaagccattaaaaagtgacccaaggacatgaacagacacttctcgaaagaagatgtttatgcggccaacaaacattttaaaaagttcaacatcgctgatcatt

SEQ ID NO: 47077 - DNA, 201 bp, Homo sapiens
gctataataatcctctaaagagatagcggattatagtttttctttacatttttagttgaatccctaatgagatagcttccattttccattctgacacacamatactcttttgattgtcaaaatattaatgttatttatctctccttggtttacttccaaggaaactggaatgatggtattctcaagactagagatgcaaat

SEQ ID NO: 47078 - DNA, 201 bp, Homo sapiens
aagaaaaccattttttttcctcctaggcctctgggcctgtgatgggaggggctactgtggagacttctgacatgtccgggagacattttccccattgtctrggtgattaacatttggcttctcattacttacgcaagtttctgcagccatcttgaatttctcctcagaaaatgggtttttccttttttatcacatcatcag

SEQ ID NO: 47079 - DNA, 201 bp, Homo sapiens
aacctctcccctcccctttgctcactgtcctggagtggcactggcctctgaagtaattcttttttggtcttgggactagttcaggggaaactgggtgggggaaatccctcctgccctaagtgcagttggactgtacagaatactccaaaggccaatggtagttcagcacagaaagagggaaggcctccaagtcagaaagag

SEQ ID NO: 47080 - DNA, 201 bp, Homo sapiens
taacctctcccctcccctttgctcactgtcctggagtggcactggcctctgaagtaattcttttttggtcttgggactagttcaggggaaactgggtgggggaaatccctcctgccctaagtgcagttggactgtacagaatactccaaaggccaatggtagttcagcacagaaagagggaaggcctccaagtcagaaaga

SEQ ID NO: 47081 - DNA, 201 bp, Homo sapiens
tgtaatgggaaggggaagatgcacattctgttccatctgtctatttggtgctcttggctgcctcacttccacttaagcagtcagttttgtcaatttacacratggggatttgggaccttttcttgtggagttgagtctggtgaaaagattctcaggaccagcccaaacttgggattattcccttctcaggaccatgtaaat

SEQ ID NO: 47082 - DNA, 201 bp, Homo sapiens
gtaacctctcccctcccctttgctcactgtcctggagtggcactggcctctgaagtaattcttttttggtcttgggactagttcaggggaaactgggtgggggaaatccctcctgccctaagtgcagttggactgtacagaatactccaaaggccaatggtagttcagcacagaaagagggaaggcctccaagtcagaaag

SEQ ID NO: 47083 - DNA, 201 bp, Homo sapiens
ttcttaaaatcactacctcatttcctcatgaaccagtaagtactccagtctgataattttgggtggtcaaatttcacttgcaggaaatgaagttgcacttycctctctaggagcaatgctttccaacagcatagggcactgtaatgggaaggggaagatgcacattctgttccatctgtctatttggtgctcttggctgcc

SEQ ID NO: 47084 - DNA, 201 bp, Homo sapiens
cctgtaacctctcccctcccctttgctcactgtcctggagtggcactggcctctgaagtaattcttttttggtcttgggactagttcaggggaaactgggtgggggaaatccctcctgccctaagtgcagttggactgtacagaatactccaaaggccaatggtagttcagcacagaaagagggaaggcctccaagtcaga

SEQ ID NO: 47085 - DNA, 201 bp, Homo sapiens
atccagttcagtgccctgtaacctctcccctcccctttgctcactgtcctggagtggcactggcctctgaagtaattcttttttggtcttgggactagttmaggggaaactgggtgggggaaatccctcctgccctaagtgcagttggactgtacagaatactccaaaggccaatggtagttcagcacagaaagagggaag

SEQ ID NO: 47086 - DNA, 201 bp, Homo sapiens
acctcctctgaatctagaaagtaaaataatacttatatttataagactgaattgcagaatttattattttattctttagtttctggtgaaaatgaaccaakagaagtaaaataatttggtagacaaaatacaaaaagccattgttgattctacatgtaattcattggcacatacttgcttggattagtattggttgaaatt

SEQ ID NO: 47087 - DNA, 201 bp, Homo sapiens
ttaaaatagtaggagagtaaatagtgtttttggtaaaatttataaaaatacaatgatgtagcttttgctaaagaatttttttttctaagagttattttaartaaagataaaaatattatatagataaaactaaatggataaagagagaaattaaaagatgagtgaggagaaaccttgactccagggtggccatgtggttac

SEQ ID NO: 47088 - DNA, 201 bp, Homo sapiens
ccttggttgcaagtgatagaaatttaactcaagccagcttgaggaaaatggagaatttgttgattcttataaccaaaacatgaaaagtagaagtttcatcwgggcctctcagcagaatagaaacccaggactccaatgctcttaagagtctctatctttccccctccccaactttcctgttctcttctcttattcatcttt

SEQ ID NO: 47089 - DNA, 201 bp, Homo sapiens
taagactatatacataagtcttaagactatatacatttttaaagattttatgcttactacttaattgccattgaaatatttatactttcatcatcagtgartgaaagatctctaccaatgttacctatcataataaagaacactttgacaatttgataattggaaaacggcaactaatttgtatttcaaaatttattttta

SEQ ID NO: 47090 - DNA, 201 bp, Homo sapiens
tttcaccatgttggccaggatggtctcgatcttctgacctcatgatccacccgcctcggcctcccaaagtgctgggattacaggcgtgagccactgtgccyggcctgaaacattactttttaatttatatttatttgcatgtcaatttaaagtaatgtgccattcagatcatttttgtgtgtgcctttttttaaagaacat

SEQ ID NO: 47091 - DNA, 201 bp, Homo sapiens
actacaggtgcgtgccaccacgcccggctaattttttttgtattttagtagagacggggtttcaccatgttggccaggatggtctcgatcttctgacctcrtgatccacccgcctcggcctcccaaagtgctgggattacaggcgtgagccactgtgcccggcctgaaacattactttttaatttatatttatttgcatgt

SEQ ID NO: 47092 - DNA, 201 bp, Homo sapiens
caggttacaaaacacattttgccatgtcacgtatttgtctatatttcttatctattggcttccaagctgctaacttcttatttactcagtgcctccccatrgtgccttgtacacatttaggcaccatgttattacagtgtgatggttaagagccagggctttagagactgacaaactgggttggaatacaggctgtgttgt

SEQ ID NO: 47093 - DNA, 201 bp, Homo sapiens
attcaaataaatgttcaattagaggattcctcgatcagatgatcttattgaaatcaggtgaagggaggaactatggtaataagccagttactgcaaaaatrgaatgagattaattgagattttacagacactatgacattggagttgtaagactaaagccctatagggcttttaatggctcaaacctcatagaattttgtc

SEQ ID NO: 47094 - DNA, 201 bp, Homo sapiens
tttgagttttcagagagaaatcacagtatgacagacaaaaggagcagactacactttacagtttcttgcaaattcaaaggttacttaagttggagacaatsagtcttatggtggaaggcattttgtcaacagacggcaagtatacaatttaaaaataattttttctacgttttcttatatttttttcctagatgtttctgt

SEQ ID NO: 47095 - DNA, 201 bp, Homo sapiens
tataattgtcggcacagtgtccgcagaggactgagaggtactgggatcatgagtgtagtggagacattagtgttttagggaggagggacgtggactttggraatatcagtttattcagaatctgttttatgtcatgaattgtgttagaacattcttatgcaatgtctcccataatcttcaaacaaccctaatgttaccttt

SEQ ID NO: 47096 - DNA, 201 bp, Homo sapiens
tcatactgagaagtaggagccaaagaaagatatggaagtgctcaaagatgacttattgggagatatgagtagtgtcagcaatcaaatgaagaaaaaattcraagaaagaaaggttgttatgagtgttacatgataaagataaataacataggatgaaggctaaaaaacagaaatttgaatttaaaagtaaaagtttcccta

SEQ ID NO: 47097 - DNA, 201 bp, Homo sapiens
tatctaagttctagttgtcttttagtgggaggactcttcaggataaagtcatacttcaggaaatagtgatgtgtatgcacattttaaagacttctgagctrtatagacaaattctactctataaaggtcgtaataatccatactcctctagaaatgatttagtggctctggtcttcttaaaattgccaacacgggaaatta

SEQ ID NO: 47098 - DNA, 201 bp, Homo sapiens
gatttcttttcctttctgtgagcttagccataaaaatatgtttgtcttaacttatctaagttctagttgtcttttagtgggaggactcttcaggataaagycatacttcaggaaatagtgatgtgtatgcacattttaaagacttctgagctatatagacaaattctactctataaaggtcgtaataatccatactcctct

SEQ ID NO: 47099 - DNA, 201 bp, Homo sapiens
ttgatgtgttgctggattcggtttgccagtattttattgaggatttttgcatcgatgttcatcagggatattggtctaaaattctctttttttgttgtgtytctgccaggctttggtatcaggatgatgctggcctcataaaatgactgagggaggattccctctttttctattgattggaatagtttcagaaggaatggt

SEQ ID NO: 47100 - DNA, 201 bp, Homo sapiens
tcaacaaacatgggtgacttaaaaatcttcagataactctctctcctgtcaggtaccctattcataaatataaattttacaattataactcatttacttgmattaatctgtgtgtcctcctcttctaaattgtttatttattgaaattttgttccagaatgaattgtgagcagtttattaagcaaaccaagattgtgcata

SEQ ID NO: 47101 - DNA, 201 bp, Homo sapiens
atctgggttactaagagttaaaatagtaggagagtaaatagtgtttttggtaaaatttataaaaatacaatgatgtagcttttgctaaagaatttttttttctaagagttattttaagtaaagataaaaatattatatagataaaactaaatggataaagagagaaattaaaagatgagtgaggagaaaccttgactccag

SEQ ID NO: 47102 - DNA, 201 bp, Homo sapiens
tgggcgacatagcgagactccgtctcaaaaacaaacaacaacaacacaacagcattatgtgctacagaaaaaacttttgtgaaaggaagagtcaattgccrcaggaaacttcatcactgtcttattttaagaaatttccacagcccccacaaccttcagcagccgctaccctgatcagccagcagccatcagcgtggaggc

SEQ ID NO: 47103 - DNA, 201 bp, Homo sapiens
tcaagagccttccaaagttagcctaaaaaacaagtttaggctgttatgggaaggaggtgttggacatgcctctttataccctcctctcttttggaattcargaataaccaaccatcattaacatcaacacagaccttaagtctgataagaaacatttatatccattctctatgaagcctgcgtatctagaggctttatctg

SEQ ID NO: 47104 - DNA, 201 bp, Homo sapiens
gccaaaaataaaattcaaccctcccaccccctgctcccagcactgaatggacctcctcttggtcaagagccttccaaagttagcctaaaaaacaagtttargctgttatgggaaggaggtgttggacatgcctctttataccctcctctcttttggaattcaggaataaccaaccatcattaacatcaacacagaccttaa

SEQ ID NO: 47105 - DNA, 201 bp, Homo sapiens
tgtattgtgtggtgtgaatgtgtcccatccaaattcccatgttgaaatcctaatttctaaggtgatggcagtaggaagtggggccttcgagaggtgattargtcacaaaggtaaagcctttatgaatgggttcagtggctttataatagaggactaagagagattcactgcattttctgccatgtgaagacacagtgagaa

SEQ ID NO: 47106 - DNA, 201 bp, Homo sapiens
tttaggtctcacaaaaataattgataaattttggcttagatgtattgtgtggtgtgaatgtgtcccatccaaattcccatgttgaaatcctaatttctaargtgatggcagtaggaagtggggccttcgagaggtgattaggtcacaaaggtaaagcctttatgaatgggttcagtggctttataatagaggactaagaga

SEQ ID NO: 47107 - DNA, 201 bp, Homo sapiens
tgctaccataggcaatgtccttgaacatgatatgcactcattaaaattttgttaacactagaaagagagatgggggaattgaaataaattataatgttaartaacaaatccatatatgtaatatttataaacctaaatataatgttgatattataacttgacatattataaattacatattttgttatacctatttatatc

SEQ ID NO: 47108 - DNA, 201 bp, Homo sapiens
atatctttactgtgaattgttccctttagtatatttaaactacttttctatgtcacatttaatgctttttcaaaagctctgaatgttaccttttcaaatawgatcatgactcatttttttcttacctctctccttcctttttctctctccctttttttcttttgtatcccactgtgcccgttcttctattgttatctttag

SEQ ID NO: 47109 - DNA, 201 bp, Homo sapiens
agtttccacgagcactggaaaaggcatattttctgtttaagatacaaaagttctcactactctatagatctccatacaatctactttattaaaaatgtaayttaagtcttacaaatccttctttatactttttaccttactagaacttggactgcatgagaattaagctactattatttaaatgtttctgcctgtttgtct

SEQ ID NO: 47110 - DNA, 201 bp, Homo sapiens
aagagcagtattagggtgggagtgtcccgattttccaggtgctgtctgtcatggcttccctttgctaggaaagggaattcccccaccccttgtgcttcctkggtgaggcaatgccctgcccagctctgtgggctgcacccacttgtctggcaagccccagtgagatgaacctggtacctcagttggaaatgcagaaatcac

SEQ ID NO: 47111 - DNA, 201 bp, Homo sapiens
tggtcagtatatattaaaaaattatttttcagagcaatgcttatgttttgtgtagctaattgctataagtccataactaaaaccaagattatagtagctcwatgcatagaagttaaagataagtcagttttgtaacctggcctttggctttctgtttgttgactttttactgaaaaaaatttaaggggtaatgaatacttg

SEQ ID NO: 47112 - DNA, 201 bp, Homo sapiens
tttgtttataagatcatctgttttttaacttaatctgtaagaatcctaagtgtttatgttggaaatattccctgagaaaagatttggttgcattgccactrtacagaattccctaacatctaggatcactttagctccatgggggattaagggtaatataggaaactcacatcagctccctaaccttgagacagactcaaa

SEQ ID NO: 47113 - DNA, 201 bp, Homo sapiens
ctcagttacagtagtttgatttttgtttataagatcatctgttttttaacttaatctgtaagaatcctaagtgtttatgttggaaatattccctgagaaargatttggttgcattgccactatacagaattccctaacatctaggatcactttagctccatgggggattaagggtaatataggaaactcacatcagctccc

SEQ ID NO: 47114 - DNA, 201 bp, Homo sapiens
ttgatgccttttgtgataatcctgtataatttcttaaaatctattttcaagttcacaaatcatccctttcatctgtatctgatatgctgttactcattcartactattttaatatcaaagattaagttagtttagttctaaatacttcttggccattttaagtagccttttttggttaattagaaataatcagttttaaaa

SEQ ID NO: 47115 - DNA, 201 bp, Homo sapiens
gaggcaagaagtctaagattaggtgtcagcagggttggttctatctgagggctgttccatgcctctttctagcttctggtagtttgctggcaatcttgttkgtttggagaagcagcatcacctgatttttgtcttcattcccatgaggcattatccctgtgtgtgtgtctctgtgaccaaacttcccctttttatacgtcc

SEQ ID NO: 47116 - DNA, 201 bp, Homo sapiens
cttaaagaacactattttctatgtaaaaagctgcaaattagcaagcttaatgattttttccagcatactttcatctctttgtatcacagattcactttgcyagagaacaatctagagttgtcttttaaaaaattattctttctaccatcctttaaaatgtagcacagacatttttaagtttattaagtgaaaaatgcctat

SEQ ID NO: 47117 - DNA, 201 bp, Homo sapiens
acatgtttattccttcaggaatctctttgtggctttggtaggtatttagacttatgtattagaattcagtatttaatggtttgcatctttatattttaaaagtatctccaacaaaccgctttttatttttcttttaattttttcaatattgttcatttattgtttgtagacttcttttcatgtttcaaagttaatttttaa

SEQ ID NO: 47118 - DNA, 201 bp, Homo sapiens
ggaagagggtttataatttagttgattttccctgtttttaaactagtgtttttcttcttccctttatggtgattggtttccacagacctagagtctatcamgtttaatttatccagaaattaaactgttgttagggttagagaaggttgttacctggatgcttggaaggaagtatgcggggatggtctttcttaaagtcca

SEQ ID NO: 47119 - DNA, 201 bp, Homo sapiens
gattttttttttttttttaagacggagtctcgctctgtcgcccaggctggagtgcagtggcacgatctcggctcactgcaagctctgcctcctgggttcaygccattctcctgcctcagcctcccgagtagctgggaccacaggtgcccaccaccatgcctggctaattagaagtccattgacatttattagtgagacact

SEQ ID NO: 47120 - DNA, 201 bp, Homo sapiens
acaaaatgtttagccattttgttaatggacttcgggttgtttctagtttgaggctattacaaataaagctgcaacaaatattcatgtacaagtctttgtgytgacacatgcttcttcttttctcttgtttaagtatgtaaggagaggtaagaagtccattgattttttttttttttttaagacggagtctcgctctgtcgc

SEQ ID NO: 47121 - DNA, 201 bp, Homo sapiens
aggtccactccagaccctgtttgcctgggtatcaccagcagaggctgaagaacagctaatattgcagaacagcagatgttgctgtctgatccttcctctgraagctttgtcttagaggggcatccccctgtatgaggtgtctgtcggcccctactgggaggtgcctcccagttaggctactcaggggtcagggacccactt

SEQ ID NO: 47122 - DNA, 201 bp, Homo sapiens
cggaagctgccaaggcttggagtttgcatcctctgaagccaagcttgagctgtaccttggccccttttagccatgattggagtgcctgggatgtagggcaycaagttccaagggtgtacacagcaggagggccctggacctggcccaggaaatcatttttcctccctaggcctcagggcctgggatgggaggggctgctgt

SEQ ID NO: 47123 - DNA, 201 bp, Homo sapiens
tttgttagttttccttctaacagtcaggaccctcaactgcaggtctgttggagtttgctggaggtccactccagaccctgtttgcctgggtatcaccagcrgaggctgaagaacagctaatattgcagaacagcagatgttgctgtctgatccttcctctggaagctttgtcttagaggggcatccccctgtatgaggtgt

SEQ ID NO: 47124 - DNA, 201 bp, Homo sapiens
tttttcctgctctcttcagtgcctctttctgtgatatgaagttaaaaccaggtattgtgagtgctcacctgatttttcattcttacaaaggttttttttgktttttttttgtatgtagatagttgttaaatttggtgttccttcaggagggatgattggtggagacttctatttagctccttgctctacccctcccttata

SEQ ID NO: 47125 - DNA, 201 bp, Homo sapiens
atttttcctgctctcttcagtgcctctttctgtgatatgaagttaaaaccaggtattgtgagtgctcacctgatttttcattcttacaaaggttttttttkgtttttttttgtatgtagatagttgttaaatttggtgttccttcaggagggatgattggtggagacttctatttagctccttgctctacccctcccttat

SEQ ID NO: 47126 - DNA, 201 bp, Homo sapiens
ttctatttgatcaaatcggctactgaagcttgtacatgcgtcacgtagtccttgtgccatgattttcagctccatcaggtcatttaaggacttctctacaytgtctattctctacactgccattcgtctactcttttttcaaggtttttagcttctttgtgataggttcaaacatcctcctttagctcggagaagtttgtt

SEQ ID NO: 47127 - DNA, 201 bp, Homo sapiens
tcatttctttttactcttttttctctaaacttctcttctccctgcatttcattcatttgatcttcaatcactgataccctttcttctatttgatcaaatcrgctactgaagcttgtacatgcgtcacgtagtccttgtgccatgattttcagctccatcaggtcatttaaggacttctctacattgtctattctctacact

SEQ ID NO: 47128 - DNA, 201 bp, Homo sapiens
gtgggtaacctgacctttctctctggctgcccttaacattttttccttcatttcaactttggtgaatctgacaattatgtgtcttggagtttctcttctcraggagtatctttgtggcattctctgtattttctgaatttgaatgttggccttccccgctaggttggggaagttctccggcatgatatcctgaagagtgtt

SEQ ID NO: 47129 - DNA, 201 bp, Homo sapiens
tttgactgggtatgaaattctgggttgaaaattcttttctttaagaatgttgaatattggcccccactctctactggcttgtagagtttctgccgagagasccgctcactgttagtctaatgggcttccctttgtgggtaacctgacctttctctctggctgcccttaacattttttccttcatttcaactttggtgaatc

SEQ ID NO: 47130 - DNA, 201 bp, Homo sapiens
aataagtgtgatgtgttgctgagaagaatgtatattctgttgttttggggtggagggttctgtagatgtctattaggtccgcttggtgcagagctgagttwaattcctggatatccttgttaactttctgtcttgttgatctgtctaatgttcacagtggggtgttaatgtctcccattattattgtgtgggagtctaagt

SEQ ID NO: 47131 - DNA, 201 bp, Homo sapiens
atttgctgaggagtgctttacttccaactatgtggtccattttggaataagtgtgatgtgttgctgagaagaatgtatattctgttgttttggggtggagrgttctgtagatgtctattaggtccgcttggtgcagagctgagttaaattcctggatatccttgttaactttctgtcttgttgatctgtctaatgttcaca

SEQ ID NO: 47132 - DNA, 201 bp, Homo sapiens
ttgtgcccattttcaaagggaatgcttccagtttttgcccattcagtatgatattgcctgtgggtttgtcataaatagatcatattattttgagatacatmccatcaatacctagtttattgagagttttcagcatgaagagctgttaaattttgtcaaaggccttttcttcatctattgagataatcatgtggtttttgt

SEQ ID NO: 47133 - DNA, 201 bp, Homo sapiens
cttcacactgggagctgcagactggagctgttcctattcggccatcttggtgccaccctctgatgtttatatttcttattggagctttctttaaatatctratgatccttattggcccatttatttatttttatattggtgtcgttttacaccttcatttagggattatcaaaattcaataaactgcacatatttaaaatg

SEQ ID NO: 47134 - DNA, 201 bp, Homo sapiens
gagcctccaagccagccgcgggatataatctcctggtgtgccatttgctaaggctgttggaaaagagcagtattagggtgggagtgtcccgattttccagstgctgtctgtcatggcttccctttgctaggaaagggaattcccccaccccttgtgcttccttggtgaggcaatgccctgcccagctctgtgggctgcacc

SEQ ID NO: 47135 - DNA, 201 bp, Homo sapiens
ttgatcaaatcggctactgaagcttgtacatgcgtcacgtagtccttgtgccatgattttcagctccatcaggtcatttaaggacttctctacattgtctwttctctacactgccattcgtctactcttttttcaaggtttttagcttctttgtgataggttcaaacatcctcctttagctcggagaagtttgttattacc

SEQ ID NO: 47136 - DNA, 201 bp, Homo sapiens
tatttttattttattattttacttaaggttctagggtacatgtgcacaatgtgcaggtttgttacataggaatacgtgcgccatgttgttgtgctgcaccygtcaactcgtcatttacattaggtatatctcctaatgctatccctcccccgcccaccccccggcaggcccgtgtgtgtgatgttccccaccctgtgtccc

SEQ ID NO: 47137 - DNA, 201 bp, Homo sapiens
atatttcttttttatttttattttattattttacttaaggttctagggtacatgtgcacaatgtgcaggtttgttacataggaatacgtgcgccatgttgktgtgctgcacctgtcaactcgtcatttacattaggtatatctcctaatgctatccctcccccgcccaccccccggcaggcccgtgtgtgtgatgttcccc

SEQ ID NO: 47138 - DNA, 201 bp, Homo sapiens
tttgacaaaaaattatgatccaaattagtggaggtggcgtgtgaaagagaggttggaggtagacaaggctagaggagagtaaacaggatttcaattgtctragctaaactgttcatacatatgagaggtttcatcatacgtgtggtagttaaaagcatggatgagcatgaacttcctaaagacagcatgcatagcaaaagg

SEQ ID NO: 47139 - DNA, 201 bp, Homo sapiens
tatacaaaagcactgacctataaaatggcagggttaattaacacagctacatgtagaacactgtgtctaaggacaagcaacaggagatgatactgaaatayagatgaggctttgtttaccatcttaaaaatcagagatttttgtttatgggaattactgaaaagttttaagaagtaaaatttgctaactatgtattttatt

SEQ ID NO: 47140 - DNA, 201 bp, Homo sapiens
gaagaaaggcattaaaactggaggaatattatacaaaagcactgacctataaaatggcagggttaattaacacagctacatgtagaacactgtgtctaagracaagcaacaggagatgatactgaaatacagatgaggctttgtttaccatcttaaaaatcagagatttttgtttatgggaattactgaaaagttttaaga

SEQ ID NO: 47141 - DNA, 201 bp, Homo sapiens
gtaaattttttttttccctagggaaaggatgatctcctaagtcttcttcatgtatgtactactagctttgctgtaaagtaaggcctttatttcattaattygagagtagagaataatgtaaaattaaacacaagcattttttcccagttgatttctaacaatcacaaactatattaatttgtttaatactgcaagagcaca

SEQ ID NO: 47142 - DNA, 201 bp, Homo sapiens
caagaggctgttcttgtctcacagagctaggagccatttcaagatcctggaaataagtgattttcataagatttttgctagtgtaaattttttttttcccyagggaaaggatgatctcctaagtcttcttcatgtatgtactactagctttgctgtaaagtaaggcctttatttcattaatttgagagtagagaataatgt

SEQ ID NO: 47143 - DNA, 201 bp, Homo sapiens
ttgtttcagctggataccacccaagaggctgttcttgtctcacagagctaggagccatttcaagatcctggaaataagtgattttcataagatttttgctrgtgtaaattttttttttccctagggaaaggatgatctcctaagtcttcttcatgtatgtactactagctttgctgtaaagtaaggcctttatttcattaa

SEQ ID NO: 47144 - DNA, 201 bp, Homo sapiens
gagactctagggaagccttggaatgcaaataacttgaaaagagagcctggccaaaaaaagatttttgagccttggtagggttagtgaagcaggtttttagyacaaacacaactcaaagtatgtgtgttattaaaagtagctattttcatggaagtcttttggtactatttgttttggctagagaagtgaaaagctttcttt

SEQ ID NO: 47145 - DNA, 201 bp, Homo sapiens
gaggaaacatcgggagtaaggagggattgtggctaaaccaatgtgacaggatttttactgactgaaggccaggatgatcagatatcgcctggggggttccrggggatgtagaatttgatcaactatcaagatgatcagatatcaagagtgagggattctctccaaacagacttagcaagattctcactacaattaggcagt

SEQ ID NO: 47146 - DNA, 201 bp, Homo sapiens
tgtttgtacttacctagtctacgcagataaaaggaaaataagaattgggataataatctgaagaaatgacatagttgatattgctgccaaactaaaatcasagctggacagtaaagtggtaaaagatttcattaagggactactgcgataggagaaaagagacctcagtgtagtactgggctcaattccgaatatagcttg

SEQ ID NO: 47147 - DNA, 201 bp, Homo sapiens
cagccctgcaaggagtcttatgtaaattttataactcaatcttcatgacaatcttgcaaagtagtcataaatatttcaatatcagagatgaggaataggcwcaaagagtttaaacagctcacaattaatctgctattaatgctaggctaagtggattacaaggtctgctattttgactatgtctagctgcctccctacata

SEQ ID NO: 47148 - DNA, 201 bp, Homo sapiens
cattgtatgttatattaaagcttgtgtctttccaacttggtgctagccctttagctgcctcttcatccttttcttatatgttggggtctttgaaagtgctyagtaaataccacctttctttctccatcttaattgtaaatcattttaaacccgagacagacaagtattgcacgtggagtccaaagtgtcaattttaccact

SEQ ID NO: 47149 - DNA, 201 bp, Homo sapiens
acacctgtggagaggtagcttagggtagttacgattctctagggccagacttcctgagtctgaatcctggctctgccacttataaggtgtgtgactttgtrcaagttacttgacctctctgtgctttaatttttacatctttaaagttgggaataatacttatgtcataagattttaggagaattaaatgggttgatatct

SEQ ID NO: 47150 - DNA, 201 bp, Homo sapiens
cacatgctcatcgattaaacctcatcccatgcctcatttatacatacacagagctccaaactgttccctttacatgatttaaatcatcattttatttactsgtcccaaagtagaaatctgaatggacactatcccgaccttgaaccattttatacatacatagagctccaaactgtttcctttatatgatttaaatgatta

SEQ ID NO: 47151 - DNA, 201 bp, Homo sapiens
tcagcattcacgttttccagttgtctacaaaaaaaaaatttaactggtttgttggattcaggatctaaacaagattgcatttggttgctctgtgtgactckttaatttacaattttctgtccgttatttttcacattactgatatttaaaaaatgggggcatttgttgtgtagaatttcccacatcctggattttgctgat

SEQ ID NO: 47152 - DNA, 201 bp, Homo sapiens
aaaattgtctaatgatccaaaccaccatgctgacaaacggtattcagctgagtggcaaagggaaggataggtgagtcatatgcacatgctcatcgattaawcctcatcccatgcctcatttatacatacacagagctccaaactgttccctttacatgatttaaatcatcattttatttactcgtcccaaagtagaaatct

SEQ ID NO: 47153 - DNA, 201 bp, Homo sapiens
tccaaaatgtgtaactctagccttttgcctgagcttcagactcatgtcctactgcccacaggacatacccacctggatgtgacgcacaggtcatgtcagcrtaagtatgagcgtatgttcatgttgaaattgagtgtacttttccccctagagctgctctctgtcctaattttttatcgcaagtactggtactatcaagct

SEQ ID NO: 47154 - DNA, 201 bp, Homo sapiens
ctcaggccccaccttggatccactctatcaaaatctgcatttcaaaaatgatctttccttagcaattgcatacacactacagttggagaaaaactgtcccrcaactttaaaacatcagtctggatgtggaataatatgtgatatctcacttcatcttcacacctctacggtggttatcatctgctctaatttatagatagt

SEQ ID NO: 47155 - DNA, 201 bp, Homo sapiens
ttttttttctaattttttctcagcaagttttctttaaagttgtttcactttaaacaataagtttctttttaattcaacttatcaaaagaatgactcctctrtatgttaaaacacacttcatcttacaaaacaatgcagtcttgacagatgggctataaatagtggctttttttttttttggatgtttgaaacaaatccgaa

SEQ ID NO: 47156 - DNA, 201 bp, Homo sapiens
attttcataaccttttttgtttctctaagatgttaagggtgccaaacataacattcaaaatggatcctctcttaccctaatgttataaggaaaatcttctrtcgaaacactgcacgttctcactcataggtgggaattgaacaatgagaacacatggacacaggaaggggaacatcacacaccagggcctgttgtggggtc

SEQ ID NO: 47157 - DNA, 201 bp, Homo sapiens
ataagacacgccccctagtgtgccatgtcagtttaccattgctataacaacacccaggagttactgcctctttccagggcaatgaccagatgacccaaaarttactaccacttcccttgaaatttccgcataaaccatcccttaatctgcatgtagttaaaagtgggtataaatatgactgcaaaaccgccgtaagctgct

SEQ ID NO: 47158 - DNA, 201 bp, Homo sapiens
gtctatgttaagagaaggaatggtcagagaaacaagagggggaactaggagaaaatggtattatgaaaaacaaaggagtagaaatttgaaaaaaaaaaaaagtatcagcagtgtgaaaagcattagaaatatccagttagacaaggatgaagaactattccctgggtttcataatatggagataactgatgatctttgcca

SEQ ID NO: 47159 - DNA, 201 bp, Homo sapiens
aatctgaccgagttataagttttctaaaactaactgattagctaagcttagaatatgcttggaaataattcatttaaatattacctcatattaacacctamatattgccacatatcctaccattgttctttttattctaatagtttcttagttatgtagcatgagtagcagagtatttacagtatttatatttaaatatca

SEQ ID NO: 47160 - DNA, 201 bp, Homo sapiens
atattcatgtacaagtctttgtgttgacacatgcttcttcttttctcttgtttaagtatgtaaggagaggtaagaagtccattgattttttttttttttttaagacggagtctcgctctgtcgcccaggctggagtgcagtggcacgatctcggctcactgcaagctctgcctcctgggttcacgccattctcctgcctca

SEQ ID NO: 47161 - DNA, 201 bp, Homo sapiens
tggaaaatttctctttctattcatgggaggagaggaaatctaactggggattgagatgaaaagaagaaaaaaaggattgaatcctcttttaatatctatgrcattattttaaatcacttcagaattccacaagatttatatgtggaaaatgacatctttgctgattgcaatgtggattgcaactgtccatctaaaatatgg

SEQ ID NO: 47162 - DNA, 201 bp, Homo sapiens
ttcacttgcaggaaatgaagttgcactttcctctctaggagcaatgctttccaacagcatagggcactgtaatgggaaggggaagatgcacattctgttcyatctgtctatttggtgctcttggctgcctcacttccacttaagcagtcagttttgtcaatttacacaatggggatttgggaccttttcttgtggagttga

SEQ ID NO: 47163 - DNA, 201 bp, Homo sapiens
atcttggtgccaccctctgatgtttatatttcttattggagctttctttaaatatctgatgatccttattggcccatttatttatttttatattggtgtcrttttacaccttcatttagggattatcaaaattcaataaactgcacatatttaaaatgtataatttgactggttttggccaatgcacacactcctgaaacc

SEQ ID NO: 47164 - DNA, 201 bp, Homo sapiens
tttcacttgcaggaaatgaagttgcactttcctctctaggagcaatgctttccaacagcatagggcactgtaatgggaaggggaagatgcacattctgttycatctgtctatttggtgctcttggctgcctcacttccacttaagcagtcagttttgtcaatttacacaatggggatttgggaccttttcttgtggagttg

SEQ ID NO: 47165 - DNA, 201 bp, Homo sapiens
cctcatgaaccagtaagtactccagtctgataattttgggtggtcaaatttcacttgcaggaaatgaagttgcactttcctctctaggagcaatgctttcyaacagcatagggcactgtaatgggaaggggaagatgcacattctgttccatctgtctatttggtgctcttggctgcctcacttccacttaagcagtcagt

SEQ ID NO: 47166 - DNA, 201 bp, Homo sapiens
acagtttcttgcaaattcaaaggttacttaagttggagacaatcagtcttatggtggaaggcattttgtcaacagacggcaagtatacaatttaaaaatawttttttctacgttttcttatatttttttcctagatgtttctgttggcaataacatgtgcatttgtatccaaaacactgtctggatcttatatgaattcca

SEQ ID NO: 47167 - DNA, 201 bp, Homo sapiens
ctagtttttaaaatacgacagtcctggtaaaattgctcctatctgcatgaagtgatctaatattaatgccatattgcctgttctattgataatttcttgcwttaaagaagttggttttataactgagggtgtgtctacacaggattattgattcaggcaagttagtcctaaatggctttgagagacttaaatggaagacag

SEQ ID NO: 47168 - DNA, 201 bp, Homo sapiens
tctttgaagatcagtggtttcactttaaatgtaaattgagtgggacaaactggccaagcttactgagatatttttgcatacaccttatgtacttcccccarttcctacaagaacaatcaaccaaacaatgaactaaacaaacatgtaaagcaacaaggaaaaaacattttttagtttaatgtttcagcataaatggattga

SEQ ID NO: 47169 - DNA, 201 bp, Homo sapiens
taattcagtggctctctctttaaaacctctactgcattcctcttgccatatgtattggatcccacgttggtagatgagagaatggcaccaaagttgttgcyggaatgaactaaaaaatttgccaggcgctgcgttgcacatgtggcagtgttgcatttccgcttttccacctgatgactggtaacatggaacaaatgtgaa

SEQ ID NO: 47170 - DNA, 201 bp, Homo sapiens
tttttgtatgtggatatatgtgcatgtacactagtttttaaaatacgacagtcctggtaaaattgctcctatctgcatgaagtgatctaatattaatgccrtattgcctgttctattgataatttcttgctttaaagaagttggttttataactgagggtgtgtctacacaggattattgattcaggcaagttagtcctaa

SEQ ID NO: 47171 - DNA, 201 bp, Homo sapiens
gggtagaagtaagacatatcaagatttaaaacataaatagcttggaacaccctgaagagcaacatgggagaaactgagaaaagaattgaaacccatagaayaagatgtctttccaagttgaaggtatggaatttttgtatgtggatatatgtgcatgtacactagtttttaaaatacgacagtcctggtaaaattgctcct

SEQ ID NO: 47172 - DNA, 201 bp, Homo sapiens
agcggatgggtcattattacattaactcatcagtaaatattaacgtagcaaatacacagtgtccttgtgcagttaatggtgtgtcatacacagcagaagtktgaatttgccatctttgtaagacatgagtgaatttccaagaattaagtgtatgttatggtaaggaactgatagaaaagggtaaggataacaacaaatgtg

SEQ ID NO: 47173 - DNA, 201 bp, Homo sapiens
tggacacatgaaagactgagaccttttgtttctgagcatagttctaaacacattatttttattcagaattataaaggcattatttcattgtattctaaccrctaatgtggctaaaagaaaagcagtttttgattttttatatttcattgtttaaaacctctctgtagaagtccttaggatcttttctgtattcctgatata

SEQ ID NO: 47174 - DNA, 201 bp, Homo sapiens
cccctcacacctttctcagctctgacatcaggcagctcagagagcctctgtcattaatttccatccctatagatagaaagtacctcacaggcagcagaagyggatgggtcattattacattaactcatcagtaaatattaacgtagcaaatacacagtgtccttgtgcagttaatggtgtgtcatacacagcagaagtttg

SEQ ID NO: 47175 - DNA, 201 bp, Homo sapiens
aatccacttggtataaaaatatatgctttagttaagtttctctggtttgtttcagtatcaggttaatatagaagaaattactaccttttgatttttttccygcttcatgttctggctttgcccctctaagttccaagagtatatttcttgacaaaactggaattatccattcctgtctgtcagaagttccatcaaagatat

SEQ ID NO: 47176 - DNA, 201 bp, Homo sapiens
aggattgctacgtagttgtttttatccttttgctttcatattgagaaatactcccatcattcttccattttaaaaatactgttctagttttcttgatttaygtccttattttgatggaacatatactgcagtagcttcctgagaatggacacatgaaagactgagaccttttgtttctgagcatagttctaaacacattat

SEQ ID NO: 47177 - DNA, 201 bp, Homo sapiens
agaataactttttataaatctgtttcactcacagaatagctagctagcaatatagaataaatcccccaacagcaaatggctttttaactacttcttttagrtttcatttcttaaaaacattaatttgctcctgattatttctatacatttccatttccacaagatgtaaaagtttttaacatttccagagacatctgagga

SEQ ID NO: 47178 - DNA, 201 bp, Homo sapiens
tctagttaatgctgaatcctggaccaaagcttagctttatgactcatggtctagtgttcatttagacaaaaatacttgcttattacctacattgttatttrttctattttcataaccttttttgtttctctaagatgttaagggtgccaaacataacattcaaaatggatcctctcttaccctaatgttataaggaaaatc

SEQ ID NO: 47179 - DNA, 201 bp, Homo sapiens
tcccaatttccttctctaagcaatctgaacatttatattgtaatacattctccctttagcctttctttgaaataaaccatgaatttaacaccaagtgtgcrtttctctaaataaataaaactttcccagaaataggaaattctttaccttttaatgtttcaatgtcagcaatatcagcaaatgcttctgatagaaagaaag

SEQ ID NO: 47180 - DNA, 201 bp, Homo sapiens
aatggtctgggttcagtggctcactcttataatcccagaattttggaagactgaggcaggaggaaggcttgagcccaggagtttgacaccagcctgggcawcatagggagaccctttccctataaaataaagataaaacaattagctgggtatggtggcaggtgcctgtggtcccagctacttgggaggctgaggtgggag

SEQ ID NO: 47181 - DNA, 201 bp, Homo sapiens
aaaagtaataaaggaaaattatgggtcaaattgagaagattcaaaggtaatatctgttccaagatatgtttagcatatgactgaagcacagtgtgaaatamtttatatgctaaatgctgagtggtattttgataattggttggaaggtcaataatataatttaaaattgttctaaataaaatgttaccttatttgagttag

SEQ ID NO: 47182 - DNA, 201 bp, Homo sapiens
tctaaaatacttacttttcttgaaaaacagtaaaaattggaatttggtccaaacatctcaaaaaaagtaataaaggaaaattatgggtcaaattgagaagrttcaaaggtaatatctgttccaagatatgtttagcatatgactgaagcacagtgtgaaatactttatatgctaaatgctgagtggtattttgataattgg

SEQ ID NO: 47183 - DNA, 201 bp, Homo sapiens
taagacatttatttgtataccaactctatttttttgacagccttttgtttcaatgtgcttttaaaacgatatcggaaatggatgcagaataataacattgsttcctctttgctgattattaggaaagttagagaaatgttttagttttcagctccatagaaatcaaaatattggtgaaacttagggtaaatggaaaatgaa

SEQ ID NO: 47184 - DNA, 201 bp, Homo sapiens
tattatgggaccttagttagtactacatataaaacaatcttttgagaaggtatatgtcctagcaacaaacatcagacacacagaccatatattcacactgragatgaaaagggcactgttaaattatacaggaaatcactagaacataaaacaataactatagagttacattgtcctctaaaggggcaagtaattcagtgg

SEQ ID NO: 47185 - DNA, 201 bp, Homo sapiens
agcagttttatacttttaaatagcctcttagtaccagcaagcacaacaaacaatagactttaaaaaatattttgaccgagtcaggagcaggattttatttmtttgtttttaaaacagcattctgtcatttcagaaatatactgcaaaaaggaattgcttaacaggggtattgacaattactaatttgcttatcaggggtac

SEQ ID NO: 47186 - DNA, 201 bp, Homo sapiens
taactttcatgctttgcttcccttttaaacataagttccaatttcaaaccatatctttgtgaattaataaaactgaatgctcttaagagcacccaagtcasttcttgaaagctttagtttgaaatttcttccaccagataccttaaattatgtctcttaagttcaaagttccactgatctctagtgcaggggcaaaatgct

SEQ ID NO: 47187 - DNA, 201 bp, Homo sapiens
tgaacccgggaggtggatcacttgaacccgggaggtggaggttgcagtgagcactccagcctgagcaataagagtgaaactccatctcaaaaaaaaaaaaatggagaggtaataaatgaaatcaagagggagaaataaggttgctgtggaagaacatatatatactgagagatattaggataaaatactgggaaagacttt

SEQ ID NO: 47188 - DNA, 201 bp, Homo sapiens; identical to SEQ ID NO: 13286

SEQ ID NO: 47189 - DNA, 201 bp, Homo sapiens; identical to SEQ ID NO: 13289

SEQ ID NO: 47190 - DNA, 201 bp, Homo sapiens
taaaattttgaatgttcattatgtgtgactagcttacaactggccttttcaagacaatatgatagttttaaatctttatttttcttttatttacaaacttrtttacttttcaggtgtatgaaatctgaagagaagtcccttggtgtgggattacatacattttgcacaagagtatttggtaaaaatagttattttttccca

SEQ ID NO: 47191 - DNA, 201 bp, Homo sapiens
acttaaacaaaataaatgacatatacatttaatagaagctcactgctgctaacacacaatgaaaccctcatggatacaaagcagttttatacttttaaatwgcctcttagtaccagcaagcacaacaaacaatagactttaaaaaatattttgaccgagtcaggagcaggattttatttctttgtttttaaaacagcattc

SEQ ID NO: 47192 - DNA, 201 bp, Homo sapiens; identical to SEQ ID NO: 13312

SEQ ID NO: 47193 - DNA, 201 bp, Homo sapiens
ggcataacgcagcatgatggcagtttatctgaattaatgctacttccaaagctacctaactcaaagtcagggaaaagcagatattcataagaatctgactsaaagcaaagcatttcatcttctgtccaacattgcagctgctatcaaaaaaagtgtatcatatacataacctctgccagaaatgtctaatttgttaaacaa

SEQ ID NO: 47194 - DNA, 201 bp, Homo sapiens
tcaagagatttcttacagttctaattgatgtaattttaaattagagcttagtttttaaaagaaacatctttttaaaacgtaatttacaaggatcaaaattkttattgatacagtcccttaatattgtccacttttcaagtaatttcgagatttttactttcccaatttccttctctaagcaatctgaacatttatattgta

SEQ ID NO: 47195 - DNA, 201 bp, Homo sapiens
ttaaatgtttcactttcgtaagaaattgaatgaataaacttcagaataaaatcttcgattaatatctgctgtatccatataataacctttgtgttatagartcactctaactatgttttaatctctagcaccagaggttgttgggttactattcataattcttcttgtttaattcctgggaattgtatgctaccataggca

SEQ ID NO: 47196 - DNA, 201 bp, Homo sapiens
aagcacaacaaacaatagactttaaaaaatattttgaccgagtcaggagcaggattttatttctttgtttttaaaacagcattctgtcatttcagaaatayactgcaaaaaggaattgcttaacaggggtattgacaattactaatttgcttatcaggggtacttacaattactaattttctttcttttttttgagacgag

SEQ ID NO: 47197 - DNA, 201 bp, Homo sapiens
aacatatgtgtgcaagtgtgtttttcatataatcactgctcttcctttggttagatactcaatactgggattactgtatcaaattgtagatgtacttttakctctttaaggaatctccatattcttttccagagaggttgtactaatttacattctcactagcattgtgtaagcatttctttttccccacatttacacgaa

SEQ ID NO: 47198 - DNA, 201 bp, Homo sapiens
taatggctgagtagtatcccatagtgggtaaataccatattttctttatccactcattagttgatgggcacttaggttggcttcacacctttgcaactgtkaattgtactgctataaacatatgtgtgcaagtgtgtttttcatataatcactgctcttcctttggttagatactcaatactgggattactgtatcaaatt

SEQ ID NO: 47199 - DNA, 201 bp, Homo sapiens
atttaatagaagctcactgctgctaacacacaatgaaaccctcatggatacaaagcagttttatacttttaaatagcctcttagtaccagcaagcacaacraacaatagactttaaaaaatattttgaccgagtcaggagcaggattttatttctttgtttttaaaacagcattctgtcatttcagaaatatactgcaaaa

SEQ ID NO: 47200 - DNA, 201 bp, Homo sapiens
tatagtggtgaattttaacattttagtgtacctgtcacccaagaagcgtacattatatctgactgatggttctttattcctggccccctctcaccctcccscttctgaatctctaaagtccattatatcactctgtgtgcctttgcataactgatagcttagctcccccttgtaagtgagaacatacagtttttggttttc

SEQ ID NO: 47201 - DNA, 201 bp, Homo sapiens
aaagagtttccagaagtctgtggtcttttaattgaagacacgattaatagaacacaagttgtttcgcaataccctgcataagaatatgactgaggtttgckgaaagccacttaaacaaaataaatgacatatacatttaatagaagctcactgctgctaacacacaatgaaaccctcatggatacaaagcagttttatact

SEQ ID NO: 47202 - DNA, 201 bp, Homo sapiens
gattacagagatgactcatacatccttcacctcagttagtttacaggctggatggggaaataacacttgagcatacataaccaaaaaataaggtagaaccygtgaacttcttctaggtggtctcaaaatcccaaccactaatatcatatcaaatataaaaataagctcactaaacatgttcagtgactgagggaatgtcta

SEQ ID NO: 47203 - DNA, 201 bp, Homo sapiens
tagaccaaaattccatggggaggacgttaagggaccagctataggatgtgggtctacttagtcggcaaaggttttattgaaccatagaagaaaatgttctyagttgtatacggaacaaagaaaataggacaatcccatttggattttggaagaaaaaaaagatgtgctaccagcaatctttcagtgttggaaatatttagt

SEQ ID NO: 47204 - DNA, 201 bp, Homo sapiens
ttcatttattatttaatgcaaccctagcacaaatccaagtatttaagatagttgttatgcagtaaatgctagaatgtaaatgattgggtgaggctcttaaktaagactttgttcatactttttaaaatgattattctcaattttttcctaggaaatcttttgttgattatatttgtgagttattttggaaccaaactgcat

SEQ ID NO: 47205 - DNA, 201 bp, Homo sapiens
gttttaaatctttatttttcttttatttacaaacttatttacttttcaggtgtatgaaatctgaagagaagtcccttggtgtgggattacatacattttgyacaagagtatttggtaaaaatagttattttttcccacatcctatcagaacaatattattattattattttttattacactttaagttttagggtacatgt

SEQ ID NO: 47206 - DNA, 201 bp, Homo sapiens
attaaggtagcttgttctaagaaagtcactcaggactcagtatctaagaactcagtgctctaatgtaccatttattaagggttttgtattaagcattgttkgatttcacaaaattttaaagttagcaatgcacatgttcatctgctggcatttcactcctattcctcgctacttttcttccttatttcttagagttaaatg

SEQ ID NO: 47207 - DNA, 201 bp, Homo sapiens
ctgcctggacatccaggtgtttccacacatcttctgaaatctaggtggaggttcccaaacctcaattcttgacttctgtgccccgtagggtcaataccatrcggaagctgccaaggcttggagtttgcatcctctgaagccaagcttgagctgtaccttggccccttttagccatgattggagtgcctgggatgtagggca

SEQ ID NO: 47208 - DNA, 201 bp, Homo sapiens
aattattttctttatttatatttttttggggtcatttattaaggtagcttgttctaagaaagtcactcaggactcagtatctaagaactcagtgctctaaygtaccatttattaagggttttgtattaagcattgttggatttcacaaaattttaaagttagcaatgcacatgttcatctgctggcatttcactcctattc

SEQ ID NO: 47209 - DNA, 201 bp, Homo sapiens
tgcactgcgctagcaggggtccatgagggccctgcccttacaacaaacctctgcctggacatccaggtgtttccacacatcttctgaaatctaggtggagsttcccaaacctcaattcttgacttctgtgccccgtagggtcaataccatacggaagctgccaaggcttggagtttgcatcctctgaagccaagcttgagc

SEQ ID NO: 47210 - DNA, 201 bp, Homo sapiens
cggtggatctaccattctggggtctggaggacagtggccctcttctcacagctccactaggcagtatcccattggggactctgtgggggcgctccaacccygcatgtcccttctgcactgcgctagcaggggtccatgagggccctgcccttacaacaaacctctgcctggacatccaggtgtttccacacatcttctgaa

SEQ ID NO: 47211 - DNA, 201 bp, Homo sapiens
ctgtggcttttccaggtgcacggtgcaagctgtcggtggatctaccattctggggtctggaggacagtggccctcttctcacagctccactaggcagtatyccattggggactctgtgggggcgctccaaccccgcatgtcccttctgcactgcgctagcaggggtccatgagggccctgcccttacaacaaacctctgcc

SEQ ID NO: 47212 - DNA, 201 bp, Homo sapiens
gttacttcctagatacaataggggtacagacattgggtaaatatacccattccaaatgggagaaattggccaaaacaaaggggctacaggcccaacataartctaaaatccaatgggcagtcattaaaccttaacattccaaaatgatctcctttgactccatgtctcacatacaggtcgtgctgatgcaagaggtgggct

SEQ ID NO: 47213 - DNA, 201 bp, Homo sapiens
gactggcacagagtagatgttcaataagtatttgttgtatctgtgagagaatgtgttaaaataacaaaactcaaacataatagtgcagcgactatgccttratgtgtgtgtgtttgggattcagcacatttgtagaggtaaagcagttggttttttaaaaaattagtgccattcaggatcacttgttaaatggatattgtt

SEQ ID NO: 47214 - DNA, 201 bp, Homo sapiens
attttttaatatttcatgctttggtcaatgccacagtaccctagaattttagtaatgattacagttaaaaattagtgttgtattgctagatgtattagtcyattttcatactgctataaagaaatacccaagactgggcaatttataaataaagagagatttaagggactcatagttccacatggctggggaggcctcaca

SEQ ID NO: 47215 - DNA, 201 bp, Homo sapiens
cgctagtttatactctctgtaggcacgtacttggctttcttgctcactgctgaatgctggtgcgtagcaccatgactggcacagagtagatgttcaataartatttgttgtatctgtgagagaatgtgttaaaataacaaaactcaaacataatagtgcagcgactatgccttgatgtgtgtgtgtttgggattcagcaca

SEQ ID NO: 47216 - DNA, 201 bp, Homo sapiens
agtacattacccattttaggttattcagctcctaaactcgcaaatattgacagggcaacatgtaccacagatgtgtgagattttaaagctattgaagaggytcagtacattgtgtcttaaaaatagtcacatttaagcatccattggattgctgtattatggtatttacaatgatgaggtacaaaagggtctaggtctatg

SEQ ID NO: 47217 - DNA, 201 bp, Homo sapiens
gtaataattataactatttttgacaagtaaattgatatcttgttgccttcctttattatagatgaaaaaacagtttacctcagattactggtcacagtgaycctaactcatatttggttgtaaggtagtacattacccattttaggttattcagctcctaaactcgcaaatattgacagggcaacatgtaccacagatgtg

SEQ ID NO: 47218 - DNA, 201 bp, Homo sapiens
gaatgtggcttaggggttacttaatacagctactcagaggcagaacaaagacaagacagagctgaaggctgacaacttttcagtgaatttgtctagcagcwggagctaccaattattgaaatttataacatttcaggctctctaagagggactttacataatttatctcatttttttatatgctatgtggatatctaatct

SEQ ID NO: 47219 - DNA, 201 bp, Homo sapiens
tttaaagcctagtgagcatgactttaagtttgctcagagtgctttatatttgtcctctgcagtttgggagacacaggggactggtgtccaattcatacttmggaaatttaagaagcctaaaaggcaaaaaggctgtggctggatccacctgccaggaggtgaattgaagagagggctacatttgaaaaggagcttcacccc

SEQ ID NO: 47220 - DNA, 201 bp, Homo sapiens
gctcactgcaacctccgcctcctgggtttaagcgattctcctgccttagcctcctgagtagctgggattacaggcacatgtcaccacccccggctaatttytgtatttttagtagagacagggtttcaccatgttggtcaggctggtctcgaactcctgaccttgtgatctgcctgcctcggcctcccaaagtgctgggat

SEQ ID NO: 47221 - DNA, 201 bp, Homo sapiens
aagatttatatgtggaaaatgacatctttgctgattgcaatgtggattgcaactgtccatctaaaatatgggatcctgtgtgtggaaacaatggcttgtcrtatctgtcagcttgtcttgctggttgtgagacatccattggaacgggaataaacatggtaagacatcctatttgacagaacttttttgagttgcattggt

SEQ ID NO: 47222 - DNA, 201 bp, Homo sapiens
tcactatgagttggacctaaatagttacttatataaggcatattacataaaagtgataacatatttgttcctttggtaagtcattttgtaaataatatttyatttgcatttataggtatttataacttacctccaatatgtattggatatataattggtggtttaattatgaagaagttcaagattactgtcaaacaagct

SEQ ID NO: 47223 - DNA, 201 bp, Homo sapiens
gaagaggttttatgaaaactctcattgccagcatgtgtaacaggttgtagaggtagagaggtgcactagagatcaaagggtagagataaaaataaaagtcrtttctgtagagagagttgtgctgtgtgtcccactttcacttctgttagggggaggtaagctattctttcttctgatttaaagcctagtgagcatgacttt

SEQ ID NO: 47224 - DNA, 201 bp, Homo sapiens
agtgtgtgtatttttttacagatgatctgatcataactcccactgacactcgttgggtcggtgcatggtggtttggctttctgatttgtgcaggagttaaygtgctcactgccattccttttttctttttgcccaacacacttccaaaggaaggactagagactaatgctgacatcattaaaaatgaaaatgaagacaaac

SEQ ID NO: 47225 - DNA, 201 bp, Homo sapiens
gaaaattaactacaaaacctaaggtatttggccagtgctaaacaagagacttagagaaatatggtctcatgtgattctgccccaggaggcatgaattatttgataataggagaggaggatgaaatgtgccacagtaagatttagaataggtgagagataagtccttccttttgtaacatttggaaaggaaattatgcaggg

SEQ ID NO: 47226 - DNA, 201 bp, Homo sapiens
tacaatgaaatcttctgttagaaaattaactacaaaacctaaggtatttggccagtgctaaacaagagacttagagaaatatggtctcatgtgattctgcyccaggaggcatgaattatttgataataggagaggaggatgaaatgtgccacagtaagatttagaataggtgagagataagtccttccttttgtaacattt

SEQ ID NO: 47227 - DNA, 201 bp, Homo sapiens
ttctttggaagcattcttactaaatactagaataaaactgctatcactaccagtattcattttgaggtgaagatcctactcaatgaaaaactagttagttataacaacaataataaaacattagaaaagatgaaaataaatttggattttctcagtgggaaaattaaaaaaacataaaatattttaacaaatactgaaatt

SEQ ID NO: 47228 - DNA, 201 bp, Homo sapiens
gaaggaaggcattttactacagtaatgtcgcttggttatttgaaccctctgtagttacatgtcaaaattcaaattgtgttgcaatatcaaaaattactgtsaattgataagttggttttctttcaagtttgttgaaaacaatcaaaatttttacagaagaatatgttagttattagaatctttcattttgccaatttctga

SEQ ID NO: 47229 - DNA, 201 bp, Homo sapiens
attctttggaagcattcttactaaatactagaataaaactgctatcactaccagtattcattttgaggtgaagatcctactcaatgaaaaactagttagttataacaacaataataaaacattagaaaagatgaaaataaatttggattttctcagtgggaaaattaaaaaaacataaaatattttaacaaatactgaaat

SEQ ID NO: 47230 - DNA, 201 bp, Homo sapiens
atatgtatatttctgctgaagtgtttatcatataatacattttcatttatatttatattggatacagttataaactcagttttgtacagtaactagtacaytttttgtggtcataacatgttattgtaatccaattaatatcacagaaggctttagtatcctatgtcaggtaccgatcatctttttcaatatttttaggta

SEQ ID NO: 47231 - DNA, 201 bp, Homo sapiens
gattctttggaagcattcttactaaatactagaataaaactgctatcactaccagtattcattttgaggtgaagatcctactcaatgaaaaactagttagttataacaacaataataaaacattagaaaagatgaaaataaatttggattttctcagtgggaaaattaaaaaaacataaaatattttaacaaatactgaaa

SEQ ID NO: 47232 - DNA, 201 bp, Homo sapiens
tgattctttggaagcattcttactaaatactagaataaaactgctatcactaccagtattcattttgaggtgaagatcctactcaatgaaaaactagttagttataacaacaataataaaacattagaaaagatgaaaataaatttggattttctcagtgggaaaattaaaaaaacataaaatattttaacaaatactgaa

SEQ ID NO: 47233 - DNA, 201 bp, Homo sapiens
taatataagtacagatattataacacttacatagggattttagatataacaatttagaaacatattaaatagatatttttctagacaattaattatatattaccagattttattataaatctatagaaacatgaatatttttatagttacttaaaaatgtaaaactttcaaaagtgctcatctcccaaggtaccaagttca

SEQ ID NO: 47234 - DNA, 201 bp, Homo sapiens
cagcatgtatatctaaatcgtggttagtccctaaatccttagataagaatatctatttctgcagaatggatttccaaaagtggaatgccagaaacattgtstactgcaatatgcaatcccatcacttctccaccccattccattgtatgtgataaatctttcaaaaaatttttaattaactgtatgcaaaaataagggtat

SEQ ID NO: 47235 - DNA, 201 bp, Homo sapiens
gctaatataagtacagatattataacacttacatagggattttagatataacaatttagaaacatattaaatagatatttttctagacaattaattatatattaccagattttattataaatctatagaaacatgaatatttttatagttacttaaaaatgtaaaactttcaaaagtgctcatctcccaaggtaccaagtt

SEQ ID NO: 47236 - DNA, 201 bp, Homo sapiens
aaatacaggatcatcattacctacatatgtggacttgttgctgtaatcatttaactatgaactatggacatccctctaggtcagcatgtatatctaaatcrtggttagtccctaaatccttagataagaatatctatttctgcagaatggatttccaaaagtggaatgccagaaacattgtgtactgcaatatgcaatccc

SEQ ID NO: 47237 - DNA, 201 bp, Homo sapiens
aaaaagctaatataagtacagatattataacacttacatagggattttagatataacaatttagaaacatattaaatagatatttttctagacaattaattatatattaccagattttattataaatctatagaaacatgaatatttttatagttacttaaaaatgtaaaactttcaaaagtgctcatctcccaaggtacc

SEQ ID NO: 47238 - DNA, 201 bp, Homo sapiens
taaaaaagtcaattttgggcgtatctttttacatttctttctatgctcatgtaaaacatacatgatttatgtaattatacacatatgctcccccacaaccyttagtcacaaatacaggatcatcattacctacatatgtggacttgttgctgtaatcatttaactatgaactatggacatccctctaggtcagcatgtata

SEQ ID NO: 47239 - DNA, 201 bp, Homo sapiens
ttaacaaacaccttgctatgacatctgtttctttattcaacaaatactatggtgtattatatgtaaatgtagctgtgataatctctatacatattaaaatraggatgatgtggtccatacaaggttagtaaataaagaactacataattattagtactatatatatgtagtgtgtatatatatgtatatacatatatagtg

SEQ ID NO: 47240 - DNA, 201 bp, Homo sapiens
tgcattcaaaacctttctcgctattttcactacctctgtttttgttgaggttctcattactttgtctgtagtttctctttattattttctcttcagaattytattttctcagtttttaagaaacattcttgcaatataatttttctcaagcattgttttaatcatgtcttctctactatatttatgacacatataagctcc

SEQ ID NO: 47241 - DNA, 201 bp, Homo sapiens
gaaatctaccttagcttcttttcagggcaatatgttccttgaggttagaaattagttatatttttgtagtcttagtgatttccacaatgatgagtagagtrtcttggcacagttggccttccataaaagtttgttgaatggagatgagatatgctaaatgacaatgagctacttggttaataaatctactttctactattg

SEQ ID NO: 47242 - DNA, 201 bp, Homo sapiens
tgtacgtggaatgggtgaaactcccatcctgcctttgggtatttcctatatagaagattttgccaaatttgaaaattctcctttatatattggtaagtatrgaaatctaccttagcttcttttcagggcaatatgttccttgaggttagaaattagttatatttttgtagtcttagtgatttccacaatgatgagtagagt

SEQ ID NO: 47243 - DNA, 201 bp, Homo sapiens
aggggccatggtcatataactgtgaaatgcctacagaaaacatagaattaatattactgacactttatcgtcaaagcactaatgtcatgtcttttttttttaatgcagagtgtacaaaggaagttaaatcattaatgtgggtgtacgtcctagtaggcaatattgtacgtggaatgggtgaaactcccatcctgcctttgg

SEQ ID NO: 47244 - DNA, 201 bp, Homo sapiens
aatttgaaaaatgtctgtctcagaagaagccaaagaacccccatgggggaaacaaaggaaaacaatgacattaatagtggcctgtgttctcttcctgagckggctattgccaaagactgacccaggtgctagtcggcttcattgtggatatagcaaaaccttcccattctggcacatctccaggaaggtggattgatgctt

SEQ ID NO: 47245 - DNA, 201 bp, Homo sapiens
accatcattgagtcaggaaaccaaaacagtttcaaaaatttgaaaaatgtctgtctcagaagaagccaaagaacccccatgggggaaacaaaggaaaacartgacattaatagtggcctgtgttctcttcctgagcgggctattgccaaagactgacccaggtgctagtcggcttcattgtggatatagcaaaaccttccc

SEQ ID NO: 47246 - DNA, 201 bp, Homo sapiens
ctattaaaaaatacaaaaattagccaagcatggtagcgggcacctgtaatcccagctactcaggaggccgaggctggaggatcgcttaaacccaggtggcrgaggttgcagtgatccaagattgcgccattgcactccagcctgggcaacagagtgagactctgtctcaaaaaaaaaaagagtcaaagacatctatccaag

SEQ ID NO: 47247 - DNA, 201 bp, Homo sapiens
ttatgatggacaaatattttggtttttttaggggtttatgaaacgcatggaggagttattgtacggtttctcagaaactggaggtttcgcttcttttgagyaaactttagagaatgccaagttgaaggcttgttttgttgttattccttccaaagcatttatcttcttaattatgcattattgaatgtcacattttttaaa

SEQ ID NO: 47248 - DNA, 201 bp, Homo sapiens
ttttttttatccttgtggaatcatgcctttccccattctgtttgaaaatctatttaccgtcattttgctgatgctttgggaatgaatagactttgagttaytggatttttagtggataaattaacaaaacatattttctcttttaaagtatttttgaagggatcagagtttctaagcagagtctttccttttcttttattt

SEQ ID NO: 47249 - DNA, 201 bp, Homo sapiens
tcagaagttccatcaaagatatttatttgccactggtgttattctttaaagaacacagaattcaaggaacaatggaatagctgaaggtactgttcttaagyatgatatagtcagaaatctaaggctgtagttatttgacagtatttaattctaattttctcacactttacaaaagttacaaagaaacaggattttaaagtt

SEQ ID NO: 47250 - DNA, 201 bp, Homo sapiens
tttctatagttcatacagaaaatactgacttaagctaataacagtgtgtgtatttttttacagatgatctgatcataactcccactgacactcgttgggtyggtgcatggtggtttggctttctgatttgtgcaggagttaacgtgctcactgccattccttttttctttttgcccaacacacttccaaaggaaggactag

SEQ ID NO: 47251 - DNA, 201 bp, Homo sapiens
tgaaaaagctaatataagtacagatattataacacttacatagggattttagatataacaatttagaaacatattaaatagatatttttctagacaattaattatatattaccagattttattataaatctatagaaacatgaatatttttatagttacttaaaaatgtaaaactttcaaaagtgctcatctcccaaggta

SEQ ID NO: 47252 - DNA, 201 bp, Homo sapiens
gagcatttacaagtagagtagttaagttaaatgtggttatactggattaccataggcttaaatccaatcactggtgtccatttttttctgaatcctagtamtgtttcataataaaagaaaattttagaagtagaaagataaaaatagatgaagaaattaataaatagactatataccatagagggaataagaaagtaaaga

SEQ ID NO: 47253 - DNA, 201 bp, Homo sapiens
tctatttagctccttgctctacccctcccttataaattattgcactattttggacagataggtctgtgtgtgtgtgtgtgtgtgtgtgtgtgtgtgtgtgtccatatttatctctatcatctctacgcataagtagagataggtatatatgtatatgtgtggtactgttctcttatattttctagttggttattgctggtt

SEQ ID NO: 47254 - DNA, 201 bp, Homo sapiens
ttctatttagctccttgctctacccctcccttataaattattgcactattttggacagataggtctgtgtgtgtgtgtgtgtgtgtgtgtgtgtgtgtgtgtccatatttatctctatcatctctacgcataagtagagataggtatatatgtatatgtgtggtactgttctcttatattttctagttggttattgctggt

SEQ ID NO: 47255 - DNA, 201 bp, Homo sapiens
cttctatttagctccttgctctacccctcccttataaattattgcactattttggacagataggtctgtgtgtgtgtgtgtgtgtgtgtgtgtgtgtgtgtgtccatatttatctctatcatctctacgcataagtagagataggtatatatgtatatgtgtggtactgttctcttatattttctagttggttattgctgg

SEQ ID NO: 47256 - DNA, 201 bp, Homo sapiens
acttctatttagctccttgctctacccctcccttataaattattgcactattttggacagataggtctgtgtgtgtgtgtgtgtgtgtgtgtgtgtgtgtgtgtccatatttatctctatcatctctacgcataagtagagataggtatatatgtatatgtgtggtactgttctcttatattttctagttggttattgctg

SEQ ID NO: 47257 - DNA, 201 bp, Homo sapiens
gtgttccttcaggagggatgattggtggagacttctatttagctccttgctctacccctcccttataaattattgcactattttggacagataggtctgtstgtgtgtgtgtgtgtgtgtgtgtgtgtgtgtgtccatatttatctctatcatctctacgcataagtagagataggtatatatgtatatgtgtggtactgt

SEQ ID NO: 47258 - DNA, 201 bp, Homo sapiens
tgctgcctgggcttgggtgaagggtggcacaagcacttccttagcttccctggctggtgtctcagtagggaagtgactcccaagtccattggctctgagcscagctcagcactagaacttgcctaggagttgtagtccttgcaacctagactgcctttcaagtttatttagggagagcacgtttgcccatggtggcgaggc

SEQ ID NO: 47259 - DNA, 201 bp, Homo sapiens
tgtattctgtagccattggataaaatgttctgtaagtatttattaggttcatttggtttataatttggatgaaatccaatgtttctttgtttatttatttwtttttttttttggtctggaagatctgtccaatgctgaaagtgaggtgtgaattcttcagctattattgtattaggctctatctctctctttagctataat

SEQ ID NO: 47260 - DNA, 201 bp, Homo sapiens
tatttgtattctgtagccattggataaaatgttctgtaagtatttattaggttcatttggtttataatttggatgaaatccaatgtttctttgtttatttwtttatttttttttttggtctggaagatctgtccaatgctgaaagtgaggtgtgaattcttcagctattattgtattaggctctatctctctctttagcta

SEQ ID NO: 47261 - DNA, 201 bp, Homo sapiens
ctccagactctggagtcaatgaacattttcagctggagtggcaggggatgtctctgggagttgaatgtttcttaaacaaactttaaaccaaaatgtttgcrctcttattgttttggatcatactcacttttgcatttaagtatcttgcctgaatgttcctgggctttgcagcattgcttccttgcaggcacttagagttgc

SEQ ID NO: 47262 - DNA, 201 bp, Homo sapiens
tggagattcctcacatatcactttcaattctccatctgcaatctgaacttggaattctctaggcctgctgcattgctatttccttggaattttctctcatyattatccttgagaatttgctttttacctgtttcatacattcagttattcattttctgggatgtcatgtctcctgctttcctctttcctcttcacttgttt

SEQ ID NO: 47263 - DNA, 201 bp, Homo sapiens
cagtgtattatttttgtcttggagattcctcacatatcactttcaattctccatctgcaatctgaacttggaattctctaggcctgctgcattgctatttycttggaattttctctcattattatccttgagaatttgctttttacctgtttcatacattcagttattcattttctgggatgtcatgtctcctgctttcct

SEQ ID NO: 47264 - DNA, 201 bp, Homo sapiens
gccttcaggtgttgaagtgaaagaaagagttgcacatttctcactttaaatcaaaagctagaaatcattaagctcagcgaggagggcaagttgaaattcaraataggcccaaagctaagccacttgcaccaaatagccaagctgtgaacacaaggaaaaagtgctatttcaaggaagacacaaatgattagaaagtgaaac

SEQ ID NO: 47265 - DNA, 201 bp, Homo sapiens
atcatttttccaacagcatgtgctcactttgtgtctgggtcatatttgataattattgcaatatttcaaacttttgcattatttttgtatctgttatggcratctgtgattagtgatcattgatattactaatgtaattgttttgatgtgccactaacttatgcccatttaagatggtgatttatttatttatgtatttct

SEQ ID NO: 47266 - DNA, 201 bp, Homo sapiens
attagttttgaatcctggcataccctgctttactgcatttcactttattgcactttgcagatattacatttctcacaaattgaaggtttattgcaaccctrcgttgaagattagaatcatttttccaacagcatgtgctcactttgtgtctgggtcatatttgataattattgcaatatttcaaacttttgcattattttt

SEQ ID NO: 47267 - DNA, 201 bp, Homo sapiens
ctaactaaatgttattctattagttttgaatcctggcataccctgctttactgcatttcactttattgcactttgcagatattacatttctcacaaattgwaggtttattgcaaccctacgttgaagattagaatcatttttccaacagcatgtgctcactttgtgtctgggtcatatttgataattattgcaatatttca

SEQ ID NO: 47268 - DNA, 201 bp, Homo sapiens
gccttgcctctgtatttctaactaaatgttattctattagttttgaatcctggcataccctgctttactgcatttcactttattgcactttgcagatattrcatttctcacaaattgaaggtttattgcaaccctacgttgaagattagaatcatttttccaacagcatgtgctcactttgtgtctgggtcatatttgata

SEQ ID NO: 47269 - DNA, 201 bp, Homo sapiens
ttccccaagttggccaggctggtctggaacccctgggttcaagcaatccgcccacctcggcctctcaaagtgcgggattacaggcatgagccacctggccmagccttgcctctgtatttctaactaaatgttattctattagttttgaatcctggcataccctgctttactgcatttcactttattgcactttgcagatat

SEQ ID NO: 47270 - DNA, 201 bp, Homo sapiens
aataggatatatatggaagttagacttatggaaattagaagaaggggaatgagagatagtttggaattctgtggctatttaggtgactgacataaatgggrgcagaggacataatgaggttagttcttacggattcaaggcagatagtgttggtgaaacagtgagtgtcaaaattaggcgaggtggtgactgggctccctg

SEQ ID NO: 47271 - DNA, 201 bp, Homo sapiens
gatttgttggtgacactgtgtggtcctgggagcagaagtcactgtgtaaacaacactgtgctaacaaaagaggactgttcacatggctggcactagcacarcctcgagaagatgaaaagacggcacacggaatttcctgatttggggccaagatggacaacaatgactatgatattaaccgttggattttatggattttta

SEQ ID NO: 47272 - DNA, 201 bp, Homo sapiens
atagattgatttgcatatgttgaactattcttgcatctctgggataaatcccatttggtcatgatgaatgatcttcttaatgtgttgttgaatttggtttratagtattttgttgaggatttttgcatcagtattcatcagtgatattagcctttagttttccttttttttttttttcttatgtgtctttttctggttttg

SEQ ID NO: 47273 - DNA, 201 bp, Homo sapiens
aatgatcatatggttttattcgtttgttcttttggtatgatgtatcatatagattgatttgcatatgttgaactattcttgcatctctgggataaatcccrtttggtcatgatgaatgatcttcttaatgtgttgttgaatttggtttaatagtattttgttgaggatttttgcatcagtattcatcagtgatattagcct

SEQ ID NO: 47274 - DNA, 201 bp, Homo sapiens
ccccactcagtatgatacttactataggtctctcatatatggcctttattatgttgagccatgttccttttatacccagttttttgagagtttttttttttaccataaagcgatgctgaatcttatcaaatgttttttccacattaattgaaatgatcatatggttttattcgtttgttcttttggtatgatgtatcatat

SEQ ID NO: 47275 - DNA, 201 bp, Homo sapiens
ctgcgcccactgtctggcactccctagtgagataaacccggtacctcagatggaaatgcagaaatcacccgtcttctgcatcgctcacactgggagctgtrgaccggagctgttcctatttggccatcttggctcctccccctcattcttttttttatggctgaatattactccatcctgtatatgtaccacattttcttt

SEQ ID NO: 47276 - DNA, 201 bp, Homo sapiens
atcagtattggcctgcgcccactgtctggcactccctagtgagataaacccggtacctcagatggaaatgcagaaatcacccgtcttctgcatcgctcacrctgggagctgtggaccggagctgttcctatttggccatcttggctcctccccctcattcttttttttatggctgaatattactccatcctgtatatgtac

SEQ ID NO: 47277 - DNA, 201 bp, Homo sapiens
tttgctgaggagagttttacttcccagtatgtggtcaattttggaataggtgtggtgtggtgctgaaaaaaatgtatattctgttgatttggggtggagarttctgtagatgtctattaggttcgcttggtgcagagctgagttcaattcctgggtatccttgttaactttctgtctcattgatctgtctaatgttgacag

SEQ ID NO: 47278 - DNA, 201 bp, Homo sapiens
atttgctgaggagagttttacttcccagtatgtggtcaattttggaataggtgtggtgtggtgctgaaaaaaatgtatattctgttgatttggggtggagrattctgtagatgtctattaggttcgcttggtgcagagctgagttcaattcctgggtatccttgttaactttctgtctcattgatctgtctaatgttgaca

SEQ ID NO: 47279 - DNA, 201 bp, Homo sapiens
agaacatctttatttctgccttcatttcgttatgtacccagtagtcattcaggagcaggttgttcagtttccatgtagttgagcggttttgagtgagattmttaatcctgagttctagtttgattgcactgtggtctgagagatagtttgttataatttctgttcttttacatttgctgaggagagttttacttcccagta

SEQ ID NO: 47280 - DNA, 201 bp, Homo sapiens
gtcttttggtgcctgccctactttacttaacgttatgacctccagttccattcatgttgttgcaaatgaaagggtctcattctttttttttttttttttttattatactttaagttttagggtacatgtgcacattgtgcaggttagttacatatgtatacatgtgccatgctggtgcgctgcacccactaactcgtcatc

SEQ ID NO: 47281 - DNA, 201 bp, Homo sapiens; identical to SEQ ID NO: 13303

SEQ ID NO: 47282 - DNA, 201 bp, Homo sapiens
tgtcttttggtgcctgccctactttacttaacgttatgacctccagttccattcatgttgttgcaaatgaaagggtctcattctttttttttttttttttttattatactttaagttttagggtacatgtgcacattgtgcaggttagttacatatgtatacatgtgccatgctggtgcgctgcacccactaactcgtcat

SEQ ID NO: 47283 - DNA, 201 bp, Homo sapiens
acccagaaatatatgtaagaaaactattaaaataaaaatcaatctaatttcacctcccagagaaacatgactttttttttttttttttttttttttttttkgagacagagtcttgctctgtcaccaggctggagtacagtggcaccatctcggctcactacaacccctgcctcctgggttcaagtgattcccctgcctcgg

SEQ ID NO: 47284 - DNA, 201 bp, Homo sapiens; identical to SEQ ID NO: 13307

SEQ ID NO: 47285 - DNA, 201 bp, Homo sapiens
agcctcctgagtagctgggactacaggtaccatgcctggctaattttttgcatttttagtagagacggggtttcactgtgttagccaggatggtctcgatytcctaacctcgtgacccgcccgcctcggcctctgtttttatttttgttgagacagtctcactcactctgtcgcccaggctggagtgcagtggcgccatct

SEQ ID NO: 47286 - DNA, 201 bp, Homo sapiens
cagtctgaaggctgatttttcttttaatttttaccaaagtaactatgtacaaagtcataaaaataaaaactattacaaaaaagcttacattgacaaaaagktctcccttgtcacttattactgctttccagaggcaagtgcttataacttttagctctttcttgtatttgccaccaatttctttcttttttttctgttttt

SEQ ID NO: 47287 - DNA, 201 bp, Homo sapiens
aatgcaaataacttgaaaagagagcctggccaaaaaaagatttttgagccttggtagggttagtgaagcaggtttttagtacaaacacaactcaaagtatrtgtgttattaaaagtagctattttcatggaagtcttttggtactatttgttttggctagagaagtgaaaagctttcttttaaccatgtgaccattatttt

SEQ ID NO: 47288 - DNA, 201 bp, Homo sapiens
gtgtttgggattcagcacatttgtagaggtaaagcagttggttttttaaaaaattagtgccattcaggatcacttgttaaatggatattgtttaaaggacwtaattaattaatgctggggatactgttaagaaatcattctagaaactagaataaatattgccaaagtgaaacactttggttttgatacaaattattgcct

SEQ ID NO: 47289 - DNA, 201 bp, Homo sapiens
tttataatcttgagtcattgcagaggcattctttatatatagtgggggcaaggtagatattatttactgaattaaaaatgtatggtttgcaaaaaacttaytcgtatatttgtttttttcaaatctttattccacactcttcaaggatctgtccatcagatgggccttcccccattagtttctttattctaaagcttcgtc

SEQ ID NO: 47290 - DNA, 201 bp, Homo sapiens; identical to SEQ ID NO: 13285

SEQ ID NO: 47291 - DNA, 201 bp, Homo sapiens
taataattttaattgcataaaaaaaactatatgggtgcaaaggaagccaattatattgaagtagaattatcaaaatattaaaacaaatttttatatagtartatttgtacttttaatcaacccattaaattaaaaagttactaattttaaagtaattattgtgtcaatgttttgaattgtttgcaacagccatattgtcat

SEQ ID NO: 47292 - DNA, 201 bp, Homo sapiens
tcaaaatgtgatattcactcagaacttcacaatgtgaccttatttgcaaatagagcatttacaagtagagtagttaagttaaatgtggttatactggattrccataggcttaaatccaatcactggtgtccatttttttctgaatcctagtactgtttcataataaaagaaaattttagaagtagaaagataaaaatagat

SEQ ID NO: 47293 - DNA, 201 bp, Homo sapiens
agccagactctcggaggatagctaaaattttctaggagaagaaatgaggttaagcaagtgtgaagaaaattccagtagaaaaagcctaagaaggatgcagygcaatagcctatgtgagaagcaacattcagcttgataatattggctagccaagataaagttggaaaggattaggaatgtgagcctgcagaaatgggcagg

SEQ ID NO: 47294 - DNA, 201 bp, Homo sapiens
tcaaaatgagcagtggtttctgatatcagcttccaaggaagaataaggtacttctaagtcaagcgactaaattcagattcaatgctttaatccaattaatraggtaaaacaccttttacaggatttagtgttcctcaaaatgtgatattcactcagaacttcacaatgtgaccttatttgcaaatagagcatttacaagta

SEQ ID NO: 47295 - DNA, 201 bp, Homo sapiens
gttatggattgcatcaacctcactgtttcctggaactataccaataataggaagtatgattgataaaacctatggaaatttatagtatatatattaggcargcagtaaggataaacagaagccaatggtccaggtgagctgattctccaaggttcaggaaagcttcccaaaataaatggagtctcatttttgtgtggtcct

SEQ ID NO: 47296 - DNA, 201 bp, Homo sapiens
tatacatataagtacatatatacatatttatttacatatgtatataaatgtatatttacatatgtatagctatattacatatgtaaatatacatatgcaayatatattcacatgtatatacacataggtatatatgtttatatacacataggtatatatgtttatatacacatatgtatataaagatgtatatatttatac

SEQ ID NO: 47297 - DNA, 201 bp, Homo sapiens
aaaatataagtaagttaaagggaaaaaattaatagggttaaccagagatattacttaataataaaaggaaaacactataaaaatatagaaaaattatgaasctatgtaaatctatcaacataacctcaaatatacaaaacaaaaatttataaaattataagaataaatctacagaatggaaaatttcaatatacttgtccc

SEQ ID NO: 47298 - DNA, 201 bp, Homo sapiens
tacttatcttttaataatttagaaactttacagtaaaagtaactcatcatttctaaaaataaaatttagaccattagatttatgttttgataaactttgcmgtacaaataaagaaaattgaaatatttccaaataaatcaagtatcttaattcttgttgatagatttttctttccctgtcaattgtagctggcattcctgc

SEQ ID NO: 47299 - DNA, 201 bp, Homo sapiens; identical to SEQ ID NO: 13305

SEQ ID NO: 47300 - DNA, 201 bp, Homo sapiens
caacactctgttgaataggagtggtgagagagggcatccctatcttgtgcccattttcaaagggaatgcttccagtttttgcccattcagtatgatattgsctgtgggtttgtcataaatagatcatattattttgagatacatcccatcaatacctagtttattgagagttttcagcatgaagagctgttaaattttgtc

SEQ ID NO: 47301 - DNA, 201 bp, Homo sapiens
gcagatttttagtgtatctagtttctgtgttattaaaaacaattttttttttttgagatggagtgtagctctatcacccaggctggagtgcagtggcgcartttcagctcattgcaacctctgcctcccaggttcaagtgattctcctgcctcagcctcccaggtagctgggattacaggcacccaccaccacacccagct

SEQ ID NO: 47302 - DNA, 201 bp, Homo sapiens
tgtcctctgcaacagggacaatttgacttcctcttttcctaattgaataccctttatttctttctcttccctgattgccctggccagaacttccaacactmtgttgaataggagtggtgagagagggcatccctatcttgtgcccattttcaaagggaatgcttccagtttttgcccattcagtatgatattgcctgtggg

SEQ ID NO: 47303 - DNA, 201 bp, Homo sapiens
tgtatcctgagattttgctgaagttgcttatcagcttaaggagattttgggctgagatgttggggttttctaaatatacaatcatgtcctctgcaacaggracaatttgacttcctcttttcctaattgaataccctttatttctttctcttccctgattgccctggccagaacttccaacactctgttgaataggagtgg

SEQ ID NO: 47304 - DNA, 201 bp, Homo sapiens
aaagttcttaaaaatttttcataaaggtgatgtgccattagattgcttcttaagtactatatataaatatataaattatatatgcacatatatacatatayatgtctctatatgcacacacacatatgtacatacagccacacagatacatacacacacgcatacatacacacacacacactgagaaaaacaaacggtttc

SEQ ID NO: 47305 - DNA, 201 bp, Homo sapiens
acattgattcttcctatccacgagcatgaaatgttcttccatttctttgtgtcctgttttattttgctgagcagtggtttgtagttctccttgaagaggtmcttcacatcccttgtaagttggattcctaggtattttattctctttgaagcaactgtgaatggagttcactcatgatttgtctctccgtttgtctgttat

SEQ ID NO: 47306 - DNA, 201 bp, Homo sapiens
taccttttatttcccagatcttatgtgaaacctccatagcatctgaccagtgatctgaaatttccaagaagtttatattattactcaaataatttgggttstaaatactctggactaaaaaaattttatcattgaaataaagttggtggttttgatttcaattgtccagctaattgctttgctatatatatatacatatat

SEQ ID NO: 47307 - DNA, 201 bp, Homo sapiens
tgatggggatggcattgaatctataaattacctcaggcagtatggccattttcacaacattgattcttcctatccacgagcatgaaatgttcttccatttstttgtgtcctgttttattttgctgagcagtggtttgtagttctccttgaagaggtccttcacatcccttgtaagttggattcctaggtattttattctct

SEQ ID NO: 47308 - DNA, 201 bp, Homo sapiens
gtggggataaaattaaatcattcttcttcactatgagttggacctaaatagttacttatataaggcatattacataaaagtgataacatatttgttccttyggtaagtcattttgtaaataatattttatttgcatttataggtatttataacttacctccaatatgtattggatatataattggtggtttaattatgaag

SEQ ID NO: 47309 - DNA, 201 bp, Homo sapiens
gaaagtcattggtagcttgatggggatggcattgaatctataaattacctcaggcagtatggccattttcacaacattgattcttcctatccacgagcatraaatgttcttccatttctttgtgtcctgttttattttgctgagcagtggtttgtagttctccttgaagaggtccttcacatcccttgtaagttggattcc

SEQ ID NO: 47310 - DNA, 201 bp, Homo sapiens
tcacttattgggaagggttcagagaggaagagccagtagcagcaagacatgaaatgtaaatacacttgacagcaacaggctcagcaaagtgactctctaaagtaccttgaactgggtgtggtggctcatgcctttaattccagcactttgggatgctgaggagtgaggatcacttgaggccaggagttcaagaccagcctg

SEQ ID NO: 47311 - DNA, 201 bp, Homo sapiens
tttaagtctttaatcccacttgaactgatttttgtataaggtgtaaggaagggatccagtttcagctttctacatatggctagccagttttcccagcaccrtttattaaatagggaatcctttccccatttcttgtttttgtcaggtttgtcaaagatcagatggttgtagatgtgtggtattatttctgagggctctatt

SEQ ID NO: 47312 - DNA, 201 bp, Homo sapiens
ttcctatttctccacatcctctccagcacctgttgtttcctgactttttaatgattgccagtctaactggcatgagatggtatctcattgtggttttgatktgcatttctctgatggccagtgatgatgagcattttttcatgtgtctgttggctgcataaatgtcttcttttgagaagtgtctgttcatatccttcaccc

SEQ ID NO: 47313 - DNA, 201 bp, Homo sapiens
atgtcatgtcttttttttttaatgcagagtgtacaaaggaagttaaatcattaatgtgggtgtacgtcctagtaggcaatattgtacgtggaatgggtgamactcccatcctgcctttgggtatttcctatatagaagattttgccaaatttgaaaattctcctttatatattggtaagtatggaaatctaccttagcttc

SEQ ID NO: 47314 - DNA, 201 bp, Homo sapiens
ttcacttattgggaagggttcagagaggaagagccagtagcagcaagacatgaaatgtaaatacacttgacagcaacaggctcagcaaagtgactctctaaagtaccttgaactgggtgtggtggctcatgcctttaattccagcactttgggatgctgaggagtgaggatcacttgaggccaggagttcaagaccagcct

SEQ ID NO: 47315 - DNA, 201 bp, Homo sapiens
ttgccccactgtcttccacaatggttgaactactttacagtcccaccaacagtgtaaaagtgttcctatttctccacatcctctccagcacctgttgtttmctgactttttaatgattgccagtctaactggcatgagatggtatctcattgtggttttgatgtgcatttctctgatggccagtgatgatgagcatttttt

SEQ ID NO: 47316 - DNA, 201 bp, Homo sapiens
acattgtcctcattactttcttaaaataaactcattttccctgtgtttatacagatatgaatatgaatctacagtttcagtttcaggcaacttgtcctcawacagtttcttgtgtatggaaaatggaacccagattttaagaccaacgcaggatccatcaggttgtctacttcattgtattgatttttgttcagcgaactt

SEQ ID NO: 47317 - DNA, 201 bp, Homo sapiens
ttactctttttggttccagttcaaggattctatgttcctcctaatttaattttttggtccccctagtggttttaggtgtctctgcagccacacacattcgrcttttcctgcaaccacactaacctcagtggttttagcctaacttgggtttttcctgggatctttccactgtttttaaaagtcaatatcccaggctacttg

SEQ ID NO: 47318 - DNA, 201 bp, Homo sapiens
gagaacttgagcctgaatggtagcagtgtgaccaagaacatttactagaagcaggccacacattactagaggcaggccacacattactagaagcaggccamacattactagaggcaggccacacatttggctctgtgctttttctaacaggaatcatttttgattaaatcatttacatagtccttagaatgtaccaaatga

SEQ ID NO: 47319 - DNA, 201 bp, Homo sapiens
ccatcaggttgtctacttcattgtattgatttttgttcagcgaacttataactaaacactttctgctgaggggcttgaatgagatattgattgagttagayaaataaacaaagatatgttctctctccaggaacttccaaaggagttacaatgggcaataagaatagctaataataaagaatgttatttttcttatatttg

SEQ ID NO: 47320 - DNA, 201 bp, Homo sapiens
atatatatatacacgtatatatatacacatatatgtgtgtgtatatgtgtgtgtgtatatatatacgtgtgtgtgtatatatatatatatatatacacacrtatatatatggtcccatttgctcaaaaaaccgattttacagagaacataggttgaattgaaacaaaatgaacaagcaaatttaaactaagaacaaaagta

SEQ ID NO: 47321 - DNA, 201 bp, Homo sapiens
acacgtatatatatatacacgtatatatatacacatatatgtgtgtgtatatgtgtgtgtgtatatatatacgtgtgtgtgtatatatatatatatatatwcacacgtatatatatggtcccatttgctcaaaaaaccgattttacagagaacataggttgaattgaaacaaaatgaacaagcaaatttaaactaagaaca

SEQ ID NO: 47322 - DNA, 201 bp, Homo sapiens
cacgtatatatatatacacacacgtatatatatatacacgtatatatatacacatatatgtgtgtgtatatgtgtgtgtgtatatatatacgtgtgtgtgkatatatatatatatatatacacacgtatatatatggtcccatttgctcaaaaaaccgattttacagagaacataggttgaattgaaacaaaatgaacaag

SEQ ID NO: 47323 - DNA, 201 bp, Homo sapiens
cacatggctggcactagcacagcctcgagaagatgaaaagacggcacacggaatttcctgatttggggccaagatggacaacaatgactatgatattaacygttggattttatggatttttattgaataaatggaatagattttgttaatttgtttattttcctccatgaagatgtttgaaatgtatctgaaaatataaaa

SEQ ID NO: 47324 - DNA, 201 bp, Homo sapiens
gtggtcttcatttccttcagatcccttttgttaaaaaatatcttttaatgtttatatttcttttttatttttattttattattttacttaaggttctaggktacatgtgcacaatgtgcaggtttgttacataggaatacgtgcgccatgttgttgtgctgcacctgtcaactcgtcatttacattaggtatatctcctaa

SEQ ID NO: 47325 - DNA, 201 bp, Homo sapiens
aaacaacttctacaatcatatttttaattttcaagagatcttgctttctgaatcttcttttatagcatcctgcttttgtttcattgatgtaatatccatcsttatctctgaggatgctatttacagctttctcttttctggtttcttttcaaaattctccttctgttgtggtcttcatttccttcagatcccttttgttaa

SEQ ID NO: 47326 - DNA, 201 bp, Homo sapiens
taatctctttaattatttaacttctatgaaatttcctaatctaccaacttttccataaaaaaacaacttctacaatcatatttttaattttcaagagatcktgctttctgaatcttcttttatagcatcctgcttttgtttcattgatgtaatatccatcgttatctctgaggatgctatttacagctttctcttttctgg

SEQ ID NO: 47327 - DNA, 201 bp, Homo sapiens
ccattttctctgctttcctctcccaaaacgcttttattaatcttgtgtttatatatattttcactatttttaatctctttaattatttaacttctatgaartttcctaatctaccaacttttccataaaaaaacaacttctacaatcatatttttaattttcaagagatcttgctttctgaatcttcttttatagcatcct

SEQ ID NO: 47328 - DNA, 201 bp, Homo sapiens
atacaagcaccctccctctaggcctaaggactgttgtggaagaggtgggtgtgtgagattgtaagggctaggtttgaggaagtgaattagttcagatcatycaaaccaaggatgggtacacgatgcctaaacagctggtaaaacaaagttttttgccctctgagctattatgaggcatcttttcatccagcccaaccatga

SEQ ID NO: 47329 - DNA, 201 bp, Homo sapiens
cattcttccattttaaaaatactgttctagttttcttgatttacgtccttattttgatggaacatatactgcagtagcttcctgagaatggacacatgaamgactgagaccttttgtttctgagcatagttctaaacacattatttttattcagaattataaaggcattatttcattgtattctaaccgctaatgtggcta

SEQ ID NO: 47330 - DNA, 201 bp, Homo sapiens
acctttctctccaagttctcccaaatttggaaaccgtgagtattctggttttatgacaatatagttatttgcataagtttagtaagagtcttttgttttawaacaggacaattggagacactgattattttaccaagtctttgactagaataacatatttgcaggtaaatttccagcaaagccaacttaaaaagagcctat

SEQ ID NO: 47331 - DNA, 201 bp, Homo sapiens
gataatatttccttcttatttccaacttcccctctcactgcccattctcatggaaatctttctcctatagcctctgaccttctgcttttctccaaactgaytgctttctaggattgctacgtagttgtttttatccttttgctttcatattgagaaatactcccatcattcttccattttaaaaatactgttctagttttc

SEQ ID NO: 47332 - DNA, 201 bp, Homo sapiens
aacctccgcctcctgggtttaagcgattctcctgccttagcctcctgagtagctgggattacaggcacatgtcaccacccccggctaatttttgtattttyagtagagacagggtttcaccatgttggtcaggctggtctcgaactcctgaccttgtgatctgcctgcctcggcctcccaaagtgctgggattacaggcaa

SEQ ID NO: 47333 - DNA, 201 bp, Homo sapiens
agggtagaagctgaagggctagtagggacaaattctccacttcatatccatttgtggagcatttattagggcttatggtaaaagactgggagcacttcccratgacaaatactagactagagaatttccagttgagggacatttactgccttgttatggaatgttaactgaagctacccctttgctaaaggaaataatggt

SEQ ID NO: 47334 - DNA, 201 bp, Homo sapiens
tagtagagacagggtttcaccatgttgaccaggctggtctcgagctcctgacctcaggtgatccgtctgccttggcctcccagtgtgctgggattacaggrgtgagccactgcgcctgaccaataaaataggtattaataagaaaaagtgatgagtaaagtgccagtgaccagaaatgggctcctgtgtaggctgccagct

SEQ ID NO: 47335 - DNA, 201 bp, Homo sapiens
aaatatcttgtgaaaattggtattgtatctgattgggggatgtttctcctatcaagtactatgaaactgaagtcatgtaaatgtgccctttgaggaatgtkaattggacacactaaatggaaactagtaagattgcctgagcctacacaatgtagggtagaagctgaagggctagtagggacaaattctccacttcatatc

SEQ ID NO: 47336 - DNA, 201 bp, Homo sapiens
taaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagt

SEQ ID NO: 47337 - DNA, 201 bp, Homo sapiens
ttaagtgctacatgggcactccaggtgacattactaccacagaatcacagactgatcaaatttgctgtcctcatgggtcttacagatgcttaataaaacaytggggtaattaacaaagaataatgagaaaggcaaaagggagtcagaggactcaccccagagggtgattaaaatatttggacgttttataagaaatgaaat

SEQ ID NO: 47338 - DNA, 201 bp, Homo sapiens
tatcacatggtaaatttggaggttaagtgctacatgggcactccaggtgacattactaccacagaatcacagactgatcaaatttgctgtcctcatgggtyttacagatgcttaataaaacactggggtaattaacaaagaataatgagaaaggcaaaagggagtcagaggactcaccccagagggtgattaaaatatttg

SEQ ID NO: 47339 - DNA, 201 bp, Homo sapiens
tatttgttctcataatttgttgattttgttaggttttctatgtaggtttttcaatgtgcaaatatgacaagttttgtcttttcacttccaaaccttacacmtctgagacttctaaaattctcttatagcataaattaaaacctccaagatttatttaactgtagttgtgatagtgagtattcttgttcttttctaatctta

SEQ ID NO: 47340 - DNA, 201 bp, Homo sapiens
gactcccaagtccattggctctgagcccagctcagcactagaacttgcctaggagttgtagtccttgcaacctagactgcctttcaagtttatttagggaragcacgtttgcccatggtggcgaggcttgctggaactcaagttctaactgtggggctgggtgattactttctggtgatagctagtctaaatgctccctcc

SEQ ID NO: 47341 - DNA, 201 bp, Homo sapiens
tatcacagaacagcatgggaaaacccacccctatgatccaattacttcccagtgggtccctctcacagcatgtggggattatgggagctactattcaagawgagattttggtggggacacagccaaaccatatcacatggtaaatttggaggttaagtgctacatgggcactccaggtgacattactaccacagaatcaca

SEQ ID NO: 47342 - DNA, 201 bp, Homo sapiens
cagtgtttgcttgtctgggaaaatctttatttcttctttatgtttggaggatattttcaccagatataaaggtaaaagtttttttccttcagcactttaartatgtcatgccactctctcttggcctgtaaggtttccaccgaaaagtctgctgccagttgtattggcgctccattgtatgttagtcacttcgtttctctt

SEQ ID NO: 47343 - DNA, 201 bp, Homo sapiens
gccattggataaaatgttctgtaagtatttattaggttcatttggtttataatttggatgaaatccaatgtttctttgtttatttatttatttttttttttggtctggaagatctgtccaatgctgaaagtgaggtgtgaattcttcagctattattgtattaggctctatctctctctttagctataataatatttgctt

SEQ ID NO: 47344 - DNA, 201 bp, Homo sapiens
attcatatttgtattctgtagccattggataaaatgttctgtaagtatttattaggttcatttggtttataatttggatgaaatccaatgtttctttgttkatttatttatttttttttttggtctggaagatctgtccaatgctgaaagtgaggtgtgaattcttcagctattattgtattaggctctatctctctcttt

SEQ ID NO: 47345 - DNA, 201 bp, Homo sapiens
tgagaaatacttgcagcttcaggatgcccattgcttctcaaattttctgcaaagaataatccagcactgaaatcaagagatttcttacagttctaattgaygtaattttaaattagagcttagtttttaaaagaaacatctttttaaaacgtaatttacaaggatcaaaatttttattgatacagtcccttaatattgtcc

SEQ ID NO: 47346 - DNA, 201 bp, Homo sapiens
gtttcaatcctgaatccatcctgactatgtgatcttagataagtcagctcattttctttctttcttttttcgtttcttttctttctttttttttttttttttgagacggagtttcttctgtcgcccaggctggagtgtagtggcatgatcttggctcactgcaacctctgcctcccaggttcaagcgactctcccgtctca

SEQ ID NO: 47347 - DNA, 201 bp, Homo sapiens
acacgtatatatatatacacacacgtatatatatatacacgtatatatatacacatatatgtgtgtgtatatgtgtgtgtgtatatatatacgtgtgtgtrtatatatatatatatatatacacacgtatatatatggtcccatttgctcaaaaaaccgattttacagagaacataggttgaattgaaacaaaatgaacaa

SEQ ID NO: 47348 - DNA, 201 bp, Homo sapiens
ttagttgtatacggaacaaagaaaataggacaatcccatttggattttggaagaaaaaaaagatgtgctaccagcaatctttcagtgttggaaatatttartaagtgtattgaattttttttaactttcttccagttaaaaccttaaaaaacaaaataaaacaaagcaaaagtatctcataatgggtagggtaaagattgt

SEQ ID NO: 47349 - DNA, 201 bp, Homo sapiens
tacacacacacatatatatatgagagagaggagagagagggtcatgtatatatatacacacacgtatatatatatatacacgtatatatatatacacacamgtatatatatatacacgtatatatatacacatatatgtgtgtgtatatgtgtgtgtgtatatatatacgtgtgtgtgtatatatatatatatatatacac

SEQ ID NO: 47350 - DNA, 201 bp, Homo sapiens
taatcttcaagaaaactattcaagatagatattactatccgttttacaaagggagtataagatgccacactctatcaacttaatcacactgtattaaattataaatttatattaaaataatttgttttttcattattcctagagtaaatgtattcaaccaatatgtattgtgcatctgttataggcacataatgggcttaa

SEQ ID NO: 47351 - DNA, 201 bp, Homo sapiens
gccacacatttggctctgtgctttttctaacaggaatcatttttgattaaatcatttacatagtccttagaatgtaccaaatgaatcagcatctctgaggrtgggacctggatgttggtattttaaaaaatatctccaggtagatcttgctgagaaccaatggcagaaccactgaaactgttgttctgaagaagcaaaaaa

SEQ ID NO: 47352 - DNA, 201 bp, Homo sapiens
acacatatatacacatatatatgtacacacacacatatatatatgagagagaggagagagagggtcatgtatatatatacacacacgtatatatatatatacacgtatatatatatacacacacgtatatatatatacacgtatatatatacacatatatgtgtgtgtatatgtgtgtgtgtatatatatacgtgtgtgtg

SEQ ID NO: 47353 - DNA, 201 bp, Homo sapiens
ctaatcttcaagaaaactattcaagatagatattactatccgttttacaaagggagtataagatgccacactctatcaacttaatcacactgtattaaattataaatttatattaaaataatttgttttttcattattcctagagtaaatgtattcaaccaatatgtattgtgcatctgttataggcacataatgggctta

SEQ ID NO: 47354 - DNA, 201 bp, Homo sapiens
tcacatcatcagtctccaaattttcctaactttcatgctttgcttcccttttaaacataagttccaatttcaaaccatatctttgtgaattaataaaactkaatgctcttaagagcacccaagtcacttcttgaaagctttagtttgaaatttcttccaccagataccttaaattatgtctcttaagttcaaagttccact

SEQ ID NO: 47355 - DNA, 201 bp, Homo sapiens
cacacatatatacacatatatatgtacacacacacatatatatatgagagagaggagagagagggtcatgtatatatatacacacacgtatatatatatatacacgtatatatatatacacacacgtatatatatatacacgtatatatatacacatatatgtgtgtgtatatgtgtgtgtgtatatatatacgtgtgtgt

SEQ ID NO: 47356 - DNA, 201 bp, Homo sapiens
ctctgaaaccattatcccatctaaacatacaatttatgggaattccttaatataaatattcattcagcattcacgttttccagttgtctacaaaaaaaaaatttaactggtttgttggattcaggatctaaacaagattgcatttggttgctctgtgtgactctttaatttacaattttctgtccgttatttttcacatta

SEQ ID NO: 47357 - DNA, 201 bp, Homo sapiens
tctaatcttcaagaaaactattcaagatagatattactatccgttttacaaagggagtataagatgccacactctatcaacttaatcacactgtattaaattataaatttatattaaaataatttgttttttcattattcctagagtaaatgtattcaaccaatatgtattgtgcatctgttataggcacataatgggctt

SEQ ID NO: 47358 - DNA, 201 bp, Homo sapiens
cctatggtactacttgaaaataaatattataatttggaagctgaaatatttcagatcagcatttgtgtaaacttttatgtcagtcttggcactctcctctctctctctctttcatatatatatacacacacatatatatgtacacacacatatatatatacacacatatatacacatatatatgtacacacacatatatct

SEQ ID NO: 47359 - DNA, 201 bp, Homo sapiens
ttctaatcttcaagaaaactattcaagatagatattactatccgttttacaaagggagtataagatgccacactctatcaacttaatcacactgtattaaattataaatttatattaaaataatttgttttttcattattcctagagtaaatgtattcaaccaatatgtattgtgcatctgttataggcacataatgggct

SEQ ID NO: 47360 - DNA, 201 bp, Homo sapiens
tcctatggtactacttgaaaataaatattataatttggaagctgaaatatttcagatcagcatttgtgtaaacttttatgtcagtcttggcactctcctctctctctctctttcatatatatatacacacacatatatatgtacacacacatatatatatacacacatatatacacatatatatgtacacacacatatatc

SEQ ID NO: 47361 - DNA, 201 bp, Homo sapiens
tttctaatcttcaagaaaactattcaagatagatattactatccgttttacaaagggagtataagatgccacactctatcaacttaatcacactgtattaaattataaatttatattaaaataatttgttttttcattattcctagagtaaatgtattcaaccaatatgtattgtgcatctgttataggcacataatgggc

SEQ ID NO: 47362 - DNA, 201 bp, Homo sapiens
ttcctatggtactacttgaaaataaatattataatttggaagctgaaatatttcagatcagcatttgtgtaaacttttatgtcagtcttggcactctcctctctctctctctttcatatatatatacacacacatatatatgtacacacacatatatatatacacacatatatacacatatatatgtacacacacatatat

SEQ ID NO: 47363 - DNA, 201 bp, Homo sapiens
cttcctatggtactacttgaaaataaatattataatttggaagctgaaatatttcagatcagcatttgtgtaaacttttatgtcagtcttggcactctcctctctctctctctttcatatatatatacacacacatatatatgtacacacacatatatatatacacacatatatacacatatatatgtacacacacatata

SEQ ID NO: 47364 - DNA, 201 bp, Homo sapiens
tcttcctatggtactacttgaaaataaatattataatttggaagctgaaatatttcagatcagcatttgtgtaaacttttatgtcagtcttggcactctcctctctctctctctttcatatatatatacacacacatatatatgtacacacacatatatatatacacacatatatacacatatatatgtacacacacatat

SEQ ID NO: 47365 - DNA, 201 bp, Homo sapiens
taaatctctgagttgcccacaatcccacaattttttttagctcttcttatatcattataactagttttccatataatatccctctattaaattatctattrtgagttctattttcctatcaggaccttgacaaagatagagactgtcttcattttgtagaaatattaagtaacttgtacaaaaacacacggctagtttaaa

SEQ ID NO: 47366 - DNA, 201 bp, Homo sapiens
tttatggggacatttttattctggattcatgttcgtggaaattgcagtagtccacaagggtgggaatttcatgaccatcattgagtcaggaaaccaaaacagtttcaaaaatttgaaaaatgtctgtctcagaagaagccaaagaacccccatgggggaaacaaaggaaaacaatgacattaatagtggcctgtgttctct

SEQ ID NO: 47367 - DNA, 201 bp, Homo sapiens
aatgaaatagttatagggctaaaaactcaatgtccaggagccagtggatatgcataatctgggactcaaatgcaatggatttatctcattgtgtttacctkgtgtggggagtatttcattatctctatctctaagtagagatagcctaagagtaaatatttaataatctcatgtgaaactgttttttttttaaattttact

SEQ ID NO: 47368 - DNA, 201 bp, Homo sapiens
tgaatttctcctcagaaaatgggtttttccttttttatcacatcatcagtctccaaattttcctaactttcatgctttgcttcccttttaaacataagttycaatttcaaaccatatctttgtgaattaataaaactgaatgctcttaagagcacccaagtcacttcttgaaagctttagtttgaaatttcttccaccaga

SEQ ID NO: 47369 - DNA, 201 bp, Homo sapiens
tggatctaccattctgggatctggaggatggtggccctcttctcacagctccaccaggcagttccccagtggagactctgtgtgggggcttcaaccctacrtttcccttccacactgccctagcagaggttctccatgagggtcctgcctctgcagcatacctctgcctggacatccaggtgtttccatacatcctctgaa

SEQ ID NO: 47370 - DNA, 201 bp, Homo sapiens
ctcatgtccgcacatttcaaaaccaatcatgccttcgcaacagtcccccaaagtcttaactcatttcagtattaacccaaaagtcctaacttaggagccakcaaaaaaaatcaaaagcaagttagttacttcctagatacaatggggatacaggcattgagtaaataaacccattccaaatgtgaaaaattaaccaaaatg

SEQ ID NO: 47371 - DNA, 201 bp, Homo sapiens
aacaggcaatcccaccacctctacctgctcacgccaggagaatccataactgcctagaggcctgagacccctacaagtagtaaggtgaataggcatctatycagcctagcagtaggattgatgtctgtccagcctggaagaggggcactaggtgactccctccccttctgttgtaaatactataattatcagataatttaa

SEQ ID NO: 47372 - DNA, 201 bp, Homo sapiens
tttttttcttttcttttttttttgagacggagtctcactctgtcgctcaagttagagtgcagtggcgcgatcttggctcactgcaacctctgcctcctggktttaagcaattcttctgcctcagcctcctgagaagttgggactacagtctcacaccaccacacccagctaatttttgtatttttagtagagacgggattt

SEQ ID NO: 47373 - DNA, 201 bp, Homo sapiens
atttaagtctttcatcgattttgattgatttttgaatatggcaagaaatatgggtctagtttcactcttctgcttatggaaattccattttccctgcaccrtttattgaagagactgtcttttccccaatgtacattcttggcatctttgtcaaaaatgagttcaccatagatgaatggattttttttcagagttctctat

SEQ ID NO: 47374 - DNA, 201 bp, Homo sapiens
atgctcccgaggagttagctctctaaatgcataaggagatgcaaactaataaaaaaaaaaaaagcaaaaatattcaatcccttggttattgttatctgtarttgctaaatgaatgtacaagaatgctgggttgatccttaaggctggatcaggcccagaggtgggtctgtcccagctcaagccactagactccaagctacc

SEQ ID NO: 47375 - DNA, 201 bp, Homo sapiens
tacaaaagataaaattcattagaatttagagatggattatgctcccgaggagttagctctctaaatgcataaggagatgcaaactaataaaaaaaaaaaaagcaaaaatattcaatcccttggttattgttatctgtaattgctaaatgaatgtacaagaatgctgggttgatccttaaggctggatcaggcccagaggtg

SEQ ID NO: 47376 - DNA, 201 bp, Homo sapiens
tgtggttacctatggtagggagatgcagctgagctacattcaattacaaaagataaaattcattagaatttagagatggattatgctcccgaggagttagytctctaaatgcataaggagatgcaaactaataaaaaaaaaaaaagcaaaaatattcaatcccttggttattgttatctgtaattgctaaatgaatgtaca

SEQ ID NO: 47377 - DNA, 201 bp, Homo sapiens
tgtgtaataaccatattagggtagatggggtatccattccctcaagcatttatcctttgtgttacaagcaattcatttatactcttttagttattttaaartgtacgagtaaattattttccactatagtcactctaatacactatcaaatagtaggtttaattcattctttccattttttcgtacctattaactatctct

SEQ ID NO: 47378 - DNA, 201 bp, Homo sapiens
ggcaaaagttaaacggttcagtcctacaagactgcccccactttagatgtcaatcacaaaatcacaagtccagacaccctgggctgcttttttttttttttaccctgggcttctgactgacaaacgatgcattaaggttgatgcctccattttctagaatggttcacagaactcagggaagaaacacttttcttacattta

SEQ ID NO: 47379 - DNA, 201 bp, Homo sapiens
aaactttacagtaaaagtaactcatcatttctaaaaataaaatttagaccattagatttatgttttgataaactttgccgtacaaataaagaaaattgaartatttccaaataaatcaagtatcttaattcttgttgatagatttttctttccctgtcaattgtagctggcattcctgcacctatatattttggcgcttta

SEQ ID NO: 47380 - DNA, 201 bp, Homo sapiens
cgtcaccttgatttaattactttggccttgcaaatgttaatatctcatatggtaactttgcctcacccacctgccatcttcacttttcctttattctttcwttctcaaacttattttgctgtctgtggatctttatatcttcataagaattttgactgagtttgtgtagattccatagattacttggagaaaatctgacat

SEQ ID NO: 47381 - DNA, 201 bp, Homo sapiens
ttattctgctccacagatttatttgcctgttcccataccagcgtcaccttgatttaattactttggccttgcaaatgttaatatctcatatggtaactttkcctcacccacctgccatcttcacttttcctttattctttctttctcaaacttattttgctgtctgtggatctttatatcttcataagaattttgactgag

SEQ ID NO: 47382 - DNA, 201 bp, Homo sapiens
ttttatggggacatttttattctggattcatgttcgtggaaattgcagtagtccacaagggtgggaatttcatgaccatcattgagtcaggaaaccaaaacagtttcaaaaatttgaaaaatgtctgtctcagaagaagccaaagaacccccatgggggaaacaaaggaaaacaatgacattaatagtggcctgtgttctc

SEQ ID NO: 47383 - DNA, 201 bp, Homo sapiens
aacttttatgctctgtcatctcttgaatgctttgctgcttagaaattttttccaccagataccctaaatcatctctctcaagttcaaaattctctagggcmggggcaaaaagccagcagtctctttgctaaagcatagcaagagtcacctttgctctagttcccaagaagttcctcatctccatctgagaccacctcagcc

SEQ ID NO: 47384 - DNA, 201 bp, Homo sapiens
ctgctaagagacttgtataatcttctggttatacttggtctggagatgactctgatgactcaacatttttatggggacatttttattctggattcatgttygtggaaattgcagtagtccacaagggtgggaatttcatgaccatcattgagtcaggaaaccaaaacagtttcaaaaatttgaaaaatgtctgtctcagaa

SEQ ID NO: 47385 - DNA, 201 bp, Homo sapiens
gtttttcttttctactgcaatgtcaggctgcaagttttccaaacttttatgctctgtcatctcttgaatgctttgctgcttagaaattttttccaccagawaccctaaatcatctctctcaagttcaaaattctctagggcaggggcaaaaagccagcagtctctttgctaaagcatagcaagagtcacctttgctctagt

SEQ ID NO: 47386 - DNA, 201 bp, Homo sapiens
aaagtcttaactcatttcagcattaactcaaaagtccaagtccaaagtcttatcagagataaggcaaatcccttttgtctatgagcctgcaaaatcaaaascaagttacttcctagatacaataggggtacagacattgggtaaatatacccattccaaatgggagaaattggccaaaacaaaggggctacaggcccaaca

SEQ ID NO: 47387 - DNA, 201 bp, Homo sapiens; identical to SEQ ID NO: 13281

SEQ ID NO: 47388 - DNA, 201 bp, Homo sapiens
tttagtggaggaagtcactgcagatgtggaaagagaaagagaactagaatttaagatggaacctgaagatgtgacttaattgctgcaatctcataataaarcttgaataaatgaagactttctgtttatggacaagcaaataatgtggcttcctgtgatggaatctactactgatgaagagcctgtgaaaactgttgaaat

SEQ ID NO: 47389 - DNA, 201 bp, Homo sapiens
aaatcatatcattctgcccctggtccctcccaaatcttatgtcctcacatttcaaaacacaatgtgcccttccaacagtcccccaaagtcttaactcatttcagcattaactcaaaagtccaagtccaaagtcttatcagagataaggcaaatcccttttgtctatgagcctgcaaaatcaaaagcaagttacttcctaga

SEQ ID NO: 47390 - DNA, 201 bp, Homo sapiens
tcaagtcttattatgtaagacacacagtttgtaaggatattgctgttataaatagtgattcttctgatggatctaagtaacataaattgaaaaccttctcraaagaattcactattctacattccactaggaaaaggagaggagggcaaaatctcaacattaacaggaattttgaaaagttgactcaaatcctcttagata

SEQ ID NO: 47391 - DNA, 201 bp, Homo sapiens
aaaatttttacagaagaatatgttagttattagaatctttcattttgccaatttctgagatatataccttacaattttatctagattgaaaaaaggattastaaccgtatctgtttatctcttacagtcacctggtttttgaagctacaagtagattatatcagcctaaaaaaattaaattgggcattgtctattgcagaa

SEQ ID NO: 47392 - DNA, 201 bp, Homo sapiens
ctgctaacacaacatccattgtgtggccacaaatcaggagtaacttggactttcaagtcttattatgtaagacacacagtttgtaaggatattgctgttayaaatagtgattcttctgatggatctaagtaacataaattgaaaaccttctcgaaagaattcactattctacattccactaggaaaaggagaggagggcaa

SEQ ID NO: 47393 - DNA, 201 bp, Homo sapiens
gacttattcactatcatgagaacagtgtgggaataacccacctccatgattcaattacctcccacctggcccctcccgcaatatgtgggggttatgggagygacaattcaagatgagattttggtggggacacagccaaaccatatcactagggattgttatatgctaagggctttttatacattatttcatcctcatatc

SEQ ID NO: 47394 - DNA, 201 bp, Homo sapiens
caccttgttcaggaatagcttgctctaactgcagtatgtctccctgcacttttctttttcttttttttttgttttttgttgtgtgtgtgtgtgtgtgtgtkcgtgtgttatttttgagacagtgtctctctctgtcacccaggctggagtgtggtggtacgatcacagctcacttgcagcctctacctcctgagctaaaga

SEQ ID NO: 47395 - DNA, 201 bp, Homo sapiens
tcttcctcttcttcttctcctcctcttcttcttcctcttcttcttctcctcctccctcctcctcttcttctcctcctcctcctcttcctcctcctcctccttcttcttctccttctcattctccctctccttcttctttcttctttttgagatggagtctcatgctgttgctcaggctcgagtgcagtggcgtgatctcag

SEQ ID NO: 47396 - DNA, 201 bp, Homo sapiens
tttgtggaggtggccgtatcaccttgttcaggaatagcttgctctaactgcagtatgtctccctgcacttttctttttcttttttttttgttttttgttgkgtgtgtgtgtgtgtgtgtgcgtgtgttatttttgagacagtgtctctctctgtcacccaggctggagtgtggtggtacgatcacagctcacttgcagcct

SEQ ID NO: 47397 - DNA, 201 bp, Homo sapiens
ttcttcctcttcttcttctcctcctcttcttcttcctcttcttcttctcctcctccctcctcctcttcttctcctcctcctcctcttcctcctcctcctccttcttcttctccttctcattctccctctccttcttctttcttctttttgagatggagtctcatgctgttgctcaggctcgagtgcagtggcgtgatctca

SEQ ID NO: 47398 - DNA, 201 bp, Homo sapiens
cttcttcctcttcttcttctcctcctcttcttcttcctcttcttcttctcctcctccctcctcctcttcttctcctcctcctcctcttcctcctcctcctccttcttcttctccttctcattctccctctccttcttctttcttctttttgagatggagtctcatgctgttgctcaggctcgagtgcagtggcgtgatctc

SEQ ID NO: 47399 - DNA, 201 bp, Homo sapiens
gacctccacaggctcaggtgatcctctcacttcagcctctccagtggctgaaactacaggcatgtgccactatgcctggctaatttttgtatatatatatwtttttttggtagagacaggatttcaccatattgccctggctggtcctgaactcctgggttcaagcaatgcgcctgcctcagactctcaaaatgttgggat

SEQ ID NO: 47400 - DNA, 201 bp, Homo sapiens; identical to SEQ ID NO: 13309

SEQ ID NO: 47401 - DNA, 201 bp, Homo sapiens
tgtatgtctgttatagctatatgtttatatgtgtcatgtagaagtaatatttcactaccaaattatattaaagacctctaatcacttggctaaaagaaaartaagtgcttttcagactgaaggaagctaccaaagatgccttttaattcatatgaccttagtagttttgggtaagactaatctggtaaatttaatctcaaa

SEQ ID NO: 47402 - DNA, 201 bp, Homo sapiens
ctacaagtgtgcaccacaaagccaagcttttttatttatttatttatttattttgtattatttatagagatggagtgtcacatgttgcccaggctggtctygaacacctagactaaaatgatctgtctgccttagtctcccaaagtgctaggattacaggcatgagccatggtgtctggcctttttaagttaatagttgaa

SEQ ID NO: 47403 - DNA, 201 bp, Homo sapiens
gcctggaatggtaactctctccttcaactttgtttggctcctgtaactttttacttttattttattttttttgaggcagggcctcactctgtcacccaggytggagtgcagtggcacaatctcagttcactgcaccctcaacctcccaggctcaagaaatcctcccctcagccttctgagtagctggaactacaagtgtgc

SEQ ID NO: 47404 - DNA, 201 bp, Homo sapiens
taaataaatcttctttcaactacaccagtctttgtgcctagtaaacaatcctgaacataatttgcattttttctctctttttcttcttcttttggagctckaaagtagagttcagttaatcacaatgctcaagtcataacacattatcatcataggccagtgcaaggattctctcttattttacttcatttatttatttat

SEQ ID NO: 47405 - DNA, 201 bp, Homo sapiens
ttctgttgcagcttcctgtcttaaaaacacaattgttctttcattttcttttcttccacactatttctccttcccccttcactgtctggtaccaaaaaaaatctagagaagccatcaaatgacttgaaccccttaaaacactcagaacaaaggcatcactcaccctttctttctctgtggagtttcaagagtcatgggcag

SEQ ID NO: 47406 - DNA, 201 bp, Homo sapiens
ctaaaactaggaaattgcagagccagttttcaaatttaggtatattaaataaatcttctttcaactacaccagtctttgtgcctagtaaacaatcctgaasataatttgcattttttctctctttttcttcttcttttggagctctaaagtagagttcagttaatcacaatgctcaagtcataacacattatcatcatagg

SEQ ID NO: 47407 - DNA, 201 bp, Homo sapiens; identical to SEQ ID NO: 13324

SEQ ID NO: 47408 - DNA, 201 bp, Homo sapiens
accatcctgcacatgacctgctgccgtcagcgcctggaggagatcacgggccatctgcacaaagctaagcagctgggcctgaagaacatcatggcgctgcrgggaggtgtggagccagcactcccctacactctgggttctggctttcccggaggccacttggtagcctgaacttggttcctgaaatggtcctttacttct

SEQ ID NO: 47409 - DNA, 201 bp, Homo sapiens
gaggagctgaccagtgaagaaagtgtctttgaagtctttgttctttacctctcgggagaaccaaaccggaatggtcacaaagtgagtgatgctggagtggrgaccctggttcatcccctgcccctggcctgaccccagctgcaggccaggctgcggggctgtgacttccccatcctgtgccctcccctccatgctgtggac

SEQ ID NO: 47410 - DNA, 201 bp, Homo sapiens
aggaagcactccctgaaaggcagctgctgttactatcctgagttgacacctttctcccagggctgctggagttaacattatgttctgatctaaggcccacrggccctggagcagaaagacctgagtttaaggaccagctctactgtttactgtcagagtagccaacgtgctcaacttccctgaacccactttcctcacgtg

SEQ ID NO: 47411 - DNA, 201 bp, Homo sapiens
cctcccaaagtgctgggattacaggtgtgttttttgtttttttaagagatggagtctcgctatgttgcccaggctggccttgaactcctgggctcaggcawtccttctgcctcagccttcccagtagctgggtcactgtgatgatttgaattgaattctgtgatgtgtaagaagagcagcctgcaaggcaagcacagatgg

SEQ ID NO: 47412 - DNA, 201 bp, Homo sapiens
gccagcagtggcagtgagagctccaaagatagttcgagatgttccaccccgggcctggaccccgagcggcatgagagactccgggagaagatgaggcggcrattggaatctggtgacaagtggttctccctggaattcttccctcctcgaactgctgagggagctgtcaatctcatctcaaggtaaactcatgcaaggtta

SEQ ID NO: 47413 - DNA, 201 bp, Homo sapiens
cagagcaaagcagcttggccttccgcctggctcagagtcctgccctgggcttgggctgatgaaaccagcactccatgtagtttcatgaaggcctatggtcrtcctgcttgcctgaccgagcaaggcggctagtaagtttagtcattgaggaaaggggtcagagagttcacagagccagtaaggagcctatgggacatctga

SEQ ID NO: 47414 - DNA, 201 bp, Homo sapiens
actactacctcttctacctgaagagcaagtcccccaaggaggagctgctgaagatgtggggggaggagctgaccagtgaagaaagtgtctttgaagtcttygttctttacctctcgggagaaccaaaccggaatggtcacaaagtgagtgatgctggagtggggaccctggttcatcccctgcccctggcctgaccccagc

SEQ ID NO: 47415 - DNA, 201 bp, Homo sapiens
gcctttggggagctgaaggactactacctcttctacctgaagagcaagtcccccaaggaggagctgctgaagatgtggggggaggagctgaccagtgaagmaagtgtctttgaagtctttgttctttacctctcgggagaaccaaaccggaatggtcacaaagtgagtgatgctggagtggggaccctggttcatcccctg

SEQ ID NO: 47416 - DNA, 201 bp, Homo sapiens
gcaattcctcttcccctgcctttggggagctgaaggactactacctcttctacctgaagagcaagtcccccaaggaggagctgctgaagatgtggggggakgagctgaccagtgaagaaagtgtctttgaagtctttgttctttacctctcgggagaaccaaaccggaatggtcacaaagtgagtgatgctggagtgggga

SEQ ID NO: 47417 - DNA, 201 bp, Homo sapiens; identical to SEQ ID NO: 13330

SEQ ID NO: 47418 - DNA, 201 bp, Homo sapiens
ccagagaggagcacctgaaccccatgggcttggacttcctggggccccgctgggatttcttcgctgctctagctggcaggacacatcccggcctcttcttccacccattcccccatgtggctgaagacattccaacaatggggtgggcccataatagttagccctcagtcagttcccggagcacagccctgggagggggct

SEQ ID NO: 47419 - DNA, 201 bp, Homo sapiens
gccagagaggagcacctgaaccccatgggcttggacttcctggggccccgctgggatttcttcgctgctctagctggcaggacacatcccggcctcttcttccacccattcccccatgtggctgaagacattccaacaatggggtgggcccataatagttagccctcagtcagttcccggagcacagccctgggagggggc

SEQ ID NO: 47420 - DNA, 201 bp, Homo sapiens
agccagagaggagcacctgaaccccatgggcttggacttcctggggccccgctgggatttcttcgctgctctagctggcaggacacatcccggcctcttcttccacccattcccccatgtggctgaagacattccaacaatggggtgggcccataatagttagccctcagtcagttcccggagcacagccctgggaggggg

SEQ ID NO: 47421 - DNA, 201 bp, Homo sapiens
ctattggcaggttaccccaaaggccaccccgaagcagggagctttgaggctgacctgaagcacttgaaggagaaggtgtctgcgggagccgatttcatcaycacgcagcttttctttgaggctgacacattcttccgctttgtgaaggcatgcaccgacatgggcatcacttgccccatcgtccccgggatctttcccatc

SEQ ID NO: 47422 - DNA, 201 bp, Homo sapiens
tctgggcctccagaccaaagagttacatctaccgtacccaggagtgggacgagttccctaacggccgctggtgagggcctgcagaccttccttgcaaatayatctttgttcttgggagcgggagggcagaagaagtttgcatgcttgtggttgacctgggaggagtcaggggcagaatttacaggaatggcctcctgggca

SEQ ID NO: 47423 - DNA, 201 bp, Homo sapiens
ctcaggggtgctcccctgcttccggctccctctagccaatcccttgtctcaattctctgtccccatcctcacccaggcgtcccctaccctgggctctcagygcccaccccaagcgccgagaggaagatgtacgtcccatcttctgggcctccagaccaaagagttacatctaccgtacccaggagtgggacgagttcccta

SEQ ID NO: 47424 - DNA, 201 bp, Homo sapiens
ctcagagggcatcagatggaagaactcagcctcaggggtgctcccctgcttccggctccctctagccaatcccttgtctcaattctctgtccccatcctcrcccaggcgtcccctaccctgggctctcagcgcccaccccaagcgccgagaggaagatgtacgtcccatcttctgggcctccagaccaaagagttacatct

SEQ ID NO: 47425 - DNA, 201 bp, Homo sapiens
ggccaaggtgggaggattgcttgagcccagaagttccagacaaacctggacaagatagcaagaccccatctctaaaaaataaataattaattaaaaaaaawttttttaattagccagatgtggtggcttgcatctgtagtccaagctactcaggagactgaagtgggagatcacttgtgcccgggagttcaaggctacagt

SEQ ID NO: 47426 - DNA, 201 bp, Homo sapiens
agagatccccagaggagggtccaagagcagccccggctgcagtgctggctccccacggtggtacagatggatgtctgtgccatggctagctgggcacatcraaggctccagtctcagagggcatcagatggaagaactcagcctcaggggtgctcccctgcttccggctccctctagccaatcccttgtctcaattctctg

SEQ ID NO: 47427 - DNA, 201 bp, Homo sapiens
ctgctgaccctctttctaactgttcctacagcgaggctgtgcttgccacagttaggattcccctaactctcaatcatgatgtcttaactcacctgagatartaaacaggcaagcgctgtgaaaagtctgaagtgctgctctcacacaaaatgatagcgctgttgttgtgtcttacctctgtaatagtgattataacggcac

SEQ ID NO: 47428 - DNA, 201 bp, Homo sapiens
tgactgtcatccctattggcaggttaccccaaaggccaccccgaagcagggagctttgaggctgacctgaagcacttgaaggagaaggtgtctgcgggagycgatttcatcatcacgcagcttttctttgaggctgacacattcttccgctttgtgaaggcatgcaccgacatgggcatcacttgccccatcgtccccggg

SEQ ID NO: 47429 - DNA, 201 bp, Homo sapiens
tggagagccctgttaatcttgcctctgtgtgtgtgtgcatgtgtgcgtgtgtgcgggggtatgtgtgtgtaggacgaggcctttgccctgtggattgagcrgtggggaaagctgtatgaggaggagtccccgtcccgcaccatcatccagtacatccacgacaactacttcctggtcaacctggtggacaatgacttccca

SEQ ID NO: 47430 - DNA, 201 bp, Homo sapiens
cgagagatcatccagcccaccgtagtggatcccgtcagcttcatgttctggaaggtaaaggagccgggggcaagcttgccccgcccacctggaaaaccgtsgggagggattgggaccaagtcccaagcgtgtgctgaaggccacactggacccagccttcagggcacacccagctctgactcacccatgtcactgctgacg

SEQ ID NO: 47431 - DNA, 201 bp, Homo sapiens
tggcccaggtcttacccccaccccacatcccctcagggtgaaaacatcaccaatgcccctgaactgcagccgaatgctgtcacttggggcatcttccctgrgcgagagatcatccagcccaccgtagtggatcccgtcagcttcatgttctggaaggtaaaggagccgggggcaagcttgccccgcccacctggaaaaccg

SEQ ID NO: 47432 - DNA, 201 bp, Homo sapiens
tggccagcatcaagttctaacccacaacacggtctttttggagtagcatgaattcaggagaaatctggctgcatagtcaagccctcaccccttccatcctrtgcacgaactgtttcaagtaacagatgttccaggcagagccagccagagtgagctgttccttctctggagggtgatctggtatccctgaacgcctgttgg

SEQ ID NO: 47433 - DNA, 201 bp, Homo sapiens
tgctcttaaggagctcccagcctagagtgagggaggcagatcaatgtgtgaccaccagccagtgtaagtgggaaaatcaagttcaggagaggatgctgtcrggtccagaggagggatatctcacctgggaggccagggaaggcttctcagagggtcatctgtgggaatcactgaggacaaagaggagttggccaacaggag

SEQ ID NO: 47434 - DNA, 201 bp, Homo sapiens
ttaaccagactgccagatgaccctatgccctctgttggcctgtctgtgccctggtggctctgattacttgtttctgttttttgtttttgttttttttttttgagatggagttttgcttttgtcgcccaggctggagtgctatggcacaatcttggttcactgcaacctctgccttccgggttcaagcgattctcctgcctc

SEQ ID NO: 47435 - DNA, 201 bp, Homo sapiens
ctgagcccaggccgttccccttggcttcctccgtccacccaggctgcactgcagtgatggcgcgggaggcaccagctctgtggcctgtgtccagcagctgygggtctgaaggaatagccagagaggagcacctgaaccccatgggcttggacttcctggggccccgctgggatttcttcgctgctctagctggcaggacac

SEQ ID NO: 47436 - DNA, 201 bp, Homo sapiens
accacacacccattcactactgtgtgtttgcccattgctgtgcaagtgttttgtttgtttttaagtgtttgtcttattttcttaaccagactgccagatgrccctatgccctctgttggcctgtctgtgccctggtggctctgattacttgtttctgttttttgtttttgttttttttttttgagatggagttttgctttt

SEQ ID NO: 47437 - DNA, 201 bp, Homo sapiens
tagccctcagacctgtccagactgagaaactcacgtccccactcccctcaccctttgcttatggacgtgccaacgccacagttcattattccgcccacatkgctgccagtagtcctgataccttaggtgtctgcgaaagggcgtctggcagggctggggttggtgacaggcacctgtctctcccacaggcctacttagagt

SEQ ID NO: 47438 - DNA, 201 bp, Homo sapiens
gatgctgccatccgcaactatggcatcgagctggccgtgagcctgtgccaggagcttctggccagtggcttggtgccaggcctccacttctacaccctcarccgcgagatggctaccacagaggtgctgaagcgcctggggatgtggactgaggaccccaggtgagggcagtggcccagagatccccagaggagggtccaa

SEQ ID NO: 47439 - DNA, 201 bp, Homo sapiens
aggagttgagtacagtgaggagggtggaggaaggtgctgagcttagccttgtgccctgcccccatctccccaggcctccagcctctcccggctgcctgccrcccaaagagaaatcacaggggcggggcaggaatgcaaagtgttttctcagaacagctgaaacattccgaagagggaatggatggggagaatggtcaatac

SEQ ID NO: 47440 - DNA, 201 bp, Homo sapiens
tgcccctgaactgcagccgaatgctgtcacttggggcatcttccctgggcgagagatcatccagcccaccgtagtggatcccgtcagcttcatgttctggwaggtaaaggagccgggggcaagcttgccccgcccacctggaaaaccgtggggagggattgggaccaagtcccaagcgtgtgctgaaggccacactggacc

SEQ ID NO: 47441 - DNA, 201 bp, Homo sapiens
aaggctagttcctttcaattccatttaaaaaacaaaaaccagcaggtgtggtggctcatggcgtaatgggcctgcccaatgctttgggaggccaaggcagrtagatcgcttgagcccaggagtttgagacaagccctggcaacatagtgagatcccatttctacaaaaaaaaaaaaaaaattagccgggtgtggtggcaca

SEQ ID NO: 47442 - DNA, 201 bp, Homo sapiens
cctcacccaggcgtcccctaccctgggctctcagcgcccaccccaagcgccgagaggaagatgtacgtcccatcttctgggcctccagaccaaagagttasatctaccgtacccaggagtgggacgagttccctaacggccgctggtgagggcctgcagaccttccttgcaaatatatctttgttcttgggagcgggaggg

SEQ ID NO: 47443 - DNA, 201 bp, Homo sapiens
agtgccagcagtggcagtgagagctccaaagatagttcgagatgttccaccccgggcctggaccccgagcggcatgagagactccgggagaagatgaggcsgcgattggaatctggtgacaagtggttctccctggaattcttccctcctcgaactgctgagggagctgtcaatctcatctcaaggtaaactcatgcaagg

SEQ ID NO: 47444 - DNA, 201 bp, Homo sapiens
aacgatgctgccatccgcaactatggcatcgagctggccgtgagcctgtgccaggagcttctggccagtggcttggtgccaggcctccacttctacacccycaaccgcgagatggctaccacagaggtgctgaagcgcctggggatgtggactgaggaccccaggtgagggcagtggcccagagatccccagaggagggtc

SEQ ID NO: 47445 - DNA, 201 bp, Homo sapiens
tgtgaaggtaggccaggccccagggttcccacagagtaccaggcccttcgttgagcaaacacccagcacctagcctgggctaggcattgtgcaagacagasagatacaggcagaactggggccctgctcttaaggagctcccagcctagagtgagggaggcagatcaatgtgtgaccaccagccagtgtaagtgggaaaat

SEQ ID NO: 47446 - DNA, 201 bp, Homo sapiens
gtggactgaggaccccaggtgagggcagtggcccagagatccccagaggagggtccaagagcagccccggctgcagtgctggctccccacggtggtacagrtggatgtctgtgccatggctagctgggcacatcgaaggctccagtctcagagggcatcagatggaagaactcagcctcaggggtgctcccctgcttccgg

SEQ ID NO: 47447 - DNA, 201 bp, Homo sapiens
gtgtgctcctagaatatgatcggactttcgtgggtccctctgcctgacactgtggttggcatggatgatggaagggggagaagtatttagggtgggagacrggctggccagcagccgccacagcccctcatgtcttggacagggctaccactcccttcggcagcttgtgaagctgtccaagctggaggtgccacaggagat

SEQ ID NO: 47448 - DNA, 201 bp, Homo sapiens
ccctggcggctgagaccagcctgctgaaggaggagctgctgcgggtgaaccgccagggcatcctcaccatcaactcacagcccaacatcaacgggaagccrtcctccgaccccatcgtgggctggggccccagcgggggctatgtcttccagaaggtgtggtagggaggcacggggtgcccccctctcttgaccggcaccc

SEQ ID NO: 47449 - DNA, 201 bp, Homo sapiens
tgctgccatccgcaactatggcatcgagctggccgtgagcctgtgccaggagcttctggccagtggcttggtgccaggcctccacttctacaccctcaacygcgagatggctaccacagaggtgctgaagcgcctggggatgtggactgaggaccccaggtgagggcagtggcccagagatccccagaggagggtccaaga

SEQ ID NO: 47450 - DNA, 201 bp, Homo sapiens
tttccctcctgctgtcttaccaagtgctagaaagagacgaaccaaacctaaataatatgaagtttctgccttccagggactcgcagtcctgggtgtcgggrctaggtagagggaacagaaagggtctctggaggttgggtgagacccagtgactatgacctccaccaaccctgcagacccaataggtgaccagtgggaaga

SEQ ID NO: 47451 - DNA, 201 bp, Homo sapiens; identical to SEQ ID NO: 13358

SEQ ID NO: 47452 - DNA, 201 bp, Homo sapiens
ccctgcttccggctccctctagccaatcccttgtctcaattctctgtccccatcctcacccaggcgtcccctaccctgggctctcagcgcccaccccaagygccgagaggaagatgtacgtcccatcttctgggcctccagaccaaagagttacatctaccgtacccaggagtgggacgagttccctaacggccgctggtg

SEQ ID NO: 47453 - DNA, 201 bp, Homo sapiens
ttttttccctcctgctgtcttaccaagtgctagaaagagacgaaccaaacctaaataatatgaagtttctgccttccagggactcgcagtcctgggtgtcrgggctaggtagagggaacagaaagggtctctggaggttgggtgagacccagtgactatgacctccaccaaccctgcagacccaataggtgaccagtggga

SEQ ID NO: 47454 - DNA, 201 bp, Homo sapiens
actggtgggctgcttttttccctcctgctgtcttaccaagtgctagaaagagacgaaccaaacctaaataatatgaagtttctgccttccagggactcgcrgtcctgggtgtcggggctaggtagagggaacagaaagggtctctggaggttgggtgagacccagtgactatgacctccaccaaccctgcagacccaatag

SEQ ID NO: 47455 - DNA, 201 bp, Homo sapiens
caagttcaggagaggatgctgtcgggtccagaggagggatatctcacctgggaggccagggaaggcttctcagagggtcatctgtgggaatcactgaggasaaagaggagttggccaacaggagagaagggtattcctgggacagggcagaggacaggcagaggcagtgagctgcaccatctggggaaaccgggaacatga

SEQ ID NO: 47456 - DNA, 201 bp, Homo sapiens
agacctcctccatgatgatcgccagcaccgccgtgaactactgtggcctggagaccatcctgcacatgacctgctgccgtcagcgcctggaggagatcacrggccatctgcacaaagctaagcagctgggcctgaagaacatcatggcgctgcggggaggtgtggagccagcactcccctacactctgggttctggctttc

SEQ ID NO: 47457 - DNA, 201 bp, Homo sapiens
tttgagtgaggcggcccggacagccatagctgaggagcatggagccactgggagggggcagtgtcaccttttttggccttcttcctgtgtggaaatacagygcctccggcttgaacctgccactcaggtgtcttgatgtgtcgggggtgtggctgcctgccccctgatgctccctgccccaccctgtgcagtaggaaccca

SEQ ID NO: 47458 - DNA, 201 bp, Homo sapiens; identical to SEQ ID NO: 13361

SEQ ID NO: 47459 - DNA, 201 bp, Homo sapiens
ccgggcctggaccccgagcggcatgagagactccgggagaagatgaggcggcgattggaatctggtgacaagtggttctccctggaattcttccctcctcraactgctgagggagctgtcaatctcatctcaaggtaaactcatgcaaggttaaggtgggaggcgggagtggtggtgcctggggagcaaactgtcagccct

SEQ ID NO: 47460 - DNA, 201 bp, Homo sapiens
cgcagggagagtggaggccgggagtggaggcgcaggcagagggtattgagcccagacagcctcattgagtcaaggctgtccaggcagtgggactccagttrttcttggcccaggtcttacccccaccccacatcccctcagggtgaaaacatcaccaatgcccctgaactgcagccgaatgctgtcacttggggcatcttc

SEQ ID NO: 47461 - DNA, 201 bp, Homo sapiens
cgtcagcttcatgttctggaaggtaaaggagccgggggcaagcttgccccgcccacctggaaaaccgtggggagggattgggaccaagtcccaagcgtgtrctgaaggccacactggacccagccttcagggcacacccagctctgactcacccatgtcactgctgacgcagggtgtttatttctgggcaggggtgggaag

SEQ ID NO: 47462 - DNA, 201 bp, Homo sapiens
tggggagggattgggaccaagtcccaagcgtgtgctgaaggccacactggacccagccttcagggcacacccagctctgactcacccatgtcactgctgaygcagggtgtttatttctgggcaggggtgggaagtgatactggcagtgggccttgttctattccgggaaatgtcctgttgagcagagcccttggagagccc

SEQ ID NO: 47463 - DNA, 201 bp, Homo sapiens
agtgactatgacctccaccaaccctgcagacccaataggtgaccagtgggaagaggaggagggaggcttcaactacgcagtggacctggtgaagcacatcygaagtgagtttggtgactactttgacatctgtgtggcaggtgagtggctggatcatcctggtggcggggatggagctagggaggctgagatgcccagaga

SEQ ID NO: 47464 - DNA, 201 bp, Homo sapiens
ttagtgcccgcctaggagttgagtacagtgaggagggtggaggaaggtgctgagcttagccttgtgccctgcccccatctccccaggcctccagcctctcmcggctgcctgccacccaaagagaaatcacaggggcggggcaggaatgcaaagtgttttctcagaacagctgaaacattccgaagagggaatggatgggga

SEQ ID NO: 47465 - DNA, 201 bp, Homo sapiens
gaaatgtcctgttgagcagagcccttggagagccctgttaatcttgcctctgtgtgtgtgtgcatgtgtgcgtgtgtgcgggggtatgtgtgtgtaggacraggcctttgccctgtggattgagcggtggggaaagctgtatgaggaggagtccccgtcccgcaccatcatccagtacatccacgacaactacttcctggt

SEQ ID NO: 47466 - DNA, 201 bp, Homo sapiens
tgcttccggctccctctagccaatcccttgtctcaattctctgtccccatcctcacccaggcgtcccctaccctgggctctcagcgcccaccccaagcgcygagaggaagatgtacgtcccatcttctgggcctccagaccaaagagttacatctaccgtacccaggagtgggacgagttccctaacggccgctggtgagg

SEQ ID NO: 47467 - DNA, 201 bp, Homo sapiens
tcactgaggacaaagaggagttggccaacaggagagaagggtattcctgggacagggcagaggacaggcagaggcagtgagctgcaccatctggggaaacsgggaacatgagcaggaggaggcgggagtgttaagcaggggccaggcccgcagagatcatggttgtcctgctggaatttgagttttccctcaatgcaaggg

SEQ ID NO: 47468 - DNA, 201 bp, Homo sapiens; identical to SEQ ID NO: 13336

SEQ ID NO: 47469 - DNA, 201 bp, Homo sapiens
cagatggggcagcttttgttctgagaaattcgtgcccttactgaacttgggtctggctatttttggaacatggccagcatcaagttctaacccacaacackgtctttttggagtagcatgaattcaggagaaatctggctgcatagtcaagccctcaccccttccatcctgtgcacgaactgtttcaagtaacagatgttc

SEQ ID NO: 47470 - DNA, 201 bp, Homo sapiens
caccccaagcgccgagaggaagatgtacgtcccatcttctgggcctccagaccaaagagttacatctaccgtacccaggagtgggacgagttccctaacgrccgctggtgagggcctgcagaccttccttgcaaatatatctttgttcttgggagcgggagggcagaagaagtttgcatgcttgtggttgacctgggagga

SEQ ID NO: 47471 - DNA, 201 bp, Homo sapiens
ttggcaggttaccccaaaggccaccccgaagcagggagctttgaggctgacctgaagcacttgaaggagaaggtgtctgcgggagccgatttcatcatcaygcagcttttctttgaggctgacacattcttccgctttgtgaaggcatgcaccgacatgggcatcacttgccccatcgtccccgggatctttcccatccag

SEQ ID NO: 47472 - DNA, 201 bp, Homo sapiens
aagcagggagctttgaggctgacctgaagcacttgaaggagaaggtgtctgcgggagccgatttcatcatcacgcagcttttctttgaggctgacacattyttccgctttgtgaaggcatgcaccgacatgggcatcacttgccccatcgtccccgggatctttcccatccaggtgaggggcccaggagagcccataagct

SEQ ID NO: 47473 - DNA, 201 bp, Homo sapiens
tagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggctgga

SEQ ID NO: 47474 - DNA, 201 bp, Homo sapiens
atagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggctgg

SEQ ID NO: 47475 - DNA, 201 bp, Homo sapiens
gatagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggctg

SEQ ID NO: 47476 - DNA, 201 bp, Homo sapiens
tgatagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggct

SEQ ID NO: 47477 - DNA, 201 bp, Homo sapiens
gcccaggtcttacccccaccccacatcccctcagggtgaaaacatcaccaatgcccctgaactgcagccgaatgctgtcacttggggcatcttccctgggygagagatcatccagcccaccgtagtggatcccgtcagcttcatgttctggaaggtaaaggagccgggggcaagcttgccccgcccacctggaaaaccgtg

SEQ ID NO: 47478 - DNA, 201 bp, Homo sapiens
atgatagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggc

SEQ ID NO: 47479 - DNA, 201 bp, Homo sapiens
gcccccatcggtgactcagtgacctggtgactggattctcggccacctgggcgccgagacggcttccggctcctgccttttaaacctgcctccccggcgakcacctggagaagagcgctgggcccggggcactgcggtccctggcgcccactgcgtcccgctgcgcacgggggtccgccgggacctttctgggagtcgtag

SEQ ID NO: 47480 - DNA, 201 bp, Homo sapiens
aaggagctcccagcctagagtgagggaggcagatcaatgtgtgaccaccagccagtgtaagtgggaaaatcaagttcaggagaggatgctgtcgggtccaraggagggatatctcacctgggaggccagggaaggcttctcagagggtcatctgtgggaatcactgaggacaaagaggagttggccaacaggagagaaggg

SEQ ID NO: 47481 - DNA, 201 bp, Homo sapiens
gttccccttggcttcctccgtccacccaggctgcactgcagtgatggcgcgggaggcaccagctctgtggcctgtgtccagcagctgcgggtctgaaggartagccagagaggagcacctgaaccccatgggcttggacttcctggggccccgctgggatttcttcgctgctctagctggcaggacacatcccggcctctt

SEQ ID NO: 47482 - DNA, 201 bp, Homo sapiens
gagaagatgaggcggcgattggaatctggtgacaagtggttctccctggaattcttccctcctcgaactgctgagggagctgtcaatctcatctcaaggtraactcatgcaaggttaaggtgggaggcgggagtggtggtgcctggggagcaaactgtcagccctgaggctgggctgccctttaacccggcagaaaaaagc

SEQ ID NO: 47483 - DNA, 201 bp, Homo sapiens
ggggaggtgtggagccagcactcccctacactctgggttctggctttcccggaggccacttggtagcctgaacttggttcctgaaatggtcctttacttcytcctgggccccacgctgaggatccgcaggatcccatccccgccagtagtgtcagtaggcattgtgggtagtgagtcatcctgggcaccacacacaggcag

SEQ ID NO: 47484 - DNA, 201 bp, Homo sapiens
tccactgcccctgtgttttcagactccaggagctcattgttttgtgagtggcttatagtactctagccagctctctgaaccggatgctggttctgccattrgaaacaacacagaatatgactaataaagaacttcactagggggctgggtacagtggctcatgcctgtaatctcagcactttgggaggccaaggtgggagg

SEQ ID NO: 47485 - DNA, 201 bp, Homo sapiens
gggctgcttttttccctcctgctgtcttaccaagtgctagaaagagacgaaccaaacctaaataatatgaagtttctgccttccagggactcgcagtcctsggtgtcggggctaggtagagggaacagaaagggtctctggaggttgggtgagacccagtgactatgacctccaccaaccctgcagacccaataggtgacc

SEQ ID NO: 47486 - DNA, 201 bp, Homo sapiens
gaagcacttctgcaagtgctgaagaagtacgagctccgggttaattaccaccttgtcaatgtgaaggtaggccaggccccagggttcccacagagtaccargcccttcgttgagcaaacacccagcacctagcctgggctaggcattgtgcaagacagagagatacaggcagaactggggccctgctcttaaggagctccc

SEQ ID NO: 47487 - DNA, 201 bp, Homo sapiens
tgtggggcatggttccttccctgggaaggctaagttcagttctgttttttattctatgagaacaagtcacagctgcagctgggccccatgctctgccccargcccccaaccccgcggtgctccggcggcttcctgtccactctcggggcccttggggcctggcttgctccagggtcttgggctactggcagctcctctcct

SEQ ID NO: 47488 - DNA, 201 bp, Homo sapiens
gggaaggctaagttcagttctgttttttattctatgagaacaagtcacagctgcagctgggccccatgctctgccccaagcccccaaccccgcggtgctcyggcggcttcctgtccactctcggggcccttggggcctggcttgctccagggtcttgggctactggcagctcctctccttgggctcctggctgccaggcgt

SEQ ID NO: 47489 - DNA, 201 bp, Homo sapiens
gcggaagcacttctgcaagtgctgaagaagtacgagctccgggttaattaccaccttgtcaatgtgaaggtaggccaggccccagggttcccacagagtaycaggcccttcgttgagcaaacacccagcacctagcctgggctaggcattgtgcaagacagagagatacaggcagaactggggccctgctcttaaggagct

SEQ ID NO: 47490 - DNA, 201 bp, Homo sapiens
caagcccctcagcccttgcccccatccctcggacccaccaaactgcacacacagctcctcttaccgtagcctccgtttatgggccttgctttgggctttgsaggctctgggctcagggctggagtgcgctcttggtccctggtccctcgtccacaggggcaggcctgggacccagctactctgtccaggccactgtggcca

SEQ ID NO: 47491 - DNA, 201 bp, Homo sapiens
gggacccagctactctgtccaggccactgtggccagagctggaaggcagggcagagggaatgttccctgcaccctggaaaggggagttgagtcacaagagkttaaggtgggtccaggaaggcagctgctcttagtgcccgcctaggagttgagtacagtgaggagggtggaggaaggtgctgagcttagccttgtgccctg

SEQ ID NO: 47492 - DNA, 201 bp, Homo sapiens
gaaggcagggcagagggaatgttccctgcaccctggaaaggggagttgagtcacaagaggttaaggtgggtccaggaaggcagctgctcttagtgcccgcytaggagttgagtacagtgaggagggtggaggaaggtgctgagcttagccttgtgccctgcccccatctccccaggcctccagcctctcccggctgcctgc

SEQ ID NO: 47493 - DNA, 201 bp, Homo sapiens
gctccagcatccagcctgtgtgttctgtaatggaactgaccccctcccctgaaaacgaaggggccccggggctggcaagcagggaaagctccacggtgcgyggctgtggcacagacttctggaaggctggctgagtggaatgcagggaagagggcagtacctgggaaaggacccacccatcttcctgctgctgtaactgct

SEQ ID NO: 47494 - DNA, 201 bp, Homo sapiens
ccaatgctttgggaggccaaggcaggtagatcgcttgagcccaggagtttgagacaagccctggcaacatagtgagatcccatttctacaaaaaaaaaaaaaaaattagccgggtgtggtggcacacgcctgtagtctcagctactcaggtggctgaggtgggaggatcgtttgagccctggaggttgaggctgcagtgag

SEQ ID NO: 47495 - DNA, 201 bp, Homo sapiens; identical to SEQ ID NO: 13354

SEQ ID NO: 47496 - DNA, 201 bp, Homo sapiens
cccaatgctttgggaggccaaggcaggtagatcgcttgagcccaggagtttgagacaagccctggcaacatagtgagatcccatttctacaaaaaaaaaaaaaaaattagccgggtgtggtggcacacgcctgtagtctcagctactcaggtggctgaggtgggaggatcgtttgagccctggaggttgaggctgcagtga

SEQ ID NO: 47497 - DNA, 201 bp, Homo sapiens
ctccgaccccatcgtgggctggggccccagcgggggctatgtcttccagaaggtgtggtagggaggcacggggtgcccccctctcttgaccggcacccgtkggttccccagagcttagggcagagcagcctgcctctcctgggctcttaaattttgaatgagcatggattggagcggatgggagctcatgctttaagtcag

SEQ ID NO: 47498 - DNA, 201 bp, Homo sapiens
tctgggcaggggtgggaagtgatactggcagtgggccttgttctattccgggaaatgtcctgttgagcagagcccttggagagccctgttaatcttgcctstgtgtgtgtgtgcatgtgtgcgtgtgtgcgggggtatgtgtgtgtaggacgaggcctttgccctgtggattgagcggtggggaaagctgtatgaggagga

SEQ ID NO: 47499 - DNA, 201 bp, Homo sapiens
tcagtgaatgttggctatcaccgtgtgccaaactctggggataccccaggcaggacaccggtcctgtctcagggaactggggaaagagaaaggagacaggycttttcacccacagttacaacccagggtgctatgggagtccagctgataacggataaatcgtgggagttggcttacaaatatggcacatgcgtggcatat

SEQ ID NO: 47500 - DNA, 201 bp, Homo sapiens
agacctgtccagactgagaaactcacgtccccactcccctcaccctttgcttatggacgtgccaacgccacagttcattattccgcccacatggctgccartagtcctgataccttaggtgtctgcgaaagggcgtctggcagggctggggttggtgacaggcacctgtctctcccacaggcctacttagagtttttcact

SEQ ID NO: 47501 - DNA, 201 bp, Homo sapiens
ggctggagtgctatggcacaatcttggttcactgcaacctctgccttccgggttcaagcgattctcctgcctcagcctccagagtagctgggattacaggygcccgccaccaaacctggctaatttttatatttttagtagagtcgggatttcaccatgttggccaggctggtctcaaactcctggcctcaggtgatccac

SEQ ID NO: 47502 - DNA, 201 bp, Homo sapiens
tcttactggatggctcatgacaggtggtgctacagtcccgagactacaatgcactctccatgtctgtgatggcattcgtggcaatgatctacccactggartatatgtttcctgtcatcccgctgctacccacctgcatggcatcagcagagcaggtgagtctcaaggcgacttccggctttctcacctctgtcttcctga

SEQ ID NO: 47503 - DNA, 201 bp, Homo sapiens
gctccagagaggtggggatgtggtgcacttggacattcagagacatggctttgtgttttacccctggaggcagacatctagtctgggtgaaaggtgggggktgctctgcaaaggagctgatgaccacagaagcggtgtgtggaccctgtagtgagaaccagcagttcctgaaggaggtggtgcacagcgtgctggacggcc

SEQ ID NO: 47504 - DNA, 201 bp, Homo sapiens; identical to SEQ ID NO: 13538

SEQ ID NO: 47505 - DNA, 201 bp, Homo sapiens
cctgggttctggatctttgaggtataggtttccaagtcagttctttaaatgcttcttcactggacttgattataatctcgtttacatttggtgtttctccrttcccacaaaggcagtgccttagtgagctttctaggcatcacctctgtttggctcactccctgcttgaccttgagtcatcgaggttggatctttcttttt

SEQ ID NO: 47506 - DNA, 201 bp, Homo sapiens
gggaggggctgtggctctgctataaatagtgctgggagccagagtcgctatagagataaaactgaatcctattacctgcaggtcctctactgggagcaagrgaaaggagaaagcagtattttgaggatttgagaggtattgcaaataggtcttgtttattgttaggtaggggagaaaaaacttctactcattacctaaacc

SEQ ID NO: 47507 - DNA, 201 bp, Homo sapiens
cagcctcaaacttctgggctcaagcaatccacccacctcagcctcccaagtagctgggactgtaggcatgcaccatccctcctggctgagatttttatactttttttttttttttggtagaaacaggttcttgctatgttgcccaggctggtcttgaacttctgggcttaagtgatcctcctgtttcatcctaccaaagtg

SEQ ID NO: 47508 - DNA, 201 bp, Homo sapiens
ccaaaatgctggtattataggcatgagccaccgcacccggccaaattatcagattgttattcaaataattaaattttatatagtagatgatacccatttctttttttttttttttttgagacagagtatcgctctgtcacccaggctggagtgcagtggtgtgatcttggctcactgcagcctccacctcccaggttcaag

SEQ ID NO: 47509 - DNA, 201 bp, Homo sapiens
caaaatgctggtattataggcatgagccaccgcacccggccaaattatcagattgttattcaaataattaaattttatatagtagatgatacccatttctttttttttttttttttgagacagagtatcgctctgtcacccaggctggagtgcagtggtgtgatcttggctcactgcagcctccacctcccaggttcaagc

SEQ ID NO: 47510 - DNA, 201 bp, Homo sapiens
aaaatgctggtattataggcatgagccaccgcacccggccaaattatcagattgttattcaaataattaaattttatatagtagatgatacccatttctttttttttttttttttgagacagagtatcgctctgtcacccaggctggagtgcagtggtgtgatcttggctcactgcagcctccacctcccaggttcaagca

SEQ ID NO: 47511 - DNA, 201 bp, Homo sapiens
aagtgatccacctgcctcgacctcccaaagtgctgggattacaggtgtgagccactgcgcccggccccatttcttttatacacgtgcgcgcgcacacacacgcgcacacacatatacataaagatatctatatatagatgatatagtcacattgttcataaatcagaataacagaaaatagtacacattgggaggtcttgc

SEQ ID NO: 47512 - DNA, 201 bp, Homo sapiens
agtgatccacctgcctcgacctcccaaagtgctgggattacaggtgtgagccactgcgcccggccccatttcttttatacacgtgcgcgcgcacacacacgcgcacacacatatacataaagatatctatatatagatgatatagtcacattgttcataaatcagaataacagaaaatagtacacattgggaggtcttgca

SEQ ID NO: 47513 - DNA, 201 bp, Homo sapiens
gcactcattcttgtccccttccactgaatttcccactcccctcaccccttcatcctatagacaaccacttttattggtttcctttgtaaattccagtggattttttttttctttttctttttttttttttttttttttgagacggagtctcactctgtcgcccaggctggagtgcaatggcttgatctcagctcactgcaa

SEQ ID NO: 47514 - DNA, 201 bp, Homo sapiens
actgaatttcccactcccctcaccccttcatcctatagacaaccacttttattggtttcctttgtaaattccagtggattttttttttctttttctttttytttttttttttttttgagacggagtctcactctgtcgcccaggctggagtgcaatggcttgatctcagctcactgcaacctccacctcctgggttcaagc

SEQ ID NO: 47515 - DNA, 201 bp, Homo sapiens
gggtttcaccattttggccaagctggtctcgaactcctgacctcaagtgatctgcccacctcagcctcccaaagtgctgggattacaggtgtgagctgccrcacctggccaaggaaaatatatatatatatataattttttttttttttttggaggtggagtcttgctctgtcacccaggctggagtgcagtggcacaatc

SEQ ID NO: 47516 - DNA, 201 bp, Homo sapiens
tgtcgggagctgtactactgtgtgaaggacagcatggagcgcgctgccgcccgacagcaaagcatcaaacccggtgaggagagtttttcctgagagtgtcytccctgtttctaccagtccttctgagtgtcaggggcctggcagggaagtcaggggtgggattccccacctcaccagtgagctgatagccccctccctcac

SEQ ID NO: 47517 - DNA, 201 bp, Homo sapiens
cctttcttctccaccttccgagagtgtttgtatactctcaagcgcctggtggactgctgtagtgagcgccttctgggcaagaaactgggcatccctcgagrcgtacaaaggtacagtttgctgctgatgcctaatgggggaagcatttagagattccatgtaattggtctttgaggggcataggaaatttcctctacagct

SEQ ID NO: 47518 - DNA, 201 bp, Homo sapiens; identical to SEQ ID NO: 13543

SEQ ID NO: 47519 - DNA, 201 bp, Homo sapiens
aacctccagccttcagtggccattatagagcagtgggtggggaaccctggacagccctcatgatgggaccactctccccctgtgccacagtgtcgggagcygtactactgtgtgaaggacagcatggagcgcgctgccgcccgacagcaaagcatcaaacccggtgaggagagtttttcctgagagtgtcttccctgtttc

SEQ ID NO: 47520 - DNA, 201 bp, Homo sapiens
tttgcacatctgtctgcaggctgtctctccaggcacggggtgtcaggagggagagacagcctgggtatgggcaagaaatgactgtaaatatttcagccccmcattatttatagaaaatgtacagttgtgtgaatgtgaaataaatgtcctcaactcccttcaggctccctggctgccttgtgttaaatgacacctcctctt

SEQ ID NO: 47521 - DNA, 201 bp, Homo sapiens
tttttctttaatggatgcttagccattagatgtcgtatggtgtaccataattggtttaactagtgcctctcactattttttaaaaaaatattactcatgcygggtgtggtggctcacgcctgtaatcccagcactttgggaggccaaggtgggtggatcacgaggtcaagagttcaagatcagcctggccaagatggtgaa

SEQ ID NO: 47522 - DNA, 201 bp, Homo sapiens
caggggccctggacagtagctgtgaccaggctggtgaaaggcccgtccctcccatccagggctttcaaagaagtgggtagaatcacggccatcaagtaaamgccactgcggatgacagaggcctagctgaggaggctagggccatgtcctcccagctggcagagtctggacagagcctctggtggcctctgccctgtcata

SEQ ID NO: 47523 - DNA, 201 bp, Homo sapiens
cttattttcctcctttcttttttttctttgagacagagtgttgctcttttgctcaggctggagtgcagtggtccaaactcagctcactgcaacctctgccycttgggttcaagtgattctcctgcctcagctgcctgagtagctgggattacagtcgcccaccaccatgcccagataatttttctatttttagtagagacg

SEQ ID NO: 47524 - DNA, 201 bp, Homo sapiens
agtgcagtggtacgatcttgcctcactgcaacctctgcctccagggctcaagcaattgtcgtgcctcaacctcccgagtagctgagattacaggtgtgcaycaccacgcccggctaatttttgtattttttggtagagacagggtttcatcatgttggccaggctggtctcaaactcctgacttcaggtgatctacctgcc

SEQ ID NO: 47525 - DNA, 201 bp, Homo sapiens
aagatgatttgctcagaattttctcaggttgagaagatggctggagaacccattgagaccaggtctgatttgtcctacttggttcttaaggcatctggggwcctctttttccagtgggtcctgagtggggggtagtccttggaaaggtgactaggatgggctgaacgggtctgggaacagcctgtgctgccgtcccacccc

SEQ ID NO: 47526 - DNA, 201 bp, Homo sapiens
ttagtagagacagagtttcaccacgttggccaggctagtcttgaactccaggcctcaagtgatctgcccgcctcagcctcccaaagtgctgggattatagrcgtgaaccaccgtgccctgtgatgggaagctttttattacagattcaatctcattacttgaaattggactattcaggtttctgtttcttggttaaatctt

SEQ ID NO: 47527 - DNA, 201 bp, Homo sapiens
aatcttggctcactgcagtctccacctcccaggttcaagtgattcttctgcctcagcttcccaagtagctgagattacaggtgcccaccaccacaaccggmtaaatttttttttgtatttttagtagagatggggttttgccatgttggccaggctggtctcaaactcctggcctaaggtgatccacccatctcagcctcc

SEQ ID NO: 47528 - DNA, 201 bp, Homo sapiens
tagtagagataggatttcaccgtgttggtcaggctggtctcgaactcctgacttcaaatgatctgcccgccttggcctcccaaagtgctgggattacaggygtgagccaccgcatctggctggagaggacttttttgggttgaatctgtttggggacttttgagcttcctggatctggctgtccatctctctccccagact

SEQ ID NO: 47529 - DNA, 201 bp, Homo sapiens
ctagactccaggatggtggggcttggctgtatcctagactctgtgaagccaagtgcaatggcagcgaataccccagcgtggcagagcacagctgtcatttkggccctgggggtcagggagcagcacagcaatgactccactccccaggaagagggtatcttagcagctcagactctaggggcaagtccagttccagggaag

SEQ ID NO: 47530 - DNA, 201 bp, Homo sapiens
tgagcatgttcttcctttggggaggggggttgggggcggggacactcacagccctctgggcagtactccacgctgtagccatccaggcctcctgctcccaygcgctctgggggccgccacttgagggagaccgtggtgtcagagacgtcctctactgccaggtgggtgggttcgctggggggacctgggcagaggagaggt

SEQ ID NO: 47531 - DNA, 201 bp, Homo sapiens
ggagaatgcaactatttgattctaagccaaacattaaagagatttgcaaaaatgtgaaacagtgccttttttttgaaaatatagttattttattaaaaatstttatattactatgtaatgggttatattaatcattaattgtttttataattaatcatttgagaaatttctgtttaaatttctagtatgtaaatatctata

SEQ ID NO: 47532 - DNA, 201 bp, Homo sapiens; identical to SEQ ID NO: 13539

SEQ ID NO: 47533 - DNA, 201 bp, Homo sapiens
gcaattggggcatggacattttcatttgagatcacatgaggtagaatagccagctgttattgtctgagcatggttaactagacagtctatgtggtagtttyacatcaagctgaatgtagattgttgaaacagaataattaagtttccatctagacctagaagtgcaggttagtgctagctagttgaggagtctggtttgat

SEQ ID NO: 47534 - DNA, 201 bp, Homo sapiens
tgaggcaggagaatcattttaacccacaaggcagaggttgcagtgagtcgagattgcaccactgcactccagcctgggcaacagagtgggactccatctcaaaaaaaaaaaaaaaaaattatagccaatgtgatggtgtgcacctgtagtccctgctactttgggggctgaggcaggaagaacctggctggtcgaggctgc

SEQ ID NO: 47535 - DNA, 201 bp, Homo sapiens
gtttaacatgacccaattttcaggctggtgacgagttcacgggtgtctcagcaaagttggacacaagctagagagagctctctcctcccagccaaaacctrggaattccccactgcagctcctcaggggccctggacagtagctgtgaccaggctggtgaaaggcccgtccctcccatccagggctttcaaagaagtgggt

SEQ ID NO: 47536 - DNA, 201 bp, Homo sapiens
ttcttcctctgcatgctgaacacagtacctgaaggtaacacatgacaaagcttcattcccttcctctgccttatgtgttgtacaggaacaccagtagatarcactgtgtttatttttaggaatccctgctctcatttgaagggcctttagaaatctttttctgtgttgtctgaagtacttagtagtatctctagatgctat

SEQ ID NO: 47537 - DNA, 201 bp, Homo sapiens
tttacatttggtgtttctccgttcccacaaaggcagtgccttagtgagctttctaggcatcacctctgtttggctcactccctgcttgaccttgagtcatygaggttggatctttctttttctggttctaggtccctaggcactctgcttccagctgacatctcattgccatggccattagcagttgccatatgctcccat

SEQ ID NO: 47538 - DNA, 201 bp, Homo sapiens
ggtgtgagctgtactcctggcccctccttttatttacgtctgcatttcttcacatagtggagagaattcctggaagtgctcaggaagtttatagatgcatytttgggctataaaattatgacatttgtgtctctgaagccagtgtcctcccatccaaccattatactcctctggaatgtgctcctctggggcatgcctggc

SEQ ID NO: 47539 - DNA, 201 bp, Homo sapiens
gctcatcaacatgacctactgtcccaagacgaaggtgttgtgcttgtggcgtagaaatggctctgagacccagctcaacaagttctatactaaaaaggtaygcaggatctgtgtttgggttggggctagtaggcattgaagaccaaatagtgaatttctctttgggaagttaaaattccaaaacacacatctggagccaca

SEQ ID NO: 47540 - DNA, 201 bp, Homo sapiens
aggcttactgcagggggtgtgagctgtactcctggcccctccttttatttacgtctgcatttcttcacatagtggagagaattcctggaagtgctcaggargtttatagatgcatctttgggctataaaattatgacatttgtgtctctgaagccagtgtcctcccatccaaccattatactcctctggaatgtgctcctc

SEQ ID NO: 47541 - DNA, 201 bp, Homo sapiens
agcgtaaggcagaaaacctgaccatggggatgccccaggaccacctttccctgtaggaaacagtctagggagaggctgtcagagacaggaaccactgagcygctttgtgcacttctccaggtgtgcgatgactgtgtggtgttgcgtagtaacatcggaacagtgtatgagcgctggtggtacgagaagctcatcaacatg

SEQ ID NO: 47542 - DNA, 201 bp, Homo sapiens
atttgtggtacatgcagggacagatacaaacggagatatctttttcatggaggtaggtgctggttcatgctgggggcccaaagggctattgagagtcacarggaactcataggaccgatgccaggatatttttctcatttatctcattcatcttcatgatctatttatcattaaattatcagattggtttttttgtttttt

SEQ ID NO: 47543 - DNA, 201 bp, Homo sapiens
aggagaagctggcaggcagccccattcgtacttctgaagatgtgagccagcgagtctatctctatgagggactcctaggtgagaaacacactgggaaggcyctttgcactggagaaagctgactcagccaggggagagggtcacactgaacaagtagctggttgtctttctgctgatcttaatgctaacattagatagcag

SEQ ID NO: 47544 - DNA, 201 bp, Homo sapiens
cgaccacgcctggctaatttttgtattttcagtagagacagggtttcaccatgttggccagggtggtctcgaactcctgacctcaagtgatctaccccccscccgccccaaagtgctgggattacaggcgtgagccactgcgcccagctttttttctttgagacagagtctcgctctgttgctcaggctggagtgcaatgg

SEQ ID NO: 47545 - DNA, 201 bp, Homo sapiens
ttgtacatattttatattctggaaacaaaagttgctcgtgacttctctaaggatgataacagaagggtggggatgaggagaaagaaaaaggtacagtattyctgtgggaaactgagaggagattggacacctcccctaatgttcctgtgtcttgtttcagaggactgatcaagactctgtcatcggcgtgagtccagctgt

SEQ ID NO: 47546 - DNA, 201 bp, Homo sapiens; identical to SEQ ID NO: 13550

SEQ ID NO: 47547 - DNA, 201 bp, Homo sapiens
ctgtccaagttggatgccctttatttctttctctggccaattgctttgattagcatttccagttgaataaaagtggtggaagtagacatccttgtcttgcyacagattgtagaggaaaaactttcatctttccccattcagtatgatgttggttgtgggtttgtcatatatgacttttattgttttgaggtatgttcgctc

SEQ ID NO: 47548 - DNA, 201 bp, Homo sapiens
gcctgggtctgccgggcctaggcagggtgcacgtggggaccccagaccctgggctcaccatggtcttcttgtcggctttctgcactgtgtacccccagagytccgtgttgccgacatcctggggtggcttccactccagagccacattaagaccccaggcgtcagtcacccggagatcctggggaggacttggcttgtctg

SEQ ID NO: 47549 - DNA, 201 bp, Homo sapiens
acatatttctcatagactggtagttcagtttagaggtttgatcactttcagattcactcttttgggaagaatacttaatgagtggtgctatacgcttcctrttgcctcatatggttgtccctctcttacacatcagtgggctcagatgtgggcaacctgatctgcccaccagaaagttcctcatttgtcttctgattttgc

SEQ ID NO: 47550 - DNA, 201 bp, Homo sapiens
gaagccttaagaacggataactggctgcgcatggtggctcacgtctgtaatcccagcactttgggaggccgaggcgggcggatcatgaagtcaggagatcragactatccttgctaacacggtgaaaccccgtctctacttaaaaaaatatataaaaaattagccgggcatggtggtgggtgcctgtagtcccagctactc

SEQ ID NO: 47551 - DNA, 201 bp, Homo sapiens
ttatacatcggttccttctaatgactccatctcttccaacaatccttgtagcaggcagcatgtcagtagttctgttttgtgtcttcacctagggaaaccaygagcgtaaggcagaaaacctgaccatggggatgccccaggaccacctttccctgtaggaaacagtctagggagaggctgtcagagacaggaaccactgag

SEQ ID NO: 47552 - DNA, 201 bp, Homo sapiens
ttgcctttttcttctgcggattcttcttcctgttcttttccttcctctgagtgttcccactctgtcccctgctccacaggccccattccctttcttttgaytggggagcacttgtggatacatctttccctcattgtaattccaccataggagctgacttttttttttctctcttggtcttttaacacagtgttacctttt

SEQ ID NO: 47553 - DNA, 201 bp, Homo sapiens
ccttaagctaattcctttctgaggccagcgcatcatcccaggtccgttcacagctctgactcctcacacaagtgccttccctcctctttccctgatgtccrggttcctctccctgaggctctgagccagacccaaatgtgtgaagccccacagaccctggccaggccgcagaccctcaggggaggtggatgcctgactgac

SEQ ID NO: 47554 - DNA, 201 bp, Homo sapiens
aggagctgccttcatggaattctgtcctggaaaaacctggctgcactctcagggaatttgagacctgctggcttcccgcgcccaaaaggaaacagatgctyggatttaggctccccatgggggaagtgagagcagagtggggccctggccctgacacctttctggtgcccagcgtcctggactggattgggttgctgtctc

SEQ ID NO: 47555 - DNA, 201 bp, Homo sapiens
gggacagcttccttgcttggagctcacgtttagcccagaggcccatgcccagtgttagggcaggagttgcccattggcagatccttcacatatggagatgsaggagtctcagtatcgtgatccgcctggttttctctcctctaggcccacgaaatctgctactccgtattatgtctcttctcgtacgtggctgcagttcat

SEQ ID NO: 47556 - DNA, 201 bp, Homo sapiens
gctgtgatgttggagagagaagggatgggtatggaccagggtccccaggaaatgatcgacaggtatggggcttaggaaaccattgggaatcagcaaactcrgcctcctcccagttagttctgtggtctcccacttgagggctgacttgtgcttggtcttctccttaggtacctgtcccttggagaacatgaccggaagcgc

SEQ ID NO: 47557 - DNA, 201 bp, Homo sapiens
tctcttgcccgtccggttttagttcctgaaattaaagaagtggtgagccacaagtacaagacaccaatggtgagtgtgccgctcaaccctgatgggccacrgtgcgcagggctccctgggggaccttcggacaggaggaggggagggccctctgagcgcacaggggtgagtggggacctcgttttgttgccaaaggttcaa

SEQ ID NO: 47558 - DNA, 201 bp, Homo sapiens
acagccttccttttgccaagccaggtttctccgggagatgtttcgggctgtgggttcatgtcaggagccctgcatctgctgaatcctttgacctggttgtygtccctcatgttgctcctcatggctttcaccgcacatcctgggctctgatggttgtcagatggaaaccatctttgtagctagagacggccctgttatgtc

SEQ ID NO: 47559 - DNA, 201 bp, Homo sapiens
cagagcattctgggcctccccaactgtccccacctccactggacaccaagggcctggggtgtcaatggcgggtcttgtgactgcacaaaggggcactcacrcaggatctcctgcactgtcaccggctccgtggtggtaacaggggctccaggccctgccatattgtgtgcccgcactcggaaaagcagccgggcccccgtg

SEQ ID NO: 47560 - DNA, 201 bp, Homo sapiens
agcggcccggatgaacaggatggtgtctgtggggctgttgcggatgctcacctcctcgcctgccaggggctgcccctctttggtccaggtcacctgaggcyggggcttgccctgaggggaggaaaagcttaaccctgaacctggatcactccaagggccggccgccaccccagcctctggtacctcagatcaggccagccc

SEQ ID NO: 47561 - DNA, 201 bp, Homo sapiens
ctaaagccaaccatattctggctgaagacgcggaagtagtagccattgccaatgatgagctctggcaccacgcagtgggtgcggcggtaatgctccaagayggtgaaccactcctgggggcagggagggaggggaggcatctctgggccaggcccttcctgatgccgagagcctctcctgggtgcccttggcatctccacc

SEQ ID NO: 47562 - DNA, 201 bp, Homo sapiens
caactgggacctcgggcaccaagtgccacaggaaagggtcctaaggaactggacaccagaagtttaaaggaagaaaattttatagcatctattggtacgtrtcagtgtgtttggtgtggtggaggggtcctggcttcttaaatatccctttctcctcaattcatccagaatcctgcctttctctgccccatgctttgcttc

SEQ ID NO: 47563 - DNA, 201 bp, Homo sapiens
gcttggtcttctccttaggtacctgtcccttggagaacatgaccggaagcgcctggaagatgatgaagatcgcttgctggccacacttctgcacaacctcrtctcctacatgctgctgatgaaggtaatgtcaattttgctgtgtccagctccgctgatcctagaggggcaaggcttgttcctgtcgcctaaatttcgggg

SEQ ID NO: 47564 - DNA, 201 bp, Homo sapiens
atctttgggcttttggagattgcccagacccactactatagtaaaggtagggatcgtacttgctgggcaccacgccatccctaactctgccacttgtctcytgaagagaaaatatatgtgtacccaggacacgtttcccagtgccacgctgcttcccattaggctttgggattttattttctaatgcatgtttatacgcag

SEQ ID NO: 47565 - DNA, 201 bp, Homo sapiens
cgatgcccggcaggacatcatcccggatgtggtcagtgttgggggtagggaatcggagtaactggagagagggatgtgaacaccacaggcaatttgccaaygctagcccctgggttattgttgcaggagatcagtcggaaggtgtacaagggaatgttagacctcctcaagtgtacagtcctcagcttggagcagtcctat

SEQ ID NO: 47566 - DNA, 201 bp, Homo sapiens
tggttgttattttccaccttagtaaaatcaaagtgaagaaatagtaaaccacgtgctcaggatgaagagggggctgatgattctttaagatatctctcccyttgatgttggaagcctgttaagtgatggctttgggaggtgttctaagactttggatcatgggaatccttaccctatgggtctcagattatctcatcatct

SEQ ID NO: 47567 - DNA, 201 bp, Homo sapiens
ttttcattcattaataaacatccatgaagtgatttactaagtgccagattttgtgctaaagaaacagggatgaaaaaggcatggtttctactcaagaagtytgtgattcactatattgctgtgagtagtctcttctaataggtgaggggaacaatgccttaggaaaaaagaacttccctagatcacacagtaagcccatga

SEQ ID NO: 47568 - DNA, 201 bp, Homo sapiens
cctgtgcaggacctgaagactggtgagggtggcctgctgcaggtgaccctggaagggatcaacctcaaattcatgcacaatcaggtaggtgcgagcggcarcacgaggctccctgtcgttccatctgtaagaaggaccaatgtccaagcccccagtacttccccagcaagcatgagagagggccctctggagctagaggga

SEQ ID NO: 47569 - DNA, 201 bp, Homo sapiens
tgttcccacggatgctaatgaaactggtgagcctccggaccctgagcagcgtccactcagagcaagtgtttgcactgcgtctgcaggacaaaaagctcccmccgctgctctctgagatctgggatgtgcacgaatgactgttctgtccccatattttctgttttcttggccggatggctgaggcctggtggctgcctccta

SEQ ID NO: 47570 - DNA, 201 bp, Homo sapiens
cctttaggaacctgctgactctacggagatggatgataaggcagcagtaggcgtctccaagcccctcccttccgtgcctcccagcattggcaaatcgaacrtggacagacgtcaggcagaaattggagaggggtcagtgcgccggcgaatctatgacaatccatacttcgagccccaatatggctttccccctgaggaaga

SEQ ID NO: 47571 - DNA, 201 bp, Homo sapiens
gctgatgattctttaagatatctctccccttgatgttggaagcctgttaagtgatggctttgggaggtgttctaagactttggatcatgggaatccttacsctatgggtctcagattatctcatcatctgcttccccagggttgccatggtacggttcttcaattccgccaacgtgctgcagggatttcagatgcacacgc

SEQ ID NO: 47572 - DNA, 201 bp, Homo sapiens
gtgccacgctgcttcccattaggctttgggattttattttctaatgcatgtttatacgcagtgggtattctttgttacgaaaaataagacatcagctcatstttccttgaacttcttccattccgcaccctcctgtatcctggctcctcccacctcatatctgcgccttgattcctactcactacttctcttgacctcttg

SEQ ID NO: 47573 - DNA, 201 bp, Homo sapiens
atattttctgttttcttggccggatggctgaggcctggtggctgcctcctagaagtggaacagactgagaagggcaaacattcctgggagctgggcaaggrgatcctcccgtggcattaaaagagagtcaaagggttgcgagttttgtggctactgagcagtggagccctcgctaacactgtgctgtgtctgaagatcatg

SEQ ID NO: 47574 - DNA, 201 bp, Homo sapiens
ggttaatcagcagcggtgggtatttggacaaatcgcgtgctccagagaggtggggatgtggtgcacttggacattcagagacatggctttgtgttttaccyctggaggcagacatctagtctgggtgaaaggtggggggtgctctgcaaaggagctgatgaccacagaagcggtgtgtggaccctgtagtgagaaccagca

SEQ ID NO: 47575 - DNA, 201 bp, Homo sapiens
gaggcccatgcccagtgttagggcaggagttgcccattggcagatccttcacatatggagatggaggagtctcagtatcgtgatccgcctggttttctctyctctaggcccacgaaatctgctactccgtattatgtctcttctcgtacgtggctgcagttcatagcagtgaggaagatctcagaaccccgccccggcctg

SEQ ID NO: 47576 - DNA, 201 bp, Homo sapiens; identical to SEQ ID NO: 13551

SEQ ID NO: 47577 - DNA, 201 bp, Homo sapiens
tctctgagcacctctccctgtccttgcagaaatcctggtatttctgcctctaattcatagcctctgtaatgtatagtaggacaaggactcatctgtgggtrttgtattactgattctgagcctgagatcaaaatagaggagagattatgattcagcaccaagggcagagctagtagcagtggcctctgggctcctttcttg

SEQ ID NO: 47578 - DNA, 201 bp, Homo sapiens
acatagtttagaaatttctctgagcacctctccctgtccttgcagaaatcctggtatttctgcctctaattcatagcctctgtaatgtatagtaggacaargactcatctgtgggtattgtattactgattctgagcctgagatcaaaatagaggagagattatgattcagcaccaagggcagagctagtagcagtggcct

SEQ ID NO: 47579 - DNA, 201 bp, Homo sapiens
catatcagtctttatgctttggttgactgtttttcttggcttctttatttgatttgttccctggccttgagttcggagtgctcccccttttatttttcctsgtgctgattgtaggtgttctccctgcccctttctgttttgtttgttttttatgcacttcactctgcagtggcagtgatagtatggattatgacgattcaa

SEQ ID NO: 47580 - DNA, 201 bp, Homo sapiens
ggtaggatccggttgcctttctgcggtggaggaggaagtgttggatttcagcgctaaggcgtcggcggtgcacctcacgtgcatgtgtagcatgccttggkttttcctttggcatctgaaaaaggcacaacctgaaagacctagaacccagtgtcggtccccaggccctttgggacaggaagagaagagccgtgtggccgc

SEQ ID NO: 47581 - DNA, 201 bp, Homo sapiens
tgaaaaaggcacaacctgaaagacctagaacccagtgtcggtccccaggccctttgggacaggaagagaagagccgtgtggccgcggggaggatgtcctgmggcggggctgtcctcgcggactgactggactccatctcccagcgggcgccgcggcgcggccacgcccccccactccccgcgcgcgcccggtggaggtaac

SEQ ID NO: 47582 - DNA, 201 bp, Homo sapiens
ttagagaagtgtatagacacttaacacgaaataaattataattaagaccatgaaagcttttcctaattttaggacatagtttagaaatttctctgagcacstctccctgtccttgcagaaatcctggtatttctgcctctaattcatagcctctgtaatgtatagtaggacaaggactcatctgtgggtattgtattactg

SEQ ID NO: 47583 - DNA, 201 bp, Homo sapiens
gtctcttgcccgtccggttttagttcctgaaattaaagaagtggtgagccacaagtacaagacaccaatggtgagtgtgccgctcaaccctgatgggccayggtgcgcagggctccctgggggaccttcggacaggaggaggggagggccctctgagcgcacaggggtgagtggggacctcgttttgttgccaaaggttca

SEQ ID NO: 47584 - DNA, 201 bp, Homo sapiens
ctttatgctttggttgactgtttttcttggcttctttatttgatttgttccctggccttgagttcggagtgctcccccttttatttttcctggtgctgatkgtaggtgttctccctgcccctttctgttttgtttgttttttatgcacttcactctgcagtggcagtgatagtatggattatgacgattcaagctcttctt

SEQ ID NO: 47585 - DNA, 201 bp, Homo sapiens
atatgtttgatccagccctgattggtgacaagccaaagtggtatgctcatcagctgcagcctatccactatcgcgtctatgacagcaattcccagctggcwgaggccctgagtgtaccaccagagcgggactctgactccgaacctactgatgataggtgagcatccttagggcagcaaaaaggttttaaaggtgaggagg

SEQ ID NO: 47586 - DNA, 201 bp, Homo sapiens
ttgctaatgtttgacctgtgccttctatcctggctctgctttagactttttcctgcctttctttcaggcgttgcttgcctttttttccttgctgctgactktctgttcttttccctcatggggtagatatgtttgatccagccctgattggtgacaagccaaagtggtatgctcatcagctgcagcctatccactatcgcg

SEQ ID NO: 47587 - DNA, 201 bp, Homo sapiens
cacttgctgtgttttcagtcttgatgattgctttagtatgactaatgagatggagaggttaataaatggaattatatttaattaaattaattaattaattwatttatttattttgagatggagtcccactctgtcacccaggctggagtgcagtggcacaatcttggctcactgcattctctgcctcccaagttcaagcga

SEQ ID NO: 47588 - DNA, 201 bp, Homo sapiens
cggaggttgcagtgagccgaggtcgcgccactgcactccagcctgggtgacagagcaagactccgtcttaaaaaaacaaaaaacaaaaaacgaaaccttayttgaattggtttgtgctatctgacagtttcaggggcttttctgaatttgattttttattttttttattttctgagacagtgtcactccgtcacccaggct

SEQ ID NO: 47589 - DNA, 201 bp, Homo sapiens
tcatttctctggtgcaggtgattgcccccaccaatgcagaagtgctgcctatcctgccagaaccagaatcactagagctgaaaaagcatttaaagcaggtrggtgaagaacgaaggaaagaaaggggagtattagatgctgtgggattcctataagaagacagctattctcagagccaatttcctatcaaacttcaagtgg

SEQ ID NO: 47590 - DNA, 201 bp, Homo sapiens
tctcccacttgagggctgacttgtgcttggtcttctccttaggtacctgtcccttggagaacatgaccggaagcgcctggaagatgatgaagatcgcttgytggccacacttctgcacaacctcatctcctacatgctgctgatgaaggtaatgtcaattttgctgtgtccagctccgctgatcctagaggggcaaggctt

SEQ ID NO: 47591 - DNA, 201 bp, Homo sapiens
ctgtgaactgctgagggttcagaaggtgaaaacgatttcaaatgattctaaaatgttatttgctgttttcacggggttacatttgcactgatggtaccaamgcagtgatgggtaaaactgctggcactgtaacccaagtgaagacaatggccccaaactatgccagcagccattgcattccttgccttcatatactctcag

SEQ ID NO: 47592 - DNA, 201 bp, Homo sapiens
ggccttggccacgcaccaacaacctgcagcaccagcgtggccttgtcctccatgttctcaatgcgcaccgtcacctggtaagtgcctgaatgcacgcggcragcggcccggatgaacaggatggtgtctgtggggctgttgcggatgctcacctcctcgcctgccaggggctgcccctctttggtccaggtcacctgaggc

SEQ ID NO: 47593 - DNA, 201 bp, Homo sapiens
cagcctggccaacgtagtgaaaccccgtctctactaaaaatacaaaagttagctgggtgtggtggcgggcacctgtaatcccagctacttaggaggctgasgcaggagaatcactggaacccgggaggcagaggttgcagcgagctgagattgcgccactgcactccagcctgtgccgcagagtgagactccgtctcaaaa

SEQ ID NO: 47594 - DNA, 201 bp, Homo sapiens
cgagatggctacaggctggacacaggggtgattcatgtctgggtgggacagagcgggacagcatgagatttcatcatgcttctcagaactattgtcctgcmcttcagatatgatcaagctgcagtttaaaatttatgaattgtttatttctggaattttccttttaatattttcagactacagtttgcctcagttaactgg

SEQ ID NO: 47595 - DNA, 201 bp, Homo sapiens
cactcacaccgtgcctcgccctgtaagttggtggccctgcagacatagatgcccccgtcaaaggggcagggctttctaatctccagagtcaacactccctrcttgctgaacatgcggaagcgggcgtcttctcccaggtccaggccattcttgaaccaggaaatcttgggctataaataaggtaaagagagggagggaagc

SEQ ID NO: 47596 - DNA, 201 bp, Homo sapiens
caatggcgggtcttgtgactgcacaaaggggcactcacgcaggatctcctgcactgtcaccggctccgtggtggtaacaggggctccaggccctgccataktgtgtgcccgcactcggaaaagcagccgggcccccgtgggcaggtccttcaccagtatcgatgtgtgctctgtcagcccctgcagggcagccacccactc

SEQ ID NO: 47597 - DNA, 201 bp, Homo sapiens
gtgggttgggtcccctggccccacccttggccccagcagcccagcccagggaagggaaacaagggggctcaaggaggccttggccacgcaccaacaacctrcagcaccagcgtggccttgtcctccatgttctcaatgcgcaccgtcacctggtaagtgcctgaatgcacgcggcgagcggcccggatgaacaggatggtg

SEQ ID NO: 47598 - DNA, 201 bp, Homo sapiens
ccccgcttccctggggacaggcaaaagctgtgtttgtctctctcctttccccaggaccgactgatgttcccacggatgctaatgaaactggtgagcctccrgaccctgagcagcgtccactcagagcaagtgtttgcactgcgtctgcaggacaaaaagctcccaccgctgctctctgagatctgggatgtgcacgaatga

SEQ ID NO: 47599 - DNA, 201 bp, Homo sapiens
ctagccgttgtagctctctttcaggaacgtagctgggcagctttggtttaacaggaaatggctgcgcaggctgccagcagccccttagtatattttcaatytaggacttagggcagtagccaaccccaaagaccttaggaccatcccagagaggggtctacctaagtgcttttctggaccacaaaggtgtcagtacttctt

SEQ ID NO: 47600 - DNA, 201 bp, Homo sapiens; identical to SEQ ID NO: 13549

SEQ ID NO: 47601 - DNA, 201 bp, Homo sapiens
ctggaaagggatgagaaggttcacaggctccccgaccttcttctgaatggtctggcgcaggtgcctgggcagctgaagccgtggccgttctgtgggtataragtgggtagctaagtgagggcccgccacagctctgaggggctccacagctccaacctcccttgagacaaggcccagagagctgcagctaagaaaaaagct

SEQ ID NO: 47602 - DNA, 201 bp, Homo sapiens
gtatattcgtttatataataataatgtatatacgtcctcttatttttatttatgtaagtgaaattcctgagcaataaactctaaggtcacgtcttttatcrtttctctggtgcaggtgattgcccccaccaatgcagaagtgctgcctatcctgccagaaccagaatcactagagctgaaaaagcatttaaagcaggtagg

SEQ ID NO: 47603 - DNA, 201 bp, Homo sapiens
actacaatgcactctccatgtctgtgatggcattcgtggcaatgatctacccactggaatatatgtttcctgtcatcccgctgctacccacctgcatggcrtcagcagagcaggtgagtctcaaggcgacttccggctttctcacctctgtcttcctgagggaggaggcttaatgctcaaagaagttgtaagtgagtgctg

SEQ ID NO: 47604 - DNA, 201 bp, Homo sapiens
caaagggttggttagcatggctatttctgctgaaaaggcatagataacttaaaagtttgtgaatcctaaatctacctctgggtggagctgatggtgatgtsggacttcagcagatagatatgcattttgagctggatgcttttggaatacaggaagataggaaccagaggctctacgttagtaaacatggttgaggcaaga

SEQ ID NO: 47605 - DNA, 201 bp, Homo sapiens
ttggcgggtgtgcttgtgcgtgtgcgtgcttgcgccttatttttggctagaatttggagaaacacgtttggttctcaagaaattttttttttaacttgatrtttcaaaattgacttgctggagagagaacaccatttcatctttctgcaatcgctctcctccccatcctcgtgtatctaccttcttccacctttccctgcc

SEQ ID NO: 47606 - DNA, 201 bp, Homo sapiens
acagacagatgagggagaagacaacctaattcttagcaggtactgtcagtgggagaagtgtctctaggttcgaggagagtgaattgttatgggccttggcygactctggagtagcagctgctagcactgtgcggtcaccaagcaggggaggggctgtggctctgctataaatagtgctgggagccagagtcgctatagaga

SEQ ID NO: 47607 - DNA, 201 bp, Homo sapiens
ggctgactctggagtagcagctgctagcactgtgcggtcaccaagcaggggaggggctgtggctctgctataaatagtgctgggagccagagtcgctatasagataaaactgaatcctattacctgcaggtcctctactgggagcaagggaaaggagaaagcagtattttgaggatttgagaggtattgcaaataggtctt

SEQ ID NO: 47608 - DNA, 201 bp, Homo sapiens
aaaaaacttctactcattacctaaaccaaatagggccttaagcatccagggagtgtgtatgtctgtatatatgggagtgcccgcagcagcaggtgagggaktagagggtgtgtgtgtgtatacgataatgggtttctctccgtgtgcattgaacaaggtcttaggccgcatgtagagcacagaggtagaatcctggaacac

SEQ ID NO: 47609 - DNA, 201 bp, Homo sapiens
gaggatcaccattgtgcctggattgggaggtggcaggcatggtggggcagggggcagtgggagagacaaagctggagctgtaggctcgatgaagtggaaaycaagttgtaatgttggaagctgttttcttgtaaaccatattttatgttttggagtgattcttactggatggctcatgacaggtggtgctacagtcccgag

SEQ ID NO: 47610 - DNA, 201 bp, Homo sapiens
aaaagtgcaatacagttcgaggcgtctttgtcctggaggaatttggtaattacactattttgctcttaggtctggactcacatggcagtaactcaaacctyggagctccagaggagggtctaggggcagggagaagaagaacctctgtagagaagtcaggaggagcaggagtgacaaggaagaaaagggacccctgagatg

SEQ ID NO: 47611 - DNA, 201 bp, Homo sapiens
acagaggcctagctgaggaggctagggccatgtcctcccagctggcagagtctggacagagcctctggtggcctctgccctgtcatagcctaagctgctgyagccactgtgagaggccacagaggggaaggggaccctgacgccgggcgctgccgcctgggggagcatggcacgattgctcttagtgttgaactttctgtt

SEQ ID NO: 47612 - DNA, 201 bp, Homo sapiens
aagacaccaatggtgagtgtgccgctcaaccctgatgggccacggtgcgcagggctccctgggggaccttcggacaggaggaggggagggccctctgagcrcacaggggtgagtggggacctcgttttgttgccaaaggttcaactcaggctgaaacaggtcttgagccctgagagacagacacacacacacggatcccct

SEQ ID NO: 47613 - DNA, 201 bp, Homo sapiens
taccatcttctaatgcttatgatgctgtataaaatagcccttcactctctgtttcttgtatgtgtgccactctctatggcttcagaacattttctcagtctttttttttttttttttttgagatgtggagtcttgctctgtcccctaggctggagtgcagtggcgcgatctcggctcactgcaagctctgccttctgagtt

SEQ ID NO: 47614 - DNA, 201 bp, Homo sapiens
tgctgtgttttcagtcttgatgattgctttagtatgactaatgagatggagaggttaataaatggaattatatttaattaaattaattaattaattaattwatttattttgagatggagtcccactctgtcacccaggctggagtgcagtggcacaatcttggctcactgcattctctgcctcccaagttcaagcgaatct

SEQ ID NO: 47615 - DNA, 201 bp, Homo sapiens
aatgtgacattaatggtgatactcccagtaagtgtgcttggggagattggccagccctgggcaggggttgggggcccaaggatggagtggtctgtacctgcctcccttggattttggcagatgtggaccctctgacacatgcagcactgggggatgccagcgaggtggagattgacgagctgcagaatcagaaggaagcag

SEQ ID NO: 47616 - DNA, 201 bp, Homo sapiens
gcggcccggatgaacaggatggtgtctgtggggctgttgcggatgctcacctcctcgcctgccaggggctgcccctctttggtccaggtcacctgaggccrgggcttgccctgaggggaggaaaagcttaaccctgaacctggatcactccaagggccggccgccaccccagcctctggtacctcagatcaggccagccct

SEQ ID NO: 47617 - DNA, 201 bp, Homo sapiens
acacaacacttgataaacatcagggtgaaagtacaggaagtgactcaccaagaagccttgaatggaaaagtgtagcagatggttgctaaaagaaatctgamaaagcctggggaactctgtagggtgcagagactttgacaatgtgtatgagagacattctctaggtatcattactttagctcatgttttgttgcattttag

SEQ ID NO: 47618 - DNA, 201 bp, Homo sapiens
agaaatgctttaaccggtgggcggaggttgtggtgagccgagattgtgctgttgcactccagcctgggcaacaaaggtgaaactccatctcaaaaaaaaawaaaaataaaaataaaaataaaatagccaggtgcggtggttcatgcctgtaatcacaggactttgggaggccgaggcaggtgggtcacttgaggtcaggag

SEQ ID NO: 47619 - DNA, 201 bp, Homo sapiens
ttacatcagtgttttttatttttcctcatggagatcttttacctccttcataaaagataaatttctcctaagaatttattcttagggcattaatttgtggytatcgtaaatgagattgccttcttgatttctttttctgctattttattgttggtatatagacacactactgatttttatgttgattttgtatcctgcaag

SEQ ID NO: 47620 - DNA, 201 bp, Homo sapiens
cttttatctagagataataaccaataacattaagttatatttcatttcagatgcatatgtatgtcatatatgtgtgtacatatatcttactgtgcagttayataatgtatattcgtttatataataataatgtatatacgtcctcttatttttatttatgtaagtgaaattcctgagcaataaactctaaggtcacgtctt

SEQ ID NO: 47621 - DNA, 201 bp, Homo sapiens
atatcatcccattctctactggcttgtaaagtttctgcagagaaatctgttagtttaatagagattcccttaaatgtgacttaacacttttctcttgctgttttttttttttttttttttgagacggagtctcactctgtcacccaggctggagtacagtggtgcaatctcggctcactgcaagctccgcctcctgggttc

SEQ ID NO: 47622 - DNA, 201 bp, Homo sapiens
tgaggcaccatgtagtagtgactctagactccaggatggtggggcttggctgtatcctagactctgtgaagccaagtgcaatggcagcgaataccccagcrtggcagagcacagctgtcatttgggccctgggggtcagggagcagcacagcaatgactccactccccaggaagagggtatcttagcagctcagactctag

SEQ ID NO: 47623 - DNA, 201 bp, Homo sapiens
ctgggtctgccgggcctaggcagggtgcacgtggggaccccagaccctgggctcaccatggtcttcttgtcggctttctgcactgtgtacccccagagctmcgtgttgccgacatcctggggtggcttccactccagagccacattaagaccccaggcgtcagtcacccggagatcctggggaggacttggcttgtctgcg

SEQ ID NO: 47624 - DNA, 201 bp, Homo sapiens
gactctattgcagttgggagaaccaagggactatttgggttcgttaagcagtggtgatacctagaaatgaatatatggcgtgctcagaaacctggtggtgktctagagatatcactatcaaaagccagaattaggacgaagtacaaactacagacagatgagggagaagacaacctaattcttagcaggtactgtcagtgg

SEQ ID NO: 47625 - DNA, 201 bp, Homo sapiens
ctgctgctctcgaccagtggtcttcacgctgccccattgagcctctgaggggccgatttagcttgggagccctgagcatttgaggctctgcttcctgtgtycttcagagcagctctgttttcaaatttccattctatataatttcacatagattccaattttaaaaaacatttaatgactataataattttgcaaacgact

SEQ ID NO: 47626 - DNA, 201 bp, Homo sapiens
aatttcatgagggccaggagatcccccttctcttgggaaggccttctaatgacctgcagtccacaccgtccactgaattcaacccactcatctatggcaaygatgtggattctgtggatgttgcaaccaggtaagaccaagccgactgtataatcacaagttcttaaattaatttctttgctctctaagggaccttggggc

SEQ ID NO: 47627 - DNA, 201 bp, Homo sapiens
ctgaagcagctcagtgaagtagcaccacctccccgtgctgggccagccagtggtcagaaagtttgggacacagcagactggcgacccccaagctccactaygtccatgtcacctgctgcaatctctctagcagcccagtgcgctagccagcctccctggcgccgctctggtctccacctggcctctgtgccagacaaaggg

SEQ ID NO: 47628 - DNA, 201 bp, Homo sapiens
agtggctgggattacaggcgcctgccaccacgcctggctaatttttacatttttagtagagacggggtttcaccatgttggccaggctggtctggaactcytgacctcagttgatccacccgccttgtcctcccaaagtgctgggattacagccgtgagccaccgcacccagcccagggtttctttatgtataaaatatat

SEQ ID NO: 47629 - DNA, 201 bp, Homo sapiens
ccaagtagctgggactacaggtgctgccaccttgcctggctaatttttgtatatatatattttttgagatggagtcttgctctgtcgcccaggctagagcrcagtggcgtgatctgggctcactgcaacctccgcctctcgggttcaagcgattctcttgccccagccacccgagtagctgggattacaggcacatgccat

SEQ ID NO: 47630 - DNA, 201 bp, Homo sapiens
caagcgattctcttgccccagccacccgagtagctgggattacaggcacatgccatcacgcccagctaattttttgtgtttttagtagagacaaggtttcmccatgttggccaggctggtttcaaactcatgccttcaagcaattcgcctgcctcggcctcccaaagtgctaggattacaggcgcgagccactgcacccgg

SEQ ID NO: 47631 - DNA, 201 bp, Homo sapiens; identical to SEQ ID NO: 13552

SEQ ID NO: 47632 - DNA, 201 bp, Homo sapiens
tctccaagctttatgacttcccatctctcccattctctaggagacatattaggctctgccatgcaaaacacacaaaatcttctccagatgccctatggctrtggagagcagaatatggtcctctttgctcctaacatctatgtactggattatctaaatgaaacacagcagcttactccagagatcaagtccaaggccatt

SEQ ID NO: 47633 - DNA, 201 bp, Homo sapiens
acccaaatctgtcttaattttttttctttccaatgtcacagatcttggaaatgcttgaagaccacaaggctgaaaagtgctttgctggagtcctgttctcwgagctccacagaagacacgtgtttttgtatctttaaagacttgatgaataaacactttttctggtcaatgtctttccctgtttcctgttcattcaataaa

SEQ ID NO: 47634 - DNA, 201 bp, Homo sapiens
cagtccagtgaaatcacaagaaccataaccaaactctcatttgtgaaagtggactcacactttcgacagggaattcccttctttgggcaggtggagtattytccagttcactcatcaacccatgtactgttacctaattagcacaatagttatggtttgtgctaaaaccatgcctggttaatgttatcatttaatataacc

SEQ ID NO: 47635 - DNA, 201 bp, Homo sapiens
gtctgagaagggaagaaaatcctgtcacatgctacagcatgaatgatccttgaggacgttatggtaagtgaaataagctagtcacaaaaagaccaatactrtatgattcacgtacatggggtttctaaagtagtcaaagtcatagaaacagaaaacaggatggtggttgccaagggctagggaaagagagaaatggggaat

SEQ ID NO: 47636 - DNA, 201 bp, Homo sapiens
aaggaattaactaaaacctctgtgcttcatttccttatctgtaaaatgattgcaatactaacacctgactcttggggtggttgtgaagattaagtgaaatmatacatgttgaatcacttagtaagccccctttaactgttagatacttttactataaaagccaattctaacataattagcatttagttttaaatatatata

SEQ ID NO: 47637 - DNA, 201 bp, Homo sapiens
ttaggattgattactactaaattagtgtatgttatgtatatatttatttagcatctatctctttcactagacagtaagctctgtgatggaagaaacttcgtttttttttcactgctgtgtcctcagtgcctggaaccatgttcaacatagaggaggcactaaaaaatgtgataaatgaatatgtttggtgcctattagtta

SEQ ID NO: 47638 - DNA, 201 bp, Homo sapiens
tcaaaaagtgtcttgaatgctttccacgtgccagcactgtgctagtcttgacaatgaaattattatttctacctgttccctgtttggggtgatcatatatrtgttgtcaccaaaatatacattaagatatgaacaaaatgttttgctcaaggattcactagtgctattgggagctggggatgaaggtagaggaagcctgaa

SEQ ID NO: 47639 - DNA, 201 bp, Homo sapiens
gagcattaaaaatagtcagcctaggccaggcacggtagctcacgcctgtaatcccagcactttgggaggctgaggtgggtggattgcgtgaggccaggagwtcgagacgagcctaggcaacgtggtgaaaccctgtctctacaaaatatacaaaaaattagctgggtggggtggcatgcacctgtagtcctagcaactcag

SEQ ID NO: 47640 - DNA, 201 bp, Homo sapiens
gccaagattgtgccactgtactccagcatgggcgccagagcaaaaccctgtctcaaaaaaataataataatagcaatcagcctaagatagcccagaagagstagacttcagctaattcatcagctcagctcttaaaccaatgctttctaccaatgtcttctcagacccctaaggttacaatattttatttattcataatac

SEQ ID NO: 47641 - DNA, 201 bp, Homo sapiens
aaggatgcctccttttatgctcttaagaaatataaatctcaatcccaggaggctctgcagtgtaaagtcacaaagcatgcctacatttgaagcagagaaasaaaatcaggggtccttctcccacttttcattgtggaacaaaagatttctagctactagttaaggtaggacagtaaacttacgtagttttgtgagaacatt

SEQ ID NO: 47642 - DNA, 201 bp, Homo sapiens
gaaacgttgggaaatatgtaagcaagtttttaagactactaaggagccaaaagaaaaatgcaagagcacctagacccatgcatgtcccaccacaattaatragcaccttgccgtgtatcaaagataaaaatggcatttcatgactagtaatttataagaataattagaaataattctactggctcaagtgattcttgagaa

SEQ ID NO: 47643 - DNA, 201 bp, Homo sapiens
tttgttttcctatacctggcttatttcacataacataatctcctccagatttaatcatgctgccataaatagcagaatgttcttgttttttaaaatggaayggaattctatgtgtatataccaaattttctttatctgttcatctgttgatgacacttatgattccataactagacagacatcagtaatttgttagggatt

SEQ ID NO: 47644 - DNA, 201 bp, Homo sapiens
acaaagtgatgttatgatttatgaataaaatgtgaaataattaaatcaagctaacctgaaatacttatgttttgtggtgggaacatttgaaattctctaascaagtttgaaacataaaatacactattattaactatattcaccatgctgtgcaatagatcccaaaaagaaaaaaatgtattccttctgtctgagactttg

SEQ ID NO: 47645 - DNA, 201 bp, Homo sapiens
agagtccataggattgcttatgggtaatgatttggaatagatttggtttcccactgtactgattaggtttccttgggcactatgctacccagaactaaggsaaagaatactctctgctcatggagacccaaatctgtcttaattttttttctttccaatgtcacagatcttggaaatgcttgaagaccacaaggctgaaaa

SEQ ID NO: 47646 - DNA, 201 bp, Homo sapiens
aattctatgacccatcttaatgattacatctgaacatatttacttatagttacataagtgtttatttctcaacctgtaaaattgcatagcaaaggattgawcttcactaggatgctataagcacttaagacatgttaatccatttttagtaaatggcactttacatgtatatttgttgctgaaggcctagtaagttcttaa

SEQ ID NO: 47647 - DNA, 201 bp, Homo sapiens
gacctacctcaagtaaaatgttcactgccatggcatgtgagggaaaagggaaataattcttatgcatggccttcaacggccaaatttcatgctcatcagtrcatcttctcttggtgtagaactgatgatgataattatgatgatggaaaaaagtgctgttgatagcaatgcctctcttccttcactttcctctaactgaac

SEQ ID NO: 47648 - DNA, 201 bp, Homo sapiens
ttgggcaggtgaggacaggacagatgaggacagcagctgttctctctgagaagtcctaactcagaaaacaatgggacagatcagagaaagggttagggacrtggacaggaattctgggaaagggcaaaaaactgattttgtctttgatgttctatagacatccttgaaatacaatattctcccagaaaaggaagagttccc

SEQ ID NO: 47649 - DNA, 201 bp, Homo sapiens
ttaatgatgtatgtatccccagcataagacaatactaatatcaaaatactattaaagtcaatctctatcaaagccttatcctttttccagctcagaaatayaatcacatgtgtttgtatgaatgctgaccatgtgcagagcactgcgctaggacccatgactacaagaaaaagattgtcagcaggttcctgcttttcaatt

SEQ ID NO: 47650 - DNA, 201 bp, Homo sapiens
gaaaaatgactggataagtaggataagatcaattaaaattatatttatctaggaattaattgctttgagctctcttgtgggctttcattggtaaggaattwtatatatatatatatataactactcacttctgcagttaaaaaaataaacaaaatacaatatattgaatcaaataaaagaatttttaaaaggacaaaatgt

SEQ ID NO: 47651 - DNA, 201 bp, Homo sapiens
aggaaaaatgactggataagtaggataagatcaattaaaattatatttatctaggaattaattgctttgagctctcttgtgggctttcattggtaaggaattttatatatatatatatataactactcacttctgcagttaaaaaaataaacaaaatacaatatattgaatcaaataaaagaatttttaaaaggacaaaat

SEQ ID NO: 47652 - DNA, 201 bp, Homo sapiens
ctgaggcaggagaatcacttgaacccaggaggcagaggttgagtgagccgagatcgtgccactgcactccagcctgggcaatagagcaagacttggtgtcaaaaaaaaaaaaaaaaaaagaattacatcagttgaaataattgctgtcccaagctacacataatttctgagggaacatatgtattatctctgaggaacaaa

SEQ ID NO: 47653 - DNA, 201 bp, Homo sapiens
caattgtaataacctcttactgaagctttttctactaccataatttaacaaagagaaatttatatttttattttcctgaaatagaaacttataaaaaaatrtttcttacttgtttgtccttctaatgggattttaactgaaaatattagaatacttctaaaggaagcatcaagtacatttcaacagtaggatctcaagagg

SEQ ID NO: 47654 - DNA, 201 bp, Homo sapiens; identical to SEQ ID NO: 13686

SEQ ID NO: 47655 - DNA, 201 bp, Homo sapiens
taatgggattttaactgaaaatattagaatacttctaaaggaagcatcaagtacatttcaacagtaggatctcaagaggatatgtgggaaaataatatacrtgttttatacttttataatataattttataattctcaaagaatttttcaaattataacaaccctgatgggtagataaggcagacagtcctatttattaat

SEQ ID NO: 47656 - DNA, 201 bp, Homo sapiens
gacagtaaacttacgtagttttgtgagaacattaatctttatgacgtataatctaaaaataatataatttttctaattcattaggtcaattacaaggatcrtagtccctgttacggctaccagtgggtgtcagaagaacacgaagaggcacatcacactgcttatcttgtgttctccccaagcaagagctttgtccacctt

SEQ ID NO: 47657 - DNA, 201 bp, Homo sapiens
agtgtaagggctaatcatcaaatagttttactaaatttcattttaattaccaacataatcaaatgtgcctacctaattttacaaaaatatattcttctttaaaaaaaaaaacagaacatcacattaaaggttaatgtcacccccctgaacatttttcagtactttgccatccatttatctttagaaataatgtgtgtagat

SEQ ID NO: 47658 - DNA, 201 bp, Homo sapiens
ccattagctcacattgttacctatttttgtgtgcatagcaagcacacctaaaatctatcctcttagccaagtttcagtatccaatacagtattatcaactrcagtcctcatgctgtactttagatttctaaatttattcatcctacgtaacttcaactttgtaccctttgacctgcttcttcccatccctgcaaccccaac

SEQ ID NO: 47659 - DNA, 201 bp, Homo sapiens
tctccatactgttttccataatggctgtggcaatgtacatttgcaccaaggggagtgaacaaattccttccagagagacactggaaacagagttttatccstgaaacaagccagtggggcaggtggagagaaagagccggaatggccatatactccctttcaggctcctggagtcttgtttacttctccctttcactccca

SEQ ID NO: 47660 - DNA, 201 bp, Homo sapiens
gtagccatcaagtaaattaaaagttgcattcctaggaatactgcaaactcttgtatgcaaaatatgcttactagatattcatgattgtaaaagttacaggttttgagatctccaaataccaaattgcaccataaagcaagtttctagcccttataacccttcaaagttagtatttgtgtggtatgaagaattctgacaggg

SEQ ID NO: 47661 - DNA, 201 bp, Homo sapiens
aataaaacaaaagtttacagagcattgaacatttctaaatcttgagtttggaggcatggaggaaggggaagatgctattcatttctactggcctttttttwcaggaaatgtgaatttcactgtgagcgcagaggcactagagtctcaagagctgtgtgggactgaggtgccttcagttcctgaacacggaaggaaagacac

SEQ ID NO: 47662 - DNA, 201 bp, Homo sapiens
tcaaaaaagaatcttaaagatgtatcttttgaatgtgagaataacagataaaaataatattatatctattgataagaatgaggaatcgttggaaaaatgcrtttgaaaaacttctgtgctgtgatccgtgtatttgcctgggaatgctaatatgcctgtttacatagcttagttcccttcttgttctgccttcacagcacc

SEQ ID NO: 47663 - DNA, 201 bp, Homo sapiens
attcatctgttgccaagatgtaacacataaaatgtaccctaaaaacataacttccttgtcatttagccttatttctacatttaagtgaactgattacctaycattcaatccttttatcatgacttctccgtttctgagttactcattttgatgtatctcttaagtgtaagggctaatcatcaaatagttttactaaatttc

SEQ ID NO: 47664 - DNA, 201 bp, Homo sapiens
ttttctcttttttcagtggtggaattgactggaaggcagtccagtgaaatcacaagaaccataaccaaactctcatttgtgaaagtggactcacactttcracagggaattcccttctttgggcaggtggagtattttccagttcactcatcaacccatgtactgttacctaattagcacaatagttatggtttgtgctaa

SEQ ID NO: 47665 - DNA, 201 bp, Homo sapiens
cagaatgcccagggcggtttctcctccacccaggttggtgatttgccaaaaccttttatttcaccttcaggtagcaaaagatttgaatgaaaaagaaacaracacatccaagaagaaaaaaatacagatgacagtaacttgaaatgaggaaaagttttcagtatccaaggataatggaaataaaagcaaatcaaagtcaaa

SEQ ID NO: 47666 - DNA, 201 bp, Homo sapiens
atccttgtcttgttccagatcttaaaggaaagtctttcaattttccactgttaaatatgtaagctataggtttatcatacatgccctttattgtgttgagraacattgcttgtatatctaatttggtgagagttttatcataaaagagcattgaattctgtcaaatactttttctccatctaacaagatgatggtatggtt

SEQ ID NO: 47667 - DNA, 201 bp, Homo sapiens
ctgtctttattcatccaacctcctaaatctagctatataaccatgtatctgaacaattcattgatatgtacacagcagaaagttttatcttcagagaattyggatgtttgcttatataccctaaaacggaaaaaatgtgacaaaatggcattccatcctatttccattgtattaatcttttatcatatgaatgaaaaaaac

SEQ ID NO: 47668 - DNA, 201 bp, Homo sapiens
ttctgtaaatgtaatgtatcacatttattgatatgcatatgttgaacaatttttgcatctcagggataaatcccacttgactaggtagatgatccttttamtgtattgttggatttagtctgctagtttatttcgtgtggttggttggttggtttagttttttaagtgatgagcttttgctgtgttccccaggctggactt

SEQ ID NO: 47669 - DNA, 201 bp, Homo sapiens
tgctagtttatttcgtgtggttggttggttggtttagttttttaagtgatgagcttttgctgtgttccccaggctggacttgaactcctgagttcaagcartcctaccacctcagccacccacaggtgtatgccaccatgcttagctgctatgctagtattttattgaggatttttgcatctatattcatcaagaatattg

SEQ ID NO: 47670 - DNA, 201 bp, Homo sapiens
cccacagacgcctcagtctctggaaaaccgtgagttccacacagagagcgtgaagcatgaacctagagtccttcatttattgcagatttttctttatatcmttcctttttctttcctatgatactgtcatcttcttatctctaagattccttccagattttacaaatctagtttactcattacttgcttacttttaatcat

SEQ ID NO: 47671 - DNA, 201 bp, Homo sapiens
aatttctctttcatttctgattttatatatttaaggcctccctcttttttcttagctaacctagctaaaagtttttgtctgtctttttaaaaaaacaattyagtttcattgatcttttgtattctttttctagtctctatttgatttatttctgctctaatctttattattttcctttcttctgccaattttgagcttact

SEQ ID NO: 47672 - DNA, 201 bp, Homo sapiens
gaacaagcgcctcactgcatctgtgcaaacgggcggcaaactgtgtcctgggcagtaaccccaaagtcattaggtgagcaaaaaactgctagagataattstctactcaaagattgtatatggcagtgggaaccttatattgagtgctacttccttcaggaaaagaccactagatgctgcgatttttttcctttgcctttt

SEQ ID NO: 47673 - DNA, 201 bp, Homo sapiens
atttctctttcatttctgattttatatatttaaggcctccctcttttttcttagctaacctagctaaaagtttttgtctgtctttttaaaaaaacaattcrgtttcattgatcttttgtattctttttctagtctctatttgatttatttctgctctaatctttattattttcctttcttctgccaattttgagcttactt

SEQ ID NO: 47674 - DNA, 201 bp, Homo sapiens
ctcaatcccaggaggctctgcagtgtaaagtcacaaagcatgcctacatttgaagcagagaaacaaaatcaggggtccttctcccacttttcattgtggawcaaaagatttctagctactagttaaggtaggacagtaaacttacgtagttttgtgagaacattaatctttatgacgtataatctaaaaataatataattt

SEQ ID NO: 47675 - DNA, 201 bp, Homo sapiens
atttggagtctttccatttcccatgggtgacattgggcttggagtagaattaattacacctaagtccaatgaggacatcagtgatctgtgaataggacttmacatagcttcgttattttctgtagcaatatttaataccaacccccaaaattaaaacattcttgttttaatggagttttccataattaattaagcacacag

SEQ ID NO: 47676 - DNA, 201 bp, Homo sapiens
tcagtttcattgatcttttgtattctttttctagtctctatttgatttatttctgctctaatctttattattttcctttcttctgccaattttgagcttastttgttcttcttttcctacttctctgaggaatatcattagtatctttattggaaatttttcttcttttttggtgtttattgttataagctttcctcttag

SEQ ID NO: 47677 - DNA, 201 bp, Homo sapiens
tagggaacaaaaagcttcaggattgacacaatgccaaccctccacgaagtcaagcagagtggttatacattgtacatgaggaacactctgcaaatgcgagygaatgcatgggtaaacctggaaatttgcttttctgaccttttgttccaatttcacaggtggatttgagcttcagcccatcacaaagtctcccagcctcac

SEQ ID NO: 47678 - DNA, 201 bp, Homo sapiens
tcttcctttgtggtctgatgttctgtagtggtatgatttgaatcttttaaaatttttgttctgtgcttctattaaagatttttgccttgctgttactatgrggtttacagtcaatttcaagctgataacaacttaactttgcattctttcactcccccacacacattttatgtcgttgatgtcagaatttacatattttgt

SEQ ID NO: 47679 - DNA, 201 bp, Homo sapiens
ctttgctggatgaagaattcttgattccatgttgtttttatttttgttttccttcagtactttgaatatattattccactctccctcagcctgccgggttmctgctaaaaatccatggatagttgtattggaattcctttgtatgtgatatgtttctttatcaccttctgcttttcagaatttttttttgtctttgatttt

SEQ ID NO: 47680 - DNA, 201 bp, Homo sapiens
acagttggaagaaaaggacttatattcccatctcaatccttgattatactctccattattggtatttctattgagtgtttttaagtcatggcagtagaatmattcctagggattctctccctagaaaggatgtatttaactgcttactttctgttcttcacttacactcctctccagctcagcaggtgtggctgaggtagg

SEQ ID NO: 47681 - DNA, 201 bp, Homo sapiens
tatttagtctagcctataattctggaaagatcagttggtgacaaccttgagcaggcagagttttcatgggttccctagttggctgggccactgcctttgcycttatgtttggtagggccactggttgggccttgctctctggcaagatcactgttttgtctctgctatctggtggagctgctggctgggtactacaatggc

SEQ ID NO: 47682 - DNA, 201 bp, Homo sapiens
agagggaagtacagacagggaatatactgtagctaaaggggagatataaatagctagaaaatggggaggttcggtgtctgctctgattcctttgggaatgbtctcatgacagatacacatatgggaagcctgtccctggacatgtgactgtgagcatttgcagaaagtatagtgacgcttccgactgccacggtgaagatt

SEQ ID NO: 47683 - DNA, 201 bp, Homo sapiens
agaaaaacacatttattggagagggccgctgactctgtcaaacctcagagagtccataggattgcttatgggtaatgatttggaatagatttggtttcccwctgtactgattaggtttccttgggcactatgctacccagaactaagggaaagaatactctctgctcatggagacccaaatctgtcttaattttttttctt

SEQ ID NO: 47684 - DNA, 201 bp, Homo sapiens
agcaagtaaaaaccaaggtcttccagctgaagaggaaggagtatgaaatgaaacttcacactgaggcccagatccaagaagaaggaacaggtttgtgtacwacatgggtataagagaaaacacaacaggcattgattttcttagccaaataatgaattgtaagttggggggaggtgatagaattttagagacatcattctt

SEQ ID NO: 47685 - DNA, 201 bp, Homo sapiens
atctagctatataaccatgtatctgaacaattcattgatatgtacacagcagaaagttttatcttcagagaattcggatgtttgcttatataccctaaaayggaaaaaatgtgacaaaatggcattccatcctatttccattgtattaatcttttatcatatgaatgaaaaaaactaagtaattttgttaaaggttatcat

SEQ ID NO: 47686 - DNA, 201 bp, Homo sapiens
aaaaagggaaagccaaataaaaatgtcattaaatccagaagataattataatactcatcttttatttcttttggagaaactgaagcatgactctgctcatkgctgcaaagaaccttgggttctctccaggacactgacctcagcaactgagcaaagtttaatatgggagagagccagactgaactttgcttgagtggtggc

SEQ ID NO: 47687 - DNA, 201 bp, Homo sapiens
tgttcttctctcctttatttatatttcaccagggattacaggtagaaatggcttattatgatcttgggatatgaatattcctaaaatcccataagcaagaratcttgacaaaatgtgtttattatgttgacaagttttttggatacccagtaatataaggaagtagcccttgtgattagtcaattattagttaattatcaa

SEQ ID NO: 47688 - DNA, 201 bp, Homo sapiens
gttttaacattaattttatgagaaagggaagataactgctacatttttcatttgtatataattcaccaatactaaaattgtagtaaatgtatgttcatcartagcagttattttattttcagtgagtcaagcattttattttgcttagccatttgtcctttaactatgcttatggcttttttttaagaaacattttaatat

SEQ ID NO: 47689 - DNA, 201 bp, Homo sapiens
ttgcttagccatttgtcctttaactatgcttatggcttttttttaagaaacattttaatatgaattttatgaggaagggattcagtatgaaaataaatacyatacttctctcattttcatttcatataatttaccaagattaaaatggaagtaaatgtatgttcatgagtagtaattattttattttcaatgcatcaaata

SEQ ID NO: 47690 - DNA, 201 bp, Homo sapiens
tttgttgttggtgttttctccatacaactgttgagtaaggaagttggtggtgggaactaaatagatcatcttgtgataaccgtcttgtgtcagccatcagwtgacagcaactgaatcacaacatcaccaggctcttacaatttgttgtcttatttggcatgcgattctacataaattactgaaaagatcattgaagaagaa

SEQ ID NO: 47691 - DNA, 201 bp, Homo sapiens
ttgttgttggtgttttctccatacaactgttgagtaaggaagttggtggtgggaactaaatagatcatcttgtgataaccgtcttgtgtcagccatcagawgacagcaactgaatcacaacatcaccaggctcttacaatttgttgtcttatttggcatgcgattctacataaattactgaaaagatcattgaagaagaaa

SEQ ID NO: 47692 - DNA, 201 bp, Homo sapiens
agaccgatggtttgttatactagataaatccaccaagattagcaaggtaatcagaagaaaacctgatatccaaatacatgttatgttaggcttgtttccaraatggatcctattaataatgtaccaaggttttctttctgaaatggctattctttctaaagtagctaccataaccatgagttttaaaatgatattgccagt

SEQ ID NO: 47693 - DNA, 201 bp, Homo sapiens
aaccagaaataccatttgacctagtaatcccattactgggtatatacccaaaggaatataaatcattctactataatgacacatgcacatgtatgtttatygcggcactatttacaataacaaagtcatggaactaacccaaatgctcatcaatgacagactggataaagaaaatgtggtacatatacatcatggaatact

SEQ ID NO: 47694 - DNA, 201 bp, Homo sapiens
gggacaggaacaacacacaccagggcctgttgggaggtgtggggtgacgggagggaactaagcggatgggtcaataggtgcaagaaaccaccatggcacaygtatacttatgtaacaaacctgcacgttctgcacatgtatctcggaactaaaataaaattaaatatactaagactccctgtggcaaagagagagttagca

SEQ ID NO: 47695 - DNA, 201 bp, Homo sapiens
ctgttgggaggtgtggggtgacgggagggaactaagcggatgggtcaataggtgcaagaaaccaccatggcacacgtatacttatgtaacaaacctgcacrttctgcacatgtatctcggaactaaaataaaattaaatatactaagactccctgtggcaaagagagagttagcaaggaaatactacatctagcagattaa

SEQ ID NO: 47696 - DNA, 201 bp, Homo sapiens
tcaataggtgcaagaaaccaccatggcacacgtatacttatgtaacaaacctgcacgttctgcacatgtatctcggaactaaaataaaattaaatatactwagactccctgtggcaaagagagagttagcaaggaaatactacatctagcagattaatcaggcagactaaagattaatcaaggagataagctctctaagta

SEQ ID NO: 47697 - DNA, 201 bp, Homo sapiens
tctccattattggtatttctattgagtgtttttaagtcatggcagtagaatcattcctagggattctctccctagaaaggatgtatttaactgcttacttwctgttcttcacttacactcctctccagctcagcaggtgtggctgaggtaggagtaacagtccctgacaccatcaccgagtggaaggcaggggccttctgc

SEQ ID NO: 47698 - DNA, 201 bp, Homo sapiens
agatgctttacttcaaacccattctccctctgttctccttccctctctactccctttcttatgtgtggtttcaggtcagtgtgcagctggaagcctctccygccttcctagctgtcccagtggagaaggaacaagcgcctcactgcatctgtgcaaacgggcggcaaactgtgtcctgggcagtaaccccaaagtcattag

SEQ ID NO: 47699 - DNA, 201 bp, Homo sapiens
ctttagaaataatgtgtgtagatgtatatgtttgtggatgtgtgatttacatataataaactgtataagtttcattctataaatcactgtttgtttttcamtcagcatcctgtcttggagatttacctatgttaaattgtagatctaggtctttccttggaattgcttttaagcctataatataaatacatcacaattctg

SEQ ID NO: 47700 - DNA, 201 bp, Homo sapiens
ccagatgccctatggctgtggagagcagaatatggtcctctttgctcctaacatctatgtactggattatctaaatgaaacacagcagcttactccagagrtcaagtccaaggccattggctatctcaacactggtgagtgattacttgagtaagggaaaacttgaatgttatttcaactggatttcccagtaggtttcag

SEQ ID NO: 47701 - DNA, 201 bp, Homo sapiens
tccttccctctctactccctttcttatgtgtggtttcaggtcagtgtgcagctggaagcctctcccgccttcctagctgtcccagtggagaaggaacaagygcctcactgcatctgtgcaaacgggcggcaaactgtgtcctgggcagtaaccccaaagtcattaggtgagcaaaaaactgctagagataattgtctactc

SEQ ID NO: 47702 - DNA, 201 bp, Homo sapiens
taaatatactaagactccctgtggcaaagagagagttagcaaggaaatactacatctagcagattaatcaggcagactaaagattaatcaaggagataagmtctctaagtacacaagaattttgttagctaactcacatcatatgaagcctgttgctgtgaagtggttataaaaccattttgacaacataaacatcatgat

SEQ ID NO: 47703 - DNA, 201 bp, Homo sapiens
caggttggtgatttgccaaaaccttttatttcaccttcaggtagcaaaagatttgaatgaaaaagaaacaaacacatccaagaagaaaaaaatacagatgwcagtaacttgaaatgaggaaaagttttcagtatccaaggataatggaaataaaagcaaatcaaagtcaaagagggccaaaaggaaatgctcagaatcccg

SEQ ID NO: 47704 - DNA, 201 bp, Homo sapiens
actgtgtcctgggcagtaaccccaaagtcattaggtgagcaaaaaactgctagagataattgtctactcaaagattgtatatggcagtgggaaccttataktgagtgctacttccttcaggaaaagaccactagatgctgcgatttttttcctttgccttttattctaagatgcctacaaggatatcctcaacatctccac

SEQ ID NO: 47705 - DNA, 201 bp, Homo sapiens
tgataatgtgaaaaattctaagggaaagcctcagaggaaaataaaacctggatggcaccaaaaaagaggggatagaacaaaagttgattgtgatactttgycctatagggatggatatgggtaaggatgaattccatgacacagcagaatagaaagaactaatcaatagcattctcagaagttgaattattcagatctctc

SEQ ID NO: 47706 - DNA, 201 bp, Homo sapiens
ctgtgatccctgtctcctctcttcttttctatatatcatatatattttgtccatattgcatcttataaaatctaggatttcttaatcaaatcagaaatcaraagacaagaggccgtgcagatgcttctcaattacgatggggttatatcctgacaaactcattgtaaagtctaaaaaatcttaagtgggaccattgtaagt

SEQ ID NO: 47707 - DNA, 201 bp, Homo sapiens
ctcctctcttcttttctatatatcatatatattttgtccatattgcatcttataaaatctaggatttcttaatcaaatcagaaatcagaagacaagaggcygtgcagatgcttctcaattacgatggggttatatcctgacaaactcattgtaaagtctaaaaaatcttaagtgggaccattgtaagtcagggaccatctc

SEQ ID NO: 47708 - DNA, 201 bp, Homo sapiens
ggatttccttatatttttgctgcatatgtatccctaactaatatttagaatcttcacatgtgtttcatcttgagagaaacaagatttttatttctctcttrttcaagaaacaagagaaacatttttgaatatttcagcagcttagttttttgtttgtctgctttttattttctaagttcaacactatgttgatgaagaccc

SEQ ID NO: 47709 - DNA, 201 bp, Homo sapiens
tacctcacagagctgttgtaataaatgaattggtacacgtaaaacacttagtagagtacatgtcacatagcaaatcctataaaagtactagttattacaaytaacatatcagttctcaatatatgcccaacccttacctggtacattatataaccttaaacataagaaaataatcatggaagtaactccttgaatgaattc

SEQ ID NO: 47710 - DNA, 201 bp, Homo sapiens
attgagaaatattttataatagatatacaaaagggcataagctataactagaaaacactgtacaactctctcatagattaagaaatagaaaattaccgacrtgggaaaaataaatcccttgtgtatcactaccacctccagaggcaatcattatcctgaatttgtcgttacaattccatggatttccttatatttttgctg

SEQ ID NO: 47711 - DNA, 201 bp, Homo sapiens
agtctggttcttctcctcttggtcctcctgcccacagacgcctcagtctctggaaaaccgtgagttccacacagagagcgtgaagcatgaacctagagtcyttcatttattgcagatttttctttatatcattcctttttctttcctatgatactgtcatcttcttatctctaagattccttccagattttacaaatctag

SEQ ID NO: 47712 - DNA, 201 bp, Homo sapiens
tccagaggcaatcattatcctgaatttgtcgttacaattccatggatttccttatatttttgctgcatatgtatccctaactaatatttagaatcttcacrtgtgtttcatcttgagagaaacaagatttttatttctctcttattcaagaaacaagagaaacatttttgaatatttcagcagcttagttttttgtttgtc

SEQ ID NO: 47713 - DNA, 201 bp, Homo sapiens
gctcattaattttcactgctgcataatatattacagtctataaattagtcataatttacacatcgagtttctcctcatggattttttttatgttttgctaytaaaaaaaatgctgcaatgaatactcatgtgcctgttttcttgtgcatctgtgtttctccaaattatgctttgagaagcataatgactgattagtgggct

SEQ ID NO: 47714 - DNA, 201 bp, Homo sapiens
aattttcactgctgcataatatattacagtctataaattagtcataatttacacatcgagtttctcctcatggattttttttatgttttgctattaaaaamaatgctgcaatgaatactcatgtgcctgttttcttgtgcatctgtgtttctccaaattatgctttgagaagcataatgactgattagtgggctaagcaca

SEQ ID NO: 47715 - DNA, 201 bp, Homo sapiens
cataaaatcttcaacatgtaaaactagaagttactattgttatcatttgttttacacatgtgaacattagggccaaaagggttaaacaaattccccagagwcattcagcaaggtagtggcagagtcacactaagaagcagaatcacttgattccttatacaaaactctcaaacttctcctagcagtgcctcttaccaatta

SEQ ID NO: 47716 - DNA, 201 bp, Homo sapiens
aaaagaccatacagtacccaaagtccttaaaatcccagagctccatgcaaccagtaataggagttgtcaaactagtttcaacatttcaaaaagcctaacaraagtgatacatatacctgcactgaggctatacaggctaaatgaaatatcagatttccgtttttataagaattatggctgggcctggtggctcacgcctgt

SEQ ID NO: 47717 - DNA, 201 bp, Homo sapiens
atagctcagtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaata

SEQ ID NO: 47718 - DNA, 201 bp, Homo sapiens
tagctcagtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataa

SEQ ID NO: 47719 - DNA, 201 bp, Homo sapiens
agtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataattcaca

SEQ ID NO: 47720 - DNA, 201 bp, Homo sapiens
atgacagtaacttgaaatgaggaaaagttttcagtatccaaggataatggaaataaaagcaaatcaaagtcaaagagggccaaaaggaaatgctcagaatyccggcaccccatcgctgtgttattatccatctcctatttcccataacaacactgccttcctcaagcagcagtggagcaccagcagaatgaaggagatgtc

SEQ ID NO: 47721 - DNA, 201 bp, Homo sapiens
tatttatatattactgttgtattaaaggcggacaacttttcaggaggagtttaggtataaggcatagtcctagcttctgggtcatagagctgtttagaaasatataatgcagaaataattttcatatgtctgatttgcttatttctctaggtggtgaggtttctgaagaattatccctgaaactgccaccaaatgtggtag

SEQ ID NO: 47722 - DNA, 201 bp, Homo sapiens
atagggatggatatgggtaaggatgaattccatgacacagcagaatagaaagaactaatcaatagcattctcagaagttgaattattcagatctctctctygtattcacagggaggagtagaagatgaagtgaccctctccgcctatatcaccatcgcccttctggagattcctctcacagtcactgtaggtaccacccca

SEQ ID NO: 47723 - DNA, 201 bp, Homo sapiens
taaaaagggaaagccaaataaaaatgtcattaaatccagaagataattataatactcatcttttatttcttttggagaaactgaagcatgactctgctcatggctgcaaagaaccttgggttctctccaggacactgacctcagcaactgagcaaagtttaatatgggagagagccagactgaactttgcttgagtggtgg

SEQ ID NO: 47724 - DNA, 201 bp, Homo sapiens
gagtcagcctggaagacagcacaagaaggggaccatggcagccatgtatataccaaagcactgctggcctatgcttttgccctggcaggtaaccaggacargaggaaggaagtactcaagtcacttaatgaggaagctgtgaagaaaggtgagagcacacctgagatccttctcctggcccatcctctgtatcaagaactg

SEQ ID NO: 47725 - DNA, 201 bp, Homo sapiens
tttcaggtacttgatcttcatttatatcatctttaatgtgaggcaacctgaaatctaaccaattcctcaagatgctttacttcaaacccattctccctctsttctccttccctctctactccctttcttatgtgtggtttcaggtcagtgtgcagctggaagcctctcccgccttcctagctgtcccagtggagaaggaac

SEQ ID NO: 47726 - DNA, 201 bp, Homo sapiens
ggaggccaaggcgggcagattaccttaggtcgggagttcaagaccagcctgaccaacatggagaaaccccgtctgtactaaaaatacaaaattagtcggamgtggtggtgcatgcctgtaatcccagctactcgggaggctgaggcaggagaatcacttgaacccaggaggcggaggttgcggtgagccgaaatcatgcca

SEQ ID NO: 47727 - DNA, 201 bp, Homo sapiens
atactattaaagtcaatctctatcaaagccttatcctttttccagctcagaaatataatcacatgtgtttgtatgaatgctgaccatgtgcagagcactgygctaggacccatgactacaagaaaaagattgtcagcaggttcctgcttttcaatttcttcttagcttagaattttgctaagaagataaaagatatgaaca

SEQ ID NO: 47728 - DNA, 201 bp, Homo sapiens
ccggacagaagtcagcagcaaccatgtcttgatttaccttgataaggtaagagaacttccagtctatttgcaaaaaaacgtagataataatcctctaaggraacatctgggaaggtaaatgcattttagaaacatcacttccatgctagaaatttgagaattctaatgttaactctaaaagaatgttcttctctcctttat

SEQ ID NO: 47729 - DNA, 201 bp, Homo sapiens
tctctcctttatttatatttcaccagggattacaggtagaaatggcttattatgatcttgggatatgaatattcctaaaatcccataagcaagaaatcttsacaaaatgtgtttattatgttgacaagttttttggatacccagtaatataaggaagtagcccttgtgattagtcaattattagttaattatcaacatact

SEQ ID NO: 47730 - DNA, 201 bp, Homo sapiens; identical to SEQ ID NO: 13696

SEQ ID NO: 47731 - DNA, 201 bp, Homo sapiens; identical to SEQ ID NO: 13697

SEQ ID NO: 47732 - DNA, 201 bp, Homo sapiens
gtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataattcacaa

SEQ ID NO: 47733 - DNA, 201 bp, Homo sapiens
aaggagcaatgcatgactctccagccatgggagacaaatatttacaggcaaactaaaagtcagcttaataatcacatagaaaccctattagccagaaaggaaaaaaaaaaaaagaaaatgtgacttcttaaaattaagatggaaaaaatattaataaagcaaactagaccaaggctcaacatgagccacccgtggtggact

SEQ ID NO: 47734 - DNA, 201 bp, Homo sapiens
gccaggcatggtggccagcgcctgtagtcccagctacttgggaagctgaggcaggagaatggcatgaacccaggaggtggaggttgcagtgagccaagatygcaccactgcactccagcctgggcgacagagcgagactccatctcaaaaataaaataaaataaaataaaataaaataaacaagtgaaactcgatatagag

SEQ ID NO: 47735 - DNA, 201 bp, Homo sapiens
aaaatgactggataagtaggataagatcaattaaaattatatttatctaggaattaattgctttgagctctcttgtgggctttcattggtaaggaattttatatatatatatatataactactcacttctgcagttaaaaaaataaacaaaatacaatatattgaatcaaataaaagaatttttaaaaggacaaaatgtga

SEQ ID NO: 47736 - DNA, 201 bp, Homo sapiens
gccttcgctgtgagtgtggctgtttgacttaatatacttggttcttttagtcagggtcatagggatctagtattctgtcagatgaggctttgggaggttgstaagaactgcaggaaggaatccaaatgtagcaaactaagtatagaaattaaggagcaatgcatgactctccagccatgggagacaaatatttacaggcaa

SEQ ID NO: 47737 - DNA, 201 bp, Homo sapiens
ggctaaatgaaatatcagatttccgtttttataagaattatggctgggcctggtggctcacgcctgtaatcccaacactgggaggccaaggcaggcagatmacttgagatcaggagtttgagaccagtctggccaatataatgaaaccccgtatctactaaaaatacaaaaattagtcagacgtggtggcgggcgcctgtc

SEQ ID NO: 47738 - DNA, 201 bp, Homo sapiens
gaaatatcagatttccgtttttataagaattatggctgggcctggtggctcacgcctgtaatcccaacactgggaggccaaggcaggcagataacttgagrtcaggagtttgagaccagtctggccaatataatgaaaccccgtatctactaaaaatacaaaaattagtcagacgtggtggcgggcgcctgtcatcccagc

SEQ ID NO: 47739 - DNA, 201 bp, Homo sapiens
gtagtcccagctactcgggaggctgaggcaggagaatggcgtgaacccgggaagcggagcttgcagtgagccgagattgcgccactgcagtccgcggtccrgcctgggcgacagagcgagactccgtctcaaaaaaaaaaaaaaaaaaaaaaaaaaaagtcacaaataagtttgcctttttgtctttcgtatttgtacagg

SEQ ID NO: 47740 - DNA, 201 bp, Homo sapiens
ggtattcattctttttaaatgataagtagaacctagcagtgaagccaacagttattaggcttttctttaatggaaaactttttattactgattcaatctcyttactcattatttgtcagttcagattttctatttcttcatgattcagtcttggtagtatgtatatgtctaggaatgcattcatttcttctagatcatcca

SEQ ID NO: 47741 - DNA, 201 bp, Homo sapiens
tcaaaatccaacaacctctcctcgcaaatctctccattcttaggtcccctttaataggcttttctcaaaactacacattttgtgcttcccctattcaccttttttttttttttttttttaagacagagtcttgctctgtcacctaggctggaatgcagtggtgcaatctcggctcactgcaacctccatctcccaggttca

SEQ ID NO: 47742 - DNA, 201 bp, Homo sapiens
ctgtcttaattttttttctttccaatgtcacagatcttggaaatgcttgaagaccacaaggctgaaaagtgctttgctggagtcctgttctcagagctccmcagaagacacgtgtttttgtatctttaaagacttgatgaataaacactttttctggtcaatgtctttccctgtttcctgttcattcaataaatatcattg

SEQ ID NO: 47743 - DNA, 201 bp, Homo sapiens
tcttagcacttatagctacacaaaacaaaaatagtaacagaattaatgttgtttaattcttgcaatccatggatgcataaattcactgggggaaaaaacarctcatcattctcattaaagatgtgcttcaaaagtattttaattttatatctaatatgtatgaatcatactttgtatttattttgttttgatcagttatat

SEQ ID NO: 47744 - DNA, 201 bp, Homo sapiens
cctacaagttttaatctgtttaagacctacctcaagtaaaatgttcactgccatggcatgtgagggaaaagggaaataattcttatgcatggccttcaacrgccaaatttcatgctcatcagtacatcttctcttggtgtagaactgatgatgataattatgatgatggaaaaaagtgctgttgatagcaatgcctctctt

SEQ ID NO: 47745 - DNA, 201 bp, Homo sapiens
acagtctgttccaaccttgaaaagtcttgtttcctggatcttatgttcccatccatggtggcacacagtagcagtagcaggaagagcaggtatagtcctgyccaaagatcacacatgtaatacacctactattcagctaggcccctgctccagttctgtctcacagtgatggccaagttcctggttcctcataactggtgt

SEQ ID NO: 47746 - DNA, 201 bp, Homo sapiens
aatgaattctggtattttaagcccatttcataagaccaataatgttgaccaatctactcatattcacacagtacttctacatataccatggtctatatgarcggttgaagaaatagaaaataaaatgcaaatcacaagatgtccattaaaacagtctacctttttcctttgacagccattaattcttcttaaaatgtattg

SEQ ID NO: 47747 - DNA, 201 bp, Homo sapiens
tcctgatcacagaaattcaggtttaggagatgtgttggggttatttattacattaagtaattacattatcacttcattttgtctccatcaagtctgatgcycctctttttgtctcttatacatacattatagaaacaacctacattataaatttatcaactactaatacaaaacacctgtgggatatttagttcccttttc

SEQ ID NO: 47748 - DNA, 201 bp, Homo sapiens
acattaatctttatgacgtataatctaaaaataatataatttttctaattcattaggtcaattacaaggatcgtagtccctgttacggctaccagtgggtrtcagaagaacacgaagaggcacatcacactgcttatcttgtgttctccccaagcaagagctttgtccaccttgagcccatgtctcatgaactaccctgtg

SEQ ID NO: 47749 - DNA, 201 bp, Homo sapiens
tgaattctggtattttaagcccatttcataagaccaataatgttgaccaatctactcatattcacacagtacttctacatataccatggtctatatgagcrgttgaagaaatagaaaataaaatgcaaatcacaagatgtccattaaaacagtctacctttttcctttgacagccattaattcttcttaaaatgtattgag

SEQ ID NO: 47750 - DNA, 201 bp, Homo sapiens
tgtggagcaagtaatcatgaagctctttagatgtcattacttcaacttcttatccatgttccttttgaaagtttgatttctcttgaggtgaattattgccrgcagggactcaataaaacaagtatattgaagtgagactgaagcgtgttctctctggcacatttaatttctttttatttccttttttgcagataatggcaa

SEQ ID NO: 47751 - DNA, 201 bp, Homo sapiens
ctgccacttcctaatagcttagctcctacttctgagtgagaagatatgatgtttggttttccattcctgagctgggaatatcaggaatactttcaagtaaygagagaccatttccatctaatattaattaaaagaaagttgagggagggaaaacaataatggtttttttctcaccctttatcaaatatgtgttgtcttttt

SEQ ID NO: 47752 - DNA, 201 bp, Homo sapiens
agtgatggttaagaacgaggacagtctggtctttgtccagacagacaaatcaatctacaaaccagggcagacaggtatgaagaagcctacagacaggacamcttcaaaaaggaaagatcttcttcccctggatgttccccaggcaaagttcctataatcttggttccttaatagcttgtcttaccagcctacaggcctact

SEQ ID NO: 47753 - DNA, 201 bp, Homo sapiens
tagtagcttcttatcaatgtttattcatttttaaaagtaatatttattaaactaaatttattaatgaaatatgtccattcctcctcattcttagaactacrtaagaattctatgacccatcttaatgattacatctgaacatatttacttatagttacataagtgtttatttctcaacctgtaaaattgcatagcaaagga

SEQ ID NO: 47754 - DNA, 201 bp, Homo sapiens
ttttcctttgacagccattaattcttcttaaaatgtattgagaaatattttataatagatatacaaaagggcataagctataactagaaaacactgtacarctctctcatagattaagaaatagaaaattaccgacgtgggaaaaataaatcccttgtgtatcactaccacctccagaggcaatcattatcctgaatttgt

SEQ ID NO: 47755 - DNA, 201 bp, Homo sapiens
gattttttaaactttttattgtttttaatttttgtggaaacatagcaggtatatatatttatgggttacatgagatattttgatacaggcatgcagtgcaygataatgattatggatgataatcattatcattatccatatcattatccaatcatggataatgattattatcatgcattgcatgcctgtatcaataaatgg

SEQ ID NO: 47756 - DNA, 201 bp, Homo sapiens
ctctctcatagattaagaaatagaaaattaccgacgtgggaaaaataaatcccttgtgtatcactaccacctccagaggcaatcattatcctgaatttgtygttacaattccatggatttccttatatttttgctgcatatgtatccctaactaatatttagaatcttcacatgtgtttcatcttgagagaaacaagattt

SEQ ID NO: 47757 - DNA, 201 bp, Homo sapiens
tctcagaaacttgtcattaaaggagaagccttcaaactcccatagagctagatggctataactcatctcctctactcaccctttactactaccccatttgmcctttttgtagataacttagggtttccatagatatcttttattagctccaatgctccaggtgcttttgtaagttataattaatttactcatataggatcc

SEQ ID NO: 47758 - DNA, 201 bp, Homo sapiens
aaacaagagaaacatttttgaatatttcagcagcttagttttttgtttgtctgctttttattttctaagttcaacactatgttgatgaagacccctatacmagtatgtgcagagtcagctcattaattttcactgctgcataatatattacagtctataaattagtcataatttacacatcgagtttctcctcatggattt

SEQ ID NO: 47759 - DNA, 201 bp, Homo sapiens
agtattctgtcagatgaggctttgggaggttggtaagaactgcaggaaggaatccaaatgtagcaaactaagtatagaaattaaggagcaatgcatgactmtccagccatgggagacaaatatttacaggcaaactaaaagtcagcttaataatcacatagaaaccctattagccagaaaggaaaaaaaaaaaaagaaaat

SEQ ID NO: 47760 - DNA, 201 bp, Homo sapiens
gttggctattgtaatttttcaaaaaaaatcatgaacttagcacaatgggaattatttatttctcgtaattgcccattgtgagtgtttcagaacgatagacrctgagccatctaaagcctccatgggcattcacttctacaaaggaaggaaaaaaccatacacctcttaattgccttagctggccaggccatcagttctgct

SEQ ID NO: 47761 - DNA, 201 bp, Homo sapiens
atgtactgtgtatttcaaaatagcaagtggacaggacttgaactatttccaacacatagaaatgatacatacttgagttggtaggcaccctaaatcccgcratgtgatcattacacattctctgcatgtaacaaaatatctcgtgtaccccataaatatgtataaatattatgcatcctttgtacaaaaaaaattactcct

SEQ ID NO: 47762 - DNA, 201 bp, Homo sapiens
caggacatgggcttaaaggcattcaccaactcaaagattcgtaaacccaaaatgtgtccacagcttcaacagtatgaaatgcatggacctgaaggtctacrtgtaggtttttatggtaaacaaaaaattaataaatatatattgcctaatatattcaccaaattttaaattttttaaaagatacaatgtgacaaaaattaa

SEQ ID NO: 47763 - DNA, 201 bp, Homo sapiens
tatcgcaatatatctagggaatttcagataccaaggaatacatctgtcaattatacatgagatattgttgtgaaatttaatatttagttgctagagaatattttattgtgtcctcgtcatagaaaatgcctacatgatgttgtccccccacaaaaatcacaccggttatctgaccactgatctatttagtataatatgcat

SEQ ID NO: 47764 - DNA, 201 bp, Homo sapiens
caaaatccaacaacctctcctcgcaaatctctccattcttaggtcccctttaataggcttttctcaaaactacacattttgtgcttcccctattcaccttttttttttttttttttttaagacagagtcttgctctgtcacctaggctggaatgcagtggtgcaatctcggctcactgcaacctccatctcccaggttcaa

SEQ ID NO: 47765 - DNA, 201 bp, Homo sapiens
aaaatccaacaacctctcctcgcaaatctctccattcttaggtcccctttaataggcttttctcaaaactacacattttgtgcttcccctattcaccttttttttttttttttttttaagacagagtcttgctctgtcacctaggctggaatgcagtggtgcaatctcggctcactgcaacctccatctcccaggttcaag

SEQ ID NO: 47766 - DNA, 201 bp, Homo sapiens
ataaagtaatctgtacaccaaacccccatgacacgagtttacctatataacaaacctgcatgtgtacgcctgaacctaaaagttaagtatatatatatatwtttttttcatttaatttggtgtatatatatgccaaaaaataaattaagcagtccaaatttcggatgcaaactctcggggacaagacgctaggtgtttcta

SEQ ID NO: 47767 - DNA, 201 bp, Homo sapiens
ctaaaagttaagtatatatatatatatttttttcatttaatttggtgtatatatatgccaaaaaataaattaagcagtccaaatttcggatgcaaactctrggggacaagacgctaggtgtttctaagtgttttgttgaaagccagtgtttaagtaaacattataaattattgttgtttttgtaaataatgtagactgaaa

SEQ ID NO: 47768 - DNA, 201 bp, Homo sapiens
taaaagttaagtatatatatatatatttttttcatttaatttggtgtatatatatgccaaaaaataaattaagcagtccaaatttcggatgcaaactctcrgggacaagacgctaggtgtttctaagtgttttgttgaaagccagtgtttaagtaaacattataaattattgttgtttttgtaaataatgtagactgaaat

SEQ ID NO: 47769 - DNA, 201 bp, Homo sapiens
taaataaaataactggcatagattagaggtcacaaacagcctgtgcatcacttgtagagctttcttaaaatgcagatcctcagccgggcgtggtggctcaygcctgtaatctcagcactttgggaggccaaggcgggcagattaccttaggtcgggagttcaagaccagcctgaccaacatggagaaaccccgtctgtact

SEQ ID NO: 47770 - DNA, 201 bp, Homo sapiens
ttcttaaaatgcagatcctcagccgggcgtggtggctcacgcctgtaatctcagcactttgggaggccaaggcgggcagattaccttaggtcgggagttcragaccagcctgaccaacatggagaaaccccgtctgtactaaaaatacaaaattagtcggacgtggtggtgcatgcctgtaatcccagctactcgggaggc

SEQ ID NO: 47771 - DNA, 201 bp, Homo sapiens
cttcagggacattttccagcaaattccaagtggacaacaacaaccgcctgttactgcagcaggtctcattgccagagctgcctggggaatacagcatgaargtgacaggagaaggatgtgtctacctccaggtgagactcttgggcaggtgaggacaggacagatgaggacagcagctgttctctctgagaagtcctaact

SEQ ID NO: 47772 - DNA, 201 bp, Homo sapiens
tagatatgtgtggtaggagagtttgttcatgcataagttgatgggaattatagtttacaaattttatgaaacttaagcctgggaagatcaaccttttagahcctctttgagtctacgcaagtattcctgcaagacagagaagtcaaactataccaaatctctggatattaaaaaatgaacacagttagtcatccaataaaa

SEQ ID NO: 47773 - DNA, 201 bp, Homo sapiens
tccactgcctctctccgagccttccagcccttctttgtggagctcacaatgccttactctgtgattcgtggagaggccttcacactcaaggccacggtccwaaactaccttcccaaatgcatccgggtaaggatctctttcctaaattaaatacaaggtagccatcaagtaaattaaaagttgcattcctaggaatactgc

SEQ ID NO: 47774 - DNA, 201 bp, Homo sapiens
gtgaatacttaaactaattcaaagagagaagaaagcttcctgaaaggtcatttaattgacttttgctttccaggtgtcaaatcagacactgagcttgttcytcacggttctgcaagatgtcccagtaagagatctgaaaccagccatagtgaaagtctatgattactacgagacgggtgagtgagagtgattttcacgtag

SEQ ID NO: 47775 - DNA, 201 bp, Homo sapiens
tcaatattgtgtgagcccagcagagagcagagggaagtacagacagggaatatactgtagctaaaggggagatataaatagctagaaaatggggaggttcrgtgtctgctctgattcctttgggaatgttctcatgacagatacacatatgggaagcctgtccctggacatgtgactgtgagcatttgcagaaagtatagt

SEQ ID NO: 47776 - DNA, 201 bp, Homo sapiens
tactttgccctatagggatggatatgggtaaggatgaattccatgacacagcagaatagaaagaactaatcaatagcattctcagaagttgaattattcaratctctctctcgtattcacagggaggagtagaagatgaagtgaccctctccgcctatatcaccatcgcccttctggagattcctctcacagtcactgtag

SEQ ID NO: 47777 - DNA, 201 bp, Homo sapiens
gagacccaaatctgtcttaattttttttctttccaatgtcacagatcttggaaatgcttgaagaccacaaggctgaaaagtgctttgctggagtcctgttytcagagctccacagaagacacgtgtttttgtatctttaaagacttgatgaataaacactttttctggtcaatgtctttccctgtttcctgttcattcaat

SEQ ID NO: 47778 - DNA, 201 bp, Homo sapiens
aaataagtttgcctttttgtctttcgtatttgtacaggtttacaacctgctaccagaaaaggacctcactggcttccctgggcctttgaatgaccaggacratgaagactgcatcaatcgtcataatgtctatattaatggaatcacatatactccagtatcaagtacaaatgaaaaggatatgtacagcttcctagaggt

SEQ ID NO: 47779 - DNA, 201 bp, Homo sapiens
acatgaagtagccttggaaacaaggttgcaacctaagggtgagaaaatttccaaactgtgtctagttctatggagagaaaaaaactagcaattagaaaccrattgaaggttaacttttttaaagtttatgaaaagaaggcagtatattgtgattaaaagtgcgggttagactttagcagtgttgctgggaacgtaaaatgg

SEQ ID NO: 47780 - DNA, 201 bp, Homo sapiens
ctattcacaatagctgagagatcgaggctacccaaatgtccatcaagggatgaacaggtaaacaaaatgtggtatataaatacaacagaatattatgcagyctgagaagggaagaaaatcctgtcacatgctacagcatgaatgatccttgaggacgttatggtaagtgaaataagctagtcacaaaaagaccaatactat

SEQ ID NO: 47781 - DNA, 201 bp, Homo sapiens
aggctggagtgcagtggcgccgtctcggcctcggcctctcaaagtgctgggattacaggcatgagccaccgcgcccggcctctcctggcttgttaagtcawccaacatatttcctcctcaaagaagctttccttgatgacccaagcgccctctcctccttcctctctatttcatcagacgatttgttttttgttttttttt

SEQ ID NO: 47782 - DNA, 201 bp, Homo sapiens
tcccagatgcaggctgtttagaagcccaacccttaggagacagccagaaatgggagattttgcctgttctctctgtattgagccaaggggtggtgggggcrggtagccactggcattgctcaaaggcctatttaaaaccacctctgtgttcactgtggtctagggagactcctgattgcagagctccatctactcctggag

SEQ ID NO: 47783 - DNA, 201 bp, Homo sapiens
cctgtaagtctgtcgtttccctgctccttctgcttcccagtgcaggctagttagaagcccaacactcagtcagcaactgataaagtgggtagacgaagccsttccagggagaaactgggagctgttagctaatttttcagtactgaagtacttctttcaaacgcattgctaatttcaggagatgtttaacataaatacatc

SEQ ID NO: 47784 - DNA, 201 bp, Homo sapiens
gcccactatacacaatagtagtagaatttaaaattataaagcagccctcagtgaaatagcattttagagaagagaacttaagaacaatctcaaactgcatrttaaatttataactatattgtctgtaaaagattatgctacaattctgatatactacaattaaaaacagttggaagaaaaggacttatattcccatctcaa

SEQ ID NO: 47785 - DNA, 201 bp, Homo sapiens
ttatgatcttgggatatgaatattcctaaaatcccataagcaagaaatcttgacaaaatgtgtttattatgttgacaagttttttggatacccagtaatayaaggaagtagcccttgtgattagtcaattattagttaattatcaacatactcaacaacaatatgaaagggaaaaaaaactgtcagtctccacaaggactt

SEQ ID NO: 47786 - DNA, 201 bp, Homo sapiens
accttttagagcctctttgagtctacgcaagtattcctgcaagacagagaagtcaaactataccaaatctctggatattaaaaaatgaacacagttagtcrtccaataaaaagtatatatcatttacccccatgaacagagctatgtattggcattgacagaggtatatgcgttatgttagttatttaagaaataatctgg

SEQ ID NO: 47787 - DNA, 201 bp, Homo sapiens
acatcacattaaaggttaatgtcacccccctgaacatttttcagtactttgccatccatttatctttagaaataatgtgtgtagatgtatatgtttgtggwtgtgtgatttacatataataaactgtataagtttcattctataaatcactgtttgtttttcactcagcatcctgtcttggagatttacctatgttaaatt

SEQ ID NO: 47788 - DNA, 201 bp, Homo sapiens
tggatattaaaaaatgaacacagttagtcatccaataaaaagtatatatcatttacccccatgaacagagctatgtattggcattgacagaggtatatgcrttatgttagttatttaagaaataatctggagaatttatcatcccctctgagagatttctgcacaatttaattaaggaccctatagtgtgctgtaggataa

SEQ ID NO: 47789 - DNA, 201 bp, Homo sapiens
cgtagttttgtgagaacattaatctttatgacgtataatctaaaaataatataatttttctaattcattaggtcaattacaaggatcgtagtccctgttayggctaccagtgggtgtcagaagaacacgaagaggcacatcacactgcttatcttgtgttctccccaagcaagagctttgtccaccttgagcccatgtctc

SEQ ID NO: 47790 - DNA, 201 bp, Homo sapiens
attatgctttgagaagcataatgactgattagtgggctaagcacatcttccccattgctgaatattgccaaagagcagttggcttcccacagcagtgtatwttggttcccattgtttcacatccatgtcagcctttggtatttcaaggattactgtattttttttttcaatttaatgagtacaaactctactatttcatgt

SEQ ID NO: 47791 - DNA, 201 bp, Homo sapiens
gtggagatgacatcctatgtgctcctcgcttatctcacggcccagccagccccaacctcggaggacctgacctctgcaaccaacatcgtgaagtggatcaygaagcagcagaatgcccagggcggtttctcctccacccaggttggtgatttgccaaaaccttttatttcaccttcaggtagcaaaagatttgaatgaaaa

SEQ ID NO: 47792 - DNA, 201 bp, Homo sapiens
catccaagaagaaaaaaatacagatgacagtaacttgaaatgaggaaaagttttcagtatccaaggataatggaaataaaagcaaatcaaagtcaaagagrgccaaaaggaaatgctcagaatcccggcaccccatcgctgtgttattatccatctcctatttcccataacaacactgccttcctcaagcagcagtggagc

SEQ ID NO: 47793 - DNA, 201 bp, Homo sapiens
ttcaacggccaaatttcatgctcatcagtacatcttctcttggtgtagaactgatgatgataattatgatgatggaaaaaagtgctgttgatagcaatgcstctcttccttcactttcctctaactgaaccgtctcattcccaggcagtatatggttctggtcccctccctgctccacactgagaccactgagaagggctg

SEQ ID NO: 47794 - DNA, 201 bp, Homo sapiens
gagtactacgcaaaaatttttttgtttcctggaggattttcaaaattcaaaatatcaagtcactttgagacatattgagtctgatgttaaaaaggaaatgwtctagagtcaactgaaacacacactttaagtacaagtgaggtcaggcctagagaaagattttgggagcatagtggcgacagtttaacttgtgaaggcaaa

SEQ ID NO: 47795 - DNA, 201 bp, Homo sapiens
gacctctgttgaagctccgtattgtccataggagttaagggatctttgactcactcactgaagcagagctgtgtctcacttacatagggctcccctgagcygaatttggtgtctggcacataagaggcgtttgataaatgattcttgattgaaattcaagcccttataggtaacagtgaagtgccccaccaacttggagta

SEQ ID NO: 47796 - DNA, 201 bp, Homo sapiens
ctatttggcagccttggccaggaatgcctactgctctccctagctaattcctgatcattaatactccagatctgaatcccctatgtgcagaggcccctcargctgggttttcaaattctcctctgtgctccatagcaccctgcacagcctctaacagcatttatcacaccctcttatggctgctggttacttggccatctc

SEQ ID NO: 47797 - DNA, 201 bp, Homo sapiens; identical to SEQ ID NO: 13706

SEQ ID NO: 47798 - DNA, 201 bp, Homo sapiens
atgtatcctaatcatgggaagggcaccttgggagaagttgcagatggctgacgtgctttctctagcattcagctaaaaaatgggatggtccatgattctgygttctctgtgttctgcaaaacaacattaagtagaaaacaaacagaagcagaggcacatttccttcttttgccacagaaacaatgccactgttgagtgcaa

SEQ ID NO: 47799 - DNA, 201 bp, Homo sapiens
tagtcaacaagcaatctgccacatgcaaagtattgcaagggaccaaaaaatataagctatatgtcccatctcatttactcttcataaccatcccattttayagtcagggaaactgtctggatttgaactcagaagaccatgataaaggcaaaatcagaagtcacttttagtcctgagtttctggggtctgagattcctcct

SEQ ID NO: 47800 - DNA, 201 bp, Homo sapiens
agtaagggacaaggttttttcaaacctatgaggcaggtggagatggtgtgctgcagctgtaggattccctggcctggggagaagtccacttatatgtctcygagtactacgcaaaaatttttttgtttcctggaggattttcaaaattcaaaatatcaagtcactttgagacatattgagtctgatgttaaaaaggaaatg

SEQ ID NO: 47801 - DNA, 201 bp, Homo sapiens
agttcactttgttcactgccctcgagcctttatccaaggctaaacccacatgctgtacctacttttggaattggtccaggaattttatacctgtgtgaatktggagaaactctctcagacacccatttggaaatgcattagtgtttttctcagtgagtcctccatgcttgctgttccaatggccctccaggtttgggccca

SEQ ID NO: 47802 - DNA, 201 bp, Homo sapiens; identical to SEQ ID NO: 13710

SEQ ID NO: 47803 - DNA, 201 bp, Homo sapiens
gtcccagaggagagaccgtgctaaagctaattactaagcagtacaaaaataatctctctctctctctttctctctctctctctctctctctctctctctctatatatatatatatatatatatatgtaattttttttttgagacagtctcactctgccgcccaggctggactgcagtgacacaatctcggctgactgcaac

SEQ ID NO: 47804 - DNA, 201 bp, Homo sapiens
tcccagaggagagaccgtgctaaagctaattactaagcagtacaaaaataatctctctctctctctttctctctctctctctctctctctctctctctctatatatatatatatatatatatatgtaattttttttttgagacagtctcactctgccgcccaggctggactgcagtgacacaatctcggctgactgcaacc

SEQ ID NO: 47805 - DNA, 201 bp, Homo sapiens
cggagataaagagtgcatataggccaggcatggtggctcatgcctggaatcccaacactttgggaggccgaggcaggtggatcgctggatcccaggagttygagaccagtctgggcaacatggtggaaccctgtctctacaaaacaaaaacaacaacaacaacaacaaaaattagctgggcatggtggtacaagcctgtag

SEQ ID NO: 47806 - DNA, 201 bp, Homo sapiens
attcctggtagggttctgacatatacctgccctggaccaatgactagggagctggctacagaggtggaggtgagcctaggaaagcagaaatacaaggagagggggaaaaaaaagtcaaatctcaaaatatctagccgcagacataagctcctctgacggtaatttcttgaggggggaaaaagttgctatttaaagctagga

SEQ ID NO: 47807 - DNA, 201 bp, Homo sapiens
ctagattgacacagtagttgcattcctgaaaaattcagtatatattaaaaccgtgcaaaaactattttgttagcatgtaacacaaagttaggttctgaggkaattttgagcaagtttttgacccttggggactttgggcaggacatcctacagctgtgtggatgctggctgattctgcatggtacgggactgtcatgcacg

SEQ ID NO: 47808 - DNA, 201 bp, Homo sapiens
aattatctattagggatcaagcattaacttgacacaggagcagccctggctcagctggaggcatccgcatgctgtggtgccccaggaacagaggcaccccygaaatgcaggctgtgtgtttgctgcagagacaccatggcccataactccccaagcataagtgagcagctctgctgtccaggcaatgaagtcaagaaaggg

SEQ ID NO: 47809 - DNA, 201 bp, Homo sapiens
gcattccctctatagcttccacctgaccacagccagcccaagccctgctcagaaccccaggcctgccagcgagcctgtgactggaattatctattagggakcaagcattaacttgacacaggagcagccctggctcagctggaggcatccgcatgctgtggtgccccaggaacagaggcacccccgaaatgcaggctgtgt

SEQ ID NO: 47810 - DNA, 201 bp, Homo sapiens; identical to SEQ ID NO: 13704

SEQ ID NO: 47811 - DNA, 201 bp, Homo sapiens
gcaggtcattttcaaagtcaagtgctgtattatgtatttttaagaatttaacttggctaaaactgtgctaccttaagggggctccaatcctttttttttcyttttctttttttttttttgttttagacggagtcttgctcttgtcgcccaggctggagtgcagtggcatgattttggctcactacaacctttgcctcctgg

SEQ ID NO: 47812 - DNA, 201 bp, Homo sapiens
ttagggatcaagcattaacttgacacaggagcagccctggctcagctggaggcatccgcatgctgtggtgccccaggaacagaggcacccccgaaatgcargctgtgtgtttgctgcagagacaccatggcccataactccccaagcataagtgagcagctctgctgtccaggcaatgaagtcaagaaagggaaccaaccc

SEQ ID NO: 47813 - DNA, 201 bp, Homo sapiens; identical to SEQ ID NO: 13707

SEQ ID NO: 47814 - DNA, 201 bp, Homo sapiens
cattttcaaagtcaagtgctgtattatgtatttttaagaatttaacttggctaaaactgtgctaccttaagggggctccaatcctttttttttctttttctttttttttttttgttttagacggagtcttgctcttgtcgcccaggctggagtgcagtggcatgattttggctcactacaacctttgcctcctgggctcaa

SEQ ID NO: 47815 - DNA, 201 bp, Homo sapiens
tattatgtatttttaagaatttaacttggctaaaactgtgctaccttaagggggctccaatcctttttttttctttttctttttttttttttgttttagayggagtcttgctcttgtcgcccaggctggagtgcagtggcatgattttggctcactacaacctttgcctcctgggctcaagggtttctcctgcttcagcct

SEQ ID NO: 47816 - DNA, 201 bp, Homo sapiens
gcctggggcccagtcacacctccctgaccccagtttcctctcccagtggcgctgctgggtgctgttccccgggactgcggcagagccctcctcgcgggccygacacggtgtccggccgcacggatgaccggtagagggcagcagcgcgctccgggtcggtcgggagcagggccttcctagtccagaaaccgcggcaggtcc

SEQ ID NO: 47817 - DNA, 201 bp, Homo sapiens
aaatggtacctacagtaatggtacccagtaatagtacctacaaaagactgggaggatgagggaagggagggagctcccagctgtgtggggaggagcatacrggcgagggtaaccccccatatggtattatagggatttgcgtctatttctgtcctccctccagactctagcctcatggttctcagacatgggtatgcatca

SEQ ID NO: 47818 - DNA, 201 bp, Homo sapiens
aaccagattatgtttttgaaagaacatgctggctgctggctggaaaatgaaagcaagaccagaaataagagagccagtgaggagtctccagtctggcccaygcaaagagatggcggcggcttacagtagggcagtggataggcttgggaggtggcaccaacaggacttgctgagggattggatattggggggatgtttaaa

SEQ ID NO: 47819 - DNA, 201 bp, Homo sapiens
attattagatgcctgagtttgaaactttgagtcaatccaggcatccatgcctacttctgatttgctgtagcttgtgtgccacagcctcccagtttctgtgraaaccccaccatacatcagccccagcacaaagcacaacctcgtcagagctagcccacctccagcaccgtgactgctccaggcttaatctctcctggtgtt

SEQ ID NO: 47820 - DNA, 201 bp, Homo sapiens
tagcttgtgtgccacagcctcccagtttctgtggaaaccccaccatacatcagccccagcacaaagcacaacctcgtcagagctagcccacctccagcacygtgactgctccaggcttaatctctcctggtgttgacacttttgccagtgatggtgtctcatgggattcatgctctttataaaccattgccttcttcctat

SEQ ID NO: 47821 - DNA, 201 bp, Homo sapiens
gccctcagagaaaaccctgagctgcggcgtggccgagacgggggcgtggcctggcaggtgggcgggcccttccgtgggcggggccgcgaggttttcaggakcccgagcgagggcgccgcttttgcgtccgggaggagccaaccgtggcgcaggcggcgcggggaggcgtcccagaggtgagcgccctgcagcggcagggga

SEQ ID NO: 47822 - DNA, 201 bp, Homo sapiens
aaatgatctagagtcaactgaaacacacactttaagtacaagtgaggtcaggcctagagaaagattttgggagcatagtggcgacagtttaacttgtgaargcaaatgtggtcactgatggaagaagcctgaagcagagaacaaggtcttggggaaacctggaagccatgggggtgggaaaaagaaaagtatctgttggaa

SEQ ID NO: 47823 - DNA, 201 bp, Homo sapiens
gccaaaggaagagatatttcaagaagaaataggtggccaaagctgcccaatgctaaacaaaacaaaacaaaacaaaacaaaacccacaaggagattcataraagaaagaggctgggtacagtagttcatgcctgtaataccttgggaggccaaggtaggaggattgtttgaaaccaatagttcaagaccagtctgggcaac

SEQ ID NO: 47824 - DNA, 201 bp, Homo sapiens
tacagaggtggaggtgagcctaggaaagcagaaatacaaggagagggggaaaaaaaagtcaaatctcaaaatatctagccgcagacataagctcctctgasggtaatttcttgaggggggaaaaagttgctatttaaagctaggatatatgtggttccatttttttcatcggtacattaataacatcattttccactatgt

SEQ ID NO: 47825 - DNA, 201 bp, Homo sapiens
ggaggattgtttgaaaccaatagttcaagaccagtctgggcaacatagtgagacccctccacccccacccccacacacaaaaattatctgggcatggtggyacatgcctatagccccagctactccagaagctgaggtgggatgatcacttgaaccccggagttcaaggctgcagtgagctctgatcgcaccacttcactc

SEQ ID NO: 47826 - DNA, 201 bp, Homo sapiens
ttttaattgtggtaaaatagacatataattttcattttataaaaaatgtccattttaataatttttaggcagacagttcagtgacattaagtacattcacyactgtttgtctccagaatgttttcatcatcccagactgaaactctgcccattaaacgctaactccccatcctcccctcccagcccctggtaacttctgct

SEQ ID NO: 47827 - DNA, 201 bp, Homo sapiens
actgtgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgc

SEQ ID NO: 47828 - DNA, 201 bp, Homo sapiens
ctgtgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgcc

SEQ ID NO: 47829 - DNA, 201 bp, Homo sapiens
tgtgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgcca

SEQ ID NO: 47830 - DNA, 201 bp, Homo sapiens
gtgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgccaa

SEQ ID NO: 47831 - DNA, 201 bp, Homo sapiens
agggaacaatattaatgtgttagggaagactattgatatgctggagaataatattaacatattcaagaatgtgaatttcacatttgcttatgtgcaatttyttgcatgtaaaggcagaaaactgcacccagctgtgccaaaacacaaaagaatacacaaaatacacctccaatattagtcagctacctcattctccatgtg

SEQ ID NO: 47832 - DNA, 201 bp, Homo sapiens
tgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgccaag

SEQ ID NO: 47833 - DNA, 201 bp, Homo sapiens
ctattttggggtaaaatatttaaatttctttcaggtcctgctatctgttgtgttgatatctttttattttattttattttattttattttattttattttattttattttattttattttattttattttattttatttttgagacagtctcactctgttgccaaggctggagtgcagtggcatgatctcggcttactgca

SEQ ID NO: 47834 - DNA, 201 bp, Homo sapiens
gggcttgtgatcattgctttgatggaaataagatggtttttgaaagagtaacacggcaggggatttatttcaaatagtgtgtgcaggagaagtctcgctgkggaaacactgatgtgagatctcgccgcagtaagagcagagagaagagggttcacatgaaggaagcagcacttgcgaaggtcctgaggctggaaagagttt

SEQ ID NO: 47835 - DNA, 201 bp, Homo sapiens
tggggtaaaatatttaaatttctttcaggtcctgctatctgttgtgttgatatctttttattttattttattttattttattttattttattttattttattttattttattttattttattttattttatttttgagacagtctcactctgttgccaaggctggagtgcagtggcatgatctcggcttactgcaacctct

SEQ ID NO: 47836 - DNA, 201 bp, Homo sapiens
cttttcttttgagatggagtctctctctgtcacccaggctggagtgcaatggcacaagctcagctcactgcaacctctgcctcctgggttcaagcaattcycctgcctgagcctcctgagtagctaggatttcagacacgtgccaccatgcctggctaatttttgtatttttagtagagatggggtttcaccatgttggcc

SEQ ID NO: 47837 - DNA, 201 bp, Homo sapiens
tgtggtgggctctcacgcggccaagcctccccaacgggcgccgccccctgctccacggcgcccggtcccatcgaccacccaaggactgaagagcacaggcrcatggggtgggactggtgggcagctctgcccctagccctgacgcgggatccactaggcaaagccagctgggctcctgagtcaggtggggacttggagaac

SEQ ID NO: 47838 - DNA, 201 bp, Homo sapiens
attcttcattttatctattgagatcactttgaacttttatcccattttccaaaatgcagcctcctgcctgtgtgtgtcatctataaatacaaggtcattasctctgaggcccatttgaagccacaagaaattcactgagacagaaagtggctactttgtttgcattactcaatctcatcacctacaaaagaaacaaacact

SEQ ID NO: 47839 - DNA, 201 bp, Homo sapiens
cggccaagcctccccaacgggcgccgccccctgctccacggcgcccggtcccatcgaccacccaaggactgaagagcacaggcacatggggtgggactggygggcagctctgcccctagccctgacgcgggatccactaggcaaagccagctgggctcctgagtcaggtggggacttggagaacttttatgtctaggtaga

SEQ ID NO: 47840 - DNA, 201 bp, Homo sapiens
gaaattaaggctgcagtgagctgtaatcgcaccactgcactccagcctggacagcagagtgagaccctgtctcaaaacaaaacaatcacaaactatgtagrtggaaagaatacataggattcgcagaattcctggctttagtcatcagagtgcctgtaaggaatgtggaaaaagacctggaagctttacctctcggcactg

SEQ ID NO: 47841 - DNA, 201 bp, Homo sapiens
agcttgtgtgccacagcctcccagtttctgtggaaaccccaccatacatcagccccagcacaaagcacaacctcgtcagagctagcccacctccagcaccktgactgctccaggcttaatctctcctggtgttgacacttttgccagtgatggtgtctcatgggattcatgctctttataaaccattgccttcttcctatt

SEQ ID NO: 47842 - DNA, 201 bp, Homo sapiens
ccctctgagctatataactcttcctttaccttccaacagaggcctttcattacatttaaagcaaatggaatgcatagtaggcaccaaagatggaggtgctrtgcaaataatagacaccaagctctctgcaggtggggtccttgtgtgttttctcttcatagcacccagcacaatacttggaacataagccagacacgttca

SEQ ID NO: 47843 - DNA, 201 bp, Homo sapiens
cccacagcaccaggcagtgcacactggccaagactccgtggtaaatattgctggcctttatgttgagagggggaaaaaaaagcctgcctgtgaagatcatygcccagtggccatgctcctgtgaaaacacaattggaaagccatttcctaaggggcgagggtgggtctgggaccatgctgtggcttgggtgattggtggtt

SEQ ID NO: 47844 - DNA, 201 bp, Homo sapiens
catagcacccagcacaatacttggaacataagccagacacgttcattgagcaccatttctgctgcacccatgaaaaaaacactcaacccagacagatggtyagctccccgacaggacttaagcaagtgggccagtctctgtttattgtcgtacactcacacaatcacacagctgccaggcgagcactaggcacttatcaca

SEQ ID NO: 47845 - DNA, 201 bp, Homo sapiens
gggtgggtctgggaccatgctgtggcttgggtgattggtggttgcaggagtgagggtgctgccctgggaaggcgctgaggccctgttgggtgggaatcgayggctgcggctttctcccggaggagggagagcggtgttgttacctagtgttgggaacacatccgtccagcaccgtgaactgcaaacaagcagagtaaccct

SEQ ID NO: 47846 - DNA, 201 bp, Homo sapiens; identical to SEQ ID NO: 13700

SEQ ID NO: 47847 - DNA, 201 bp, Homo sapiens
aaggaatgttctgcttcagggaggattggccctggtctatgattgctgtcatgatgatactcagcaagtttccttagataacttcagagttaacaaggatktaaaaatgcttccatttcaaactcaccgttatacatatgcagaaactgaggacaatgaaagttagagttgtctaggatacccagactgtggctgaaggag

SEQ ID NO: 47848 - DNA, 201 bp, Homo sapiens; identical to SEQ ID NO: 13701

SEQ ID NO: 47849 - DNA, 201 bp, Homo sapiens
ccgcgggctcctccccctcggtccctgccccttttgcgccctctgctggtctctagggaaagcgcatctcctgaaatcagaagtcgcacccaagctgtccygtttccttagctcctagtaaagcgatatgacccatccatcccctcctcctcaaagcctcacatgaatcttctttgaggtactctctgatgcttcactctt

SEQ ID NO: 47850 - DNA, 201 bp, Homo sapiens; identical to SEQ ID NO: 13703

SEQ ID NO: 47851 - DNA, 201 bp, Homo sapiens
gcatattcaattttgttttgttcaaaggtcacagtgacaactaagtttgcagcgggattcaaatccgagctccacagtgtaataaatgtgagatcttagayaagtgcttaacctctctgagttaatcatctatcaaataatgaaaagcactataagccaactcttcaactttcaggacattgttcacccgaaacccgaaat

SEQ ID NO: 47852 - DNA, 201 bp, Homo sapiens
taagccaactcttcaactttcaggacattgttcacccgaaacccgaaatccaataactgtgcactgtcttctaacacagccataatttacctagatgtacygcttagaaatgtctcactctcatggtgaccttagttctatctgtccctagagagccgcaagaccattttgtctggaggttctctgctcactggacaatag

SEQ ID NO: 47853 - DNA, 201 bp, Homo sapiens; identical to SEQ ID NO: 13708

SEQ ID NO: 47854 - DNA, 201 bp, Homo sapiens
cagacgcgccaccttaagagctgtaacactcaccgtgaaggtctatagattcactcctgaagccagcgaggccatgagccccccagaaggaagaaactccraacacgtccaaacatcagaaggaacaaaccccagacacaccacctttaagaactgtaacactcaccgtgagggtccacgacttcactcttgaagtcagtg

SEQ ID NO: 47855 - DNA, 201 bp, Homo sapiens
ggccatctcagaatcaggtctgcaaacctgcaacttgtcgcatccagtcgggaaacttcacttcttttggtatttgactctagaacagttggcaccattgrccactcccaccttgaaattcattcaatgactcctatttatttattatttttattttttatttttggctctcactatgttgcccaggatggagtgaagtgg

SEQ ID NO: 47856 - DNA, 201 bp, Homo sapiens
tcaccgtgaaggtctatagattcactcctgaagccagcgaggccatgagccccccagaaggaagaaactccaaacacgtccaaacatcagaaggaacaaaycccagacacaccacctttaagaactgtaacactcaccgtgagggtccacgacttcactcttgaagtcagtgagaccaggaacccaccaatttcggacaca

SEQ ID NO: 47857 - DNA, 201 bp, Homo sapiens
acccttcctgactcctctctataaacagcagccaccacccgagccatggcacccccatctcctttttcccactttactttcttccattgcatttacctctrcctgtcagtacctatttcctcttccttttgttgtctatcacctcttccgtccaccagaatgtaagctccatgagggcaggcttggtccattttgctcaca

SEQ ID NO: 47858 - DNA, 201 bp, Homo sapiens
agtctgatgttaaaaaggaaatgatctagagtcaactgaaacacacactttaagtacaagtgaggtcaggcctagagaaagattttgggagcatagtggcracagtttaacttgtgaaggcaaatgtggtcactgatggaagaagcctgaagcagagaacaaggtcttggggaaacctggaagccatgggggtgggaaaaa

SEQ ID NO: 47859 - DNA, 201 bp, Homo sapiens; identical to SEQ ID NO: 13705

SEQ ID NO: 47860 - DNA, 201 bp, Homo sapiens
aagattttgggagcatagtggcgacagtttaacttgtgaaggcaaatgtggtcactgatggaagaagcctgaagcagagaacaaggtcttggggaaacctrgaagccatgggggtgggaaaaagaaaagtatctgttggaaaatagaatgatagaaagatagggaaaaaactaaggaagccaaaggaagagatatttcaag

SEQ ID NO: 47861 - DNA, 201 bp, Homo sapiens
aatgccgccctcttgctcagtgcctggaagaggcattggtgactccccgctaatgctaggggtagctaccgtgcaggagcagtcaggctcttgcagggccwatgtggtttcatcaattttctcctgcatttacccagcccctccgaattctgagaagtgcgtccaagatctcttggactccttgactcagttcacccttgt

SEQ ID NO: 47862 - DNA, 201 bp, Homo sapiens
tctgtgtatcgcaggcccagtttgtgcctggcccacagtatgtgcttagtaaatgtcttgtggatgagtgaagtatactgggaagcccagcctccctcatrgcaacacctgctgttattagactttccactggaggggcagggaggatgagggcctgagagagcaagatatccatggaggtgctgagtggtaagctgaaaa

SEQ ID NO: 47863 - DNA, 201 bp, Homo sapiens
ctgtgtatcgcaggcccagtttgtgcctggcccacagtatgtgcttagtaaatgtcttgtggatgagtgaagtatactgggaagcccagcctccctcatgkcaacacctgctgttattagactttccactggaggggcagggaggatgagggcctgagagagcaagatatccatggaggtgctgagtggtaagctgaaaag

SEQ ID NO: 47864 - DNA, 201 bp, Homo sapiens
ggggtacccggctgaagtgaagcaacattgtgtctcttcctgctgttttctccacctcccctcagcaaatcatgaatgaataaacaaacgaatgaatgaasaaacatagagttattataaggattaagtgaaggcagggtgcagtggctcatgcctgtaatcccagcatgttgggaggccaaggtaggaggatcgcttgag

SEQ ID NO: 47865 - DNA, 201 bp, Homo sapiens
gattaagtgaaggcagggtgcagtggctcatgcctgtaatcccagcatgttgggaggccaaggtaggaggatcgcttgagctcaggagttgaagaccagcrtgggcaacaaagcgagacccccatctctatatttttattttaatttagaataataaataaaatttttttaaaagaaaagattaagtgaaatgttttttaa

SEQ ID NO: 47866 - DNA, 201 bp, Homo sapiens
atggtcaggcccagcagttggaattctttttgaggccattttcccaagtctttatcacgtcacaagacttgctgtgtacatggcaaaaggaaggcccaacrgagccacattgggaagtgggccctggggagtctgctgagacactggttgctaagtgactgccctgtcttccatggcgcagtgattcaaagccaggcctca

SEQ ID NO: 47867 - DNA, 201 bp, Homo sapiens
gacggtgtttccagaacagtgcctccgttgttcattcccgtgcatcaggaagtttggctctgctgagtgttgaaagcaaaactctcctgtttatttgtctstgtatactaacagacttaaacagcagacagcactggaatgtccagttactgcatccagatgtgtttgtttcactcttaacattgtggaaaagaatgcaga

SEQ ID NO: 47868 - DNA, 201 bp, Homo sapiens
acattgttcacccgaaacccgaaatccaataactgtgcactgtcttctaacacagccataatttacctagatgtactgcttagaaatgtctcactctcatrgtgaccttagttctatctgtccctagagagccgcaagaccattttgtctggaggttctctgctcactggacaatagggacagtggaattgtcctcatcct

SEQ ID NO: 47869 - DNA, 201 bp, Homo sapiens
tccagaacagtgcctccgttgttcattcccgtgcatcaggaagtttggctctgctgagtgttgaaagcaaaactctcctgtttatttgtctctgtatactracagacttaaacagcagacagcactggaatgtccagttactgcatccagatgtgtttgtttcactcttaacattgtggaaaagaatgcagaaggcagatc

SEQ ID NO: 47870 - DNA, 201 bp, Homo sapiens
agccataatttacctagatgtactgcttagaaatgtctcactctcatggtgaccttagttctatctgtccctagagagccgcaagaccattttgtctggargttctctgctcactggacaatagggacagtggaattgtcctcatccttgtgcttgagtctttggaaaccaaatgaccccagaaatgtcatgaaagagatt

SEQ ID NO: 47871 - DNA, 201 bp, Homo sapiens
aaggagattcataaaagaaagaggctgggtacagtagttcatgcctgtaataccttgggaggccaaggtaggaggattgtttgaaaccaatagttcaagaycagtctgggcaacatagtgagacccctccacccccacccccacacacaaaaattatctgggcatggtggcacatgcctatagccccagctactccagaag

SEQ ID NO: 47872 - DNA, 201 bp, Homo sapiens
tcttcttcttaattagctttcctattttcccttaggaaaacaaaaagtcctttctcctgattcaccaaaaaataaaatactgactaccatcactgtgatgwgattcctatagtctcaggaactgaagtctttaaacaaccagggaccctctgcccctagaataagaacatactagaagtcccttctgctaggacaacgagg

SEQ ID NO: 47873 - DNA, 201 bp, Homo sapiens
gtggtatagaactcctgggctcaagcagtcctcccatcttggcctcccaaagtgctgggattacaggcatgagccaccatgcccagtcctgtcttcaaaakattaatggagaaaaatattgctggggtacttaagttgtgccaggtactacagggggatcctgcatgaatgaaactgagtgcctgcccctcaagacttaca

SEQ ID NO: 47874 - DNA, 201 bp, Homo sapiens; identical to SEQ ID NO: 13709

SEQ ID NO: 47875 - DNA, 201 bp, Homo sapiens
gtcactgatggaagaagcctgaagcagagaacaaggtcttggggaaacctggaagccatgggggtgggaaaaagaaaagtatctgttggaaaatagaatgmtagaaagatagggaaaaaactaaggaagccaaaggaagagatatttcaagaagaaataggtggccaaagctgcccaatgctaaacaaaacaaaacaaaac

SEQ ID NO: 47876 - DNA, 201 bp, Homo sapiens
ccaccagctcccaccttgagcccacaaatctaccttctgagccactgcagccccaggtagctccccaggcctaggctctctcttctcctttgtccatgctrtttggcagccttggccaggaatgcctactgctctccctagctaattcctgatcattaatactccagatctgaatcccctatgtgcagaggcccctcaggc

SEQ ID NO: 47877 - DNA, 201 bp, Homo sapiens
ctccagaatgttttcatcatcccagactgaaactctgcccattaaacgctaactccccatcctcccctcccagcccctggtaacttctgctctgcttcctrtctctgaatttatctattctagatatcttgtaagtggattcatgcaatatttgttcttttgtgactggcttattttactcagcataatgtcttcaaagtt

SEQ ID NO: 47878 - DNA, 201 bp, Homo sapiens
attcctgatcattaatactccagatctgaatcccctatgtgcagaggcccctcaggctgggttttcaaattctcctctgtgctccatagcaccctgcacakcctctaacagcatttatcacaccctcttatggctgctggttacttggccatctccctgctgggatggctccctgaaggcagtgattgagttaatccttga

SEQ ID NO: 47879 - DNA, 201 bp, Homo sapiens
tgctggtggagtcacctgaagactctgaacaaccctggatgcccaagccacactccacaccaactaaatttgtaattttttaaagtctcctggtgattccrgtgtgtagccaagtttgagaaccattggtttccatcagtgattctcaaatttgagtgtgtataaaattcacacaatggctaaggatacagattcctgaga

SEQ ID NO: 47880 - DNA, 201 bp, Homo sapiens
tcattaatactccagatctgaatcccctatgtgcagaggcccctcaggctgggttttcaaattctcctctgtgctccatagcaccctgcacagcctctaayagcatttatcacaccctcttatggctgctggttacttggccatctccctgctgggatggctccctgaaggcagtgattgagttaatccttgatgtatccc

SEQ ID NO: 47881 - DNA, 201 bp, Homo sapiens; identical to SEQ ID NO: 13702

SEQ ID NO: 47882 - DNA, 201 bp, Homo sapiens
cagcccttggagacctacctaggcaatttgtcactcaggcttcaagctgccagccgaggaggggagctgagaagactctataatgagatctttgcactgtwattaagtgccaggctttgttttacacctatctttcccgccttgcccgatcccaccgccaagctcctccaggcagtgagtggggagtgtcagctgctctgt

SEQ ID NO: 47883 - DNA, 201 bp, Homo sapiens
gaggtcccagaggagagaccgtgctaaagctaattactaagcagtacaaaaataatctctctctctctctttctctctctctctctctctctctctctctmtctatatatatatatatatatatatatgtaattttttttttgagacagtctcactctgccgcccaggctggactgcagtgacacaatctcggctgactgc

SEQ ID NO: 47884 - DNA, 201 bp, Homo sapiens
caaagatccaaaacttactaaaattcttttgtcttctttcccatggtcaggcccagcagttggaattctttttgaggccattttcccaagtctttatcacktcacaagacttgctgtgtacatggcaaaaggaaggcccaacggagccacattgggaagtgggccctggggagtctgctgagacactggttgctaagtgac

SEQ ID NO: 47885 - DNA, 201 bp, Homo sapiens
ggtcccagaggagagaccgtgctaaagctaattactaagcagtacaaaaataatctctctctctctctttctctctctctctctctctctctctctctctmtatatatatatatatatatatatatgtaattttttttttgagacagtctcactctgccgcccaggctggactgcagtgacacaatctcggctgactgcaa

SEQ ID NO: 47886 - DNA, 201 bp, Homo sapiens
aagaggctgggccagagatttctcaaggtcccaacttcaaccttggtgttctgtccgccttgatttacaaaatggtcttgatcttttccaattaaaattcyatttagtagagatacacagaaagtttgcaattcttccacaagaaaactgctgtatggcatagaaaaatatctacataatattttttgtttcttcttctta

SEQ ID NO: 47887 - DNA, 201 bp, Homo sapiens
caaccagggaccctctgcccctagaataagaacatactagaagtcccttctgctaggacaacgaggtaagtgcttctggtaaaaatgtgtcatagtgtgtstgtgtctgtgtgtgtatgatacatatataaatatatgcatatttgtacatatatatatacatatgtacaaatatacatacatataaggtctctctgtcgc

SEQ ID NO: 47888 - DNA, 201 bp, Homo sapiens
gaataagaacatactagaagtcccttctgctaggacaacgaggtaagtgcttctggtaaaaatgtgtcatagtgtgtgtgtgtctgtgtgtgtatgatacrtatataaatatatgcatatttgtacatatatatatacatatgtacaaatatacatacatataaggtctctctgtcgcccaggctgaaataaagcagtgtg

SEQ ID NO: 47889 - DNA, 201 bp, Homo sapiens
atatgtacaaatatacatacatataaggtctctctgtcgcccaggctgaaataaagcagtgtgatcatagctcactgcagcctcaaactcttaggcttaaygatcctcctgcctcagcctcccaaatagctcagactacaggtgcacaccagcatgcctggctaatttttctgttttttgtagagacaaggtctcactatg

SEQ ID NO: 47890 - DNA, 201 bp, Homo sapiens
aatttcggacacagtatgataaataagcaaatagacaagacaagtaagggcttgtgatcattgctttgatggaaataagatggtttttgaaagagtaacayggcaggggatttatttcaaatagtgtgtgcaggagaagtctcgctgtggaaacactgatgtgagatctcgccgcagtaagagcagagagaagagggttca

SEQ ID NO: 47891 - DNA, 201 bp, Homo sapiens
aataagatggtttttgaaagagtaacacggcaggggatttatttcaaatagtgtgtgcaggagaagtctcgctgtggaaacactgatgtgagatctcgccrcagtaagagcagagagaagagggttcacatgaaggaagcagcacttgcgaaggtcctgaggctggaaagagtttggaatgcgtaccatgtgtgtattcca

SEQ ID NO: 47892 - DNA, 201 bp, Homo sapiens
caattcaagatgagatttgggtggggacacagccaaaccatatcaaagagtaagggacaaggttttttcaaacctatgaggcaggtggagatggtgtgctrcagctgtaggattccctggcctggggagaagtccacttatatgtctctgagtactacgcaaaaatttttttgtttcctggaggattttcaaaattcaaaa

SEQ ID NO: 47893 - DNA, 201 bp, Homo sapiens; identical to SEQ ID NO: 13724

SEQ ID NO: 47894 - DNA, 201 bp, Homo sapiens; identical to SEQ ID NO: 13725

SEQ ID NO: 47895 - DNA, 201 bp, Homo sapiens
ctccccccaccccttccccccacccctgccagctgatttcatttgcctgacgttgtggttggctctacccttccctgtcaggcccccccaaccccccgccrgtcggggccaggccaggccaggccagctcctctggcagcagagcctgggcaggtgacgggcgggcgcgggcgtcgcagctgagggagtaaggaggctccc

SEQ ID NO: 47896 - DNA, 201 bp, Homo sapiens
agttacacaaagccacctcccacaccatgcttcacgttttgcaggctccacctggtacctcccttcctgcagttctgccttccctatgtcaccctcaagcsgaggccctttggggcctgaactgagaaggcagcagcttggttgggatccgcccccctcaccacccctcccctcaagctgctgtgccctgcccagtgtatt

SEQ ID NO: 47897 - DNA, 201 bp, Homo sapiens
ctgcctgcagcgctgtatagtgcagagcgggcgaggggcatagggaagtcactggcacgtggtatgtgttggcagggctgcttctcaccccaaaccaaggragggacaggcagggaggctgagagcagcggcttgccctggagctgtcaggtgggaggcagagggcgggagaggctgtgggctgcccaggtctgatccctg

SEQ ID NO: 47898 - DNA, 201 bp, Homo sapiens
atgtgctcaagcacacatgcacacacacacgtacacacacccacacatgcatacacatgcacacatatccccccacacacccacatacacacacacacccmcacacccacacatacacttacacgcatgcacacactgctttccaaatcagcttggagagacaggctgactcctttccctcttcctcaggcatcctctctg

SEQ ID NO: 47899 - DNA, 201 bp, Homo sapiens
ctccgtccgcccttctagccgggtcactgcaggcaagccttggtgctcttgcctgcgacgtggaaatgatgcctgcctgcagcgctgtatagtgcagagcrggcgaggggcatagggaagtcactggcacgtggtatgtgttggcagggctgcttctcaccccaaaccaagggagggacaggcagggaggctgagagcagc

SEQ ID NO: 47900 - DNA, 201 bp, Homo sapiens
gcatgtgctcaagcacacatgcacacacacacgtacacacacccacacatgcatacacatgcacacatatccccccacacacccacatacacacacacacmcacacacccacacatacacttacacgcatgcacacactgctttccaaatcagcttggagagacaggctgactcctttccctcttcctcaggcatcctctc

SEQ ID NO: 47901 - DNA, 201 bp, Homo sapiens
tggatgacaacaatattgtgaccagctcgggggacaccacgtggtgaggctgaacattgctggtgctggggcttgggagtgggcccggcctttctctaacrgtctccctccattttggcagtgccttgtgggacattgagactgggcagcagaagactgtatttgtgggacacacgggtgactgcatgagcctggctgtgt

SEQ ID NO: 47902 - DNA, 201 bp, Homo sapiens
atgacctgtgcctatgccccatcagggaactttgtggcatgtggggggctggacaacatgtgttccatctacaacctcaaatcccgtgagggcaatgtcarggtcagccgggagctttctgctcacacaggtgagggagagaccctctcctcccctcctgaggggttcagggaaccctgggcttccagtgggctgtggctc

SEQ ID NO: 47903 - DNA, 201 bp, Homo sapiens; identical to SEQ ID NO: 13733

SEQ ID NO: 47904 - DNA, 201 bp, Homo sapiens
aggatgcagctggggctggagccaggtctggctatcgtggtcgccgctcccctcacaccccccatgaacgcttcgaggggctcacggtgcttaaggctgckcaggtgagcacaggaggcacccgggcccgtctgatgcccagacctggaggagaggctgtgcaggaagccgggccccagggcctgggcttttgtgaaggag

SEQ ID NO: 47905 - DNA, 201 bp, Homo sapiens
ggatctgagtcctgggcatgtttaagaccctccagttgctcccctgctggtaggcctggctgtggagagctctccacctgtcaagaccataggctagaacragtctgggccctgactcttctctcctctcctccccatattccaggaaggaattgccaaggccctcagatatccagcctaccccacacagattgagattgc

SEQ ID NO: 47906 - DNA, 201 bp, Homo sapiens
tttaaatgaagaggatggtggggttgggaggtataaccctgctcctctctcccagtctgtgcaataaaggtcgtgaagatctctcagccaggggccagtcragtgtatcacagattctgtgatggctggaggtgggggtggctctggctggcctgggaggagacaggtgtctttgggcctcccagaggcggggcgcctgga

SEQ ID NO: 47907 - DNA, 201 bp, Homo sapiens
acccctttgtgtcctaggagagcaagagcagcgcatggacctgagtcacccagtgcacgcagacaactgcgtcctggaccctgacacgggagagtgctggygggagcccccagcctacacctatcgggactacaggtgggcagcccctctagtggtcaggcaggtgggcagacaaaggtcatcccactgccggcctgggcc

SEQ ID NO: 47908 - DNA, 201 bp, Homo sapiens
tggaagggcacctcgggttcgggaggagctgtgagtggctgagccagctccttgaggatgtggccacttgacttgtggaaggccatcttgatgccaggacrcacaggaagcccctgtgtgacatcaggagcagaacagcaagctctctgtccctgcacccccaccatcttggggacctacaagggcctggactcagaggac

SEQ ID NO: 47909 - DNA, 201 bp, Homo sapiens
agggatgttctgagagctggggccggggttgttgtcatggagagagaaggagcagtttgggctgatggacagagctggatgctgacagactccaaacccaygggtggagagcggcagagttgggcaggggctagggccgagaccaccctccccttgccttcctccttttctgccctgcctttcactgcctgcagctggccc

SEQ ID NO: 47910 - DNA, 201 bp, Homo sapiens
tggggagagggtgcagccacccagtcgtttccctgtgtcttggagtctggtgtgggcacgaagggcagaagcacagcctggtggggggttcctcaacaccraccccatgttcctggcaggagccagagtgacccctcgacctgtcagccatgggggagatggagcaactgcgtcaggaagcggagcagctcaagaagcaga

SEQ ID NO: 47911 - DNA, 201 bp, Homo sapiens
gcacgggctcggatgacgcttcctgccgcttgtttgacctgcgggcagaccaggagctgatctgcttctcccacgagagcatcatctgcggcatcacgtcygtggccttctccctcagtggccgcctactattcgctggctacgacgacttcaactgcaatgtctgggactccatgaagtctgagcgtgtgggtaagggcc

SEQ ID NO: 47912 - DNA, 201 bp, Homo sapiens
ttccgctggggcctgcaaggcttgggctaccgcctccctgcgatgcaccatgggacttgtagtctcccacgctccactctgccgttgcctttcattaactrcggctgtcgtgtgactaccgtccccggaagccgccgcgctcacctctccggctccccgcttcgtggagcactgtgggcattgtagtcactcactgccttc

SEQ ID NO: 47913 - DNA, 201 bp, Homo sapiens
ctccttttctgccctgcctttcactgcctgcagctggcccgggctgggacagtgggcagtcagggtgctaagctgcttctggaggtgagcgagcgggtgcrgaccttgacccaggcctacttctccccggaacggcccctgcatctgtccttcacccacctggtgtgccgcagcgccatagaaggtacgacagggaccccc

SEQ ID NO: 47914 - DNA, 201 bp, Homo sapiens; identical to SEQ ID NO: 13728

SEQ ID NO: 47915 - DNA, 201 bp, Homo sapiens
acagatatcaccaggccctgggtgactgcattgctggggccatgcagggcctagctctccaccaagggaaagtgctgattttccttgtcatggtcctggcyttgctcccatgctcgtcctccagttttcagaagtcgtccagttccaagaatggctccttcctttagttcactaacattttcacttaggggtgaaggccgc

SEQ ID NO: 47916 - DNA, 201 bp, Homo sapiens
ggtctgatccctgacccacttgccacccgtgccctcagttcttccccaatggagaggccatctgcacgggctcggatgacgcttcctgccgcttgtttgayctgcgggcagaccaggagctgatctgcttctcccacgagagcatcatctgcggcatcacgtccgtggccttctccctcagtggccgcctactattcgctg

SEQ ID NO: 47917 - DNA, 201 bp, Homo sapiens; identical to SEQ ID NO: 13729

SEQ ID NO: 47918 - DNA, 201 bp, Homo sapiens
cgagaatgggagggtgagagcgggagtgaggaaggcgggaaggggaggcttgcatgatatgggatgccctctccccaggctgctggtaagtgcctcgcaaratgggaagctgatcgtgtgggacagctacaccaccaacaaggtaccagccctgcctccctgagcctccaccactgcatccttcctaagggcgccatgcct

SEQ ID NO: 47919 - DNA, 201 bp, Homo sapiens
ccacgctccactctgccgttgcctttcattaactgcggctgtcgtgtgactaccgtccccggaagccgccgcgctcacctctccggctccccgcttcgtgragcactgtgggcattgtagtcactcactgccttcgttgccgttctaagctaggggcgcagcccgaccgtcggactacatcccccaagtggacccttgaga

SEQ ID NO: 47920 - DNA, 201 bp, Homo sapiens
ttttttttcccttctgtcctccctccccgcgagtttcgggcgctggcttagagggttcccgctttctcaagggaaggggagctgccgagaccgcgctccgytccccagccgggccggatgcctcactgagcccaggtccgagtcagtcggggtaactcagggaaaggggagcctccgcctgggagtagaaggtcctttccg

SEQ ID NO: 47921 - DNA, 201 bp, Homo sapiens
tccaagcgtgctgcaaaggaactccaaggcgcccgcatcaccatcgccacccacccttcccagatggtgctgttttaaatacggatctgcagggctgaacrcagaactgggagatttattgcaaaatcccgggaggggcgggggggggtggtgtgcggaacggggaatggaggagcagaatttaaaggtgcaacgcttgct

SEQ ID NO: 47922 - DNA, 201 bp, Homo sapiens
gccttaaactccactagggcatcagagggagctgtaggcattattttctcctattttgatttatttaattaaattaaaaacattttttacaaatagttttyaaaatttcaggcctaatggaaagttttaactagtcttcctaagacagtatttccctctcccacagttagacactcaaagaaagcaggactcttcctctag

SEQ ID NO: 47923 - DNA, 201 bp, Homo sapiens
ccaaaggatccactccaaacttggaactttcctgaaaatagcatctcatttgggagcatgccaggaattggtgtctgggtcctttgtgtctttgcaccaaytcagaactctggatactagctctagaaactaagctgggatatattctgggtaagggagtagcatatctacttgggcatcttcctgatacatttatttcat

SEQ ID NO: 47924 - DNA, 201 bp, Homo sapiens; identical to SEQ ID NO: 13747

SEQ ID NO: 47925 - DNA, 201 bp, Homo sapiens
aagtcttctatggcctttggtttccttacctgtaaaacaggatggctcaatgaaattatctttcttctttgctataatagagtatctctgtgggaagaggraaaaaaaagtcaatttaaaggctccttatagttccccaactgctgttttattgtgctattcatgcctagacatcacatagctagaaaggcccatcagacc

SEQ ID NO: 47926 - DNA, 201 bp, Homo sapiens
tgcctgtaatcccagctctttgggaggctgaggcgggtggatcacctgaggtcaggagttcgagaccagcctggccaacatggtgaaactccgtctctacyaaaacttaaaaaatgagccaagtgtggtggcgcatgcctgtaatcccagctacttgggaggctgaggcaggagaattgcttgaacccaggaggcagaggt

SEQ ID NO: 47927 - DNA, 201 bp, Homo sapiens
ggaagactgaaggtaggagtaactaggaagcttaaataaacataaatataaaatgcttatagtgatagaattgacctcagccaattaaaattattaatagwaaaaacatgtcaatgtcaagcctactacctctgttctcacttgagtaatgaggattagtttatatttcccgacaagaatagatgggaattcaaatttctt

SEQ ID NO: 47928 - DNA, 201 bp, Homo sapiens; identical to SEQ ID NO: 13741
  misc_feature (1)...(201): n = A,T,C or G, or insertion/deletion polymorphism (see Tables 1-2)

SEQ ID NO: 47929 - DNA, 201 bp, Homo sapiens
tgcaagtcagcccgctcttgatgtctgtttatgtttagattccatcttttggaagatttcattcctctgcactatctcagtatctcagatgcttttgagamtgggtccttttcccctcctatgtttggccatggccaccccctcagggttgtgttgtgtttcacagctgctgtttgtagggttgacctttacaatgtacaa

SEQ ID NO: 47930 - DNA, 201 bp, Homo sapiens; identical to SEQ ID NO: 13742

SEQ ID NO: 47931 - DNA, 201 bp, Homo sapiens
attgctacaaagagaataaaatgcctaggaatacaacttacaagggatgtgaaggacctctttaaagagaactacaaaccactgctcaatgaaataagagrggacacaaacaaatggaagaacattccattctcatggataggaagaatcaatatcatgaaaatggccatactgcccaaagtaatttatagatccaatgct

SEQ ID NO: 47932 - DNA, 201 bp, Homo sapiens
cctctttaaagagaactacaaaccactgctcaatgaaataagagaggacacaaacaaatggaagaacattccattctcatggataggaagaatcaatatcrtgaaaatggccatactgcccaaagtaatttatagatccaatgctatccccatcaagctaccattgactttcttcatagaattagaaaaaactactttaaa

SEQ ID NO: 47933 - DNA, 201 bp, Homo sapiens
gttgatgagtgcagcaaaccaccatggcatctgtatacctaggtaacaaacctgcacgttctgcacatgtaccccagaacttaaaagtattattattattwtaataataataataataaaagaaatacaataaaatagaatgcagcatacagcagtgattctcaaacacattcagcatcagaattacccttgaatctttaa

SEQ ID NO: 47934 - DNA, 201 bp, Homo sapiens
catttccagagtcatcatccctgtacagaaaaatttttcccacatgatttcaccataaattcattaaatatgatgcttacttgataatttctccaggttctttttttttttaattatactttaagttctagggtacatgtgcacaacctgcaggtttgttacatatgtatacatgtgccatgttggtgtgctgcacccatt

SEQ ID NO: 47935 - DNA, 201 bp, Homo sapiens
catgatttggctctctgtttgtctgttattggtgtataggaatgcttgtgatttttgcacattgattttgtatcctgagactttgctgaagttgcttatcrgcttaaggagattttgggctgagatgatggggttttctaaatatacaatcatgtcatctgcaaacagagacaatttgacttcctctcttcctatttgaat

SEQ ID NO: 47936 - DNA, 201 bp, Homo sapiens
agagagctggatctgttggtttcaggacaagtctagaaataagaaatctgccttgagtgagtgagttggttccctctgttgctatttcaccattaaggacsaaaggaactcacaaggaccagagacatctggctgaaagcaatactagtgtgactggacatctactacctgccatagttggtcatatcgtttccagtatga

SEQ ID NO: 47937 - DNA, 201 bp, Homo sapiens
ttgtgtctctgtcaggctgtggtatcaggatgatgctggcctcataaaatgagttagggaggattccctctttttctattgattagaatagtttcagaatrgtaccagctcctccttatacctctggtagaattcagctgtgaatccatctggtcctgatggatttttttggttggtaggctattaattattgcctcaatt

SEQ ID NO: 47938 - DNA, 201 bp, Homo sapiens
tttctctctcgctgcacttaatgttttttccttcatttcaactttggtgaatctgacaattatgtgtctttgagttactcttcttgaggagtatctttgcrgcattctctgtatttcctgaatttgaatgctggcctgcctcactagattggggaagttctcctggataatatcctgcagagcgttttccaacttggttcc

SEQ ID NO: 47939 - DNA, 201 bp, Homo sapiens
ctttggctcatgctccgtgggttgtacccactgtctgacaagccccagtgagatgaacccggtacctcagttggaaatgcagaaatcacccgtcttctgcrtcactcacgctgggggctgtagactggagctgttcctatttggccatcttggaacctccctttccaagttctttattacagagtgggtcactgaaacttc

SEQ ID NO: 47940 - DNA, 201 bp, Homo sapiens
gagtctatgattttatgatggattttttttttttttacatacaaggatatgcatgggtcttttagtattcaggaatctgttcttcacttgacagtatttayaaattgtgtgtttccccctaaaaaaacttaaattgtgagaatgcttccatttactagaagttggttaatgattatgccaaataaggaaaataagacagaa

SEQ ID NO: 47941 - DNA, 201 bp, Homo sapiens
aaaattagccgggcatggtggtgggcgcctgtaatcccagctacctcctgctgaggcaggagaattgcttgaacccaggaggtggagattgcagtgagccragattgcaccattgcactccagcctgggcgacagagcaagactctgtcttgggaaaaaaacaaaacaaaacaagtgagaagggaatcaagtactacgtaa

SEQ ID NO: 47942 - DNA, 201 bp, Homo sapiens
tgtacctcataatttggtaattaattgtatatgcacttatataacaaaacattattgtgtgtctttgctgtatcagattctaggctggaagttgtagataygatgtttttgtctagaaaaatgttctagaatgtcctactcaggacagtctgttgactttaaagacacatttcctaaacagacacttcatgaggcagcccc

SEQ ID NO: 47943 - DNA, 201 bp, Homo sapiens
aggagaattgcttgaacccaggaggtggagattgcagtgagccgagattgcaccattgcactccagcctgggcgacagagcaagactctgtcttgggaaaaaaacaaaacaaaacaagtgagaagggaatcaagtactacgtaagatgtaatgtggaattttagggaaggaaggcagtgtatgctggagtaattagagaaa

SEQ ID NO: 47944 - DNA, 201 bp, Homo sapiens
ccccaaaaagatactttttttagacttgtattaagacaataaaaagtttaatcagcatgcttcatacctaaatatgcttcactttatagcaaagtttacawgactaaaactgttttgttgtaattctctgagtctcatgtgtttattaatgattttttctgctgtttattcatctgaattctactcattcttcaagaccta

SEQ ID NO: 47945 - DNA, 201 bp, Homo sapiens
agattttattctgacttgaaataaattttctaattagaaacttccaggtgagagcaaaggcctggaacaatattcctgagccagaggaggatcgagtttgwctccaggcctaacacttactaggtctatgaccttgggtcagtaatttaaattctctgtatctcaacctctcaacagggtattggtagggattaaatgtgt

SEQ ID NO: 47946 - DNA, 201 bp, Homo sapiens
gacaagccccagtgagatgaacccggtacctcagttggaaatgcagaaatcacccgtcttctgcgtcactcacgctgggggctgtagactggagctgttcmtatttggccatcttggaacctccctttccaagttctttattacagagtgggtcactgaaacttcatggaacaaattggaaattatcttcttaattaatgt

SEQ ID NO: 47947 - DNA, 201 bp, Homo sapiens
gtatttaaacctaggaaacatagagtggctttggtatttgtaggcttagtcatgtgtgtcctaaacgtcctcttaaacttctacttaaggcatagaattayttaatcctaaataattttatacttaagtgcctcactggatttccagaatatttacactgtaaagatttagaaaggtcatgaacccaattattgactatat

SEQ ID NO: 47948 - DNA, 201 bp, Homo sapiens; identical to SEQ ID NO: 13746

SEQ ID NO: 47949 - DNA, 201 bp, Homo sapiens
tttttaaatgtataacactagccttttaaattgtattgtgctactaaaagaaattgtgcctgcattcatcttacaacctgggaaccaacgcagagggtctstggggtagcggtatccagcttcatgccctctgtcctttattgctttctggttagcctgcgtatttcacatacattaaatattccacaataaactctgcca

SEQ ID NO: 47950 - DNA, 201 bp, Homo sapiens
ctagtaatcttttaaagcaaagtaatatgtaattgggaacgttgattttctaactgcatataaaaggcgacatgatattaaatgagacccctccctactgrctcaatatcctgcaaaatctctctctcccctttattattatcgaaaaatctatttttatatgagtttgttgtaaggtcaaaagccattttggtcttacaa

SEQ ID NO: 47951 - DNA, 201 bp, Homo sapiens
cttttttccttttttaaaagccattttaagtacttcagtcttgaatcaaatgatcccaaatattggacaccaacctagaaattgggttacctcctgggaastttatcgaagaagagagattttggttggagagggggttttgatgtttgatacttatatttactattttaatatttcattgttgttgttgctgctgctgct

SEQ ID NO: 47952 - DNA, 201 bp, Homo sapiens
ttccagggccataaagtcgttgtcttttttttcttctacttcattttgtaaaatgtgataaatgttggtaaatatagaccagtagtaagtattatgacackaaaagcattatgtatgtggaactattttaagttattacagaacattttctatttataaatgatataagcagaaagaaatgatttccagataaacaaggct

SEQ ID NO: 47953 - DNA, 201 bp, Homo sapiens
ctgggccctgccccacccctactaaatcacaatttcaggaggagggaccttcattttaacactcacccaggtgatttttatgctccgaggaggtccagggwctccaagttaagtacggtactgctgtcttattctttattctaaattttaaggtctgcacaaattggttgaactaatgagaagaaaattcagctttaaagc

SEQ ID NO: 47954 - DNA, 201 bp, Homo sapiens
tttttcatttttttcatgaagaatttaaaatttggctgtagaaaatctctcactccaaacatcacacagcctaaataggtgagtctcaaaaataagctaaygttcatctttcatctgattcaatgtcctgaaaccctttggtttaaatttgttaattcttctcatggcttttctcctagcaaaaccaactaataccacagc

SEQ ID NO: 47955 - DNA, 201 bp, Homo sapiens; identical to SEQ ID NO: 13743

SEQ ID NO: 47956 - DNA, 201 bp, Homo sapiens; identical to SEQ ID NO: 13745

SEQ ID NO: 47957 - DNA, 201 bp, Homo sapiens
tacctttgagagaaattatatcagtatataataagcacctgagaatatgaaagcacaaatccaatttaaatgtgaaaggtctacaacttgggattttaaakggagtacagaaaagccactgtttcttaaacaattttgttgagggggaaaacagtgaaagctaaatgttctattcaagagttgtttcttttgaaaataatg

SEQ ID NO: 47958 - DNA, 201 bp, Homo sapiens
ggagaattgcttgaacccaggaggtggagattgcagtgagccgagattgcaccattgcactccagcctgggcgacagagcaagactctgtcttgggaaaaaaacaaaacaaaacaagtgagaagggaatcaagtactacgtaagatgtaatgtggaattttagggaaggaaggcagtgtatgctggagtaattagagaaag

SEQ ID NO: 47959 - DNA, 201 bp, Homo sapiens
gagaattgcttgaacccaggaggtggagattgcagtgagccgagattgcaccattgcactccagcctgggcgacagagcaagactctgtcttgggaaaaaaacaaaacaaaacaagtgagaagggaatcaagtactacgtaagatgtaatgtggaattttagggaaggaaggcagtgtatgctggagtaattagagaaagg

SEQ ID NO: 47960 - DNA, 201 bp, Homo sapiens
agaattgcttgaacccaggaggtggagattgcagtgagccgagattgcaccattgcactccagcctgggcgacagagcaagactctgtcttgggaaaaaaacaaaacaaaacaagtgagaagggaatcaagtactacgtaagatgtaatgtggaattttagggaaggaaggcagtgtatgctggagtaattagagaaaggg

SEQ ID NO: 47961 - DNA, 201 bp, Homo sapiens
cctcaaagaacttacctttcagctgaagactgactagaatgagcaaatacggttaacaattaacaagtgagtaggccagctcggccaacatggtgaaaccmtgtctctactaaaaatacaaaaattagccgggcatggtggtgggcgcctgtaatcccagctacctcctgctgaggcaggagaattgcttgaacccaggag

SEQ ID NO: 47962 - DNA, 201 bp, Homo sapiens
gaattgcttgaacccaggaggtggagattgcagtgagccgagattgcaccattgcactccagcctgggcgacagagcaagactctgtcttgggaaaaaaacaaaacaaaacaagtgagaagggaatcaagtactacgtaagatgtaatgtggaattttagggaaggaaggcagtgtatgctggagtaattagagaaagggg

SEQ ID NO: 47963 - DNA, 201 bp, Homo sapiens
aaccattgttagaaaaggtaggagataccactgttccaacaaaaagtattgagtttggtgttgcacccacttaacttcaaggccttacaagtgagtagacagttagttagaattgcagaagtgccactcagagagcagggcttgcaatgtggggttggactttgtcaccattgtgttaattcctaattctatgcagatgct

SEQ ID NO: 47964 - DNA, 201 bp, Homo sapiens
accattgttagaaaaggtaggagataccactgttccaacaaaaagtattgagtttggtgttgcacccacttaacttcaaggccttacaagtgagtagacagttagttagaattgcagaagtgccactcagagagcagggcttgcaatgtggggttggactttgtcaccattgtgttaattcctaattctatgcagatgctc

SEQ ID NO: 47965 - DNA, 201 bp, Homo sapiens
ccattgttagaaaaggtaggagataccactgttccaacaaaaagtattgagtttggtgttgcacccacttaacttcaaggccttacaagtgagtagacagttagttagaattgcagaagtgccactcagagagcagggcttgcaatgtggggttggactttgtcaccattgtgttaattcctaattctatgcagatgctca

SEQ ID NO: 47966 - DNA, 201 bp, Homo sapiens
cattgttagaaaaggtaggagataccactgttccaacaaaaagtattgagtttggtgttgcacccacttaacttcaaggccttacaagtgagtagacagttagttagaattgcagaagtgccactcagagagcagggcttgcaatgtggggttggactttgtcaccattgtgttaattcctaattctatgcagatgctcag

SEQ ID NO: 47967 - DNA, 201 bp, Homo sapiens
gcagaaaaagaagcactagctgcctattccaaaatgtgtaaaacaccactcagctttttaaaagtaggataaactcagagcgcgcgcacacgcgcgcgcgcacacacacacacacacacacagagagaacatctctagtaaaaagaaaagttgagctttcttagctagatgtgtgtattagccagaaaaagccaaggagtg

SEQ ID NO: 47968 - DNA, 201 bp, Homo sapiens
ttcaccacctgacggtaaccttgggttggtccataggtatgttttcattttgcttgttcatccattttaattggcttcctagagcatgcttgtagatgtaragccaaatttagagtagagcaaccctctggcaaacaggaagagattaattttgtggtatgcttttaagggacttcccaggaaacttcaaaagcagaaaaa

SEQ ID NO: 47969 - DNA, 201 bp, Homo sapiens
cagaaaaagaagcactagctgcctattccaaaatgtgtaaaacaccactcagctttttaaaagtaggataaactcagagcgcgcgcacacgcgcgcgcgcacacacacacacacacacacagagagaacatctctagtaaaaagaaaagttgagctttcttagctagatgtgtgtattagccagaaaaagccaaggagtga

SEQ ID NO: 47970 - DNA, 201 bp, Homo sapiens
gagagctctggctggcatctggtgggtgcccctctgggacaaaccttccagaggaaggaacaggcagcagtctttgctgttctgcagcttctgctggtgayacccaggcaaacagggtctggagtggacctccaccaaattccagcagacctgcagcagaggggcctgactgttagaaggaaaactaacaaacaggaatag

SEQ ID NO: 47971 - DNA, 201 bp, Homo sapiens
gccctgagttctaacataaactttcttcatgacataaggcaagtcttctatggcctttggtttccttacctgtaaaacaggatggctcaatgaaattatcwttcttctttgctataatagagtatctctgtgggaagaggaaaaaaaaagtcaatttaaaggctccttatagttccccaactgctgttttattgtgctatt

SEQ ID NO: 47972 - DNA, 201 bp, Homo sapiens
tttcgtgtctctgggaggaaaaatgcttaacagtctaagtcttgtaaccttgaggtctttaacaacttaaataaacctcaaaagtgtcacgtcatcctctacacacacacacacacacacacacacacacactcaacttgtaagatgacatggtttcacctaaactgttgtggaaatgaatagcactttaaaaatggtgca

SEQ ID NO: 47973 - DNA, 201 bp, Homo sapiens
ttcgtgtctctgggaggaaaaatgcttaacagtctaagtcttgtaaccttgaggtctttaacaacttaaataaacctcaaaagtgtcacgtcatcctctacacacacacacacacacacacacacacacactcaacttgtaagatgacatggtttcacctaaactgttgtggaaatgaatagcactttaaaaatggtgcac

SEQ ID NO: 47974 - DNA, 201 bp, Homo sapiens
atttaatgagttgcttattttaattttacaactgctacctcagaagtatctcaaattatctttctttggctggtgtctttctctgctgatctgctactgckgtgtgtgtgtgtgtgtgtgtgtgtgtgtgtgtgtctgtgtgtgtgtgtgtatgggcgtgtgtgtctctgtgtgtgttttctagtgggaatttaacaagca

SEQ ID NO: 47975 - DNA, 201 bp, Homo sapiens
gctggtgtctttctctgctgatctgctactgctgtgtgtgtgtgtgtgtgtgtgtgtgtgtgtgtgtctgtgtgtgtgtgtgtatgggcgtgtgtgtctctgtgtgtgttttctagtgggaatttaacaagcagtgagtctcttaaatttacatgccataatctatgtcaagaacattgcgtactacttagcaataaaaat

SEQ ID NO: 47976 - DNA, 201 bp, Homo sapiens
ctggtgtctttctctgctgatctgctactgctgtgtgtgtgtgtgtgtgtgtgtgtgtgtgtgtgtctgtgtgtgtgtgtgtatgggcgtgtgtgtctctgtgtgtgttttctagtgggaatttaacaagcagtgagtctcttaaatttacatgccataatctatgtcaagaacattgcgtactacttagcaataaaaata

SEQ ID NO: 47977 - DNA, 201 bp, Homo sapiens
agaaaaagaagcactagctgcctattccaaaatgtgtaaaacaccactcagctttttaaaagtaggataaactcagagcgcgcgcacacgcgcgcgcgcamacacacacacacacacacagagagaacatctctagtaaaaagaaaagttgagctttcttagctagatgtgtgtattagccagaaaaagccaaggagtgaa

SEQ ID NO: 47978 - DNA, 201 bp, Homo sapiens
ggaggctgaggtaggagactaacttgaaccatggagacagaggctgtagtaagccgagatcatgccattgcactccagcctggcaaaaaaaaaaaaaaaaraaagaaagaaagaaagaaagaattgctcactgtaatgactttcatgccatggactcaactctcttggcagtctggtaaagcttatgtaaacccttctcat

SEQ ID NO: 47979 - DNA, 201 bp, Homo sapiens
tccaaaatgtgtaaaacaccactcagctttttaaaagtaggataaactcagagcgcgcgcacacgcgcgcgcgcacacacacacacacacacacagagagracatctctagtaaaaagaaaagttgagctttcttagctagatgtgtgtattagccagaaaaagccaaggagtgaagggttttagagaactggaggagata

SEQ ID NO: 47980 - DNA, 201 bp, Homo sapiens; identical to SEQ ID NO: 13744

SEQ ID NO: 47981 - DNA, 201 bp, Homo sapiens
gaaaactacaaattttgctattattattgttattacttcccaagtctcttattgatctgttagaaatagagctacacaggaaattgtaggacagttagtaygtggtagtgttatctgctttttaattattcaagtaaggttttattccattagaggaactcaagaagttggtcatggctgataattgctatctgtcaaatt

SEQ ID NO: 47982 - DNA, 201 bp, Homo sapiens
ggacacccctcccccagcctcgctgctgctttgcagttcgatctcagactgctgtgctagcagtgagccaggctccgtgggcatgggaccctccgagccargcctgggacataatctcctggtgtgccgtttgctaagaccattggaaaagcacagtattagggtggggagtgtcctgattttccaggtaccgtcagtcat

SEQ ID NO: 47983 - DNA, 201 bp, Homo sapiens
atcatgccattgcactccagcctggcaaaaaaaaaaaaaaaaaaaagaaagaaagaaagaaagaattgctcactgtaatgactttcatgccatggactcarctctcttggcagtctggtaaagcttatgtaaacccttctcataaaaatgtctaaatggggccaggcgcgacggctcacacctgtaatctcagcactttgg

SEQ ID NO: 47984 - DNA, 201 bp, Homo sapiens
tgaaccgtgacacttcagaagagctgggagctggggtagagcagtggctaggagaacatattcaattatatttcctcctgcattaagctacaagtaatgakcactttcctgtgctttacagttaagtaattaaaagaaattatagagtgggatgcaaaaataacccgaaggacaactggatgtgtggagccaccagttttc

SEQ ID NO: 47985 - DNA, 201 bp, Homo sapiens
ctgaggcacgagaatcacttgaatctgggaggtggaggttgcagtgagccgagattagccactgcactccagcctggatgacacagtgagactttgtctcaaaaaaaaaaaaaaattctaagtgaatgaaataaatgtataagattacaaaggaagccagtggcattgatgtacagttataaaaacatttaaaataatata

SEQ ID NO: 47986 - DNA, 201 bp, Homo sapiens
tgtgtatgacagacacatgtctccaacaactatatgttcacaaggactaagagccatccttttgggtccatcattcaacattgatctcacattcgtgttcrtatcagtatctttacagtgcgctcccagttacatctccctaatttcccttagtaggcttcacagaatttgcagtgtatgcaatggcagatgaccacatgt

SEQ ID NO: 47987 - DNA, 201 bp, Homo sapiens
agcagaaaaagaagcactagctgcctattccaaaatgtgtaaaacaccactcagctttttaaaagtaggataaactcagagcgcgcgcacacgcgcgcgcrcacacacacacacacacacacagagagaacatctctagtaaaaagaaaagttgagctttcttagctagatgtgtgtattagccagaaaaagccaaggagt

SEQ ID NO: 47988 - DNA, 201 bp, Homo sapiens
gttccccctggaacattgggttaggatcatattagaacataaccaaaaagaaataaagattcagacgaattcacaattaatttttaagccccacaaaagtkaaataggtagcattattttttcaagctgtgaaactttccctcattttagtaatagagaaaatgttcagattataaacttggaaactttgctcctaacata

SEQ ID NO: 47989 - DNA, 201 bp, Homo sapiens
gtcctttataatgtagtacaagtattttttttaaatgtataacactagccttttaaattgtattgtgctactaaaagaaattgtgcctgcattcatcttacaacctgggaaccaacgcagagggtctctggggtagcggtatccagcttcatgccctctgtcctttattgctttctggttagcctgcgtatttcacataca

SEQ ID NO: 47990 - DNA, 201 bp, Homo sapiens
ttaatgggagatctgttttccagatgactatacatgtggaaaggagaagttttttgagtgttttttttaaccccttttaaagaatggtttttcatttagtstctacatttgggggtaaaaggtcctctagggagacttttcaaaagtatttgaagtttgcatctgatttcagaggtgagttggaggcctatctgtgtatga

SEQ ID NO: 47991 - DNA, 201 bp, Homo sapiens
cctattccaaaatgtgtaaaacaccactcagctttttaaaagtaggataaactcagagcgcgcgcacacgcgcgcgcgcacacacacacacacacacacavagagaacatctctagtaaaaagaaaagttgagctttcttagctagatgtgtgtattagccagaaaaagccaaggagtgaagggttttagagaactggagg

SEQ ID NO: 47992 - DNA, 201 bp, Homo sapiens
tgatagtatagcagagaacttgtttacattctttttacattcatcttctaaaacctggggtgctctctctctctctctctctctctctctctctctctctstgtgtgtgtgtgtgtgtgcgtgcacgtgcgcgtgtgtgtagagggggagagagagagagagagaactgtgaactgtgaaatataacacagccagcagctt

SEQ ID NO: 47993 - DNA, 201 bp, Homo sapiens
gcctcttgtgtaagaggaggcctcggcttgagataacataggatagtaagcctcctagagaaatttctatatggaaacatggtctgctatgaagctagaartgagaggacattatatttgaccattatatttggcttcagagcttctcaacatggggcccaaagtcaaggtcccttgtttcattaagaggaggtccaggag

SEQ ID NO: 47994 - DNA, 201 bp, Homo sapiens
atagtatagcagagaacttgtttacattctttttacattcatcttctaaaacctggggtgctctctctctctctctctctctctctctctctctctctgtstgtgtgtgtgtgtgtgcgtgcacgtgcgcgtgtgtgtagagggggagagagagagagagagaactgtgaactgtgaaatataacacagccagcagctttg

SEQ ID NO: 47995 - DNA, 201 bp, Homo sapiens
ctacatcacactcatctaaactgcaagtttgacaagttgacatccaaaagaaaggctctcctaaataacctcgccacagaaatttgggtgacctttgtagytctggagaaagcagaggcaaaaatgaaacctaaaaattatttgtgggtttttaaaaaatgttttctcatggagtaaaggtctacagctgagttcttttca

SEQ ID NO: 47996 - DNA, 201 bp, Homo sapiens
ttcagaaagtgggtaaaaacagactcctccaagctaaaggagcatgctctaacccaatgcaaagaagctaagaaccttgaaaaaaggttggaggaattgcyaactagaataactagtttagagaagaacataaatgacctaatggagctgaaaaacacagcacgagaactctgtgaagcatacacaagcttcaataactga

SEQ ID NO: 47997 - DNA, 201 bp, Homo sapiens
ggaagcccatcagactaacagtggatctctcagcagaaaccctacaagcctacaagccagaagagagtgggggccaatattcaacattcttaaagaaaagwattttcaacccagaatttcatatccagccaactaagcttcagaagtgaagtagaaataaaatcctttacagacgagcaaatgctgagagattttgtcacc

SEQ ID NO: 47998 - DNA, 201 bp, Homo sapiens
aatgccccaattaaaagaccacagactggcaaattggataaagagtcaagacccatcagtgtgctgtgttctggagacccatctcacatgcaaagacacayataggctgaaaataaagggatggaggaagatctaccaagcaaatggaaagcaaaaaaaaagcaggggttgcaatcctagtctctgataaaacagacttta

SEQ ID NO: 47999 - DNA, 201 bp, Homo sapiens
taggctgaaaataaagggatggaggaagatctaccaagcaaatggaaagcaaaaaaaaagcaggggttgcaatcctagtctctgataaaacagactttaarccaacaaagatcaaaagagacaaagaaggccattacataatgataaagggatcaattcaacaagaagagctaactatcctaaacatatatgcacccaata

SEQ ID NO: 48000 - DNA, 201 bp, Homo sapiens
gaatctctgggacacagctaaaacagtgtttaggggaaattcatagcaataaatgcccacaggagaaagcaggaaagagctaaaatcaacactctaacatyacaattaaaggaactagagaagcaagagcaaacacattcaaaagctagcagaagacaagaaataactaagatcagagcagaactgaaggagattagagac

SEQ ID NO: 48001 - DNA, 201 bp, Homo sapiens
tctgtcaccactcctattcaacatagtattggacgttctagccagggcaatcaggcaatagaaagaaataaagcatattcaaataggaagagaggaagtcmaattgtctctgtttgcagatgacatgattgtatatttagaaaaccccatcatctcagcccaaaatctccttaagctgataagcaacttcagcaaagtctc

SEQ ID NO: 48002 - DNA, 201 bp, Homo sapiens
tagccgggcgtggtggcggatgcctgtagtcccagctactcgggaggctgaggcaggagaatggcgtgaacccaggaggcagagcttgtagtgagcctagrtcgcgcaactgcactccagcctgggcaacagagcgagactccatctcaaaacaaagcaaaacaaaacaaaacaaaactcctatgcccagtccacacccca

SEQ ID NO: 48003 - DNA, 201 bp, Homo sapiens
ctgtagagtagacagcacagaaggtttacctgatgtcagagttacagttatcccacttaaccatgagaaaagatagaaaaaaactattgtataactatttrgagataccattgccattgataacattccaacattgtagtgtcttttttgatttttgctacaaaactacaagtatattttctactggttcttgaagatatg

SEQ ID NO: 48004 - DNA, 201 bp, Homo sapiens
attacaccaagttagtcaccactttgctaatttgattcttgttattatctctgtggcagtggctctcaaacttaacctgcacataaaaatcacctgggaarctttaaaaactcctatgcccagtcaaccgggcgcggtggctcacgcctgtaatcccagcactttgggaggccgaggcgggtggatcacgaggtcaggaga

SEQ ID NO: 48005 - DNA, 201 bp, Homo sapiens
cactaaacaggatttgtgtgagcaataaagctgtttatttcacctgggtgcaggtgggctgagtccgaaaagagagtcagtgaaggtagataggggtgggsccgttttataggatttgggtaggtaaaggaaaagagggggttgttctctggcaggcaggagtaggggtcacaaggtgctcagtaggggagcttttgagcc

SEQ ID NO: 48006 - DNA, 201 bp, Homo sapiens
gctgagaaaatcttttgggattatctggttaagttcccttttcacaggtgaggcaaattaaggcacagacaggtgagccagacactagtctcctaacttayggctcagtgttggaagcagtggctacctccttttttttttgcccacccccccccactcctgtaatttttgtcttttatttcctttgaaagaaatctggtt

SEQ ID NO: 48007 - DNA, 201 bp, Homo sapiens
atgaacattatggtgctgacccttttgaagtattgtactcttctttttctcttctgctgtctaatacacttcaggaggaaaaaaaggaaatggttgtataygctgttcatatttctcttcagtcacagcatgatacaaaaaggaagggaaggggtttgattaggagttgagacctatctactgatatttgcttacttgcga

SEQ ID NO: 48008 - DNA, 201 bp, Homo sapiens
agttacaaggaagagggtgaaagcagttggcatagaatgagctattttctttatcagctgattttaatgtgcatgttgtgtccattcccaggtagataggkttctgaatgagttaccatcttccaaaaaaacatattgttttaccaagaaataatttagtcccagtagagttctgccacagcatgttcattgctttggaga

SEQ ID NO: 48009 - DNA, 201 bp, Homo sapiens
gggcctggaggccagaagtaggtcattcttaaaacaaaaattgggattgtttttcatttttctgcagcttttccctttgtgagatctgtttcagcacaatrgttacatttgggagtgaattactctcttttaaacaaatagatattatttgcatatgctaaaaattccattcatgatttagttgctaattgtttatctagc

SEQ ID NO: 48010 - DNA, 201 bp, Homo sapiens
ataaatggagttggccttgatcgctcaggtgtttatgtacaagagttttccagcaagcgtattttagttgtaacattccagtgaataatcagaagtcagtytggggtaagtaccttagaaataaatagcttttgaataagtatgtatgcaataacattgcctatgaatgtttagtagagtatggaatggcatttcaattta

SEQ ID NO: 48011 - DNA, 201 bp, Homo sapiens
tagtttgatacttattagaaagtgtatttcctgttcaaaaacattgattgggattctactgtgggcaagaggctgggacagatgtaaagcaataggttccwtattgataagatggttaccacctattgataaaatggaatagtacaagatttgtgcaagaaattcactaagacagccgggagcggtggctcacgcctgtag

SEQ ID NO: 48012 - DNA, 201 bp, Homo sapiens
tatcatctgacttagttattctcccatttcacagataagaaaactgaggcactgagaagataaattgattgccattcaatgagtattgacagagaaggatyagctctcgtgtctattgggtcacagccttattagtttgatacttattagaaagtgtatttcctgttcaaaaacattgattgggattctactgtgggcaag

SEQ ID NO: 48013 - DNA, 201 bp, Homo sapiens
agagaaggaaaagtgagatttttttctttctaaattcagaggacagaaatttgttattgtttaatcacactaatacagcattacatgtaaaatgcattcayttttttactaaattaatgtcttctgatttgttaaaggaacaatttgcttatgtatttagttcattaacaattttaacttatcagaacctgtttatgaatt

SEQ ID NO: 48014 - DNA, 201 bp, Homo sapiens
gacattagccatttacttcaaaacttctctctagagaaggaaaagtgagatttttttctttctaaattcagaggacagaaatttgttattgtttaatcacrctaatacagcattacatgtaaaatgcattcacttttttactaaattaatgtcttctgatttgttaaaggaacaatttgcttatgtatttagttcattaac

SEQ ID NO: 48015 - DNA, 201 bp, Homo sapiens
gcaagtaatttaaaaccaggtaccaattatgatagttccttgagtgtagactatttcttgtaccaaatagtctccttctgtccgttgttatacttagcctrccattgcaacagtgctagcacccaccttcacctaaaagagttatctttacacctccctcctattcagcattcagagtcctccaacatttcccagtataaa

SEQ ID NO: 48016 - DNA, 201 bp, Homo sapiens
ttcttggagacaaaaaaaaaaaattactgagtttgaaaactgtctgtgacatgtaccaccagtggggtctcaggagagtcacttgaccattttgagttgtrgttttatcaatataaaatgtggataatgatacttattgctagatttttcagtctaaataataatgcataagccccaacctcaattgacaggaagaaatac

SEQ ID NO: 48017 - DNA, 201 bp, Homo sapiens
atggatatagaagaagtggaaaaactaattactgctcaacaaatcctaaaatggctctctgagatgcaagaagaggaagtagaaataagcctccctaggtyggtgatgttattttattatacgagttcttacgtttccactcacataggaatttgagcagtcagctgaaaggtaacaaatacttgaaaagtctattgacac

SEQ ID NO: 48018 - DNA, 201 bp, Homo sapiens
gtgctataaaactggtggattttcaagatgcaaaggcttgtgcagggatgataagtacctgggtagaaagaaaaacagatggtaaagtttcccattttcayaaaattattatttgccattgtattcatggtttttaatatcctaaagtaaagaatggctgaatattttcctactgcagtatggatcagaggaatcaaatat

SEQ ID NO: 48019 - DNA, 201 bp, Homo sapiens
gttgtctctattttataggcatacacatccctgtgatcatgagtctggctcaaagccaatttatagcaaatcatccatttctgtttattatgaagcataayccaacaggtaccttttttgagaattatttgggggaactgattatgttaagcagaactagttccagtttctaattgcaatgtacatatctgaagtcatttg

SEQ ID NO: 48020 - DNA, 201 bp, Homo sapiens
ttctgtctttactaaaaacaccaaaattagctgggcatggtggcaggtgcctgtaatcccagctacttgggaggctgaggcaagagaatcagttgaacctkggaggtagaggtttgcagtgagctgagactgcgccactgcactccagcctggcaacagggtgagacccagtatccaaaaaaaaaaaaaaaaaaaaaagcc

SEQ ID NO: 48021 - DNA, 201 bp, Homo sapiens
tccctaggttggtgatgttattttattatacgagttcttacgtttccactcacataggaatttgagcagtcagctgaaaggtaacaaatacttgaaaagtmtattgacacaaatgaaaatacaaatgtatttggaaattttactctacttttggatactaaagcagggcttacctgtgctagcattgctttaccatgagaa

SEQ ID NO: 48022 - DNA, 201 bp, Homo sapiens
gaaggattcactgtgaaagaacagtatctccatggcaacaaggaattttttcagagtgctataaaactggtggattttcaagatgcaaaggcttgtgcagrgatgataagtacctgggtagaaagaaaaacagatggtaaagtttcccattttcataaaattattatttgccattgtattcatggtttttaatatcctaaa

SEQ ID NO: 48023 - DNA, 201 bp, Homo sapiens
accagtgaacaaatacaaaaacaaggtaatttcaaatggtaataactgatgacattaataaagcagaagaagaaaataagaggggttcaataattgagatratgtaataagatcactacccaagtttcactttaagtacatattcttacagtgtgttcctaatgtatttgttttccttaataagatttgctaaaagtctgc

SEQ ID NO: 48024 - DNA, 201 bp, Homo sapiens
ctctgacccataagctacttgaggtgaagagctaggcatgtttcctctctgtgactgcagcaaaaagcatgtatataaaaaatagtagctattcaatgagsatttgttgctttaaactgagtagtggtaataacctggatttgttaaagagggaaagactaaagcctaaaagatcagttaaaaaaccactgcaacaactcg

SEQ ID NO: 48025 - DNA, 201 bp, Homo sapiens
ggtgggaggatcgcttgaggccaggggttcaagaccagcctgggcaacatagtgatatccggtctacataaaaattaaaaataatagccaggtgtggtggygcatgcctgtggtcccagctactcgagaggataaggcatgaggatcacgtgagtccaggaggttgaggctgcagtaaactatgattatgctactgtactg

SEQ ID NO: 48026 - DNA, 201 bp, Homo sapiens
cagttaaaaaaccactgcaacaactcggacattaagtaaagagtgtttaaagggagcagcctcactgggaatagtaaggaactggtgaaattattgaaatstgtgactaactagatatgggttaagaagaaataggttgtttgggggttccaggctcaacttactagaaaacaagagggctgtgaattcttgctgttttgt

SEQ ID NO: 48027 - DNA, 201 bp, Homo sapiens
ccctgtacagcctttggaactgtgaaccaattaaacttcttttctttataaattacccagtctcaggtatttcttttttcttttcttttcttttcttttcttttttttttttttgagactcgtatttctttatagcagtgtgagaatagcctaatacaccaagaatgattcaagcccactgtaccaaagctgggatttcag

SEQ ID NO: 48028 - DNA, 201 bp, Homo sapiens
tgtcagagttacagttatcccacttaaccatgagaaaagatagaaaaaaactattgtataactatttggagataccattgccattgataacattccaacaytgtagtgtcttttttgatttttgctacaaaactacaagtatattttctactggttcttgaagatatgtaagaaataccattaacacatgaactatttttc

SEQ ID NO: 48029 - DNA, 201 bp, Homo sapiens
aaattaaggcacagacaggtgagccagacactagtctcctaacttatggctcagtgttggaagcagtggctacctccttttttttttgcccaccccccccmactcctgtaatttttgtcttttatttcctttgaaagaaatctggttccccttcctttatccttttatagggcctatttaaaagatattaggcctgtccat

SEQ ID NO: 48030 - DNA, 201 bp, Homo sapiens
gaaattttagacttgttagaaagaagccaagcaattgagaccttagatagaacttagaattctcgccgagttttgttgggtaattgttacttcaaaaaaaratgcaatttctgttccctctttcctccaaccatttatctgggaagcaagttattggcaacccagagctgattgttggagccggggaaaatggtgtgaaat

SEQ ID NO: 48031 - DNA, 201 bp, Homo sapiens
gtatgcaataacattgcctatgaatgtttagtagagtatggaatggcatttcaatttactttggtgtaaaaatcatttgaatttatttaattaacatatcrcttttattctccttaaatgatttcaccacaaatcagaagatccagttcttataggactattcatcaggttgtttagttcagcattactttgtgctttctg

SEQ ID NO: 48032 - DNA, 201 bp, Homo sapiens
ctcataggcattctgaaatatttatgacaaagtgcattggtaatctgatgtaggagtcctgtgagaaacaaaaagaactaattactagcaaatttacaacsagtagcgcatcctttcaaattctgtgcaacttttaaaagaagcaaaataatggataaaataataatataaatttaatacttttaaaaaattctataattg

SEQ ID NO: 48033 - DNA, 201 bp, Homo sapiens
ttatatattacaaatatttattgcgagccaattatgagccaggcagttttctagagcatgcttcctttgtcctctgaggaacattgtcagatctatcttgwcttgcaaggccagcttgacatggcttctgggctccgggtttcacttcttccttcttgaggagactatacttgcaattcactctaccagaaacgcttcaca

SEQ ID NO: 48034 - DNA, 201 bp, Homo sapiens
atgaataattctccccccaccccgattttctaggagcaaaatagaattgtagaaaaaagcggtttgggaaaatattttaaaaatttgtggtaatattttayggacaattgtattgtcgtcattgtctattaaaagaggttaaaccagggagaataaatttatggctattgctttttactcctcaagagacaggaaaatgaa

SEQ ID NO: 48035 - DNA, 201 bp, Homo sapiens
ctcagctcatatccacaccagaacaaaacgttgtaaagcacgatcttatgctgaaaattttaacaggttttaaagtgtatctctgaagtgattttgtaacwggtgacacagaagttccttagaatttcatagcttccccagatttgaaggcaagtacattttattttaaactacgatcaaaaccaaatacagaatataaaa

SEQ ID NO: 48036 - DNA, 201 bp, Homo sapiens
ccaatcatgttatcatactaagattatatttgactgttttataattctaatgatacatagtgattttatttttcctggggtctgaaaataacagtacaaartaattcaattattgggaaatacagtatctgaattaagcataaaacatttaatctagataggaaaaatatctaactttttatattttcctattctaaatat

SEQ ID NO: 48037 - DNA, 201 bp, Homo sapiens
aagcatgaagataaaaaataatcatttttgcttcagtctgcctctaaattcttcactattatgtcaagggagattttattaatctgcccaatttagtagtragtagattgatgatggcatgaagattcaattcaaaatgtgattcttcctggagaaagagacagattgaaaaggctgggactaatgggttttatgtaacat

SEQ ID NO: 48038 - DNA, 201 bp, Homo sapiens
attcccctgtatttagaaaatggttatttttccacatgttaactccttacacaaaatgacttttcctgtctacaaaatgtattatgaatatactttctttwctgatcttttaatgcaagtatctaaataactgttgtctctattttataggcatacacatccctgtgatcatgagtctggctcaaagccaatttatagcaa

SEQ ID NO: 48039 - DNA, 201 bp, Homo sapiens
tcttcagtactttggtttttaaatttattgcaaattcccctgtatttagaaaatggttatttttccacatgttaactccttacacaaaatgacttttcctrtctacaaaatgtattatgaatatactttctttactgatcttttaatgcaagtatctaaataactgttgtctctattttataggcatacacatccctgtga

SEQ ID NO: 48040 - DNA, 201 bp, Homo sapiens
acttattacattgcacttttatttcttgctcacattcctgtctgtcctattaaaatgtgatttctgggacagcgggttaggtcttgctcattttagtttckgttgttcctagcatgcttcatggtatatagtatgtgctaaatgagtattattgaattaaattacacaaatattttcaaggaaagaaattctatattattt

SEQ ID NO: 48041 - DNA, 201 bp, Homo sapiens
taaataaataaataaatgtaattaattgagatctaataggtaacggcttttgattttaactcttaaatacacttttgtgtatttttttttaaccagattcwtctgaagtgtatgtttcccaagtgacgcaaaaagttttctttgagataaatgaagatggtagtgaagctgcaacatcaactggtagggtgaatgatttct

SEQ ID NO: 48042 - DNA, 201 bp, Homo sapiens
atgtttatatttaagctacagtagaaaggagcatgtgagtgactatttagattatagttactgcttaagaaatacttctcctttccctcttttgtgtatawctagtttagaattgaggccaataagatatcatctcaaaatactcgagtgcttcccattatttattatctgtaatatactagatatataattttggacatc

SEQ ID NO: 48043 - DNA, 201 bp, Homo sapiens
gagatgataactgtaaccctttgctgtggtttttatatatattcctaggcttatactttacagtcggacagtaatggcgatcaaccttctaccaagacacsttggctctcattaatgaataattctccccccaccccgattttctaggagcaaaatagaattgtagaaaaaagcggtttgggaaaatattttaaaaatttg

SEQ ID NO: 48044 - DNA, 201 bp, Homo sapiens
ccttgtaataaaatacaggatagccaggtgtggtggctcacatctgtaatctcagcactttgagaggcttaggtgggaggatcgcttgaggccaggggttyaagaccagcctgggcaacatagtgatatccggtctacataaaaattaaaaataatagccaggtgtggtggcgcatgcctgtggtcccagctactcgagag

SEQ ID NO: 48045 - DNA, 201 bp, Homo sapiens; identical to SEQ ID NO: 13758

SEQ ID NO: 48046 - DNA, 201 bp, Homo sapiens
ttttctgtgtcttactcttcttttgtaactcacagcatctaattttctaggcaggtagcaggatctcacctgtcaactcttaacagaactgaaggcattayaaactgtttctgaaattaacattcagattcaattacttatgatccatttttctgtggtaaaaggaattggtcacattaaaataggatatgtcataatttt

SEQ ID NO: 48047 - DNA, 201 bp, Homo sapiens; identical to SEQ ID NO: 13759

SEQ ID NO: 48048 - DNA, 201 bp, Homo sapiens
agagaaaaaagaccaaatgacatgttaaatattaagaaaaactaattattgtcagttgttttctcctgaaattcctaaagtatatttttttgttttttttyccctagaatcaattctgtttatgggaagagtgacaaatcctgacacccaggagataaaaggaagagatttagattcactgtgaatgaaaagcacagcctc

SEQ ID NO: 48049 - DNA, 201 bp, Homo sapiens
tcacaaggtaatgctatcagttaaggcagaaacaggccattttcatttcttttgtggtggaatgtcatcagttaaggcaggaaccggccatctgtatgtgkacgtgcaggtcacaggggatatgatggcttagcttggcctcagaggcctgacattcctgtcttcttatattaataagaaaaataaaatgaaatagtggta

SEQ ID NO: 48050 - DNA, 201 bp, Homo sapiens
gactgggtctctatatttagaagaacacctctctgtcactttatttttgtttccctctatgaaaaacaggattaatgctttttccatgacaagctgtagtrggtgttaatttacctcataaattaccagaaaatgattaataatgatataattatgaatttgagacaaaggagaaggctttgctattagacactgcctatt

SEQ ID NO: 48051 - DNA, 201 bp, Homo sapiens
aaattatattttactcatctctgtattcaggccaatatttggcaaaatgccttgcacatagtatcagtttccctatagacagagggtgtgaaattgggttsggctcaatttccagctgaattcactaacagttgtgaaacaagttgcttgtcctttctaagccacattttccctatatcttatttgaacataatagtagtg

SEQ ID NO: 48052 - DNA, 201 bp, Homo sapiens
ttgcagaatctgaatctattagatgaactagcgatactgatattattggcccagtaagggatacttcactcttttttggctccatgaaactaatgctgagmgacccttctgaaagtcatatcttaaaaacaatgaaacagttttagaattgatgagattgcattaacacaacttcaattctagtaatggctgtgtcagtgt

SEQ ID NO: 48053 - DNA, 201 bp, Homo sapiens
agtttctaattgcaatgtacatatctgaagtcatttgttctttcagtggatatttgttaagtgcattttatataccaggaattgtattttaagagatgacmgaggcctaaaatagggcagtggtaataatggctgccatcatggctactatatgtggtagccatttcatataaccatcagtaaagctaaaaccactccaga

SEQ ID NO: 48054 - DNA, 201 bp, Homo sapiens
actgttttatgttctttattgtagtgagactttctaaactagggttactcctttaaagtattgtttaaaataaatggccgctcatttatcagggactgtcygttgttgccatataaaatgtagaaagggccgttatcttaagacaatacatatttagtgatttatcaatttttctctcacaaatgaactcaagaaatcatt

SEQ ID NO: 48055 - DNA, 201 bp, Homo sapiens
ttgcgaattggattacctgtgaattagcagataggacttgtggataaaactttagggctcaaatataaaatcattattttttaggaatgctcacccttacrtaattgtattttatttcattctttcattacaccaagttagtcaccactttgctaatttgattcttgttattatctctgtggcagtggctctcaaacttaa

SEQ ID NO: 48056 - DNA, 201 bp, Homo sapiens
cagataggacttgtggataaaactttagggctcaaatataaaatcattattttttaggaatgctcacccttacgtaattgtattttatttcattctttcaytacaccaagttagtcaccactttgctaatttgattcttgttattatctctgtggcagtggctctcaaacttaacctgcacataaaaatcacctgggaagc

SEQ ID NO: 48057 - DNA, 201 bp, Homo sapiens
gaagatgatgtgaagagacacagggaaaaaaatggccatctacaaatcaacaagagaggcatagaacaaatttttccctcacggccttctgaagaatccarcactgctgacatcttgatttaagacctctagcctctgcaactgtgagacaatctatttgttatttaagatacccagtttgtagtactttgttatggcagc

SEQ ID NO: 48058 - DNA, 201 bp, Homo sapiens
agccctgaagacttacattacatgcataaaatgatgattgctaatgccttaaatttaaaactctaccacgctcatcaccgttttattatgctatgttctcyggactgggtctctatatttagaagaacacctctctgtcactttatttttgtttccctctatgaaaaacaggattaatgctttttccatgacaagctgtag

SEQ ID NO: 48059 - DNA, 201 bp, Homo sapiens
ctgaaaaaggagaactgggaagttgcacttttagccctgaagacttacattacatgcataaaatgatgattgctaatgccttaaatttaaaactctaccaygctcatcaccgttttattatgctatgttctccggactgggtctctatatttagaagaacacctctctgtcactttatttttgtttccctctatgaaaaac

SEQ ID NO: 48060 - DNA, 201 bp, Homo sapiens
ggccatattattgattgacagcagaatttgaacgcaactcatgttccctgactttaagttcagagctctttatgttattgcccactgtctctcattttaartctaaaattttctaggattctgtaacaatcattaagagaaggtagatgaatcaaagtaaaactcctcagaatagtcagtctgggtattttgactttcaga

SEQ ID NO: 48061 - DNA, 201 bp, Homo sapiens
ctatcttgtcttgcaaggccagcttgacatggcttctgggctccgggtttcacttcttccttcttgaggagactatacttgcaattcactctaccagaaaygcttcacatatacatcagttccaccaaggggagaaaaaggagcattcactctcagctcatatccacaccagaacaaaacgttgtaaagcacgatcttatg

SEQ ID NO: 48062 - DNA, 201 bp, Homo sapiens
tttgaaaatactagagatataaaaatattgtcattggaggtaaagtaagctttgattcagagctgaaaaaggagaactgggaagttgcacttttagccctkaagacttacattacatgcataaaatgatgattgctaatgccttaaatttaaaactctaccacgctcatcaccgttttattatgctatgttctccggactg

SEQ ID NO: 48063 - DNA, 201 bp, Homo sapiens
gcccactgtctctcattttaagtctaaaattttctaggattctgtaacaatcattaagagaaggtagatgaatcaaagtaaaactcctcagaatagtcagyctgggtattttgactttcagaaatccactcacggactgctcaaaagcaaaaaaagtccaagtattcactgtaaatgggaatgggagtaaaactgatcttg

SEQ ID NO: 48064 - DNA, 201 bp, Homo sapiens
aatgtatgtaaatcatctagtttaacatttggcacatagttaaatataaaacagcaagtgggaaaagtatcacattaatattacttgcacatctagcaaaygtattgttttcttgttctcttaatttaataacaatgtacttagaattttcatttaaaaattaagagaaataatgactatgaaggtataatgaatgagttt

SEQ ID NO: 48065 - DNA, 201 bp, Homo sapiens
atcattttattagctttaaaattatgcaaaatttgtcgcctttgaaattaacctttatgacatccgagcataaggaacttaaggcaacatttgacactgaytgatttaggccacttctcttaacccagtttaaaagaaaggtgaatagattttggtacatcattctttctgttttgtcctttagttcttagttccttttca

SEQ ID NO: 48066 - DNA, 201 bp, Homo sapiens
cactgcacaaatcctaaaagctctgagctcacagaataattttgaaagagtaagtaaaaaaaaaaattaatttgagctcagatgtgattaccacaaacccraagtgcaaatatacctaaataggaattaggaattacaaacattgtagaaataaatcatataatgcaaataaaaagtgaacagaaaattactgtttaaaag

SEQ ID NO: 48067 - DNA, 201 bp, Homo sapiens
aaatatcattttattagctttaaaattatgcaaaatttgtcgcctttgaaattaacctttatgacatccgagcataaggaacttaaggcaacatttgacaytgattgatttaggccacttctcttaacccagtttaaaagaaaggtgaatagattttggtacatcattctttctgttttgtcctttagttcttagttcctt

SEQ ID NO: 48068 - DNA, 201 bp, Homo sapiens
ttgcttcttcattgagcatacatataaagttagaattattctgtgagtgacctaatatttattcttcagtactttggtttttaaatttattgcaaattccyctgtatttagaaaatggttatttttccacatgttaactccttacacaaaatgacttttcctgtctacaaaatgtattatgaatatactttctttactgat

SEQ ID NO: 48069 - DNA, 201 bp, Homo sapiens
tggactgaatagtagagttaataaaaaagggccgtcccactattatttcaaatgcatttaaatatcattttattagctttaaaattatgcaaaatttgtcrcctttgaaattaacctttatgacatccgagcataaggaacttaaggcaacatttgacactgattgatttaggccacttctcttaacccagtttaaaagaa

SEQ ID NO: 48070 - DNA, 201 bp, Homo sapiens
tctttgatggtgtaaaaatcttgaatacataagagggaaattttagacttgttagaaagaagccaagcaattgagaccttagatagaacttagaattctcrccgagttttgttgggtaattgttacttcaaaaaaaaatgcaatttctgttccctctttcctccaaccatttatctgggaagcaagttattggcaacccag

SEQ ID NO: 48071 - DNA, 201 bp, Homo sapiens
tgcactccagcctgggtgacagagcgagactccgtctcagaaaacaaaacaaaacaaaacaaaaaaataaaataaaatctgctggagtttatgtctatttycatgttatttgttcttcaaagagtgtgtctttggactgaatagtagagttaataaaaaagggccgtcccactattatttcaaatgcatttaaatatcatt

SEQ ID NO: 48072 - DNA, 201 bp, Homo sapiens
gagaaacaaaaagaactaattactagcaaatttacaacgagtagcgcatcctttcaaattctgtgcaacttttaaaagaagcaaaataatggataaaatartaatataaatttaatacttttaaaaaattctataattgtttttttctcaattcttgcacatttcatcagttgatcattaacccgattgtgttagttctta

SEQ ID NO: 48073 - DNA, 201 bp, Homo sapiens
atttcatcagttgatcattaacccgattgtgttagttcttaatacaaatgtagtgaacacctgcttttgttctagaggaattaatcaagcaatggtcaagrtaaatggagttggccttgatcgctcaggtgtttatgtacaagagttttccagcaagcgtattttagttgtaacattccagtgaataatcagaagtcagtt

SEQ ID NO: 48074 - DNA, 201 bp, Homo sapiens; identical to SEQ ID NO: 13762

SEQ ID NO: 48075 - DNA, 201 bp, Homo sapiens
tagaaagttttctgttgagctctctgtggaaaactctattttgaaaatgaatatattttgatttaaacaatacagagaagtcaaaatggacacaatcttcktgtggagtcttctattgctgttttttggaagtcaagcctcaagatgctcagctcaaaaaaataccgaatttgcagtggatctttatcaagaggtttcctt

SEQ ID NO: 48076 - DNA, 201 bp, Homo sapiens
tgcagtgttggccgagaactcggatgattatgatctcatgtatgtgaatttggacaacgaaatagacaatggactccatcccactgaggaccgtaagttcrctttaactgtttctctgctaaccctgactacatatccacctcttggtctaaataacacacatatactttgtggccagtgagacaagttaaaaatttatag

SEQ ID NO: 48077 - DNA, 201 bp, Homo sapiens
caattggctttcctttttctcattttctttgctctgcagagattacagtggaagcttcttaagtcgtaatgtagggtttcacatagctttcaattgtaatmattaaaattcttatgttaaataactaatgccagaataattctgaattaatttatattttctttaatattcttcttattttcttgctactctaggttgtga

SEQ ID NO: 48078 - DNA, 201 bp, Homo sapiens
ttctgttttgtgctctctggtctgcagtgttggccgagaactcggatgattatgatctcatgtatgtgaatttggacaacgaaatagacaatggactccakcccactgaggaccgtaagttcactttaactgtttctctgctaaccctgactacatatccacctcttggtctaaataacacacatatactttgtggccagt

SEQ ID NO: 48079 - DNA, 201 bp, Homo sapiens; identical to SEQ ID NO: 13771

SEQ ID NO: 48080 - DNA, 201 bp, Homo sapiens
tcacttgagagtctcctcccgccagctgtggaaagaactttgcgtctctccagcaatgcatctccttgcgattctgttttgtgctctctggtctgcagtgytggccgagaactcggatgattatgatctcatgtatgtgaatttggacaacgaaatagacaatggactccatcccactgaggaccgtaagttcactttaac

SEQ ID NO: 48081 - DNA, 201 bp, Homo sapiens; identical to SEQ ID NO: 13774

SEQ ID NO: 48082 - DNA, 201 bp, Homo sapiens; identical to SEQ ID NO: 13773

SEQ ID NO: 48083 - DNA, 201 bp, Homo sapiens; identical to SEQ ID NO: 13776

SEQ ID NO: 48084 - DNA, 201 bp, Homo sapiens
aaagtattcctcagtcctaaggagccctaaagagagttgtggaggtaaccatcacagtcttgaaatagacgtctagggccccttacacccgatccgactargcgctgcaggagtccactggcccgttataaccgtgatccctcttgccgcccagcttccctccgttagggatttccacgtcttctaattttatcctgcctc

SEQ ID NO: 48085 - DNA, 201 bp, Homo sapiens; identical to SEQ ID NO: 13777

SEQ ID NO: 48086 - DNA, 201 bp, Homo sapiens
gtctcaaaaaaaaaaaaaaatgtattctgcaataacatcactatcctagaattttgctgaaaaatgcatgttggtaaaggctaaatggagcgaactaggtytactgaatttcacaggtttattattttaggaacttggtggtggcaaaaagagagaaccaggttgggttctgaattcttggaaattatagaattattgtct

SEQ ID NO: 48087 - DNA, 201 bp, Homo sapiens; identical to SEQ ID NO: 13779

SEQ ID NO: 48088 - DNA, 201 bp, Homo sapiens
tggcaccaccgagggaggtcagcttttacaaagcacatccaaggcaggcctgggcgggctgctaacgtgtgtgtatcccgtactctagccacgccgtgcgmctgcggtcaggagcactcggaatgggacaagctcttcatcatgctggagaactcgcagatgagagagcgcatgctgctgcaagccacggacgacgtcctg

SEQ ID NO: 48089 - DNA, 201 bp, Homo sapiens
tgagagtggtcgctcgaggtgctgctcagtcactggggcgactactttttgcccagtgtcctctggaaaagaaagatctggaggatcaggctactcttttkcttcgaaataatgagggggtgcagaagggtagggacaaacctctccctcctttgccactttagctttagctggcaaacaaacctgctctgtcacctcttc

SEQ ID NO: 48090 - DNA, 201 bp, Homo sapiens
ttataccttaataaagctaaggaaaaaaaaaagaaaatccagaataaatatgcatggtatgacccatttatttaaaaaaaaaaagagggaatgcgaagcartggttttggtgcgaacacaaaaattctggcttcaacagcatttaaattcccaaaccaagcatgtttatgttttaattctttgtggccataaattgtacag

SEQ ID NO: 48091 - DNA, 201 bp, Homo sapiens
ctccagctcctggaccataaggttctccacccagtaggcatcccgctcactgtaagaaacaaatgcatcatagcagatgttcctgctgggagctttcctgmgcttccttttggcctggagccaggcccacatcattttcatataccacaggccatggaaacggtggcacaggacccccgtgagcaggatcagcaggaacag

SEQ ID NO: 48092 - DNA, 201 bp, Homo sapiens; identical to SEQ ID NO: 13785

SEQ ID NO: 48093 - DNA, 201 bp, Homo sapiens
ctctggtactttccggaacactgtgaaaaacaattatataaagggtgtggacctataagacaaacaaccaaacaaaaatcgcaaagtgttcttttaaaagwttcgtggaaaggactctgataagtacaggtttctgataactttaagatcatactactggactgggtaagaatttccagaactctagcaaagaagtggatt

SEQ ID NO: 48094 - DNA, 201 bp, Homo sapiens; identical to SEQ ID NO: 13787

SEQ ID NO: 48095 - DNA, 201 bp, Homo sapiens
caaagagtcacttgttttactctggtactttccggaacactgtgaaaaacaattatataaagggtgtggacctataagacaaacaaccaaacaaaaatcgyaaagtgttcttttaaaagtttcgtggaaaggactctgataagtacaggtttctgataactttaagatcatactactggactgggtaagaatttccagaac

SEQ ID NO: 48096 - DNA, 201 bp, Homo sapiens
tgacgttgaacaaactttggaagcttctagatgggcttctggaatatctcaaaagaaattgttttctctcctgataaaaaagagagatattaaactaattrggcttatttgatatgttatattgcatgggaagaattgttaaattataagtgatgctgaactttctttaagtcatattgtatgggtatgttattaatatgt

SEQ ID NO: 48097 - DNA, 201 bp, Homo sapiens
tgctcttatacaataacaccagtaagtgaatgctgagttggaaaaattagcaaatctagggtcttttttggatctattctatttatttgaggtttatggayttgctttttgattagctgcagctctgcctcagcttcttttgttaattgctgagggctagtgagactaggatctcctctaaggatagaaaatagattactc

SEQ ID NO: 48098 - DNA, 201 bp, Homo sapiens
caacagtgcacatgccttgatcttagacttcccagcctccagagctataataaatacatttctgttctttataaattacttggtctctggtattttgttayagaagcactaatggactaagacaaaaagattccattatgaaagtgaaaaggcaaccgcagagtggcagaagcttttggagatgatgaatatgtttacttc

SEQ ID NO: 48099 - DNA, 201 bp, Homo sapiens
ttaaatgttggaccaaggatttcaaccatgcagtatgttgcttctggggtctgctgtcctattccagccctagtgaatagttaatgccttgaactattccyatcaccacaggttgccaggccaccaaataacgaagccaatccaggatttgtccatacagaaaatgtgtgcgctcccagctaaatctcagttaaggaggtt

SEQ ID NO: 48100 - DNA, 201 bp, Homo sapiens
gaacaaggaggaagaagaacgtatttgaagaagaataaggaactctattaagtgtatatctcctatatattgagatacacatttgaaatacatctatcacytagatattgagatatattatacatttaatatagtgtgttgctggtatagggatagaaaaatgaacattggatcagaatagcactgaaacaagatctaccc

SEQ ID NO: 48101 - DNA, 201 bp, Homo sapiens; identical to SEQ ID NO: 13788

SEQ ID NO: 48102 - DNA, 201 bp, Homo sapiens
ggtcttttttggatctattctatttatttgaggtttatggacttgctttttgattagctgcagctctgcctcagcttcttttgttaattgctgagggctartgagactaggatctcctctaaggatagaaaatagattactcagggcataggtgggaatgcctagagcaggtcatatccgattaatgtcccctagtaattt

SEQ ID NO: 48103 - DNA, 201 bp, Homo sapiens
acctccctcgggaggccgaggggggcggtggccccggcccggccctcccgcttccctcacggcctggccctcccgcttccctgattcccggtagggtcgcyctccccgcctcctggcccctcttggctcggatgacaaagattgggtaaaggctttcaacgagctagcgtctggcagggggtgtgtcctcgctcactggtt

SEQ ID NO: 48104 - DNA, 201 bp, Homo sapiens
gtaacaaaatacctgagactgggtaatttacaaagaacagaaatttatccattcatggttctggagtctgggaagtccaagattgaagggctgcatctggwgagggtcatctggctacattataacatgatggaaagcatcacatggtgagagagagcaagagaggacagaacttacttttataacaaactcattctcaca

SEQ ID NO: 48105 - DNA, 201 bp, Homo sapiens; identical to SEQ ID NO: 13780

SEQ ID NO: 48106 - DNA, 201 bp, Homo sapiens; identical to SEQ ID NO: 13782

SEQ ID NO: 48107 - DNA, 201 bp, Homo sapiens; identical to SEQ ID NO: 13783

SEQ ID NO: 48108 - DNA, 201 bp, Homo sapiens; identical to SEQ ID NO: 13786

SEQ ID NO: 48109 - DNA, 201 bp, Homo sapiens
ttaagtgcatatattagaaatgaagagtgacgaaaaatgaatgagcaagcaaataccttaaaaactggaaaaggaatagtaaaataaatccagagaaatcrgaacaggggaaataataatataagaatagaaattaatgtgctagaaaataggggatctatcaagtcagaagttgattttttgaaaatgctaataaaaatg

SEQ ID NO: 48110 - DNA, 201 bp, Homo sapiens
tttgagtaatttaaaaggaaaaggctcaaatgtagctataatatttccctgttgatctacggggtatattctaacagggaactgctaagcctctatatcaycctctcttctaacttgctgaattcctggctgaatagaactgagagtggtcgctcgaggtgctgctcagtcactggggcgactactttttgcccagtgtcc

SEQ ID NO: 48111 - DNA, 201 bp, Homo sapiens
accatgcagtatgttgcttctggggtctgctgtcctattccagccctagtgaatagttaatgccttgaactattcctatcaccacaggttgccaggccacsaaataacgaagccaatccaggatttgtccatacagaaaatgtgtgcgctcccagctaaatctcagttaaggaggttgttctatatacagccaagtagcag

SEQ ID NO: 48112 - DNA, 201 bp, Homo sapiens; identical to SEQ ID NO: 13789

SEQ ID NO: 48113 - DNA, 201 bp, Homo sapiens
agaaacatagagtgtggagtgggaaatcaggggattcacagccttcagagctgagagccctgaacagagatttacccacgtatttattgacagcaagccgrtgataagcattatttctgtagattatagattaactaaaagtattccttacaggaaacaaagggatgggccaaaacaaagcgatgggctctggctagatat

SEQ ID NO: 48114 - DNA, 201 bp, Homo sapiens
gaatgtatcagggaattcatttttttatccccattcattcgttccattcatctgtttctctctctctctctctttgtgtgtgtgtgtgtgtgtgtgtgtgkgtgtgtgtgtgtgtgtgttatgcctagaaaacatttctcaagaattagaattacgatatgctgtcaaacacaatgacttatttgaacctcttttatttgt

SEQ ID NO: 48115 - DNA, 201 bp, Homo sapiens
tgaaaatttgacattgttctatacctcttaatttgcactatggtataaaaaggaactttctagcaggtacgaatccctctaaatgggcatcttttgttcaratgctccttccctggcttggaataaatgtaaatgaggttatgattagaaatccccttcaaacattagctactacagctcactctactgcaaaggctatat

SEQ ID NO: 48116 - DNA, 201 bp, Homo sapiens
cttattatttcatctgacaattacaatatactttatgtgaaaaagacatagactgtgtgttttgttttgttttttcgaaacagagtctcactcttatctcycagcctcaacacactggactcaaacgatcctccaacctcagcctcctgagtagctggggttacagctacaaaccatcatgcctggctaatttttgaattt

SEQ ID NO: 48117 - DNA, 201 bp, Homo sapiens
aaatgtttttaaagtatcaaatagaaataaatctcacaaaatatgcttaagaactttaagcaaaaaccataaaatactattgtgataagttaaagaagacytaaataaatggagagatctgtcatgctcatggattggaagattcaatactgtaatgatatgaatagttcccaaattgttctatagattcaaaacattgcc

SEQ ID NO: 48118 - DNA, 201 bp, Homo sapiens; identical to SEQ ID NO: 13781

SEQ ID NO: 48119 - DNA, 201 bp, Homo sapiens
aacccatgggtcaaaaaataatcagaatgaaaatcagaaaatatttttaatgacttatgaaaaaaattacatataaaaacttgtcagatgcacctaaactrttgcttaaaggaaacttacaaccttaagtgcatatattagaaatgaagagtgacgaaaaatgaatgagcaagcaaataccttaaaaactggaaaaggaat

SEQ ID NO: 48120 - DNA, 201 bp, Homo sapiens
taaaattaaaaaaattaatattaaatgttggaccaaggatttcaaccatgcagtatgttgcttctggggtctgctgtcctattccagccctagtgaatagwtaatgccttgaactattcctatcaccacaggttgccaggccaccaaataacgaagccaatccaggatttgtccatacagaaaatgtgtgcgctcccagct

SEQ ID NO: 48121 - DNA, 201 bp, Homo sapiens
aatgttgactgtggtcaccctgttttgctatcaaagaataaatcttattcattttatctaagtatatttgtgtacccattaaccatcccagtccccctgcwcctccaactacacttcccagcctctgttaaccatcattctactctcttatctccatgagttcaattgttttaatttgtagctcccacaaataagcgagaa

SEQ ID NO: 48122 - DNA, 201 bp, Homo sapiens
acaaagtcctgctcttatacaataacaccagtaagtgaatgctgagttggaaaaattagcaaatctagggtcttttttggatctattctatttatttgagrtttatggacttgctttttgattagctgcagctctgcctcagcttcttttgttaattgctgagggctagtgagactaggatctcctctaaggatagaaaat

SEQ ID NO: 48123 - DNA, 201 bp, Homo sapiens
tccgaattctcccatttcttatcatcgtagccatttgatccaaataaggagttagagtctgtgaattagtatgtggaagaaaaagccactgtacaaagtcytgctcttatacaataacaccagtaagtgaatgctgagttggaaaaattagcaaatctagggtcttttttggatctattctatttatttgaggtttatgga

SEQ ID NO: 48124 - DNA, 201 bp, Homo sapiens
tagacagcactgaaagagctgcattctccttcctcccttctccactactgagaaggcctgacaaagcaaatgcctcacatgggcaaggctggccgtcgccrtggttcccttactgataccaggtgggatccccaaacattccctcaactccagttcacagcagacacgagccttgactcttatgttccacaacttaattcc

SEQ ID NO: 48125 - DNA, 201 bp, Homo sapiens
tgctgagaatgctgggcagaccccctgccagggcctgaaatgctgccattggtgactcaaccttttgtcttcaaaactgcaagggagaaaaaaaatctcayactagggggcaccacagcttttatcagcaatcccattagaggctaaggctgagaggcatgagagtgcaaggtaagtgtctgaaagatggtgagtgggaag

SEQ ID NO: 48126 - DNA, 201 bp, Homo sapiens
ccaggggaggcctcttccttccagaggagtgaaatgtgcccgccttggcctctgcctgcctgtttaccatactcttctccagtcgaggaataaagccgtcrgaagctcccccagcccctgctcgctttcatcctcaccagcacctggcggtgttcagacctttcctctacacggtgggatccactagattctcatctgaaa

SEQ ID NO: 48127 - DNA, 201 bp, Homo sapiens
ctgattcacctctcaacctgggcggggtacacaaaggactgtacacaagatgaaatgaggattatttttggtcaaatgttcccaagaagggggcaaaagtraaacaaaaggaggctggcagcccctgacacaagactagcaggtagtttccgccgcaaactgaaccttatcagcttaacacacccacacagcagccctgag

SEQ ID NO: 48128 - DNA, 201 bp, Homo sapiens
gcagccccacatgggagttcactctgtgggtgatgagttttccccaacctctgcctctccaaaagaacttctaatttccctttcccaaagatctgcaggakagtggttggctagtatttgtgagtggctcagaagggagttcatcatagtctttgtgttcaaagaatgttctaagaactagtacattaactagctttgggg

SEQ ID NO: 48129 - DNA, 201 bp, Homo sapiens
aaatgggcacagtggtagcgcctaccccacagggaggcactgaggacgcctggcctcacacagaggaagggcaataggactaaagcagttttcagggccargtgggtttaaaagtcctgcattctagtccttggcctccaactccttgggcttctactgtgaggaccaaatgacccagcactaagatccttccctgactca

SEQ ID NO: 48130 - DNA, 201 bp, Homo sapiens
aaaaaaaaaaaaaaaaaaaaattcaatcatgtcattccccactgggtccaccttcatggtggagttaaggggagggagatttcgaaaagggaacgcatagstattggttaatagcttctctgcgcctctgtcctcacctgtaaaatgggcacagtggtagcgcctaccccacagggaggcactgaggacgcctggcctcac

SEQ ID NO: 48131 - DNA, 201 bp, Homo sapiens
ggaaggaatagaaggccagcaggccagtgctgagaatgctgggcagaccccctgccagggcctgaaatgctgccattggtgactcaaccttttgtcttcaraactgcaagggagaaaaaaaatctcacactagggggcaccacagcttttatcagcaatcccattagaggctaaggctgagaggcatgagagtgcaaggta

SEQ ID NO: 48132 - DNA, 201 bp, Homo sapiens
cctgtgaggtaagcagggctggcattactcccactttagagccaaggaacagttcagaggtgaactcacttgcccaaggtaccacagcggtgtgtggaagrgacgcgacacaaggtcagggctgactccagtccccaagccctcttcctcctcactggtctgatggacagagacagcgcacagtggcccaggggaggcctc

SEQ ID NO: 48133 - DNA, 201 bp, Homo sapiens
gtgacctggagcagcagcgccatctctgggcttcagtcttctcccagagcacaaaggactctgggtctgacctcactgtttctggaaggacatgggggctyagagtcctaaacagactgtttcccccttccagcagagaaaggagtcgaagaagccaccagccaagctgcagccccgagctctagcaggctggctccgccc

SEQ ID NO: 48134 - DNA, 201 bp, Homo sapiens
aaaggagtcgaagaagccaccagccaagctgcagccccgagctctagcaggctggctccgcccggaagatggaggtcaagcagaaggggcagaggatgaamtggaagtccgggtcggtacctctgcagttttatgcttctgtggcagcgaggagggtggggtcaggggagagggagggcagggagaggtggcagtgaacag

SEQ ID NO: 48135 - DNA, 201 bp, Homo sapiens
tgtttctggaaggacatgggggcttagagtcctaaacagactgtttcccccttccagcagagaaaggagtcgaagaagccaccagccaagctgcagccccragctctagcaggctggctccgcccggaagatggaggtcaagcagaaggggcagaggatgaactggaagtccgggtcggtacctctgcagttttatgcttc

SEQ ID NO: 48136 - DNA, 201 bp, Homo sapiens
gatggggatgggcatgacctctgacatctcctgggtcctccctgccctgcctcctagttcaacgccccctttgatgttggaatcaagctgtcaggggttcwgtaccagcagcacagccaggccctggggaagtttcttcaggacatcctctgggaagaggccaaaggtgagtcctgcctggactgggtttgctcggtttcc

SEQ ID NO: 48137 - DNA, 201 bp, Homo sapiens
caaacgccagtcatcctatataaggacctgacagccaccaggcaccacctccgccaggaactgcaggtaagctctctctactctccgtgtgcgtttgctgmcaggtttattgtccgtgactgctgcccgtccgtttaacctctctgggcctcaggagtcccctctaaacacgggggatgtcggactgtctggctggaagac

SEQ ID NO: 48138 - DNA, 201 bp, Homo sapiens
gttgacttctacccagaggacaagaacatttttagttcccaaggaatgtacatcagccccacggaagctaggccacctctgggatggggttgctggtttaraacaaacgccagtcatcctatataaggacctgacagccaccaggcaccacctccgccaggaactgcaggtaagctctctctactctccgtgtgcgtttgc

SEQ ID NO: 48139 - DNA, 201 bp, Homo sapiens
taaacttttcatccacttgataaaatgctgatattacagaaacgtgtttcacttctcatgagcacgtgcttttaatagattacacaaactccaaggatttyacaatcgtttatcagcacactgacatttaataggaagagtaactttatgtgaagctactttttgtcctaactgtggaactgatattaaaaggcacacttg

SEQ ID NO: 48140 - DNA, 201 bp, Homo sapiens
taaaatgctgatattacagaaacgtgtttcacttctcatgagcacgtgcttttaatagattacacaaactccaaggattttacaatcgtttatcagcacaytgacatttaataggaagagtaactttatgtgaagctactttttgtcctaactgtggaactgatattaaaaggcacacttgaacagtgtgagttgttcact

SEQ ID NO: 48141 - DNA, 201 bp, Homo sapiens
aatagattacacaaactccaaggattttacaatcgtttatcagcacactgacatttaataggaagagtaactttatgtgaagctactttttgtcctaactktggaactgatattaaaaggcacacttgaacagtgtgagttgttcactgcctgctaatgaaggctcatgcaagtatgtatgttcacgttactaaaaaatta

SEQ ID NO: 48142 - DNA, 201 bp, Homo sapiens
gtggaactgatattaaaaggcacacttgaacagtgtgagttgttcactgcctgctaatgaaggctcatgcaagtatgtatgttcacgttactaaaaaattrcaatgattataaccagagtaagcagctgaaataatctggtaattttaataataaatgcttttgaagcaaagtgggttcactgagggtaatattttttgtt

SEQ ID NO: 48143 - DNA, 201 bp, Homo sapiens
tctcaaaaaaaaaaaaaagaaatgtcacggtgaaagggatgatggggcttggacaggatgctagcaaggaagtgacaagaagccctcagtttctacatagygtttgaaaacaaagcaacagggttggatgagagattggatgtagtggatgagaaaaggcgaggaaaagaagacctctaggtttgcaccatattagaattc

SEQ ID NO: 48144 - DNA, 201 bp, Homo sapiens
tgtcacggtgaaagggatgatggggcttggacaggatgctagcaaggaagtgacaagaagccctcagtttctacatagcgtttgaaaacaaagcaacaggrttggatgagagattggatgtagtggatgagaaaaggcgaggaaaagaagacctctaggtttgcaccatattagaattctaagcaggggtgttgttaggca

SEQ ID NO: 48145 - DNA, 201 bp, Homo sapiens
aaaattttagtgtcaaaagattaccaaatgattatttagtcagaatctatttcaaaattgtgtaattttaaacaagatatctaattcactttttttgtttmgaatatattttttcacatgtactatagatcctatggtgacgaaatattaaataatttagtgacttttttatatatccagaaaacattggcttttttttga

SEQ ID NO: 48146 - DNA, 201 bp, Homo sapiens
agggttggatgagagattggatgtagtggatgagaaaaggcgaggaaaagaagacctctaggtttgcaccatattagaattctaagcaggggtgttgttasgcagtgcatatatgggtttgtagttgagagacgagctatgggcaagagataaagacttaagagtcatcagccttctagattatatttaaagcaatgaggc

SEQ ID NO: 48147 - DNA, 201 bp, Homo sapiens
agaaaaggcgaggaaaagaagacctctaggtttgcaccatattagaattctaagcaggggtgttgttaggcagtgcatatatgggtttgtagttgagagaygagctatgggcaagagataaagacttaagagtcatcagccttctagattatatttaaagcaatgaggctagtgagatcaccaagggagtgaaaataggag

SEQ ID NO: 48148 - DNA, 201 bp, Homo sapiens
tattatatatattttttatttatggatgctacaattgtgttcttcccctatctatgactctgcttagattggtgtgcaggccaaatctggttacttctcaygctctgatttaagaaactttatatttatttctgatagtgatgcacaccattatgtcaaatttagaatacacagctattaactttattgctccccagatca

SEQ ID NO: 48149 - DNA, 201 bp, Homo sapiens
acgttggggagatgaggaggaatacccagaaataaataaaactcccctggatgtgctatctcagtgcaatcatcagtatctctcttctcaacaaaaaaccrtgagcatgaacaactttcatttatgcactcagggactttcatttttatacatttattactgccaatcttgcaaggttttatttctgcttctaccacacag

SEQ ID NO: 48150 - DNA, 201 bp, Homo sapiens
aagtagatgataataataagtgggtatgataataaatagatgatgtaaatggatgatataaccacagtgaaaatcctggaaaaagaaaagttaggttgctrtagaaaatccacgtttgtagctagttgtgttatgtaaaacaaaagctgatgctgagattgagatctggtttggctatattggcttgatcaggacacaggc

SEQ ID NO: 48151 - DNA, 201 bp, Homo sapiens
tagatgagattctcagagagactgtgcagactaagaaaaaagaaagtaacatcagaaaatgccacaaatcctatggcttcattatctctgatgaatgtgakctttttttttttctggaaaatatacataccaacatttcgtgcagttcatgataaaccaatcccttttgaacattgcccagaaagcaaacagacttcccat

SEQ ID NO: 48152 - DNA, 201 bp, Homo sapiens
cattgcccagaaagcaaacagacttcccatggtgcacaaatgtagccatagggaatattgttcattcctcattgcactgagtatgcttcagtgttcacctsccttctggcccactacacctgtcaggggtattttatagactaaatagtgtcagttagtctaaatcactcatagacatgtactaggtggttttcctttttc

SEQ ID NO: 48153 - DNA, 201 bp, Homo sapiens
tgtaatagatcaaattaaaacattttatttcctgaaagccttttttgcctgttgtaatgtgcaggacccctctcctttaatgggagagacaggaagttacstgaatctaggctgaaaaggttatgtgaaaagaaagtataataataaaagggacacttggctttttaaatctttgttttctcttaacctaagtaaggcata

SEQ ID NO: 48154 - DNA, 201 bp, Homo sapiens
gacccctctcctttaatgggagagacaggaagttacctgaatctaggctgaaaaggttatgtgaaaagaaagtataataataaaagggacacttggctttwtaaatctttgttttctcttaacctaagtaaggcatattaaaaataaatgttaaggtgaaaaataaatgttgtctttatgaaaaattaaaactgctctcag

SEQ ID NO: 48155 - DNA, 201 bp, Homo sapiens
tattgttcataccttcatgctttttaacatgatattttccatcctggaatgaccttaccccagattctgctcattttcaaaaccctgattcattgtcatcwtttctgtattcctaccttgattacccacttccccaaaagagttaatcactcacttttgtactatgcctgtgccatatatatatatataattatatattat

SEQ ID NO: 48156 - DNA, 201 bp, Homo sapiens
agttattcatctattcatatatgaatattcagcatattctatttattcagtatattcaatatttatttaatatattcaatgttccaggttgctttaggctstagtgacataatgtggacaaaagcagacatggtccctactcgttcagagttcagagtgtaaagatgtttatcagattcaaaagtcttcagcttttttcac

SEQ ID NO: 48157 - DNA, 201 bp, Homo sapiens
aaataaggttttatatatataagcaagtctttgctacataataattcaacacatatatatatgttgttttatatatatatatatatatatatatatatgtrtgtgtgttgaattattaggtagcaaacacttggaaccaacccaaatgtccctcagtgatagactgggtaaagaaaatgtggcatatatacaccatggact

SEQ ID NO: 48158 - DNA, 201 bp, Homo sapiens
ggagttgtagggataaagtcaccctctggcattagtggcaaggcttacgaaagcatatctagggaagtgtgtaatctttgagtccgtatctggaggaaggycaagtttcttaatctcatttttctcaggaaggcatgaaatttgatattttgctaagtgtaaaggaaaagtgaagtttgattggagcttgaagagattacc

SEQ ID NO: 48159 - DNA, 201 bp, Homo sapiens
tatttattcagtatattcaatatttatttaatatattcaatgttccaggttgctttaggctgtagtgacataatgtggacaaaagcagacatggtccctastcgttcagagttcagagtgtaaagatgtttatcagattcaaaagtcttcagcttttttcacaaacggtcttacctggtagatagaataatctgagctgtt

SEQ ID NO: 48160 - DNA, 201 bp, Homo sapiens
aggcagaatatctcaaatgtgaggatcaaagccataatcaaacatgtggagaaggggccagtaggtagcctgaaaggaaagcttttctggttatagacatrcactacataataatgtttcagtcaacacaggaccatatgtatgatggtggtcccataagattataatggagctgaaaaattctatcacctattgacctca

SEQ ID NO: 48161 - DNA, 201 bp, Homo sapiens
ataggctagaccacacagcctggggtgggtttgttgcctagcagcagtaggctagaccatctaggtttgtgtaaatgcactctatgatgttcacacagccrtgaaattgactagcaatgcatttctcagaacgtatctttgtccttaattgacacatgtctatacataccaggtatacttgaacacaatttttgcgaatcc

SEQ ID NO: 48162 - DNA, 201 bp, Homo sapiens
aatagttcattttcccagataattgtttatttattttgctttgcctctacctgagaaaggagaagatttgggttctatgcctacctcccttcattcccttyctccacagtggtcagatccattaaagaacagagtccttggtcagatcaacatagcattcatgaaaaccaactctcagaaaggaggaatatgcaacgactg

SEQ ID NO: 48163 - DNA, 201 bp, Homo sapiens
aaaggagaagatttgggttctatgcctacctcccttcattccctttctccacagtggtcagatccattaaagaacagagtccttggtcagatcaacatagsattcatgaaaaccaactctcagaaaggaggaatatgcaacgactgtcactgcaaacttccaaataaagaatcttcttagtgatattttcaaaatatattg

SEQ ID NO: 48164 - DNA, 201 bp, Homo sapiens
gatttgggttctatgcctacctcccttcattccctttctccacagtggtcagatccattaaagaacagagtccttggtcagatcaacatagcattcatgamaaccaactctcagaaaggaggaatatgcaacgactgtcactgcaaacttccaaataaagaatcttcttagtgatattttcaaaatatattgacaggagtt

SEQ ID NO: 48165 - DNA, 201 bp, Homo sapiens
tgggtggtaggtgcctgtattagttttctagagttgttgtaacaaatgggaggcttaaaacagaaatgtattcgctcacagttctgagatgcagaagtctraaatgcaggtgtcagaaagaccatgtgccctttcgaaggctctagagaagaatcttcctgtgcctcctcccagcttctacgggctactggcagtccttag

SEQ ID NO: 48166 - DNA, 201 bp, Homo sapiens
agatgcagaagtctaaaatgcaggtgtcagaaagaccatgtgccctttcgaaggctctagagaagaatcttcctgtgcctcctcccagcttctacgggctmctggcagtccttagtgttccttgcctctgtagctgcaccactcatctttcccgccttcttcgtatggtcttctctctgtagctatttgttcttttcttac

SEQ ID NO: 48167 - DNA, 201 bp, Homo sapiens; identical to SEQ ID NO: 13810

SEQ ID NO: 48168 - DNA, 201 bp, Homo sapiens
gaagaatcttcctgtgcctcctcccagcttctacgggctactggcagtccttagtgttccttgcctctgtagctgcaccactcatctttcccgccttcttygtatggtcttctctctgtagctatttgttcttttcttacaaagacatcagtcattagattagggttcaccctaatccaatatcacttcattttaacttga

SEQ ID NO: 48169 - DNA, 201 bp, Homo sapiens; identical to SEQ ID NO: 13812

SEQ ID NO: 48170 - DNA, 201 bp, Homo sapiens
cttggtattctaacattcgtgaattcccttactgcaatttctaaaaacatgtgcttacatgtcagcacattagtcaactaaataatttctttcctttgctrttcatgttgggatggccttgctggtgctgtagacattgggagaattcccactctcagtttccttttcctggattgtacaaattctgcactgctgaaatct

SEQ ID NO: 48171 - DNA, 201 bp, Homo sapiens
ctagaacataagccctcccaggaagtcagtccacaagagtatggagtttggtcttgttcactcgtgtaggcaccaaaggagatttgctaaataagtaagtstaataatgaaggaggttgcagtaagtcattgatttaaggcagtggctcagggtggatacagggtgagaatcctgtgcgactttgagcacgtacagttcct

SEQ ID NO: 48172 - DNA, 201 bp, Homo sapiens
cagacaacagcagagctttcagtggaaatcttaaataagtggggtcaatatcctgaggcatttatttgaagaattataggagaagataaaacatggatttmccagtataatcctgaagacaatgcataatcaaagcaatggctaccaagaggtagaagtgttacagtcaaagcaaaagcagaccagtcaagaacaaaggtt

SEQ ID NO: 48173 - DNA, 201 bp, Homo sapiens
taccttatacacaagcacttaaaaaattttcactgtgtctgaaactgttccacatagcaaaagacagagataccaaattccacaatacatttgtcacatcyatgtgtcctcagaggaaaaataaccagaataagaatcagaggctctagatgccagtatttgctctggcatgattgtatatgtgatctcagttgcttcatc

SEQ ID NO: 48174 - DNA, 201 bp, Homo sapiens; identical to SEQ ID NO: 13807

SEQ ID NO: 48175 - DNA, 201 bp, Homo sapiens
gcctggattaagaaaatgtggcacatgtacaccgtggagtactatgcagccacaaaaaaggatgagtttatgtcctttgtagggacatggatgaagctggraaccatcattctcagcaaactatcgcaaggacaaaaacccaaacaccgcatgttctcactcataggtggaaattgaacaatgagaacacatggtcacagg

SEQ ID NO: 48176 - DNA, 201 bp, Homo sapiens
tcctccgagtaagtagagggggatgggctgcccatggaggttgttcttagagttattgacaaaatataaaattatagtcttgagacttaccttaaatgtawgtggatgttaaaataatacttatttgaccaacaggggtattcttgagacagaataaaaataagcttaaataaaagtaaggcagtattatatgaaattaaa

SEQ ID NO: 48177 - DNA, 201 bp, Homo sapiens
tagaagatgtggcagatttttatgatgatctgaatatgagacaagattgaaaacggagtagaagattaatgctcataatgaataaaaactagagaagcatmgctctggaaacttagtcagatattattagtgctatgttatcgtctgaggattttaaatgatatgatacacctgggtttgtttttctagtaaattgtgtaa

SEQ ID NO: 48178 - DNA, 201 bp, Homo sapiens
cagatattattagtgctatgttatcgtctgaggattttaaatgatatgatacacctgggtttgtttttctagtaaattgtgtaattttgttctatgatatwgatgattatcaaatattatatatcagtacttttttgtggttatatagaaatattacttttcctttttaagaagtaatcatggaggaagctacatagtaga

SEQ ID NO: 48179 - DNA, 201 bp, Homo sapiens
tctctgaaataaaatttcccttctagcagtaacgaacacatggattttaccaaaaattaataagattgaaaaatctatatcaaaaacaggctatactatgtttttttttttttttttttaagatggagtttcactcttgtcgcccaggctagagtgcaatggctcaatctcagctcactgcaacctccacgattctcctgc

SEQ ID NO: 48180 - DNA, 201 bp, Homo sapiens
gttctagtagcctaatcacataatacactgaatgataagcattactcatgactgttgaagaaaataaatgctttaaccagagtaaccaaatggaattgttygtaagtctagatagtgacatgtatataatagacagcaaacagtataaggcagacctaaccgtagatcatatgtgaaggggagtacaacaattatctttgc

SEQ ID NO: 48181 - DNA, 201 bp, Homo sapiens
tagtacctatttagacatataaaaagggaagttttttaatgaaaaattagattggctgaagagtgtggaaatcatcacatagggaagtggtcagcactgtkgatatacaccaaacagtattacagagacatactgaaaataaagcacactgacagaaagaaacctcattaggatagaattttgggagattggtgtcttgtt

SEQ ID NO: 48182 - DNA, 201 bp, Homo sapiens
gtcagggatatctaaattttaaacttcagattttgtacaaaaaaacctaaaaggactatattttaaaataagaagcatgtacaaataattgtaaaggaaaragtgtgagttttgtagtctccagttctgtgtcagtaagaatttgatgaggaatagccaatagcatttatgctggtccaggctggatcaaattgtgatcgt

SEQ ID NO: 48183 - DNA, 201 bp, Homo sapiens
gcctcctcccagcttctacgggctactggcagtccttagtgttccttgcctctgtagctgcaccactcatctttcccgccttcttcgtatggtcttctctstgtagctatttgttcttttcttacaaagacatcagtcattagattagggttcaccctaatccaatatcacttcattttaacttgattacatctccaaaga

SEQ ID NO: 48184 - DNA, 201 bp, Homo sapiens
acagtgagggctgttacagacagaaatgatgagagtttgaagaaggaggagagagacatcgggagcagagaaaaagcaatcaaaatgtttgagagctattyaaaaggtagaatttacatttgtgatgataaattagagatgagaagatgactcctacttttcaggcttaatcaacctggcaggtggactatatctccactt

SEQ ID NO: 48185 - DNA, 201 bp, Homo sapiens
tctagacatctatgtaacccatgaatatcactaagctttaagtgtcatcatgttctgttgcctggatctattctttgtaaatttgagaaagtcatacaccstttctcagtctcagtttatgtatctatgaaatggagataattatcattatttaacaaggttattataaaaagtaaatttagaaatgtatgtgaaaagacc

SEQ ID NO: 48186 - DNA, 201 bp, Homo sapiens
gtagaaaaaaatagtttttaaattagaaaaaacaaaatagaatggaaaaaaagaagtgcaagataaaaatacagatttgtaatagtaaaatgaaaaggacrctctttcaaaaatatattatcctctagagtcctctccttctaatgtgggtgacaaattttaaaagtattcattttgccaatgtgaagaagtaagatgatc

SEQ ID NO: 48187 - DNA, 201 bp, Homo sapiens
ggcgatagagggagtgagtctctgtctcaaaaaaaaaaaaaaaaaaaaacttaaaaaaaatatataatcaatatcaatccctacaaccctcaaattataarggaaatcatagatatatatatggctaggtatataggtggaaagatgagagagagagaaagagaggaagaggattagagattaaaaacatatctaagaaac

SEQ ID NO: 48188 - DNA, 201 bp, Homo sapiens
aacctctctacagagactgtaattattctcattatccacataagaaaattcagacagctcagtattggagctggagttcccatccaagacttccgaaccckagttactctggtctcttgtctcccagtttaatcaagtctttataaaacaacatggttggccaataaaaaaacaaaaaagtcagctgggcacggtggctca

SEQ ID NO: 48189 - DNA, 201 bp, Homo sapiens
agggcagggaaaggagagtgagtcactttttgccccgtatccaggctttcccagctattgtgcctgtggtctccctgcagcaaacttggatgagttttatyatacaacagtggtacctccaagaatttgttccaggtatatctgagcctgtatggatgctgatgagggaagtaagatctggagtaactattgcttcttctc

SEQ ID NO: 48190 - DNA, 201 bp, Homo sapiens
tgcttatctgtaatttgaaatgtataactaaatgatgcttcattgttgggattattacatataaaccaattagaatttgagtagatttcatcacctttatrcaaatcactgcctgcagtaccagcaccagggaccgcagcttctgataggctcgtgcagagtgcagacaggagtcggaaaataattcaaggttctaaccaa

SEQ ID NO: 48191 - DNA, 201 bp, Homo sapiens; identical to SEQ ID NO: 13809

SEQ ID NO: 48192 - DNA, 201 bp, Homo sapiens
atcagtgatattccaaggctaattcaaagtagatatcccactaatatgacttagattttttattttatagacagggtcttactctgtcacctaggctggartacaatggtacaatcacaggttaatgcagcctcaaactcctgctctcaagcgatcctcccaccttagcctgcagagtttctcgggaccacaggcctgcac

SEQ ID NO: 48193 - DNA, 201 bp, Homo sapiens
ggctcctcattgttacagtcaaattccattcccaattgttcttttattcccagagtaactcaagcaatactttccacatagtatataagaattaaatcatrgaattaatgaatgcatggatgaggctgtcaacccaaaacttggtccccacaatgaatttaataaatgtgatgagatacagttaagaaatatacttttatt

SEQ ID NO: 48194 - DNA, 201 bp, Homo sapiens
acataccataatcaattttctatgtgaaattttcaaaaaaaaaatgtaagggtaaacagaaggcaatcaaaaaatgcacctctatacctctgaactatccyttaatgaatgggagtaaatataatctcaaagataaataaatatatcaaagggtcacaagtcaaatttttacatactgctccttgcatgttgaatgtttta

SEQ ID NO: 48195 - DNA, 201 bp, Homo sapiens
agaacatttttcccaggttgaaaagtgtgggtttgaaatcattcttgcacctataaaatttatctccaaaagtaaaatagtaagatattctcaaggtcaayagctagatttttgcttttgttttctttgtttttcttttttgtttttctggagaagaggaaaaagaaaaaatcctcaactcttcatccctagagaattgaa

SEQ ID NO: 48196 - DNA, 201 bp, Homo sapiens
caggaacatagtctaggcttggtacagtggctcacgcttgtagtcccagcactttgggaggctgaagtgggaagatcactggaataaatgagttcaagacyagcgtggacaacatagtaagatcctatctctaccaattaaaaaaaaaaaaaaaaaaaaaagccaggcgtgatagcatgcacctgcagtcctagctactac

SEQ ID NO: 48197 - DNA, 201 bp, Homo sapiens
aagacgagatttcctagaacgacacagttggcttgtttcacatggagtctccaagaaattcccccattatggcttagcctacagactcttaatcctttccyggatgctgtagttattttcattttctacttcttactcatatcctgcttaatccatgccaaagtaaaacattggaccctcaggtattttagggacctatat

SEQ ID NO: 48198 - DNA, 201 bp, Homo sapiens
ttagataatataatcaatgcagacaagctcagtataaaaaaaagaaaagtatcctaaaataccactagtctggatgaattattttgatgcttatattatgyagagatctgacaagtctgtatttagcattgtttctttaagacagtggttcccaacctttttggcaccagggaccagttttgtggaagacaatttttccac

SEQ ID NO: 48199 - DNA, 201 bp, Homo sapiens
ctgcttatatctctataaagtagggatttctggtctaaagaactggtaagaaaggaagataataagtatactgagatactaagaagaaaatggtttttttyaaacttaaataaggaatagaatgacagagtttagtctcatgtgaagttacttacttggctatgtggagataagtctctcaagttttcttgacataatttg

SEQ ID NO: 48200 - DNA, 201 bp, Homo sapiens
taaaatttgccagttatttagataatataatcaatgcagacaagctcagtataaaaaaaagaaaagtatcctaaaataccactagtctggatgaattattytgatgcttatattatgcagagatctgacaagtctgtatttagcattgtttctttaagacagtggttcccaacctttttggcaccagggaccagttttgtg

SEQ ID NO: 48201 - DNA, 201 bp, Homo sapiens
atatcataactaccattgtaataaatttaaccctaaatcctaattccaataaatgatacaaaaaggaaatcatgactatgagtaaacaataggataataastgttatgctcctcaaaagtcatttctatgttcgattatttctttccactgagtagtggtaattgacacatgcaaagaagaccttacatgttccctgactt

SEQ ID NO: 48202 - DNA, 201 bp, Homo sapiens
gtaagtctagatagtgacatgtatataatagacagcaaacagtataaggcagacctaaccgtagatcatatgtgaaggggagtacaacaattatctttgcrttgaataaatcatcttcacatttgcaagctatctcatttttaagacataaaaactcacactagtagtgagttatgaatcacaagcaaattggactatatt

SEQ ID NO: 48203 - DNA, 201 bp, Homo sapiens
tctttaccaataggtggtgctagaaagtttaatatttattccaatagttgaagttatttggaaaatgtgctaaacatttttttgtgtttaaaaaaaaagtsctgtaaagcagtatgtacataattagtccttgcttgccttttttttttttttttttttttttaactttacagctccatttacgaaagttcgactggtcgg

SEQ ID NO: 48204 - DNA, 201 bp, Homo sapiens
tggtttaaatttacagggtaaaaagtgatgtcataatttgttgcttttggtactgctcatttacacaaataggcattacccagttcctcataaaagacagrtcgagttcctggggtaatcaatgactcttctaggttatcaggttaccattttgtttggtgcactacaagaaaagtattcaaaataccaggcatctttcct

SEQ ID NO: 48205 - DNA, 201 bp, Homo sapiens
actttgctcagacacatcagaggaatcactctctgtgtcagttacagccttacaagatgtatttcttaagtaataagacttgaaagtaaaaattaatcctkgatccatgggctacacaatggatattgtgttagcaggcatgaaaacaacaccagtctttctgtccatctccatcagagctcttgggtgaccaggtgcact

SEQ ID NO: 48206 - DNA, 201 bp, Homo sapiens
ctcacctagactcacaatcatgatgcgaatatctgcaaaacctaagtggttgtcctagtagcctcaaataactaatacattaaatatagtagaattattaytcatatactagggtggatattatgtttaaatatgctttattccccaaataataacaaatttattttagagggctatttccttgaaagcatgctagggaga

SEQ ID NO: 48207 - DNA, 201 bp, Homo sapiens
gtaaacagatacagaatctctgaattcacagcgcttccaggatgataagtagtaatataagggaggcaaatgtcatgatcaaggattttttatctcatgtragtttcttttaaggggctgattttacccatgacaacaatgttttgaaggagaagcaactttcttttctaaaggaaactttgtgtgggccatctaagaagc

SEQ ID NO: 48208 - DNA, 201 bp, Homo sapiens; identical to SEQ ID NO: 13847

SEQ ID NO: 48209 - DNA, 201 bp, Homo sapiens
tgacaaaacatatccttaggacatcacttcttattaaaagacaccaatctggtagagatgtcagcagcagtgccaggtgctgttctagttgtactgcagastaaaagaaggaacagtacagtctctcctctacaagagtctgaagaaggtgctaaaattagaaataagtccgataattgtcaaatatgaaataagtaaaaa

SEQ ID NO: 48210 - DNA, 201 bp, Homo sapiens
tgaagaagaaaacccagagaacagagcatgaaaaaaggcaaacacagagtttcaaaggtggtcaagtaaggtgaagtctacaaaaagccctttgcacctgstgctgtggggatgttgccattgttcagagcagattctgtggggtggggtgataaccagattagggtatgcggagaagggaatggttgataagggttggag

SEQ ID NO: 48211 - DNA, 201 bp, Homo sapiens
aaaatgcataatgaagagaaaagaagccttcactaagctctaacgctagtcatagtgaatcgtctgttgtgttctcaccttaacgcggaagagtgatgttycagtcacacgaaatgattcctaccatacaatacaacacttgtgtgaggctctgtcctaaatatctcaattaccaatatgtggtttggtagtatttctcat

SEQ ID NO: 48212 - DNA, 201 bp, Homo sapiens
acccctcacagtcattcatgagggttggaatcaacttcttccaaatttcagttaacctcaatactttgaccttctcccatgaattataaattattttaatrccatataggattgtgaaacctttccaaaaagttttcaatttactttgctcagacacatcagaggaatcactctctgtgtcagttacagccttacaagatg

SEQ ID NO: 48213 - DNA, 201 bp, Homo sapiens
cctcacagtcattcatgagggttggaatcaacttcttccaaatttcagttaacctcaatactttgaccttctcccatgaattataaattattttaatgccrtataggattgtgaaacctttccaaaaagttttcaatttactttgctcagacacatcagaggaatcactctctgtgtcagttacagccttacaagatgtat

SEQ ID NO: 48214 - DNA, 201 bp, Homo sapiens
tgagttttgtagtctccagttctgtgtcagtaagaatttgatgaggaatagccaatagcatttatgctggtccaggctggatcaaattgtgatcgtacttytagtcttcaagctgcctggttagaaattatgcagcttactttgatgcctgtcctactactactattagccttttagtggttaccttaagaataactgaat

SEQ ID NO: 48215 - DNA, 201 bp, Homo sapiens
cgtacttctagtcttcaagctgcctggttagaaattatgcagcttactttgatgcctgtcctactactactattagccttttagtggttaccttaagaatractgaataatactgttactttgcatctctcaaagaccgtgcgctgttcccgcatactttcttgcagacgtattgtcttctgaaggatggtgcccatgggc

SEQ ID NO: 48216 - DNA, 201 bp, Homo sapiens
ttcacgaaatttgactatgttgccactgtaagtacagtacgaagacattttacttcagataaattaagaccttatggtgtttatttaattttattgttagmattttgacatctatatatataggaatagaaacatatcatagatacattaaattgatttttgaagggggttgtgattgtaaacattcagccattcagtcaa

SEQ ID NO: 48217 - DNA, 201 bp, Homo sapiens
atgtcttgtcatttctccagaaaatgatatatatattaaaatatactgatacatgcagagatttgatatttgaaatcctatggtttgaaataaatagtttytgagcttacatttactgcaaatacccaaaggaaagaatatgaaaatcagataaagacagggtacgataaccagtagcctggtatcacttaaatagaaagg

SEQ ID NO: 48218 - DNA, 201 bp, Homo sapiens
cctgtctctaaaaaaataagaaaaagaaaaaaaaggaatagggtccctatcattgaggtatttttaaactacattttatttttagaacagttttacatttrtagaaaaactgcacagaaagcatagagagttcccataaaccacccatgcacacatggtctcctctactattaacatcttgcattagtgtggtatatatgt

SEQ ID NO: 48219 - DNA, 201 bp, Homo sapiens
gtgacagtgcgagactccgtctcaaaaaaaaaaaaaaaaaaaaaagaaagaaaaagtagcctcagcttttaggtatgatgaaaaacctggatgattcctcrtttctaggaagcaaaatcactgtctagtcacttaacactttatgctgaatgtctggaactacccgacatacttgcagcaatttttagccccctaaattaa

SEQ ID NO: 48220 - DNA, 201 bp, Homo sapiens
ttaaaaggatcttttgaactctccaaaataatgatggatttgtccatttcttctgcagtgcctgttagtgaaataaggtgaattggatcttacttatatayataaataaaatatatgtatatatgctttctttatatatataggctttcagttttagctttacattttagatattttagttttagctttacattatagatt

SEQ ID NO: 48221 - DNA, 201 bp, Homo sapiens
tttgaattaatcagatttttctctaacagttagatacctccactttggatttcaaataaatgtccgaagctttacaaattcaaaaccaaatccttgcttcytaactagccacccgcatctgcctccccaaatctgttgcgttttcagtctttttgttggttttgtcattttccaactacctgctcactgcctgatcttgga

SEQ ID NO: 48222 - DNA, 201 bp, Homo sapiens
tgagacaatataattccagcacttcaggagagtgagacatgagggccttttgagcccagaagttcaagaccagcctaggcaaagtagcaagaccctatctytgaaaaaaaaaaaaaaaaaaaaattaaccaaaggaaaaaaactgaattgtgagtttgtctaaccactatgtaaaggaaaaattcagctgaggaataatgg

SEQ ID NO: 48223 - DNA, 201 bp, Homo sapiens
cacctaggacatgtgaataattatcagaccagctttatgtaagtgatttgatcactctggtctcatggaactgtctctaaaatgatggattctgacttgaygatgtctaacgtctctttgaacatcccatggctgagattccatgtaactgtacttatattgtccatgagttagaagcaggtgccagaccctttcccattg

SEQ ID NO: 48224 - DNA, 201 bp, Homo sapiens
tgtcacacaattagtgaattccagaggcaggattcttcattgttattcataaaaaattttggtataaaaatgaatgaattataaaatataaaaatgtttgkttcctggaaaacattgagattctacaatgcatttcttatgtaaataacactgtttctttattgaaatagttttctactagctgattttagaggccctacc

SEQ ID NO: 48225 - DNA, 201 bp, Homo sapiens
cattagtctgcctctaagagatagatctgctcactgagctgacaagatcagattttctaatgtctcaggcttctctgatcagagcctcccaccaaaagctygtatttggagaggctctcagtagccagccatatgggtttttttccataaaaacacttatgtttatgccagttaaatcaatctttccttcatgatttttct

SEQ ID NO: 48226 - DNA, 201 bp, Homo sapiens
ctgacttctgttcacccgaggaaagtctctatatcccaaaggaaaatcgtttaaaaaaacacacaggagttataaactcctcacaatcataaatcatcackaacaatgatatccgtctttgaacaaagagagttgaaagactggcaaagaaaaaaaaagaagcaaagtgtaaatacccgtttaaccacaactggccagact

SEQ ID NO: 48227 - DNA, 201 bp, Homo sapiens
ctacactgcagttatcaaggaacagacagagagccctcggtgctgtcagccttgtgatggggaaatggaccctgcttccccaaaaggcatttgcaaggagsgatttgaaactggaaggatctcaagtgtttagtcgaaagaccatggcccatgtcagtcatcactgtcatatccacagataatagagtgttggaaagaagc

SEQ ID NO: 48228 - DNA, 201 bp, Homo sapiens
tatataaatattattcagaaccactgattttaataatattttatgggtagagagtggaaaggtacaaagagaaggggcatagcataaagctttaagtagtkccagaagtacaggctgagatgaacaaagtagcaaatggaagagaagtagcccaactgaagaagaaaacccagagaacagagcatgaaaaaaggcaaacac

SEQ ID NO: 48229 - DNA, 201 bp, Homo sapiens
gggcccctaggctgatattccatcatgatttcacagacttctggttaagaatttgcttaatgcattttgctctggcttaaattaattgacacttttacaastttgaaactcatttaaactacatgggtctttcctacaattctgaagccatagttccctaaacacagtgcaatgtgcatttatgtttttaaaatagcacat

SEQ ID NO: 48230 - DNA, 201 bp, Homo sapiens
gtgaagtctacaaaaagccctttgcacctgctgctgtggggatgttgccattgttcagagcagattctgtggggtggggtgataaccagattagggtatgmggagaagggaatggttgataagggttggagatgtggtagactcaactctcaagctgcctcactatgcagaggaggaggaagagatgcattttttgttagt

SEQ ID NO: 48231 - DNA, 201 bp, Homo sapiens
ggggtgagatgtgggggcggggtgaggtgttctatagtcttctgattaaatctcagtcttttagtgggcccttgtccccggactgtgacctgtgaccttcrtgagcgtttctaaacttttttttttttttcctttttctctgccaagttgaactgcagctggaagactagagggagcgagcattgaatagttacccttcag

SEQ ID NO: 48232 - DNA, 201 bp, Homo sapiens
ttttgtttttgtgatgaatactattttctaaaaattccacaaagaaaattgttcaattttcaagtcaatttctatccactaagggaaaatcaagcttatgmatagaaacaattacaacctccttccttactaaatgaaaccttaaatataagaatttggacagtttaagaaccctgaaaaattaactatctgatgtctggg

SEQ ID NO: 48233 - DNA, 201 bp, Homo sapiens
agcgagcattgaatagttacccttcagctgcctagctaagataacgctctgataaactcttttcactggggagtaagcctttgttacaggaaatgctctaygtatattttaaaatcattagatttcccttctctctgccagggacatcaggtgatattttttggtatatactgtgagaaccaagttgtattcctggaagta

SEQ ID NO: 48234 - DNA, 201 bp, Homo sapiens
tgggtccaagacgtcattgatttttagtttctccagcttttttcgtggtgtcgagatatgagtgatgacttccaagctctttagatgttgaagctgcaacyagaagtcttccatgaactttcttttaaaaatagacagtatggcatagtgcagtgtttctcaaaagaaaataaatatattgatctctataccttattaagt

SEQ ID NO: 48235 - DNA, 201 bp, Homo sapiens
atactaaatattagatgagatgtcttctatttgccatgctgtaagtcaattgttgtgtctaggctgaatgtatactgatataatgaaaggattatgaagasgagtgtggaatccccacttaacttctcagaatcagaaggctcctccctccctctgtattcccagtagaaactacatgtgatgtgtgtgtgtgtctgtgtg

SEQ ID NO: 48236 - DNA, 201 bp, Homo sapiens
ttgatctctataccttattaagtgttgatatattattttattataattttatgttaaaatagagaaacacgaatttagacctaaacactgtaagcctacasttcttaaccaagtttttgaaatataatgcatatgttaattaaattttaaaatctcgcaaaaaaattaaaattttaactaacaccaccaatttaagattgt

SEQ ID NO: 48237 - DNA, 201 bp, Homo sapiens
acaataaataagtcataatgtattaactatatattatgactaacaacctgctgtaactttagacatacaaaaatacctcttaatgagtgtaaaatgttaamtcttcttttgagttcagtatacctgtaccacagtgagtcctaggacatttgaatcaattctctcaagccatttgcctatttgattatgaatctctgtttg

SEQ ID NO: 48238 - DNA, 201 bp, Homo sapiens
cctcttaatgagtgtaaaatgttaactcttcttttgagttcagtatacctgtaccacagtgagtcctaggacatttgaatcaattctctcaagccatttgyctatttgattatgaatctctgtttggtcactgggcataatcttacatggacctcattctagacacatatatccataagcaacaaaaataaagtaattggg

SEQ ID NO: 48239 - DNA, 201 bp, Homo sapiens
tttgctcagacacatcagaggaatcactctctgtgtcagttacagccttacaagatgtatttcttaagtaataagacttgaaagtaaaaattaatcctggmtccatgggctacacaatggatattgtgttagcaggcatgaaaacaacaccagtctttctgtccatctccatcagagctcttgggtgaccaggtgcactct

SEQ ID NO: 48240 - DNA, 201 bp, Homo sapiens
taagtaataagacttgaaagtaaaaattaatcctggatccatgggctacacaatggatattgtgttagcaggcatgaaaacaacaccagtctttctgtccrtctccatcagagctcttgggtgaccaggtgcactctcaatgagcagtaatattttaaaaggattttttttctcagcaataagtctcaacagtaagattaa

SEQ ID NO: 48241 - DNA, 201 bp, Homo sapiens
atttcaatattgctgtgtctcagggaatagggatgcctgaggagaggaagagagacagaagggggaacagccagttggtggagcagtcagaatacacacarcatatatcaactaagtttgccatcttttacgggcatggtttgtggttccccaaactaatcacagtagtaatctcaaaggtcactgattgccataacaaat

SEQ ID NO: 48242 - DNA, 201 bp, Homo sapiens
tttatgatctacttcactggatattgtattttaagagacaggcttacattattcactgattggggattagacatggcaaacgaggtttttatggaaagctrtttaaaacattcctgattttttcactcctccaccttaaattcacagtttcactcaagaggaaaagaaaaagcaattttaaatacagagtagagacaagaa

SEQ ID NO: 48243 - DNA, 201 bp, Homo sapiens
ggtatctatttaaaaagagcccctatcagagccacataaatattgctaaaatggaaccaagaacacacatgaaatttatgatgaaacttgtttggaagaakggtgaaatcaccgatactttatgaaaagtttataggcacaatgtcccaaaggaatcagcagttgacaaaaagagaactcaattttacaaagggataagaa

SEQ ID NO: 48244 - DNA, 201 bp, Homo sapiens
agaataattatgagaattttaaaataataaagcaaaatgagctgagagaaaaaaatagaaccaacattatttgttctgaagaaaatgatttgaaaagtaarttttatgatctacttcactggatattgtattttaagagacaggcttacattattcactgattggggattagacatggcaaacgaggtttttatggaaagc

SEQ ID NO: 48245 - DNA, 201 bp, Homo sapiens
caagaccagcctgaccaacatggagaaaccctgtctctactgaaaatacaaaattagccgggcgtggtggtgcatgcttgtaatcccagttactccggagkctgaggcaggagaatcacatgaacccaggaggcggaggttgtggtgagccaagatcacgccattgcactccagcctgggcaacaagagcgaaactccatc

SEQ ID NO: 48246 - DNA, 201 bp, Homo sapiens
aagccagggtggggaagacaaagccccaaggggttgtaggttgaaaatggatgttcaggaacagtcagcttgcttgcttgcttgctttttctttctttccyttttttttttttttttttttttttggagacagagttttattcttgttgcccaggctagagtgcagtggcctgatcttggctcactgctacctctgtttcc

SEQ ID NO: 48247 - DNA, 201 bp, Homo sapiens
tgtgtccatgggataggtaacacaaacagggtgatcatatttaatcatcaggggtctgttttaggcagataatggcaaatccttttatgtaccaaaatctrgcagtttttatttgtaatcattatctagaaatatacagtagcaatttatctgccctacaaaacctaattattttaacctaatattgtgtaggtatgacat

SEQ ID NO: 48248 - DNA, 201 bp, Homo sapiens
ctgggcaacatagtaagactgcatctctagatgggcatggtggcatgcacccgtagacccagctactcaggaggctgaggtggaagaatcacttgaacccrggaggtcaaggttgcagtgatgtgatcacacggctgcactccagcctgagcaagagagcaagaccttgtctcaaaaaaaaaaaaaagaaatgtcacggtg

SEQ ID NO: 48249 - DNA, 201 bp, Homo sapiens
attacaggcatgagccaccaagcctggcccacctgctgtgtactttttactcgacttacttctttctttctccttttcactccatttactttcagctgagytcctcttaaaaagttctccttcttatccttatgttatctttatctctgcctttattttatcttttgtttttatctccttttcctgaggctttctctgagc

SEQ ID NO: 48250 - DNA, 201 bp, Homo sapiens
catgccctccctcctcatgcagagtatataacaactgcataatgctttaaaaacaaagaatgatatacataaacatctaatgtggtatattctgcttttcrcttatgttaatatgtcagtcatctgtccatatcattatatatgtcactacctcttttctctcaatggctacacattattctattattcagctacaccata

SEQ ID NO: 48251 - DNA, 201 bp, Homo sapiens
agcaaaatgaaaatgcaagaagctgaataaatgtcatggcaaaaagagagatgctcgagaaaaagaaaagattttatattagatagagcaatgcaagtgtraccagattgcaaatcaatgagtttgtctgagtcgagcagaagagcattagttataaataaaagaagctactaaacagagtgcacgccggagggcagaagg

SEQ ID NO: 48252 - DNA, 201 bp, Homo sapiens
ggatgtagtggatgagaaaaggcgaggaaaagaagacctctaggtttgcaccatattagaattctaagcaggggtgttgttaggcagtgcatatatgggtytgtagttgagagacgagctatgggcaagagataaagacttaagagtcatcagccttctagattatatttaaagcaatgaggctagtgagatcaccaaggg

SEQ ID NO: 48253 - DNA, 201 bp, Homo sapiens
gcaaaatgaaaatgcaagaagctgaataaatgtcatggcaaaaagagagatgctcgagaaaaagaaaagattttatattagatagagcaatgcaagtgtgrccagattgcaaatcaatgagtttgtctgagtcgagcagaagagcattagttataaataaaagaagctactaaacagagtgcacgccggagggcagaaggt

SEQ ID NO: 48254 - DNA, 201 bp, Homo sapiens
taaatatctcaattaccaatatgtggtttggtagtatttctcatcattctttgctcaagtgcaatgagactacaactaggatgtgaattttgagtatcctrtctaaaactcaaacaacgataggaaaaatccatttgttttttcatttgatttttactgaggactcagctcagtcttaaatgaatactagtctttttccaa

SEQ ID NO: 48255 - DNA, 201 bp, Homo sapiens
tggatctattctttgtaaatttgagaaagtcatacaccctttctcagtctcagtttatgtatctatgaaatggagataattatcattatttaacaaggttwttataaaaagtaaatttagaaatgtatgtgaaaagacctagcatattaccttatacacaagcacttaaaaaattttcactgtgtctgaaactgttccaca

SEQ ID NO: 48256 - DNA, 201 bp, Homo sapiens
tcacacaatgctacttccccatagttaatcaatattgggcatataggtacctgaatcacacatcttgaatccaaatattaatcatagcaaaaacctgaaamttttcaagtgcttattacatgccaggaagtggtctaagtattttacatatagttcatttaattatttggacactgactattagtaccccatttatacagg

SEQ ID NO: 48257 - DNA, 201 bp, Homo sapiens
tctctgagcatgaagctttgccatggacttcaaagatatttttccactggagttacaaacataggtgagaaaaacatagctgaagactattgtcctaaaaytgtattaactttaaggcttagtctcatgagtaaaatagtattttcctcaaaacttttattcattcctgcttatatctctataaagtagggatttctggtc

SEQ ID NO: 48258 - DNA, 201 bp, Homo sapiens
tgtaatcccagcactttgggaggccgaggtgggtggaccacgaggtcaggagttcgagaccagtctggccaacatagtgaaaccccatctctacaaaattaaaaaaaaaaaaattagtcaggtgtggtagtgtgcacctgtaatcccagctactcgggagaaccacttgaacccaggaggtggaggttgcagggagccgag

SEQ ID NO: 48259 - DNA, 201 bp, Homo sapiens
aaaggtaagatgaacttctcaaatgcctagaagatattaccaagtgctaatatgctatgatttattgagtaatgactatatgccacgcattgtgttaaatrcctgcatagcgttaataataggtcacaatcacatcctttactattttacctaaaataattttcatattaggctgggcatggtggctcacacctgtaatcc

SEQ ID NO: 48260 - DNA, 201 bp, Homo sapiens
aataaatgttaaggtgaaaaataaatgttgtctttatgaaaaattaaaactgctctcagttccatattgttcataccttcatgctttttaacatgatattwtccatcctggaatgaccttaccccagattctgctcattttcaaaaccctgattcattgtcatcttttctgtattcctaccttgattacccacttccccaa

SEQ ID NO: 48261 - DNA, 201 bp, Homo sapiens
aaattatatattatataatgtatatataaatatgtattacatgttatagatgtaattatataatgaatatttatatctatatagttattcatctattcatrtatgaatattcagcatattctatttattcagtatattcaatatttatttaatatattcaatgttccaggttgctttaggctgtagtgacataatgtggac

SEQ ID NO: 48262 - DNA, 201 bp, Homo sapiens
tcgagaacagtgttcactcttcctggacacaagctacttccattagaaactgttctttatatctcttatagcacctagccataaaatatctattaattaarttataacttaagaaccatattttagaaattaatgagtgctttatcctttatcatgtgttgattgcagagttagtgtaattactttgtgttctcttttccc

SEQ ID NO: 48263 - DNA, 201 bp, Homo sapiens
gactttggatttccttatataagtaccttgacagatgactaacccatttttcctatgctttacaactatgatcagtaactgtaatttttttaaaggtcctsctggacccccgggtgaaaaaggagatcgaggtcccactggagaaagtggtccacgaggatttccaggtccaataggtatggtaattttagctatttaatc

SEQ ID NO: 48264 - DNA, 201 bp, Homo sapiens
tccattttcacattagagagatatttttgttatgaaaattacatcttttttataatataacattcctcaaacttatatttgaaaagctatcttttgtttaygtagaattacatttattagtttttatgattattagaaaatattatttttatttaatattaactaaatttttaaaaataatttttcatctctgcctttcat

SEQ ID NO: 48265 - DNA, 201 bp, Homo sapiens
tttagtttctgtttctgttttttcaccaattaaaaaataataatacacgaaatcgtttaggcacatagtctatgcttatctgtgtttatttgatttgaatstagaaaatgtctacacaaataaagaggaaacagctatccagaacacacacacacacacacatatacatgtcttctgaaatctttatatacaagataaaaa

SEQ ID NO: 48266 - DNA, 201 bp, Homo sapiens
caaaaaaagaataataaagcaacctacagaaagaagcttgagtacaagttggagactcctaagcagattcgggtcttgggtcagctattgcagatacctawctataatcttatccttgggttctatgaaacatccagtgtccttaaaatacattattattttggttttggtttaaattactttagtttctgtttctgtttt

SEQ ID NO: 48267 - DNA, 201 bp, Homo sapiens
tttgtgctgtggccttgatacatgtgatttccaaaagttctccttgggattctgaagcacaaagtagttgagaaactgctatttaatatatgatacttttkttctcccatcacctattccccatcattaggccagaaatttgaatttttaagaaataatagtatcaataatacctataatgtgtagaatgaaccctctgta

SEQ ID NO: 48268 - DNA, 201 bp, Homo sapiens
agaatgactcgtgaggcttttatcatataaagatgcctggacatgacacacagatattctgatttcagggagtttgtgctgtggccttgatacatgtgatytccaaaagttctccttgggattctgaagcacaaagtagttgagaaactgctatttaatatatgatactttttttctcccatcacctattccccatcatta

SEQ ID NO: 48269 - DNA, 201 bp, Homo sapiens
cagtacattacctgcacctagaaatactatttctgcaccaaaaggacatgtgctttatcaatcacagagtgtaagctaacaaacatattattattattaaygtattaaaacatctaataggtccttcgtaagtacttatgtcatttttgaataaaaatcagcttttaaagtaggtgttttagggacaaagtgattattttc

SEQ ID NO: 48270 - DNA, 201 bp, Homo sapiens
gtaaacctctttaactgcatacaaatattcagtttctgtgtacagtattttcactaaaacttcatatgatttacagcaaaacttatttcccctataaaatsattatgttttattataaaacatcttccacctcgaactcttccctgttgcattctcacttaatcctgttacccagtacattacctgcacctagaaatacta

SEQ ID NO: 48271 - DNA, 201 bp, Homo sapiens
gcaaaatacagagaagtctgaaatcctatcctctgcaaaataaattgtctgccattatctactagtgcttaagaatcaaggttgctcagcattttgaaatstacacacatgatgatattatttccatcagctctgccagtagcctaagcttaaattgcaaactttgaacagcaatcttagaaagagctaggcttactgtct

SEQ ID NO: 48272 - DNA, 201 bp, Homo sapiens
ctactgaactctaggataaaatattttatttcactggaatataacattttcttttatatacagttgttatgatcaccatagtaatattgggtaaaaaaaayagccattttcagttttcatttaagcatatgaaaccctggatttgtgtaagtatatagtacatactcataagtaaatctgtgtatcgcatgtgtgtgtgtg

SEQ ID NO: 48273 - DNA, 201 bp, Homo sapiens
agagcacagttgattggaaagacttacgaggctacagaaagcggtagaattcaggacagaagggaatatgttatttatctctgaacagcaggagttgtagrgataaagtcaccctctggcattagtggcaaggcttacgaaagcatatctagggaagtgtgtaatctttgagtccgtatctggaggaaggtcaagtttctt

SEQ ID NO: 48274 - DNA, 201 bp, Homo sapiens
agaaactcaggagtaccagtatccagaccagcttgctgagttttcagcctctgctatttgcattttggaaactcaggagcaccagtatccagattgtcttrttgagaaaagcctatgttgttcagcccatgaaccacttcagtctcctctgcatggccatttcccatatgctatggctagggcaaaagctgactgactttg

SEQ ID NO: 48275 - DNA, 201 bp, Homo sapiens
cattttgtgaaaagtaaagcaaaacataaaccaaaaaatagatagtgaaattggctgagaaagaaagttcaatggtatgggagcagaaacagaagttaaargaggagaaatttttaatgagtgattttaggctcagtggtgactttagaacattttctctgatgatgagggtgaaggcacattgcagttgattgagaaatc

SEQ ID NO: 48276 - DNA, 201 bp, Homo sapiens
ccttgaaaatgggacataccagaggaatagacagaagtagagtcaaggatgtcaaaataagcaacaacaaaatgtacaaaatatacttattcatgagatawtctttatttatttatgtggttccccctcttagatttcttcgggtattatgtctcccacctgattaaaatttgtaaacaagtgcattctaaccagggatgc

SEQ ID NO: 48277 - DNA, 201 bp, Homo sapiens
tattcttcctcacgctttttctaggcttttatgtttcctataagtagagttgcttttataataaaaatacaattaaatgtgtgtccaatgttgcatatgargagaaagggacattctattgagaagagtaataatgatatcttgggcctctaaaacccaaattgtaccttgaaaatgggacataccagaggaatagacaga

SEQ ID NO: 48278 - DNA, 201 bp, Homo sapiens
ttttttgtttgtttgtttgtttgttttgagatggagtctcgctctgtcgccaggatggagtgcagtggcaccatctcggctcactgcaacctccacctccygggttgaaatgattcttctcccacctcagcctcctgagtagctgggattacaggcacatgccaccacacccagctaatttttgttatttagtagagacgg

SEQ ID NO: 48279 - DNA, 201 bp, Homo sapiens
ctcccgggttgaaatgattcttctcccacctcagcctcctgagtagctgggattacaggcacatgccaccacacccagctaatttttgttatttagtagakacggggtttcaccattttgaccaggctggtctcgatcccctgacctcatgatctgcccacctcagcctcccaaagtgctgggattacaggcatgagccac

SEQ ID NO: 48280 - DNA, 201 bp, Homo sapiens; identical to SEQ ID NO: 13852

SEQ ID NO: 48281 - DNA, 201 bp, Homo sapiens; identical to SEQ ID NO: 13845

SEQ ID NO: 48282 - DNA, 201 bp, Homo sapiens; identical to SEQ ID NO: 13846

SEQ ID NO: 48283 - DNA, 201 bp, Homo sapiens
ttgtgaggatcaagtaagatattgtgtgtgtgaagatgctctgtgaaatcataaagtcctttaaagatgtaaggtatgcttcgcagtgatctctctgaacyggaatagcttttccccgctggtataatgcagacatttttaatctgtaatcagaataggagtgaaagcaaaatgaaaatgcaagaagctgaataaatgtca

SEQ ID NO: 48284 - DNA, 201 bp, Homo sapiens
tgaggactcagctcagtcttaaatgaatactagtctttttccaaagcattgttgatcaaagtaaagcctgtgaggcaagggctttttttttttttcctttrtctttttttaagagacagagtcttgctctgttgcacaggttggactacagtggcacgaccatagctccctgcagctttaagctcctgggcttaaatgatc

SEQ ID NO: 48285 - DNA, 201 bp, Homo sapiens
tgacagttacatggtgtttagagctttctgtgggttcacaaattagcggtggctcacacgtgtaatcccagcgctttgggaggccaaggtgggtggatcasaaggtcaagagattgagaccatcctggccaacatggtgaaaccctgtctctaccgaaaatacaaaatttagctgggtgtggttgtgcatgcctgtagtcc

SEQ ID NO: 48286 - DNA, 201 bp, Homo sapiens
tatctgcattaactttttaatgcagaaaacaatttggaatgagacggaaaatgtgtattaaataaatttttcccctgggctcaatagtcttgaatatattratataaaaataaaacaacaaatctttggaaattacttctataattctatctagacatctatgtaacccatgaatatcactaagctttaagtgtcatcatg

SEQ ID NO: 48287 - DNA, 201 bp, Homo sapiens
tttccaagctatcaattttaattattttatatctcccaagaccaccattagttctcaacattctgtattctctgttcctttgtcatttctttatatcctcrtgtaaattattcttatgactctttgccagagttgcaattgtttcctgcccagactgtaatcctttttgcacccttgtagaatacagccttcctaaaggaa

SEQ ID NO: 48288 - DNA, 201 bp, Homo sapiens
aatttgttttttatctcattggtttacacaaggataaaattttatgaattttatactatctgcattaactttttaatgcagaaaacaatttggaatgagayggaaaatgtgtattaaataaatttttcccctgggctcaatagtcttgaatatattaatataaaaataaaacaacaaatctttggaaattacttctataat

SEQ ID NO: 48289 - DNA, 201 bp, Homo sapiens
ttttttaaatcttaatttcttatagagacaggttcttgctaagttgctcaggctcatctaaaactcctagcctcaagcaatcctcctgcctcagcctcccraagtactggaatgacaagtgtgaaccactgcacctggtttgacttagctgttgtttccactccctgcgtagagttcagtaccaaacaactaaagaataat

SEQ ID NO: 48290 - DNA, 201 bp, Homo sapiens
gactcacaatgttgtattgctcactactgaaggagatcactgctagcagcaacacaaactgtgttatcacacatttatttgctattctctttgaaagagtsagatcgctattacattgtatattgacatcagtgatattccaaggctaattcaaagtagatatcccactaatatgacttagattttttattttatagacag

SEQ ID NO: 48291 - DNA, 201 bp, Homo sapiens
gataatcatgccactgtatttagaatcattgttaaacagttcttatcccatctggaaagattgtaaaatgtgtatgttataatgtcagtattatatatatyttttatttatggatgctacaattgtgttcttcccctatctatgactctgcttagattggtgtgcaggccaaatctggttacttctcacgctctgatttaa

SEQ ID NO: 48292 - DNA, 201 bp, Homo sapiens
tgcatgccatttatagcgttatagttggagtagtgtaaactgctacattgtgaactataacaactgaactgaaaaagaaaagaacaaagacagaaacagtyctggacaatggaaattaaagaagagtgatttgtattcttttgatcctccggtttctctatgtcggcttctctttggttacctcaagtatcattagtatta

SEQ ID NO: 48293 - DNA, 201 bp, Homo sapiens
gccttttattatcttcccttgattatatagcaaatattggctgggtatctactatatgcacttcattgaactagatgtggggaaaggatacaaaaaataaratatagttctttttgtgctccggaatcttatgatttaaaacatatccccaaataggcataatgtaatttgagcaccttaagtagtatgaaagtactatag

SEQ ID NO: 48294 - DNA, 201 bp, Homo sapiens
tggtaaattatttaaccctgcaccactggctcagatagtcatcgctcacccacaacaaatatttatttaaatttgcgcatgaatttaccaattgttctccrttctaaaagcacctcgggcatttcttctgggattattttccttctgcctgaagtatatcttttggaagttcatttagtgaaagtaaattgatcaagaaac

SEQ ID NO: 48295 - DNA, 201 bp, Homo sapiens
aatttgttggaattgcaaattcttgagcccccaccccaaatatcagaaactctggtggtgaggcccatcagtttctttttatcaaacctttccaatgtttytgatacatgttaaagagacacaggaacatttttaaaagctgcttagtatgcacataaaatagagattatgctggaaaaggtacaaggacatatttatatg

SEQ ID NO: 48296 - DNA, 201 bp, Homo sapiens
ttgttaataaatctgcctttctttatctacaaccatcttggtaaattatttaaccctgcaccactggctcagatagtcatcgctcacccacaacaaatatktatttaaatttgcgcatgaatttaccaattgttctccgttctaaaagcacctcgggcatttcttctgggattattttccttctgcctgaagtatatcttt

SEQ ID NO: 48297 - DNA, 201 bp, Homo sapiens
ttattaccagaatagatgagaacatttggttcatcaaaaataaaaagcccaatgctgaaagagaaaaccaagcaaatgatctaaaagaaaaattaataaayattaatcgtcagaaatttaatgactggatactttaacctcactataatttgaaaaacaagttaagtaataatgatttgctatgtacctactcttactatg

SEQ ID NO: 48298 - DNA, 201 bp, Homo sapiens
tgaaacttgtttggaagaatggtgaaatcaccgatactttatgaaaagtttataggcacaatgtcccaaaggaatcagcagttgacaaaaagagaactcarttttacaaagggataagaaaatattgaagatgaaccctgcagcagctgactatccacgtcaatttgtgaggaaaaaaatacatcttgtttgtgccttaat

SEQ ID NO: 48299 - DNA, 201 bp, Homo sapiens
tactttatgaaaagtttataggcacaatgtcccaaaggaatcagcagttgacaaaaagagaactcaattttacaaagggataagaaaatattgaagatgarccctgcagcagctgactatccacgtcaatttgtgaggaaaaaaatacatcttgtttgtgccttaattgaaaagaactgagacagcagaacaacagccaac

SEQ ID NO: 48300 - DNA, 201 bp, Homo sapiens
attttactaataatggaaaagtttgcaaatcaataaatgtgattcacctcataaaactaacaacaaaaactacatgatgatctcaatagatacagcaaacrcttctgataaaattcaacacctcttcatgttaaaaactctcaatgcagtaggtgttgaaggaacatatctcaaaataataagagccatctttgaaaaacc

SEQ ID NO: 48301 - DNA, 201 bp, Homo sapiens
tgcctgtagtcccagctacttggggggctgaggcaggagaatcacttgaacctgggaggcaggggttgcagtgagccaagatcatgccactgcactccagyctgggtgacagagtgagactctgtctcaaaaaaacaaaacaaaacaaaaaaagaaatacacagtatcaaaatagaaagagaaaaagtcaaactatctgtt

SEQ ID NO: 48302 - DNA, 201 bp, Homo sapiens
cacaagattatttattttgctcaaattcaagcactggacttgtatgggctcacagcctattatttgcccccttcagccgatcgtctctggaaatgtcctgcccttaagatgtaaatcttttttagggcgtgttgaggggatagtctctttctgtgacccaggctggagtgcagtggcatgatcttgggtcactgtaatctc

SEQ ID NO: 48303 - DNA, 201 bp, Homo sapiens
taaatggcgtttgaggaaataggttataagtgacaccagcataacacttatcaaggacacaccaaaaattaatttgaaagaaagaggaagaacattggcascaaatgaaagacaggggtggcatttatcatcatccatagaggtgaaaaggactgtacgactacaaaattaaatgcctgtttctaggagggtcactggtgg

SEQ ID NO: 48304 - DNA, 201 bp, Homo sapiens
ttaagatgtaaatcttttttagggcgtgttgaggggatagtctctttctgtgacccaggctggagtgcagtggcatgatcttgggtcactgtaatctctgyctcctgtcctcaagtgatcttcccacctcagcctcccaggtagctggaactacaggcacaggtcaccacactcagctgttttttaaaattttttgtaggg

SEQ ID NO: 48305 - DNA, 201 bp, Homo sapiens
ttaatatatgatactttttttctcccatcacctattccccatcattaggccagaaatttgaatttttaagaaataatagtatcaataatacctataatgtgtagaatgaaccctctgtaccagacactctgaaaagcactttatatacctcctttacttaatccccacaaggaatctatcactctggtgttctccccatga

SEQ ID NO: 48306 - DNA, 201 bp, Homo sapiens
atggccgggtgcagtggctcatgtctgtaatcccagtactttgggaggccaaagcaagcaaatcgcttgagctcaggagttggagaccagcctaggctacrtggtgaaatcccgtctcttcaaaaaatacaaaaatatctcctcttgactctgtcccaaatacttgtctccctggctttaggagtaacacaatatgttatg

SEQ ID NO: 48307 - DNA, 201 bp, Homo sapiens
tcatctctgcctttcattctgttctttagccaaataattttctaaacaaatacttagcagaataatacaggctgttgagagatttttcatacgccaagtgaattgctcttataatatttgttgcactattttatttaatctgtcactaggtcaaagtgcatatatattggtttttaaaaatagaaaagagccatttcatat

SEQ ID NO: 48308 - DNA, 201 bp, Homo sapiens
tgcagttaaactctttaccaataggtggtgctagaaagtttaatatttattccaatagttgaagttatttggaaaatgtgctaaacatttttttgtgtttaaaaaaaaagtgctgtaaagcagtatgtacataattagtccttgcttgccttttttttttttttttttttttttaactttacagctccatttacgaaagtt

SEQ ID NO: 48309 - DNA, 201 bp, Homo sapiens
ggattttgctcttaacagctgttaaagctgcaatatttgcagttaaactctttaccaataggtggtgctagaaagtttaatatttattccaatagttgaarttatttggaaaatgtgctaaacatttttttgtgtttaaaaaaaaagtgctgtaaagcagtatgtacataattagtccttgcttgcctttttttttttttt

SEQ ID NO: 48310 - DNA, 201 bp, Homo sapiens
ccaggaggtggaggttgcagggagccgagatcatgccattgcactccagcctgggtgacagtgcgagactccgtctcaaaaaaaaaaaaaaaaaaaaaagraagaaaaagtagcctcagcttttaggtatgatgaaaaacctggatgattcctcgtttctaggaagcaaaatcactgtctagtcacttaacactttatgct

SEQ ID NO: 48311 - DNA, 201 bp, Homo sapiens
tgtcaaaattcaaactcgttggaatataatctgtgacgtgtcctcgtatatataacttacatgtaagacagattggattttgctcttaacagctgttaaarctgcaatatttgcagttaaactctttaccaataggtggtgctagaaagtttaatatttattccaatagttgaagttatttggaaaatgtgctaaacattt

SEQ ID NO: 48312 - DNA, 201 bp, Homo sapiens
cacaaaaatctttgttacagaatccaggaacctcacaacaaggaaagtctttgctatttctaaatgaaggttgtcactatagttcccttgtttcccttggkaaaagatatgaagtttgatcacctatttttgtgtttatgatattctaaaatatctgctcctcgccctcctatagtattgaaaatctctgcattgtatgtt

SEQ ID NO: 48313 - DNA, 201 bp, Homo sapiens
ctaaagaggaaaaacacaaaaatctttgttacagaatccaggaacctcacaacaaggaaagtctttgctatttctaaatgaaggttgtcactatagttccyttgtttcccttgggaaaagatatgaagtttgatcacctatttttgtgtttatgatattctaaaatatctgctcctcgccctcctatagtattgaaaatct

SEQ ID NO: 48314 - DNA, 201 bp, Homo sapiens
agatccatacatatactacaatggagtttttaaaattatttttgtagaataatattaaataatataaaaaagtacttatgatagagcattacattaaaaakttgtttccagattgtttaaaaatgtcatattttaagataataatatgataagggttgagacacgtacaccaaaatcctagagtttaagctaggatggtga

SEQ ID NO: 48315 - DNA, 201 bp, Homo sapiens
acttgtataaaaataaacatttggatatcacactagttaataaaacatgtctctaatatgtaaaggcttctcacaatccattcttggatttttctttctcsttttctttaggcaattacaggaaatgattgggccactcaggaattttactagtaaatgaaagttgaaatactataataacaaattattttcatgttttaa

SEQ ID NO: 48316 - DNA, 201 bp, Homo sapiens
ttaccaataggtggtgctagaaagtttaatatttattccaatagttgaagttatttggaaaatgtgctaaacatttttttgtgtttaaaaaaaaagtgctrtaaagcagtatgtacataattagtccttgcttgccttttttttttttttttttttttttaactttacagctccatttacgaaagttcgactggtcggtgg

SEQ ID NO: 48317 - DNA, 201 bp, Homo sapiens
aatgtgctaaacatttttttgtgtttaaaaaaaaagtgctgtaaagcagtatgtacataattagtccttgcttgccttttttttttttttttttttttttaactttacagctccatttacgaaagttcgactggtcggtgggagcggccctcacgaggggagagtggagatactccacagcggccagtggggtacaatttg

SEQ ID NO: 48318 - DNA, 201 bp, Homo sapiens
gttgctatcactgtagaaaaccctgcttcactaagatagcatgttggaaatggaagcaggcttttcagtgcttttgtggcaatttcaggatattctgcttygaaagtttaatccagaatgtatggaaatttgaagttgtctcaaacatacctttaaaggcaccaaaagcagctgtacaactgaagtacatcaactcacttt

SEQ ID NO: 48319 - DNA, 201 bp, Homo sapiens
aaaattcaggcataaattgagtgtctgtcctgcttgcccccctcccctgggattcattgctatgtagtgttgaatggatgcagctgcgttcatggttatgraagttaccataactccattttcttgggaagtactacattcttctgcagggaatagggggcacatagagattccctttgatacagaaatcttacatttctt

SEQ ID NO: 48320 - DNA, 201 bp, Homo sapiens
agcatgttggaaatggaagcaggcttttcagtgcttttgtggcaatttcaggatattctgcttcgaaagtttaatccagaatgtatggaaatttgaagttstctcaaacatacctttaaaggcaccaaaagcagctgtacaactgaagtacatcaactcactttcgactctaaagcctgccatcagatgcagcttgtcact

SEQ ID NO: 48321 - DNA, 201 bp, Homo sapiens
taaacataaatgccatttaaaagttattcttagctgtcttttctttgcttttttattaccacttttacataccataatcaattttctatgtgaaattttcaaaaaaaaaatgtaagggtaaacagaaggcaatcaaaaaatgcacctctatacctctgaactatcccttaatgaatgggagtaaatataatctcaaagata

SEQ ID NO: 48322 - DNA, 201 bp, Homo sapiens
aggtggagcttgcagtgagctgagatcgcaccactgcactccagcctggatgacagagcaagactccatctcaaaaaaaaaaaaaaaaaaaaagactttcycagataaacaaaagctgaggaagtttattgccagtatgtcctgccctcgccctctgagatatgttaaagggactccttcaggttgaaatgaaaaaacact

SEQ ID NO: 48323 - DNA, 201 bp, Homo sapiens
aatctagaataaggttttgtttgggagaaggcacagttagagcaataaaagctggtaagtctctctgcttcagtatagtgtcattgaagaggcaaatctasacgcacattcatttattttcgaaggtcctacactctgaccatcttgatcctctcacctaagcttgtctagtctagtccagctcaagagagtgtaatattc

SEQ ID NO: 48324 - DNA, 201 bp, Homo sapiens; identical to SEQ ID NO: 13848

SEQ ID NO: 48325 - DNA, 201 bp, Homo sapiens
atataatcaaatgtttgagtatgcctgatttttcatagcatgcatgcatgataaatatattatgtttggatatatttgacttgtataaaaataaacatttrgatatcacactagttaataaaacatgtctctaatatgtaaaggcttctcacaatccattcttggatttttctttctcgttttctttaggcaattacagga

SEQ ID NO: 48326 - DNA, 201 bp, Homo sapiens
aagagttcactcactgtgatttgccttcccatgcagatttcccaaggggagaaagtggccttgtcaagcagattcaaatattccagtttttaaggcaattrcatttctcattgtaaattgaattgacatttagtcccaagattctgtttaacattagtctgcctctaagagatagatctgctcactgagctgacaagatca

SEQ ID NO: 48327 - DNA, 201 bp, Homo sapiens
tttaaaagaaatacaatgttatgagcagagttgaagtaccagtatgtctacctgtcttcctttccagggtaaacctttatcctggagtttgtttccttccrttcatgtttttgtgcatttactacatatgtatgtactattcttatgtcccagttctttcctaaagaaaggattgaaacttctctgaaactagctaactca

SEQ ID NO: 48328 - DNA, 201 bp, Homo sapiens
agggacaccttatctctaaagaaaaacttttaaaaatttttaaaagaaatacaatgttatgagcagagttgaagtaccagtatgtctacctgtcttccttwccagggtaaacctttatcctggagtttgtttccttccgttcatgtttttgtgcatttactacatatgtatgtactattcttatgtcccagttctttccta

SEQ ID NO: 48329 - DNA, 201 bp, Homo sapiens
tttcaaaaataaagaaaagaaataatatttataataaatagctaatacacagtcatgtgtaccacttggacctttgaaatgttcacatttaccatcttgaytacaagtatttgttttttaagagatataattttggctgggtgcagtggctcatacctgtaatcacatcaccttgggaggccaaggcaggaggatcacttg

SEQ ID NO: 48330 - DNA, 201 bp, Homo sapiens
gacatgacacacagatattctgatttcagggagtttgtgctgtggccttgatacatgtgatttccaaaagttctccttgggattctgaagcacaaagtagwtgagaaactgctatttaatatatgatactttttttctcccatcacctattccccatcattaggccagaaatttgaatttttaagaaataatagtatcaat

SEQ ID NO: 48331 - DNA, 201 bp, Homo sapiens
agacagggtctcactttttcacctaggctggagtgcagtggtgcgatcatagcccattgcagcctcaacctcttgggctcaagcaattctcctacctcagyctcgtaagtatcttgggttacagggacatgctaccatgactggctaatttttgtagtttttgtagagccagggtttctccatgttgcccaggctggtctc

SEQ ID NO: 48332 - DNA, 201 bp, Homo sapiens
catgctaattggggtaaaacaaatagattatattatacaactctttcaatctcattatccatttgtcttttgtttttgtgatgaatactattttctaaaawttccacaaagaaaattgttcaattttcaagtcaatttctatccactaagggaaaatcaagcttatgaatagaaacaattacaacctccttccttactaaa

SEQ ID NO: 48333 - DNA, 201 bp, Homo sapiens
gccagagcaatcaggcaagataaggaaatatagggcatctactttgggaggctgcagtgggaagatcacctgaggtaaggagttccagaccagcctggccmaatggcaaaacccgtctgtactaaaaatacaaaaatcagccagtgtggtggtgggtgcctgtagtcccagctacttggggggctgaggcaggagaatcac

SEQ ID NO: 48334 - DNA, 201 bp, Homo sapiens
tagggccttgtaaataatttgaaatatcacaatattgagttcagaatggagcttcctaagtaataactattattattgttaacattatacaatgttattawacatttcaatatctgtccattctattatattttaattaccttgtgatgatctgtctccagttaaagcaaacattgtgaattgccctgattaaaaacaaat

SEQ ID NO: 48335 - DNA, 201 bp, Homo sapiens
tgtgaagatagatgatatacatccaggtacatgtgtaggggaggattgctattttatttatatcctgcagaggatgtgtatgtgtgtgtgtgtgtgtatgyacgcacatgtgtgtatatgtgtgtgtgttttgggggattagtaaatgttctagtagcctaatcacataatacactgaatgataagcattactcatgactg

SEQ ID NO: 48336 - DNA, 201 bp, Homo sapiens
agtggtccacgaggatttccaggtccaataggtatggtaattttagctatttaatcatatactgtgaagatagatgatatacatccaggtacatgtgtagrggaggattgctattttatttatatcctgcagaggatgtgtatgtgtgtgtgtgtgtgtatgcacgcacatgtgtgtatatgtgtgtgtgttttgggggat

SEQ ID NO: 48337 - DNA, 201 bp, Homo sapiens
aaggctgaggcgggagaatcacttgagccctgggggttgagactgcagcgagcagagatagcaatactgcgctctggcctgaaacatggcaagatcatgtaaaaaaaaaaaaaaaaaaaaagaagagttgagggtaaagataactaatcatgagaaggaccatttattttatgtcgaataatgaaaagttttcactttttt

SEQ ID NO: 48338 - DNA, 201 bp, Homo sapiens
tggcttttttttgaagaaaaggtttttagtgaatatcagagacccacatttacctggcttactccagaactacaatatgtgactttttcacagcaaacacygcatctctgaaaacttattttcctcctaatattttaatgattcctttcctgaatcctcatagtagccatctcaaatttaattattgcattcttttcaatg

SEQ ID NO: 48339 - DNA, 201 bp, Homo sapiens
tttttttttttttaagatggagtttcactcttgtcgcccaggctagagtgcaatggctcaatctcagctcactgcaacctccacgattctcctgcctcagyctcccaagtaagtgggattactaggtaatttttgtattttaagtagagatggggtttcaccatgttggccaggctggtctggaactcctgacctcaagtg

SEQ ID NO: 48340 - DNA, 201 bp, Homo sapiens
ttcacattgtcccatatttcttggaggctttgttcatttctttttattcttttttctctaaacttctcttctcacttcatttcattcatttgatcttcaawcactgaaaccttttcttccagttgatcgaattggctactgaagcttgtgcattcgtcacgtagttctcgtggtgtggttttcagctccatcgggtccttt

SEQ ID NO: 48341 - DNA, 201 bp, Homo sapiens
cagcaatggcaggcgcccctcccccagcctcactgccaccttgcagtttgatctcagactattgtgctagcaacgagcaaggctccatgggtgtgggaccmtctgagccaggcgcgggatataatctcctggtgtgctgtttgctaagaccattggaaaaacacagtattagtgtgggagtgacctgattttccaggtgcc

SEQ ID NO: 48342 - DNA, 201 bp, Homo sapiens
aggcgcccctcccccagcctcactgccaccttgcagtttgatctcagactattgtgctagcaacgagcaaggctccatgggtgtgggaccctctgagccakgcgcgggatataatctcctggtgtgctgtttgctaagaccattggaaaaacacagtattagtgtgggagtgacctgattttccaggtgccgtctgtcaca

SEQ ID NO: 48343 - DNA, 201 bp, Homo sapiens
gctaccggctacatgcctctccagcctcttctttttgaacctcctttgtacctgtttagagaaaaagcataaatagtgtactaccaacctaactaaggttrttatagtctgtttgtttaaaataccatttttttctccttttgtctttttcccactctcgaaggtactcaagaaaattgaacagatgtaatagatcaaatt

SEQ ID NO: 48344 - DNA, 201 bp, Homo sapiens
aggttattatagtctgtttgtttaaaataccatttttttctccttttgtctttttcccactctcgaaggtactcaagaaaattgaacagatgtaatagatsaaattaaaacattttatttcctgaaagccttttttgcctgttgtaatgtgcaggacccctctcctttaatgggagagacaggaagttacctgaatctagg

SEQ ID NO: 48345 - DNA, 201 bp, Homo sapiens
atatataatatatttgccaactaatataatatataatatattaacataatataaattacatataattatacatatatttatattatatattatataattgscaaatatatatggtattacatataatataattgggaaatatatatttataatatatgttatattaatatgataatatatttattatattatatattatat

SEQ ID NO: 48346 - DNA, 201 bp, Homo sapiens
actttcatatttgataattatgtatgtaacaaaggctgtgaatgctcacttatgttttacaggaaatcagtaaattagaggagcgtgtttacaatgtatcrgcagaaattatggctatgaaagaagaacaagtgcatttggaacaggaaataaaaggagaagtgaaagtactgaataacatcactaatgatctcagactga

SEQ ID NO: 48347 - DNA, 201 bp, Homo sapiens
taaaacaattttaattatggaagaagacaacactttctaacagtaggctgggcttttttgttttattagatcctaaaaacagcccttcccttcaagagaarctgaagtccttcaaagctgcactgattgccctttacctcctcgtgtttgcagttctcatccctctcattggaatagtggcaggtaacgtaacccagagtt

SEQ ID NO: 48348 - DNA, 201 bp, Homo sapiens
tataaagtctacagtgtttcacattcactcaccgctcactcactgactcacccagagcaacttccagtcctgcaagtttcatttatccaattgccctgtayaggtgcagaacttcgtatcttttataccatatttttactgcatttctctatgtgtagatatgttagaaacacacatacttgccattgtgttccaactgcc

SEQ ID NO: 48349 - DNA, 201 bp, Homo sapiens
catatatttatattatatattatataattgccaaatatatatggtattacatataatataattgggaaatatatatttataatatatgttatattaatatrataatatatttattatattatatattatatatattatatatttgcctattatataatatattatgtaatatattaacataatataaattatatattatat

SEQ ID NO: 48350 - DNA, 201 bp, Homo sapiens
tgtacagctacacaatttatggtttaagccaggtgttattataaaagagtaaaaatgttgtttaaaaaggtttctaaagtattaaaggtactgtaaactarggctaatttattattgaacaaataaaattttttatacattcagtgtagcttaagtgtgcaatgtttataaagtctacagtgtttcacattcactcaccgc

SEQ ID NO: 48351 - DNA, 201 bp, Homo sapiens
taaggctaatttattattgaacaaataaaattttttatacattcagtgtagcttaagtgtgcaatgtttataaagtctacagtgtttcacattcactcacygctcactcactgactcacccagagcaacttccagtcctgcaagtttcatttatccaattgccctgtacaggtgcagaacttcgtatcttttataccatat

SEQ ID NO: 48352 - DNA, 201 bp, Homo sapiens
atatatccataagcaacaaaaataaagtaattgggatccatcacaataactatgaacaaagtaactatccacatgatctggaatttgcccatatttgtggyttgttttctgtatactgtttttgatggagatattatagtcccctaataatacatatacctacttcagcttaagaaaaaactatattttgccaaattttgt

SEQ ID NO: 48353 - DNA, 201 bp, Homo sapiens
cttgaggtcaggagttcaagatcagcctggacaacatggtagcagtgagctgagattgcaccactgcactccagcctgggaaacagagtcagtgagactcygtctcaaaataagtaaataaataaataaatacttttttttttttttttttttttttgagacacagggtttcactcttcttgcccgggctagagttcagcg

SEQ ID NO: 48354 - DNA, 201 bp, Homo sapiens
tgaaaataaagcacactgacagaaagaaacctcattaggatagaattttgggagattggtgtcttgttattcccagagtctgacttttctaatcacgtagyattgtcagggatatctaaattttaaacttcagattttgtacaaaaaaacctaaaaggactatattttaaaataagaagcatgtacaaataattgtaaagg

SEQ ID NO: 48355 - DNA, 201 bp, Homo sapiens
ccatcagagaaatgctaatccaaaccacaatgagataccatctcacaccagttagaatggtgatcattaaaaagtcaggaaacaacagctgctggagaggrtgtggagaaataggaacacttttacactgttggtgggactgtaaactagttcaacccttgtggaagtcagtgtggcaattcctcagggatttagaactag

SEQ ID NO: 48356 - DNA, 201 bp, Homo sapiens
caggaaacaacagctgctggagaggatgtggagaaataggaacacttttacactgttggtgggactgtaaactagttcaacccttgtggaagtcagtgtgkcaattcctcagggatttagaactagaaataccgtttgacccagccatcccattactgggtatatacccaaaggattataaatcatgctggtataaagaca

SEQ ID NO: 48357 - DNA, 201 bp, Homo sapiens
ttgtggaagtcagtgtggcaattcctcagggatttagaactagaaataccgtttgacccagccatcccattactgggtatatacccaaaggattataaatyatgctggtataaagacacatgcacacatatgtttattgcggcggcactattcacaatagcaaagacttggaaccaacccaaatgtccaacgatagcctgg

SEQ ID NO: 48358 - DNA, 201 bp, Homo sapiens
cacttctcttttttttttaaagcggcctaaatggggtgaagagtgagttatctgacaaatttagattttgcaaacctgtgcattgatgagagtgctattgraacacattaagaaagattttcaacgcaggaatgtgtcatttcctttcttcatgtaccagatgctgaaatactatgagataaagattttaggtttcaattg

SEQ ID NO: 48359 - DNA, 201 bp, Homo sapiens
tgttgtaacaaatgggaggcttaaaacagaaatgtattcgctcacagttctgagatgcagaagtctaaaatgcaggtgtcagaaagaccatgtgccctttmgaaggctctagagaagaatcttcctgtgcctcctcccagcttctacgggctactggcagtccttagtgttccttgcctctgtagctgcaccactcatctt

SEQ ID NO: 48360 - DNA, 201 bp, Homo sapiens
tatgtttattgcggcggcactattcacaatagcaaagacttggaaccaacccaaatgtccaacgatagcctggattaagaaaatgtggcacatgtacaccrtggagtactatgcagccacaaaaaaggatgagtttatgtcctttgtagggacatggatgaagctggaaaccatcattctcagcaaactatcgcaaggaca

SEQ ID NO: 48361 - DNA, 201 bp, Homo sapiens
ttaaagcggcctaaatggggtgaagagtgagttatctgacaaatttagattttgcaaacctgtgcattgatgagagtgctattgaaacacattaagaaagrttttcaacgcaggaatgtgtcatttcctttcttcatgtaccagatgctgaaatactatgagataaagattttaggtttcaattgtaaagagagagaagtg

SEQ ID NO: 48362 - DNA, 201 bp, Homo sapiens
atcaacctggcaggtggactatatctccacttgcttctattatgggttctttttcttttttccttccatcttttctttcctttccttttctctcttttcctttttttttttttctttttgagacagggtctcactttttcacctaggctggagtgcagtggtgcgatcatagcccattgcagcctcaacctcttgggctca

SEQ ID NO: 48363 - DNA, 201 bp, Homo sapiens
attatatagcaaatattggctgggtatctactatatgcacttcattgaactagatgtggggaaaggatacaaaaaataagatatagttctttttgtgctcmggaatcttatgatttaaaacatatccccaaataggcataatgtaatttgagcaccttaagtagtatgaaagtactatagataattactagcaccttaagt

SEQ ID NO: 48364 - DNA, 201 bp, Homo sapiens
cttgggctcaagcaattctcctacctcagcctcgtaagtatcttgggttacagggacatgctaccatgactggctaatttttgtagtttttgtagagccakggtttctccatgttgcccaggctggtctcaaactcctaggctcaagccatcctcccgccttggcctcccaaagtgctgggattacaggcgtgagccactg

SEQ ID NO: 48365 - DNA, 201 bp, Homo sapiens
cttgaagactaagtaagattcacacagcatataatgggaggttggcatttgcactgaccaggtaaaaatacttatagaaaaaccatagaactgagattacrgatgttttatgcagtgattagccgttttatgcagtgggtaagagctaatcttctgggagtagactgcctgtgttcaaattccagctcccctgctccctag

SEQ ID NO: 48366 - DNA, 201 bp, Homo sapiens
gggatctttctcccaatccaactatccatttttgtgtgtgagggagttgacattcttataaaaccccaactgtagaacgaagtgactggtctaacaatggmtctttcaccgaacgtgacccatcagaactaattcctaaagcttttaaacttagaaccatctgtaaaatgtgctgctggtcagaagcagtactgtgtggta

SEQ ID NO: 48367 - DNA, 201 bp, Homo sapiens
ttgaagactaagtaagattcacacagcatataatgggaggttggcatttgcactgaccaggtaaaaatacttatagaaaaaccatagaactgagattacaratgttttatgcagtgattagccgttttatgcagtgggtaagagctaatcttctgggagtagactgcctgtgttcaaattccagctcccctgctccctagt

SEQ ID NO: 48368 - DNA, 201 bp, Homo sapiens
tacaaaaaaaaaaaggaagaagttaataagttaataataaccatttatttgctaagaaatatataaatgtgagatatgaggtattatcagcaacgtttttwtttaaaaatatatagaaaagatatatatttatttttcattgtttgaaagttaagacaaatggatgaaaaaaacagtgctatgataaatatgaaacaatta

SEQ ID NO: 48369 - DNA, 201 bp, Homo sapiens
gattagccgttttatgcagtgggtaagagctaatcttctgggagtagactgcctgtgttcaaattccagctcccctgctccctagttgagtaacttgactrgttacttacacatttcagttccctaacctgtaaaatggagaaaatactacttgtacctcatgaagattccgtgagaacaaaataagaaaagctcatattt

SEQ ID NO: 48370 - DNA, 201 bp, Homo sapiens
agtaatggtctacctgtgtgagcaaaatacaaaaaaaaaaaggaagaagttaataagttaataataaccatttatttgctaagaaatatataaatgtgagrtatgaggtattatcagcaacgtttttttttaaaaatatatagaaaagatatatatttatttttcattgtttgaaagttaagacaaatggatgaaaaaaac

SEQ ID NO: 48371 - DNA, 201 bp, Homo sapiens
gtttagtgagtggataagtcagtcaagtgcctataatgatacctggattggcttttcctgtgactgtccttttgctttctactgcaaagatgtggaacatkttttcttcttttttattccaataggcttggtagtaagaatataattggagattaaaacaattttaattatggaagaagacaacactttctaacagtaggc

SEQ ID NO: 48372 - DNA, 201 bp, Homo sapiens; identical to SEQ ID NO: 13813

SEQ ID NO: 48373 - DNA, 201 bp, Homo sapiens
ggtaatttttgtattttaagtagagatggggtttcaccatgttggccaggctggtctggaactcctgacctcaagtgatctacccaccttggcctcccaawgtgtgtacaatcttttatctttaattaacatttataatttaacatttgttaacataatttttgggctgttatctaagtttttaattgtatgtgtcctgag

SEQ ID NO: 48374 - DNA, 201 bp, Homo sapiens
aatttaactgcatatttaggatgacactcttaatgtaataatagctacagtagtaatgcttatcaaacagcttctttttttttttttttttttttgagacwgagtcttgctctgtcagccaggctggagtgcagtgcagtggcacaatctcggcacactgcaacctccgcctcccgggctcaagcaattctcctgcctcag

SEQ ID NO: 48375 - DNA, 201 bp, Homo sapiens
tggcacaatctcggcacactgcaacctccgcctcccgggctcaagcaattctcctgcctcagcctcccgagcagctgggactgcaggcacccaccaccacrcctggctaatttttgtattcttagtagagacggggtttcaccatgtttgccaggctggtctcgaactcctgacctcaggtgatccacacacagcctcttt

SEQ ID NO: 48376 - DNA, 201 bp, Homo sapiens
ataaaaggtataaatagatacatatagagagatataggaaaacagaaaacctcagccatgactgaatagtgataagattgtgtttaacattttcctcattstctataattattcatgttttgtttttttttttttgagatggaatctcactctgttgcccaggctggagtgcagtggcgtgatctcggctcactgcaacct

SEQ ID NO: 48377 - DNA, 201 bp, Homo sapiens
aattatttttaattctcgcaataattctttaaatttatattgtgatcatattttacatatctaaagaaagttcaattcaaataagttaaaatatttgcctragatcacacagctaaatgatgtcacagtcaatactcaaatctagatttcagattcaaaagttgatgctctttcttctttgctaccaaggatgaatatcag

SEQ ID NO: 48378 - DNA, 201 bp, Homo sapiens
gccaggctgatctcgaactcctggcctcaggtgatctgcccgtcttggcctcccaaggtgctgggattacaggcatgaaccactgcgcctggctgaccatsgaatgcttttgaacccaaacatgaggaattgaaagcaaattggaaactatctggaaggtggtagaaattttgaacctgtttgaagtgataattaatggaa

SEQ ID NO: 48379 - DNA, 201 bp, Homo sapiens
aaaacaaaaagaaagaaagaaaaaagaaagaatatgataaaaaaactaaatagggaaaaatcttaggaaaacgaatgcatgtcaagtatgaaaagacagayggtaaatatgtattaaacataaagagctgattcacatgcttaggtaaaagaaacctgtggggatgtataagcagtgaatatgaatagataataacccaag

SEQ ID NO: 48380 - DNA, 201 bp, Homo sapiens
atagaggtgaaaaggactgtacgactacaaaattaaatgcctgtttctaggagggtcactggtggtagcatgtggagggagtgtgtggatgctatataggrttttttgaaattaaatacacttttcctcctcccagtgaaaataatttccactgaaatttgacaaatgtaaacaccatgtgcagttttcaaagaagggaat

SEQ ID NO: 48381 - DNA, 201 bp, Homo sapiens
cacttttaggtattatttaactcttatcaaaatctaaatgattctaaaataagctttattattcaatggtagtgaattttgcttgaaactgccatattcayatataagtctggaatatttataaatttatgttatctttttaaagatcactaagacagtagagcccaagaagttcaaaatagttttcctttcactttttag

SEQ ID NO: 48382 - DNA, 201 bp, Homo sapiens
ctactcgggagaaccacttgaacccaggaggtggaggttgcagggagccgagatcatgccattgcactccagcctgggtgacagtgcgagactccgtctcaaaaaaaaaaaaaaaaaaaaaagaaagaaaaagtagcctcagcttttaggtatgatgaaaaacctggatgattcctcgtttctaggaagcaaaatcactgt

SEQ ID NO: 48383 - DNA, 201 bp, Homo sapiens
gaatatttataaatttatgttatctttttaaagatcactaagacagtagagcccaagaagttcaaaatagttttcctttcactttttagtttcacatatgrtgaattatcctaaagaaacattttaaaagaagaaagctaaattatgaaaataatggccggggcagtggctcacatctgtaatcccagcactttgggaggc

SEQ ID NO: 48384 - DNA, 201 bp, Homo sapiens
aggaggtggaggttgcagggagccgagatcatgccattgcactccagcctgggtgacagtgcgagactccgtctcaaaaaaaaaaaaaaaaaaaaaagaargaaaaagtagcctcagcttttaggtatgatgaaaaacctggatgattcctcgtttctaggaagcaaaatcactgtctagtcacttaacactttatgctga

SEQ ID NO: 48385 - DNA, 201 bp, Homo sapiens
taaatttatgttatctttttaaagatcactaagacagtagagcccaagaagttcaaaatagttttcctttcactttttagtttcacatatgatgaattatsctaaagaaacattttaaaagaagaaagctaaattatgaaaataatggccggggcagtggctcacatctgtaatcccagcactttgggaggccaaggaggg

SEQ ID NO: 48386 - DNA, 201 bp, Homo sapiens
tggaggttgcagggagccgagatcatgccattgcactccagcctgggtgacagtgcgagactccgtctcaaaaaaaaaaaaaaaaaaaaaagaaagaaaargtagcctcagcttttaggtatgatgaaaaacctggatgattcctcgtttctaggaagcaaaatcactgtctagtcacttaacactttatgctgaatgtct

SEQ ID NO: 48387 - DNA, 201 bp, Homo sapiens
gcatcataagtagaagaaattttattccacacacagtgagggttgcacatgaatgtagaaaagagaagagttataaaaaatgtaaaaattctcttctcatktggcttttcaaatctctagggaaaaaataaaccatttcataagcaatgagggagaatctgactatcatttgtggaagaaaaactagacccttcctctaca

SEQ ID NO: 48388 - DNA, 201 bp, Homo sapiens
tatgtaaaataaggttttgcgtatatatgaaatatatgtaaaataaggttttgcgtatatatgaaatatatgtaaaataaggttttatatatataagcaartctttgctacataataattcaacacatatatatatgttgttttatatatatatatatatatatatatatatgtatgtgtgttgaattattaggtagcaaa

SEQ ID NO: 48389 - DNA, 201 bp, Homo sapiens
ataagcaagtctttgctacataataattcaacacatatatatatgttgttttatatatatatatatatatatatatatatgtatgtgtgttgaattattakgtagcaaacacttggaaccaacccaaatgtccctcagtgatagactgggtaaagaaaatgtggcatatatacaccatggactactatgcagccataaaaa

SEQ ID NO: 48390 - DNA, 201 bp, Homo sapiens
tccaagctatcaattttaattattttatatctcccaagaccaccattagttctcaacattctgtattctctgttcctttgtcatttctttatatcctcgtrtaaattattcttatgactctttgccagagttgcaattgtttcctgcccagactgtaatcctttttgcacccttgtagaatacagccttcctaaaggaagt

SEQ ID NO: 48391 - DNA, 201 bp, Homo sapiens
aaaaaaaatagccattttcagttttcatttaagcatatgaaaccctggatttgtgtaagtatatagtacatactcataagtaaatctgtgtatcgcatgtktgtgtgtgtgtgtgtgtgtgtgtgtgtgtgtttatgtttatgtttatttaccctgggattacaatgaaatatgtaagaacaggtccatgatagataaagt

SEQ ID NO: 48392 - DNA, 201 bp, Homo sapiens
ttctgcacgtgtatcccagaacctaaagaataataaaaaaaatttcaagtttgaaaaattcgtttgaaatattaaaataatgaggtgattttaaggaaaaygcgtaataccaaatgatacgtgcatgatgatatgaactatgttacaggtatacatacatccaaagactcgagtttcatttaaaaaattaagggttttttt

SEQ ID NO: 48393 - DNA, 201 bp, Homo sapiens; identical to SEQ ID NO: 13808

SEQ ID NO: 48394 - DNA, 201 bp, Homo sapiens
tgatatgaactatgttacaggtatacatacatccaaagactcgagtttcatttaaaaaattaagggtttttttcctttattagggtgatgagatgacagaratttcatcctaacatatctataatattattaaaatgttttataataaaaacaaaaaagtaaggtatatggttcccaacaaattaaccttgaaattctttc

SEQ ID NO: 48395 - DNA, 201 bp, Homo sapiens
atagaatggaaggaatggatcaaaggaaatcaggagtttttgtgcagtcagatatgggtcttatagatgagagcggtctagaaaagcagttctgggctcarattgcgtgactgtgctttgccggcatattcctaactatatcacatattctccactatacagtaagtagatgataataataagtgggtatgataataaata

SEQ ID NO: 48396 - DNA, 201 bp, Homo sapiens
gccgaagtccaaaaattggaatagaatggaaggaatggatcaaaggaaatcaggagtttttgtgcagtcagatatgggtcttatagatgagagcggtctaraaaagcagttctgggctcagattgcgtgactgtgctttgccggcatattcctaactatatcacatattctccactatacagtaagtagatgataataata

SEQ ID NO: 48397 - DNA, 201 bp, Homo sapiens
gtgtaggtaactttgttagagctcttcttactttgcattttagtagtttacatgttaacagagtataaagtgttctgaagcaggagattaatttttgattyctactagagagcacagaacttgcatacagaaaataatcaacacttttttgtttaattagtgaaggaattaatggctttgccccactcaaagagaaacact

SEQ ID NO: 48398 - DNA, 201 bp, Homo sapiens
catattaccttatacacaagcacttaaaaaattttcactgtgtctgaaactgttccacatagcaaaagacagagataccaaattccacaatacatttgtcwcatccatgtgtcctcagaggaaaaataaccagaataagaatcagaggctctagatgccagtatttgctctggcatgattgtatatgtgatctcagttgct

SEQ ID NO: 48399 - DNA, 201 bp, Homo sapiens
ctggatctattctttgtaaatttgagaaagtcatacaccctttctcagtctcagtttatgtatctatgaaatggagataattatcattatttaacaaggtkattataaaaagtaaatttagaaatgtatgtgaaaagacctagcatattaccttatacacaagcacttaaaaaattttcactgtgtctgaaactgttccac

SEQ ID NO: 48400 - DNA, 201 bp, Homo sapiens
atcactaagctttaagtgtcatcatgttctgttgcctggatctattctttgtaaatttgagaaagtcatacaccctttctcagtctcagtttatgtatctrtgaaatggagataattatcattatttaacaaggttattataaaaagtaaatttagaaatgtatgtgaaaagacctagcatattaccttatacacaagcac

SEQ ID NO: 48401 - DNA, 201 bp, Homo sapiens
acccaggaggtggaggttgcagggagccgagatcatgccattgcactccagcctgggtgacagtgcgagactccgtctcaaaaaaaaaaaaaaaaaaaaargaaagaaaaagtagcctcagcttttaggtatgatgaaaaacctggatgattcctcgtttctaggaagcaaaatcactgtctagtcacttaacactttatg

SEQ ID NO: 48402 - DNA, 201 bp, Homo sapiens; identical to SEQ ID NO: 13856

SEQ ID NO: 48403 - DNA, 201 bp, Homo sapiens
cgctgggattacagatgtgagccactgtgcctggcccttaaatatttttcaatcaacaaaataacgtgaaaaccacttctcaacagccaatgtttgactgkcctggagacgttccacatcactgcttcctgctttttaatcatttcaccacaccccactgcactccaaaacagaagaactaaccttgactgtttttaaagg

SEQ ID NO: 48404 - DNA, 201 bp, Homo sapiens
cctctgccggactctgttctgcaggactctgttctgcaaactccagccactgcggcctccctgggctctcagctttctctcttcaatttagggagtcagcrgggctccaactgagatgccccgtcctgctctgcaccatggaaattctggacagtagctgagaccgttgtttcttggggattacgattcctgaaaaccatc

SEQ ID NO: 48405 - DNA, 201 bp, Homo sapiens
gaggtggaagcgtgcgggctcctatcttctggaagaactcttcgagggaaacttggaaaaagaatgttatgaagaaatctgtgtctatgaagaagcaagaraagtgtttgaaaatgaagtagtcactgtatgtacccccaccacaaaccacaggcctcctcattatttagacttctgctggcccagggagcatcatttctc

SEQ ID NO: 48406 - DNA, 201 bp, Homo sapiens
cacagcctacataaggatgacttcatttcccactgaaattgagcagttgtggcataagagatggataattggctaaaaatcggaagaatggggctcgaatsccccagcagttgagacctcaggctgaggcagtggccttctcatcggcttatctgtgcctatttctttcttttttttttttgagacagagtctcactcaat

SEQ ID NO: 48407 - DNA, 201 bp, Homo sapiens
tggctaaaaatcggaagaatggggctcgaatcccccagcagttgagacctcaggctgaggcagtggccttctcatcggcttatctgtgcctatttctttcttttttttttttgagacagagtctcactcaatccctcaggctggagtgcagtggcatgatccaggctcactgcaacctctgcctcctgggttcaagcgatt

SEQ ID NO: 48408 - DNA, 201 bp, Homo sapiens
taattcccctgaaaaagctgtttggatctttatcatttggtgacaagtatttgggacatgatagtgtcacttggggtcctcccaagagatgcccaaatggraagaagcctgtgtgcaggggattcagccgggaaaggccggggagaggggagggggaaagggggaggagtggggggaggcctgggttgggcattggacgag

SEQ ID NO: 48409 - DNA, 201 bp, Homo sapiens
gtaatgaatataaacattattgaggttatttgcctttttcctttacactgaatctttggaatctggtgtgaatttacactgaggtgcagccctcgtgtccmcaatgctccgtacccgagtgtggctgccgtgtggatggcacagcctcaggggccccccttgtgagtaataagcccctgaggtttctgtgtgtgacacccg

SEQ ID NO: 48410 - DNA, 201 bp, Homo sapiens
acggggtttctccatgttggtcaggctggtctccaactctcaatctcaggtgatctgcctgccttggcctctgaaagtgctgggattacaggcgtgagccwccacgcccggcatctacactttattataaaataaaatcggctttgtgtttgattttgcctaagagtggaggcttctgagtatgttaaggaaggctagagt

SEQ ID NO: 48411 - DNA, 201 bp, Homo sapiens
cctgcagatgtaggagcgagctaaggagtgctgctgaagccctggggcagctcctgcatccaggggaacctgaggaaggagccacacaaagtgagtcctgygccgcgcggcccggagagagagaaagagggattcacactttgtagaatagcctctccttgaacaagcagctttcaaatgcagtaactttgcaaagatgag

SEQ ID NO: 48412 - DNA, 201 bp, Homo sapiens
cacatggctggggaggcctcaggaaacataatcatggcaagcaggcacctcttcacagggtggcaggagagagaaaatgtgtgtcaatcacagggggaagycccttataaaatcattagctcttgtgagaatgcactcactatcacaagaaccacctccatgattcaatcacctccacctggtcctgcccttgacctgtgg

SEQ ID NO: 48413 - DNA, 201 bp, Homo sapiens
ttaaagaataaggaaaaaaaccttacatatatagtggaatgtggataaatatttaatgggatgtcataaccttttccagtgttccttgctgctttgtgtaratccaggcctccctctggtatcgttttcctcctgcctaaagggcccctttgatatctgctgtgctgtgaggcgtctggggaagaagccttcttgcgtttg

SEQ ID NO: 48414 - DNA, 201 bp, Homo sapiens
ggtttcaccatgttggacaggatggtctcgaatgcctgacctcaagtgacccacctgccttggcctcccaaagtgctgggattacaggcgtgagccaccaygcctggcctcatcattcactttctgtttacttaatggtcactcttgacacataaacatccatatttagcacaagtagtcagctatttctccctcctcagg

SEQ ID NO: 48415 - DNA, 201 bp, Homo sapiens
gggctggagtgtagtggtgtgatcatggctcactgcagcctcaacctcctgggttcaggtgatcctcccacctcagcgtcttgagtagctgggaccatagktgtgcacgaccacacacagctaatttttaaatttcatgtagagatggggtcttgctatgttgctcaggctggtctcaaactcctgggctcaagcaatcct

SEQ ID NO: 48416 - DNA, 201 bp, Homo sapiens
cctcctgacctgggtgctggttttggcataggtcttacatctacagatgttataaatgccactctatacttccattatttttgtttaaacagtatcctgtraagaagtttaaagaataaggaaaaaaaccttacatatatagtggaatgtggataaatatttaatgggatgtcataaccttttccagtgttccttgctgct

SEQ ID NO: 48417 - DNA, 201 bp, Homo sapiens
ggctgatccattcgcccagaggatgaagtgcttgcctacctcgggggagggagtagcggggtggccctgaggccctcgcaggctgagagcctgtggagacrgacggggctggggctggcggccggccggggaggaagccaggcagctctggaaagcagggccctcggtgctcccagtcacctgccttcttgtctcgtctgt

SEQ ID NO: 48418 - DNA, 201 bp, Homo sapiens
ttctcctccagaaaccacgccgggggctggctgcattctgagctgccccttccagacaggcccccatacttttcatagcaggggcccctctcctccccccmccacctcaaccattcacaatctgctcacaggctgggggggtcacacacaggcgtcctcagtgccagactcccagtgggagactgcagacagggaagacgc

SEQ ID NO: 48419 - DNA, 201 bp, Homo sapiens
ctcacatgtccttacctgtggcacttttaagattttaaatgctttttaattttaactttctaagatttcctctatcatggattttgaatttaattatactstgtattgttttcatgtttcttgcacatagggtttgttgagattcttgtatttgtgggctaatatcgcttgtcaaatttgaaaaatatttggtcataattt

SEQ ID NO: 48420 - DNA, 201 bp, Homo sapiens
agttggaaaaacactttctcacttggctcagcattttgcattagacggttgaaaactgcaacacttaacacttccagagccagtacccgtgctatgtgggsacatgctttatttcatttaatctttcaaacaacttctcgttttctccttttgtatccctggtaatattatttgctctaaaatcccctttgtctgatattg

SEQ ID NO: 48421 - DNA, 201 bp, Homo sapiens
gccacggtaaagttggaaaaacactttctcacttggctcagcattttgcattagacggttgaaaactgcaacacttaacacttccagagccagtacccgtrctatgtgggcacatgctttatttcatttaatctttcaaacaacttctcgttttctccttttgtatccctggtaatattatttgctctaaaatcccctttg

SEQ ID NO: 48422 - DNA, 201 bp, Homo sapiens
gtctggcagactgatggcgcaagtgccgtcttctctcgaacttggttttatcccctttaaagtgaggatctcacccctagaggtgcagtgaggattacagrtaacgttcttgacttatggtaggtattcaacaagtggcagctattattcataaacacatgaagagttccaggaacgacgccacggtaaagttggaaaaac

SEQ ID NO: 48423 - DNA, 201 bp, Homo sapiens
aattttcctaaaacaaactttgaaaaggagaataattaagtgacctagcaggacatagggttgaagattatctttagaacttccttgtttcttacatcctmgggaagaagtatcactaaaagtctggcagactgatggcgcaagtgccgtcttctctcgaacttggttttatcccctttaaagtgaggatctcacccctag

SEQ ID NO: 48424 - DNA, 201 bp, Homo sapiens; identical to SEQ ID NO: 13855

SEQ ID NO: 48425 - DNA, 201 bp, Homo sapiens
acttcagtattataaattgttctgaagttatttaactgaatatatggaattttcctaaaacaaactttgaaaaggagaataattaagtgacctagcaggayatagggttgaagattatctttagaacttccttgtttcttacatcctagggaagaagtatcactaaaagtctggcagactgatggcgcaagtgccgtcttc

SEQ ID NO: 48426 - DNA, 201 bp, Homo sapiens; identical to SEQ ID NO: 13858

SEQ ID NO: 48427 - DNA, 201 bp, Homo sapiens
tgttctacatgcacattcctgaaatacggacatgtgggaaacactgacacagaggacaacgatctgaagagaatgagaacacatggaccaacacaccagawctcttgtgtgcaaggctgtgataaaatgaacatggaccaacacacagaactgtgtgcaaggctgtgataaaatgactatttccaagctagcatttccttt

SEQ ID NO: 48428 - DNA, 201 bp, Homo sapiens
gcctggctaatttttgtatttttagtagagatggggtttcaccatgttggccaggctggtcttgatctcctgacctcgtgatccgcccacctcggcctccyaaagtgctgggattacaggcatgagccaccgcgcccggcctcactcacggagtctttgttctacatgcacattcctgaaatacggacatgtgggaaacac

SEQ ID NO: 48429 - DNA, 201 bp, Homo sapiens
aacaaataggctgtaaaacaggaaaattgtgcattgtttcaaccactattgtcctattaagtgaataaaatcaacattttcttaccttcaagttcatctayaggaaagaatatagaaaaacaaatatcccatttgtaacatttttatgttttaactctaaaggatgaattctggagacgatataagggtaagtggtttcct

SEQ ID NO: 48430 - DNA, 201 bp, Homo sapiens
ttataaatgccactctatacttccattatttttgtttaaacagtatcctgtaaagaagtttaaagaataaggaaaaaaaccttacatatatagtggaatgyggataaatatttaatgggatgtcataaccttttccagtgttccttgctgctttgtgtagatccaggcctccctctggtatcgttttcctcctgcctaaag

SEQ ID NO: 48431 - DNA, 201 bp, Homo sapiens
tggtttgttttttttgagatggagtctcaatctgtcacccagcctggagtgcagtggtccagtcccggctcacagcaacctctgcctcctgggcacaagcrctttccctgcctccacctcctgagtagctgggattacaggaatgtgccaccacgcccggctgatttttatatttttagtagagacggggtttcaccatgt

SEQ ID NO: 48432 - DNA, 201 bp, Homo sapiens
tttagaagttaaccattcatttgtttttggtttgttttttttgagatggagtctcaatctgtcacccagcctggagtgcagtggtccagtcccggctcacwgcaacctctgcctcctgggcacaagcgctttccctgcctccacctcctgagtagctgggattacaggaatgtgccaccacgcccggctgatttttatatt

SEQ ID NO: 48433 - DNA, 201 bp, Homo sapiens
agctggtggaagcaattgctattcccagcttgtgtgagtgtctagcacaggtccctctcacactcttgggtggttcttacccggccataattagtctccaygtacacgtgatcaccactgctctgctgaaaactgctaggcatgtggccatcctccagcattctctaccaagctctctcctctgccggactctgttctgca

SEQ ID NO: 48434 - DNA, 201 bp, Homo sapiens
tggctggtttagaagttaaccattcatttgtttttggtttgttttttttgagatggagtctcaatctgtcacccagcctggagtgcagtggtccagtcccrgctcacagcaacctctgcctcctgggcacaagcgctttccctgcctccacctcctgagtagctgggattacaggaatgtgccaccacgcccggctgattt

SEQ ID NO: 48435 - DNA, 201 bp, Homo sapiens
aactgctaggcatgtggccatcctccagcattctctaccaagctctctcctctgccggactctgttctgcaggactctgttctgcaaactccagccactgyggcctccctgggctctcagctttctctcttcaatttagggagtcagcagggctccaactgagatgccccgtcctgctctgcaccatggaaattctggaca

SEQ ID NO: 48436 - DNA, 201 bp, Homo sapiens
caaggcccacacactgatcagacacccagcatacattttctttctaggcttcaagtctgaataattctcctaattttagatactcctaccccaaactaagygtccccactccctacagaggtatatatctttaaaattcaactcggtttataaaaagcgaaaaggtgatgtgacttctatatcatgtgcttttgtggaggg

SEQ ID NO: 48437 - DNA, 201 bp, Homo sapiens
tccgggtgggaatggcaggctgcgtcccactgctccagggcctggtcctggtcctcgccctccatcgtgtggagccctcaggtaggcatctggcttacctrtctgttgtgcctgtgctgtgtctttcttgactcggtccatggtggatttgtagatgaggctttttccaggagccagaggagccctgagtgcccagactag

SEQ ID NO: 48438 - DNA, 201 bp, Homo sapiens
aggagggaagcacacagctgcacaggtcgtgccccgaggctcctgctgccggcacctcccccagcctggactttggctgtgtttgtagccctgtcccagcrctccgggtgggaatggcaggctgcgtcccactgctccagggcctggtcctggtcctcgccctccatcgtgtggagccctcaggtaggcatctggcttacc

SEQ ID NO: 48439 - DNA, 201 bp, Homo sapiens
tctacaggacctcccgtggcaggtaacagagcgctctccgcgtgcttcaatttattgttatgactttcacctcacttgtcatttcctaaatagaaatgttracaactaagtgaatcaggcatcctgactttgatgggctactgactgcactgaccaacctctattcacacttccaaccatgttctaatgccgagttcataa

SEQ ID NO: 48440 - DNA, 201 bp, Homo sapiens
taccttcaagttcatctacaggaaagaatatagaaaaacaaatatcccatttgtaacatttttatgttttaactctaaaggatgaattctggagacgatayaagggtaagtggtttccttcgtctcctcagaagtattaattcctcgggatgaggtgcgtgggtgggcttaggacgcttcacgaccccagctcagcggatg

SEQ ID NO: 48441 - DNA, 201 bp, Homo sapiens
tatgcatcctgccccgtgccccactgagtcagggatgttttaactcagctggtggaagcaattgctattcccagcttgtgtgagtgtctagcacaggtccstctcacactcttgggtggttcttacccggccataattagtctccacgtacacgtgatcaccactgctctgctgaaaactgctaggcatgtggccatcctc

SEQ ID NO: 48442 - DNA, 201 bp, Homo sapiens
agagagcacaagagaggctgaggaggcacgccggcgtctcacggggttgtgcacccgcccttctctgggagggttcccacggaaggttccggggcccgaartcagggctgagcactgagacccagctctctgctcgtcccaccaggtggctcttggacaactgttccacctcttcatgcctcagggtcgcccagggtagaa

SEQ ID NO: 48443 - DNA, 201 bp, Homo sapiens; identical to SEQ ID NO: 13861

SEQ ID NO: 48444 - DNA, 201 bp, Homo sapiens
tgaagagggaaaaggaagtcagcattgctggactgtagtgaacaaaggagggatgaggctgaagtctagcagtctctgatttctcaggcccttgaggactrtggtgaagctgctatttacggcatgaaggaaggagaagttgactcaagcatataccttctacactctctaccaagccctgccctgggcataatagccatg

SEQ ID NO: 48445 - DNA, 201 bp, Homo sapiens
aaagcaggagaccatcagcgtgcagctgcttgataccaaagatcagagccacgatctaggtaagcatgctctcttggtcttggcttgctttcagtacctgmttccacctctgccccataactagttgtgaggatcagcttagaatgagctcttccttcctttttcccctttcttgcttcttttctatttggcattctggtt

SEQ ID NO: 48446 - DNA, 201 bp, Homo sapiens
agagagaagcctgcagaggcaggcaaggaccagagtacaccttgtcaatcatcatcaagctcctgttgggaaaagttgaatgaataactcagtatcttctrgggcaaccactttcaattttagaccaactgtactttgttagaagagttttccattgtgtcctccctgagccttcttttcttcaggttaagcatcttcata

SEQ ID NO: 48447 - DNA, 201 bp, Homo sapiens
ctactcgggaggctgaggtgggaggattggttgagccagcgagtttgaggctacagtgagagctgtgacttctgcctgggtgacagagcaagactgtcttaaaaaaaaaaaaaaatcgcaaagattccacagaacaacccttcaaaatagacaaacaacttcatcacatttaaatatattagctacaaacataaaatattc

SEQ ID NO: 48448 - DNA, 201 bp, Homo sapiens
gggaggctgaggcagaagaatggcgtgaacccgggaagcggagcttgcagtgagccgagattgcgccactgcagtccgcagtccggcctgggcgacagagygagactccgtctcaaaaaaaaaaaaaaaaaaaaaagaaatggcattaaaaaaatattggcactgatgaggcaagtaattatttgcataatctcaagtggc

SEQ ID NO: 48449 - DNA, 201 bp, Homo sapiens
ctgctgaaactccctttgtagtttgccatcttttattaccctctttctttgccactttttgcacactctctgcatatccatgttttggatttttttttccrtttattagcttatattatccaggccaaatttcatttcattatttcctgcccatacttttatagacctttgggtcctaggtattgctcttccttctgtttg

SEQ ID NO: 48450 - DNA, 201 bp, Homo sapiens
tttatagacctttgggtcctaggtattgctcttccttctgtttgtggttagaatgccagcctatctcttggctgctatataattcatgtgacactggattytaccgcctctttcatatcttgagatatcattgaaacccaaaagagaactggctgaaagtcatttagggctttgaacattctgctctgttggctgcattgt

SEQ ID NO: 48451 - DNA, 201 bp, Homo sapiens
accctatttttctttacattggaggagaagaaagtgataccaagaattaggcacccctatgatcttatttccaagaggttgttttcgtcattctgtagctrtggcatgtagggagaagatttctctgctaggtgtaaaaaggccagtcttctacttcttgctctgctaccacctgtctctgtgacctggaagcagatggct

SEQ ID NO: 48452 - DNA, 201 bp, Homo sapiens
tcagcctcattaccaaggaagggtctccacaagagtctgaaatcccttttccatttgtcccgtgtgcattttgccaagagaacttctaaagggacagggagggaggaaaagctgattgaccagccccgaagcacaaggaccacttgtctgcctcagggttcatcccccaaatacctttttccacctgagaagtaggagtga

SEQ ID NO: 48453 - DNA, 201 bp, Homo sapiens
caaacgagctcaacagcaacctcaaactgcagtgccctgatggctatgccataggtatgatgggcccgagaggggagcagtaggaggggcaattccttccmgcaatgcagggctaatgcctgggtgggtcattgaacaccctggccacatgagttcctgcgtaggcactacagaaagagagatgaattagtgtagaccatg

SEQ ID NO: 48454 - DNA, 201 bp, Homo sapiens
ctttaagtatcagcagtctccaatgttccataataggcacacttctcattctccattctctccttgtatgactccaaaatctctatctttagtctgggcctttttttttttttttttttttttgacccatgaacttgtatatctaattgctctactttgacgccccaagggaactcacattcgacacatcttacacaaagc

SEQ ID NO: 48455 - DNA, 201 bp, Homo sapiens
cttggcctcctcctcatcaatcttctctgtttcatagtctttcagttcctcagcatcttttacagccagaggaaatactaacctgtctggttactgatctdcttgtttctatgccttttttgtttaaaaaatggtcaccacttccaaacttttgatttaaagtcccttaaagatccctggagtcttgagtttaaaatttag

SEQ ID NO: 48456 - DNA, 201 bp, Homo sapiens
aggaattctcttcattatcattttgtgttttttcccatggtactttgttgttattaaaaaattattactaaaaataattgatgcagaggtagatgaaagayaggaataacatcttcatttgaaaattgtcaaaaaggacatagggagggggatgtggtcgtgtggaattgacataaacatatatttgccttggaggataat

SEQ ID NO: 48457 - DNA, 201 bp, Homo sapiens
gcaagatttgagtaggcatttgagaataggcagcctgctgagaggtaaagatgcagactccatcagtgagggtcctagcaggaaacagatggcacattcawacagaataattaaggagaattgaaggaggggctgttttcaaggagaagctgtttacaatgttgtaggcaggattaaggacaaccaacaaggccttgtgct

SEQ ID NO: 48458 - DNA, 201 bp, Homo sapiens
gagtctgaagacattctctgtccattgcccctgcacctgttatcttgttggccttaaccaaacagcccaagtcctaacagcagctgaaataacagacgggyaggagaacttgagattttttgacatcatccttttgtttatgaaatcccccccaatgctggaatctgacaggaattctcttcattatcattttgtgttttt

SEQ ID NO: 48459 - DNA, 201 bp, Homo sapiens
aaagagccctcatttaacattaactctgacttaaacttgggtaaaatatagttttatcataggaatttttccgtggaaaacataatctttttagtaactgytgtacccatcccactgtccccaccttttaacttaagggagtgacttgggtttttatttttcaatctgaaaacttgggataacaacaccttcctcaaagag

SEQ ID NO: 48460 - DNA, 201 bp, Homo sapiens
gctgggcagtttgttagctatgcaatcttgggcaagccttttaatctctctgagcctccaattccacatctatttggaaggaataatagtatctgactgcytggatcacacaattgccatgagggtctcataaaataatatcccagaaagagttctgggaagagttaaccagcatgcagatgaaagggggcattgttattt

SEQ ID NO: 48461 - DNA, 201 bp, Homo sapiens; identical to SEQ ID NO: 13938

SEQ ID NO: 48462 - DNA, 201 bp, Homo sapiens
catcaagctcctgttgggaaaagttgaatgaataactcagtatcttctagggcaaccactttcaattttagaccaactgtactttgttagaagagttttcyattgtgtcctccctgagccttcttttcttcaggttaagcatcttcatacctacatgattattgctcagtggttggtgcctatccagggtcctattctttg

SEQ ID NO: 48463 - DNA, 201 bp, Homo sapiens
gaaatctattctacctaggttcttgagaaaagagccctcatttaacattaactctgacttaaacttgggtaaaatatagttttatcataggaatttttccrtggaaaacataatctttttagtaactgctgtacccatcccactgtccccaccttttaacttaagggagtgacttgggtttttatttttcaatctgaaaac

SEQ ID NO: 48464 - DNA, 201 bp, Homo sapiens
tgtagtggaaaaattatgcgtgctagagactgaccagggtttgaatcttggctccgctctgcactagctgtctgaccttggcacattgctcagtaagagcygctggtttctcatctgtaataattgggtgatagcagctatcctgtggcatgtcatggcactcaaatggagtcatctgtgtgagacacctggtatggtaca

SEQ ID NO: 48465 - DNA, 201 bp, Homo sapiens
atattaactttttttaaaggactagccacagaattggtatttttaaataaagaccctataacttctatcaaactcattgagttattgaatttgcacactgrcttacttttaaaatgacccaaatgtctggcagtgttaaaggacatatttctgtacaaaaccattccaggcaatgttgggatggctcataatgagagatat

SEQ ID NO: 48466 - DNA, 201 bp, Homo sapiens
tggtcttaagagcagaatagaggggtgaactgaattaaaagaagaactgttcaaggcccctaaagatgaggttaataaggagctcgaaacagtgacctatraggaacagtagaagatcaatacagtctagcaaataaataagaatacaagttttggagacggaacatactacagtcaagtcatttaacagttctgtaacct

SEQ ID NO: 48467 - DNA, 201 bp, Homo sapiens
gaattgaagccaatgtcccttgtaaatcagttcatgttttaaagcaaaactgaaatcctctttggagttaaacaacccccagtttgcctctgtgaaattcytttgtgtcaaataatgcactcagaacttggaaagtgaatgcctgagttggagacccagatcaggtattaacacactgtgtgatcttgggcaagttattaa

SEQ ID NO: 48468 - DNA, 201 bp, Homo sapiens
ctgcagacattcaaagtctccgctatgccccacaaggctactcacctctaaggcagtgtcattggctatagccacttgagcatatctttattaaatgtacygttagggcttcatgaataccatttgtaaaagattagatctggaattgttagggcagggaacattgtatgatagggtaatgactgtcctcctatttccttg

SEQ ID NO: 48469 - DNA, 201 bp, Homo sapiens
ctgtaactacttgagtacaaagtgttcagtgtggtaatgaggagcaattatgctctatgacaagttgaaaaaaaatcctactcatatttctcaagtcccarcagtggccttgtgatggtaccccatactggggcagtctacatgtctgctattttattttcccttaggctccaaatgtggcatcctctttccaaaaatcaa

SEQ ID NO: 48470 - DNA, 201 bp, Homo sapiens
ggcttgtctcattgaatccccacagtagcccaaggaggtgcacaagttttacagatgcagaaaatgtggttcaggtagcttaagtatcttgcccagcatcmcaaagataaaacaaggcaaaggtgaaatctaaactcaagtgtttcttactgcagagcctgtgttactaactagtaagtatctgcctcattttctggttgt

SEQ ID NO: 48471 - DNA, 201 bp, Homo sapiens
attgttcgtgtggaatgtgcatgaagaggacagtttgtggatggtcttgtatgccaagctaaggaaaatgatgttttttaaaattatttttatgtgtttattttttttttgagacagagtcttgctctgtcacccaggctggagtgcagtggcgtgatctcagctcactgcaacctccacctcccatgttcaactgattct

SEQ ID NO: 48472 - DNA, 201 bp, Homo sapiens
tgtgtatgtctgtgtataattttcttagtatccctcacagtgaaatttactgtattattatcaatgctacctagctactacacggaagttatttgaccttggtattgacttcagactcttttcactacaacctgctcagcatctagcagaaagtatttaaggagcaccaagtaaattgatgtaatgaaaacaagaccagtt

SEQ ID NO: 48473 - DNA, 201 bp, Homo sapiens
acctcacaacaatcctatgatgtacctgttgatttttttatttttttttaatccaccatttggaaataatggaacttagacccagagtggcccagccattyactcaatgtcacacagctaagtatgagcagagaaagattgaaattgggtttctgatctcagagcctgtgctcttcactgttaggtttcattgcctcctcc

SEQ ID NO: 48474 - DNA, 201 bp, Homo sapiens
tcacagttttccattagataaaatggatgaaggggccagcattatacccacaatcatctgaaatcactgcaacaacgctgggtaaatatcattacctccattttttttttttttcagatgaggaaaatgaagttcagagaggttaggttattttatttatgtcctctttgtagtgcttataggaagcagaattcagatttg

SEQ ID NO: 48475 - DNA, 201 bp, Homo sapiens
tctatattgaactgccatgaatgctactggtcacttataatgaattgatttattctgtttcttttgctcattctttctttcttttctctttctgtttttcktttgttttgttttgttttgtttttttgtttttttcagacagggtcttgctctgtcacccaggctggagtgcagtggtgtgatcactactcactgcagctc

SEQ ID NO: 48476 - DNA, 201 bp, Homo sapiens
cgccagaatgcactgttacctggacctggtctaccagggctggcagccctccaggaaaccagcgcctgttgccctcgccccccaagttctgggccacacarcggactctgtgacactggagtggttcccacctatagatggccatttctttgaaaggtgagtgtgccctgtgtagtgttgatccctctctctctctcctgc

SEQ ID NO: 48477 - DNA, 201 bp, Homo sapiens
taggggaaagttgcttgaatgtgtttcaagtgagcactgatttcacaagctgatttaattcctccacttagaagcaaatcaacccattaaaagaagagtatttttttttctctcgatgattattctaggatgtacaaagcacatttatgttcatttcctattagagttctatggttatcctgagaggttttcctggttggg

SEQ ID NO: 48478 - DNA, 201 bp, Homo sapiens
ctcccatgaggaagagttgaggtagcagctgtgcttaaaaatcacccaaatgttattgcgactaatgtgagaaaaggagagaaagaattttccagtcttagcatttgaaaagaagcttcatggggcaattattccaatcttgtaagggggggctgtcaggaattactggtgattatctcttcctaaacaaaaatccaattt

SEQ ID NO: 48479 - DNA, 201 bp, Homo sapiens
ttaatgttctatgctgtaacttttaactcaatgttaacaggctagaaggttaacaaatatttatttagcatctgctatgtgaatactctatggactaggcmcactgtattaagcaaaagctacatggcgttgagcgaagcagtgctctttaatagagacaaaatgacaacgatcttacaggattttgatgacaatcagatg

SEQ ID NO: 48480 - DNA, 201 bp, Homo sapiens
aggtgccttggaaaagtgacatggaaacagctaactagacagatcagcaaaggggtgtgtgttggggagaaggaagaaatatatgtagtaggcacaggcawggatagtatgtggaagcacactgatgagaaaaaaaaaaaaaaacatgccacagatttttttgtttgtttgttttctttttctgtactcacccaagcaatg

SEQ ID NO: 48481 - DNA, 201 bp, Homo sapiens
aatgttctatgctgtaacttttaactcaatgttaacaggctagaaggttaacaaatatttatttagcatctgctatgtgaatactctatggactaggcacmctgtattaagcaaaagctacatggcgttgagcgaagcagtgctctttaatagagacaaaatgacaacgatcttacaggattttgatgacaatcagatgag

SEQ ID NO: 48482 - DNA, 201 bp, Homo sapiens
tcataatagaaatacagctacaggaccaggcagctcaagcctgctccaatgactgacacatgagaacaagctagaagagctagtgtcttttgcatcttttaatatgtggtacgtatttaaggaacaccgggaaagtgggcattccctctctctaatacccaaaatactgccctacaatttttgcctgctgctaagatctcc

SEQ ID NO: 48483 - DNA, 201 bp, Homo sapiens
ccatataatccccagctaatgatccccacccacccccatggactgcctcaaaaaacaccaaagattcattcttttctatggaagaaactttagatcttttrgcatgtcattcacaaccctttgtgatctagcctcagacagccattgtacttcatttccctcagttactctgtgcaccctcaatcccatcaaaagcaaata

SEQ ID NO: 48484 - DNA, 201 bp, Homo sapiens
gaagcggattatgtttcatgttatgattgacagaaaataattgagaaagatttcctgtctcaatttctcttcctccctgcctctgcctgcccccttctcawacccaagtgaatgtgcacacccgcacactcacatgccctctcacacatctttatctttgtgttagaaagctctaagcaattcaaaattgctcagaaattc

SEQ ID NO: 48485 - DNA, 201 bp, Homo sapiens; identical to SEQ ID NO: 13874

SEQ ID NO: 48486 - DNA, 201 bp, Homo sapiens
ggaccagaaacctttcttttatccctgtcatttgttctggctcccttaaaacccttctttgttcttgtctttcattttcttttcttttctttctttctttyttttttttttttttgttattgttttgttttaagtggggtcaccagcattcagccagcatggcctttgctgtgtaatttagtttcatgttctgtacccaag

SEQ ID NO: 48487 - DNA, 201 bp, Homo sapiens
tggaaacagctaactagacagatcagcaaaggggtgtgtgttggggagaaggaagaaatatatgtagtaggcacaggcaaggatagtatgtggaagcacaytgatgagaaaaaaaaaaaaaaacatgccacagatttttttgtttgtttgttttctttttctgtactcacccaagcaatgaggctggaagggccagctgaa

SEQ ID NO: 48488 - DNA, 201 bp, Homo sapiens
ctcttgaacaagacacagagatgtccagaacccagtataacttggtataatcctccagtcctgtatgtctccctttaagcctcctccttccactgagcctraggcaaatcttttgacccggggtggacccggagggatgaggatgctgaggagcagtcccccaggtaccctcctcggtgatatcccagccttcctctgaat

SEQ ID NO: 48489 - DNA, 201 bp, Homo sapiens
agtttcaccatgtcggacaggctagtctcaaactcctgacctcaggtgatctgcctgccttggcctcccaaagtgctgggattacaggcgtgagccaccgygcctgactgaatatgattaattcagaagttatatccatcttcccagaaaccctatgagataaataatgttatccccgttttgtagaggaaaaaactgtgg

SEQ ID NO: 48490 - DNA, 201 bp, Homo sapiens
ctctctctttctctctctctctttctctctctctctcactggtttccagatggtcatcttttccttgtatcttcacatagtcttttctctgtattacttgkgtcctaattttctcctcttataagaacaccagtcaaattggattaggatctgccatgtcacctcactttaatttaattaccttttcaaagactgtatctc

SEQ ID NO: 48491 - DNA, 201 bp, Homo sapiens
gaaccatcaattcttagttaattgtttaggtccctacagaagaatgataaagacagcagcctcctggctttcaattcaattcaccttgcttgtgggggtgytgcagaacttacagaagtatttccagaggaggccacgcctttaaacagcctacaacaaaacatttggcctttggcacttaatgtattgaccatgactaag

SEQ ID NO: 48492 - DNA, 201 bp, Homo sapiens
ttttttcaagactgagtaatagtccatcgtgactaatgtgatgggcttgacagtaccaatggttttggtggtctgactctgcagctgctgatgattgctgwggccaaagaacaaatatttatttattctctccctttctatgtcaatcttttgcagatgaacccagccggtgctatttccatgatggtgatggggtatgtg

SEQ ID NO: 48493 - DNA, 201 bp, Homo sapiens
ggagtgcatcacatgtaagctggactttgcagggttcataagatttaaagggccaatcatcaggaagaaagattgcaaggcagaggagggaaactaatggrcattcttaagggttgggcataactggggaaaactagaggttctcagaataagaaaaccaagagaacttgagcggttgaggttgtagaaggaagaaggctg

SEQ ID NO: 48494 - DNA, 201 bp, Homo sapiens
tgagtttgtgtggctattcttggaattagtcagctacacctagacataaatgtaagctctcctgggcccacctatctccaactcatgttttttgtgaaaasatgtacaaattatggtcacaggaatgtttggttttgtgagcttggggctttctgtgacatgggcggccttgacacgctagatctcagacgtatcctattc

SEQ ID NO: 48495 - DNA, 201 bp, Homo sapiens
acacctagacataaatgtaagctctcctgggcccacctatctccaactcatgttttttgtgaaaacatgtacaaattatggtcacaggaatgtttggtttygtgagcttggggctttctgtgacatgggcggccttgacacgctagatctcagacgtatcctattcacagcagggtagaggtgtaggttttccacccatag

SEQ ID NO: 48496 - DNA, 201 bp, Homo sapiens
cccccaggtggccacaagtgtgtattatgtaatagaaagaggaagcaatttattgaaatggcaaatgagagacagtgctctgctagtaggaggtggacgastatggagatgttaaaaggggtgcaggtgaggagagcatcagggaagtcttcctggaggagggataccagaacagactttggatttgttcattagagaaca

SEQ ID NO: 48497 - DNA, 201 bp, Homo sapiens
gaaaaagtgagtttgcaagaactctgtgttcctccatgttccacccaccaacaccaacaggaactcttcttacattcaaattatacatatccataaacaaracataagtttgtacaaaccaatcaccaaaagttagacatgacaacagtttctgaaccaggccctgtaagcaaacattgcagttctttaattttatttttt

SEQ ID NO: 48498 - DNA, 201 bp, Homo sapiens
tgtgtccaaagtcctaagtggagtgaaggcatggtattcatgacctgaacctccatgcagtgtgccctttcagccacagatggacatttgttcttgagagsaagattcagttagcaaacccagggtaccgtatcaacagcatggggactggcataggcttcccagtgctgaagtcccgaagttctttctgctttgggacaa

SEQ ID NO: 48499 - DNA, 201 bp, Homo sapiens
acacactatttccaattcccatgtactaacatttatcatggggcaggcattgctcttagtgccccacacccctgcaccttggctgtgttttgagatgagcwatcgcgttatcatcactgtcttcacttcacagatggggtaactgaggcactgggggcagaaaatcacttgtccatttgactccagattctgtgtgcacta

SEQ ID NO: 48500 - DNA, 201 bp, Homo sapiens
cctgcatgtaacctatttggtggcttttccaaagttttcaagatgaagtacaaagttcatggcaacaaagaaaaaagtgtccaattatctggcccttttcrgtctgaggactttttccttgcaatagggagccatagaatgtttggtattcaggagttacatggtgggatctgggtttgagagagatttactcggttattc

SEQ ID NO: 48501 - DNA, 201 bp, Homo sapiens; identical to SEQ ID NO: 13895

SEQ ID NO: 48502 - DNA, 201 bp, Homo sapiens
tgggtgggaagcggattatgtttcatgttatgattgacagaaaataattgagaaagatttcctgtctcaatttctcttcctccctgcctctgcctgccccyttctcatacccaagtgaatgtgcacacccgcacactcacatgccctctcacacatctttatctttgtgttagaaagctctaagcaattcaaaattgctca

SEQ ID NO: 48503 - DNA, 201 bp, Homo sapiens
ctctcttgactattgagccgccaaatctgagagtagggagtggatctttgagcagttcatgagttcaatccatccattttgccaaagggagaactcaagtraggaaaagggacttgcctgtggtctcataacatggaggaaaaacatggaggtctcctatagccatggagagtgcctactgtgtgccaaacactacaacaa

SEQ ID NO: 48504 - DNA, 201 bp, Homo sapiens
cctgcttgtctataaatgtttcctgtttcttttaatactgtttggtatttactatcattgagaatgaatttgtgtgtgtgtgtgtgtgcgtgtgtgtgtaggggtgtgtgtgtgtgtataaagtgatggaactgattttctttgttgatggaaaagcaaatactaatgttttcagtcttttctctgttgtaatatcacttg

SEQ ID NO: 48505 - DNA, 201 bp, Homo sapiens
caaatttaagagtataccgaagctcagagatgtgatgtactttgccaactaggtaatagagcataggtatatttacaacatcagctaccacttatttttatttatttatttatttatttatttatttatttatttatttagagatggagtttcactcttgttgcccaggctggagtgcaatggcgcaatctcagctcactg

SEQ ID NO: 48506 - DNA, 201 bp, Homo sapiens
aaatttaagagtataccgaagctcagagatgtgatgtactttgccaactaggtaatagagcataggtatatttacaacatcagctaccacttatttttatttatttatttatttatttatttatttatttatttatttagagatggagtttcactcttgttgcccaggctggagtgcaatggcgcaatctcagctcactgc

SEQ ID NO: 48507 - DNA, 201 bp, Homo sapiens
aatttaagagtataccgaagctcagagatgtgatgtactttgccaactaggtaatagagcataggtatatttacaacatcagctaccacttatttttatttatttatttatttatttatttatttatttatttatttagagatggagtttcactcttgttgcccaggctggagtgcaatggcgcaatctcagctcactgca

SEQ ID NO: 48508 - DNA, 201 bp, Homo sapiens
atttaagagtataccgaagctcagagatgtgatgtactttgccaactaggtaatagagcataggtatatttacaacatcagctaccacttatttttatttatttatttatttatttatttatttatttatttatttagagatggagtttcactcttgttgcccaggctggagtgcaatggcgcaatctcagctcactgcaa

SEQ ID NO: 48509 - DNA, 201 bp, Homo sapiens
tatgtaccacattttctttattcagtctatcattgataggcatttaggttgattccatgtctttactattggaaatagtaaaagcactaattttaaacagkcaataaataataatgataacaatgaccagcttgaaatcctttctgccctcagtttttgccccacctggccctctcctctatttgtacctcttgtccttct

SEQ ID NO: 48510 - DNA, 201 bp, Homo sapiens
ttcagtctatcattgataggcatttaggttgattccatgtctttactattggaaatagtaaaagcactaattttaaacagtcaataaataataatgataayaatgaccagcttgaaatcctttctgccctcagtttttgccccacctggccctctcctctatttgtacctcttgtccttcttaatctgtcttcttcctctg

SEQ ID NO: 48511 - DNA, 201 bp, Homo sapiens
actgttgttggggaagtgtgacctggctggggagacaaggccttaggaggaccatcattttgacagttggtgatcccaactttgcttttcctttgaccatwcagggaaatatctctctatttccatattgatcaactaggaccaattgccacttcatgcaacttggttgtcagcatcatctagtgttcagagtactgtgct

SEQ ID NO: 48512 - DNA, 201 bp, Homo sapiens
gaaagcacatttctggtttgcattttctctcttgattaacattttggaaactttatgttctcttgtcacagaaaaccacgactttcacttcataatttacmatatacatagctaatacaatgtactttttaagagtcccaacaccttttccacagatatgttatctctcttaggcaatttggagagggtgtgcttcctgta

SEQ ID NO: 48513 - DNA, 201 bp, Homo sapiens
agatatgttatctctcttaggcaatttggagagggtgtgcttcctgtactttatatacagctccccttcccactaaccttgtgcattagctgggcaccccaaagcaatgactgccccgattacaagggcaatgcaaaaagaagtttgtagacactgactggtattctggacgcttctatgcttctatggaaaccaaatgaa

SEQ ID NO: 48514 - DNA, 201 bp, Homo sapiens
tgttacagaatttgctctatgagatggagaaacaggacaacctcctgtgaagaaggtaaacacattaatccagtgttgggaaccaggtttggctggtggarcgggaacccaacaggcactgggagctaaggccagttttctttcaatccatgaactagcttaaaacagaattctgcatctcgagggtttttcatgagttgg

SEQ ID NO: 48515 - DNA, 201 bp, Homo sapiens
atgggcaatgttacagaatttgctctatgagatggagaaacaggacaacctcctgtgaagaaggtaaacacattaatccagtgttgggaaccaggtttggstggtggagcgggaacccaacaggcactgggagctaaggccagttttctttcaatccatgaactagcttaaaacagaattctgcatctcgagggtttttca

SEQ ID NO: 48516 - DNA, 201 bp, Homo sapiens
tttggaaatgggcaatgttacagaatttgctctatgagatggagaaacaggacaacctcctgtgaagaaggtaaacacattaatccagtgttgggaaccargtttggctggtggagcgggaacccaacaggcactgggagctaaggccagttttctttcaatccatgaactagcttaaaacagaattctgcatctcgaggg

SEQ ID NO: 48517 - DNA, 201 bp, Homo sapiens
gaaaagggtcctcagaggttacccaagccagtttcccttttggccgaatggggagagagacacacagagaggggaggggtgtgtgctggatgacacagctmctcagcggcaggaactaggatttaatccctggcatctgacttccaggccttgccccctgcaccgctgagagaatgtgtctcataaacaccatcacctctc

SEQ ID NO: 48518 - DNA, 201 bp, Homo sapiens
tgtcaacttgtattagagactcagtcaagggtagccggatctaggaagtagctgcatctctttttccagtttgcggctttggctttcaaaaagtggggccwgtttgtaaggcttcccctcttgagttgctggggagtctctctagagtagataatgtatcttggggaacaattagactccttcaaatacctttctttcaat

SEQ ID NO: 48519 - DNA, 201 bp, Homo sapiens
tgtatgtagagtgtgtgctctgccttgtgtgggggtatagtcatgtatgtaattttaaacatatagccataaatcaaatgagaacaatcaacacttctggwttcatgcctcagctgtagatacttacccagagtatcttttaggagtatggtgttaggaaattattggacaattcaatatccatcaccatctgcatcaagc

SEQ ID NO: 48520 - DNA, 201 bp, Homo sapiens
tatacactgttgtctcataaggaaacatttcctttgtcttctctttattattatttgggaattatttcctttgtcttctcttttttattattatttttttkaatgtaacaaggacaatcccctgaggccaggtttttgttgttgttgcttttggactccagttaatgttgttggaagtctcacaaaaggggctgcgataag

SEQ ID NO: 48521 - DNA, 201 bp, Homo sapiens
gtcatgattacatggtcatgacacatacacttcaagctctgaaggcctatcctgtgggaaagtcacagaattattctatatggtttctaagccatggctgkgactacagtgttgcaattacaggaggcagctttgagctgagtaatagatgatatcatctccagtcagaatggtcctttttggggagggctttgtctgtgg

SEQ ID NO: 48522 - DNA, 201 bp, Homo sapiens
acattgggctcttccacttctccaaatgtgttaaagacttccctaaggtgctggaaaggagattggcaaaaattactaaggggatttaaggcagcttctgyatagaacctccctcacaccctgccccttccctaagctggattctcaaagccatgtatatagctgtccagcacctgcccaaatgtatttaatgtttgtttg

SEQ ID NO: 48523 - DNA, 201 bp, Homo sapiens
aatgtgttaaagacttccctaaggtgctggaaaggagattggcaaaaattactaaggggatttaaggcagcttctgtatagaacctccctcacaccctgcmccttccctaagctggattctcaaagccatgtatatagctgtccagcacctgcccaaatgtatttaatgtttgtttgataagaagaaaccagtatatgctg

SEQ ID NO: 48524 - DNA, 201 bp, Homo sapiens
gcaggattttatatccatacaatgtctcatttatgcttgaaaagaagttctcatattgatcagaagcatggccttgaagtcaggactgcctgggttcaaaycccagatgtatccctagctttgtgattttgaaataattatttaccctctgtcagctttaatatcctcttctgtacgataaggaaaatagtagtgcgtact

SEQ ID NO: 48525 - DNA, 201 bp, Homo sapiens
caatcttagccgtgcaatctgatcagcctcaactatctccttctttagaagccttcctggtcgcctgcctgtccctgctcccacccatgccgtcttcctcsctttatcagtgattgacatcacagactttagtagccttgtaacaaccttgactcatacactggactggtcttgactccataactagacttgtacctcatc

SEQ ID NO: 48526 - DNA, 201 bp, Homo sapiens
ggataaacaagtgaatgaatgaatgaatgaatgagagatattgagtggggggtgagggagggagggagtaatggaattgttgacttagtgcccagtggatktgggggccatgggaaataggggaaatagctcatcttgcctgtgtcctttgccgtgacctctgggctgctctcttcccagtctcagccatactttttcagt

SEQ ID NO: 48527 - DNA, 201 bp, Homo sapiens
gaagatgctgctctacacctaaagtacctactttcaaggttcacagacctgagttttaaccttcccttaaacattttaaaattttaaagtttaattatctytctggcagcctgtatgcatctttccaatgcctaaaatgaacacagcacaaatactacccataaattctgctgagatctgttctgtctatctgcccaagcc

SEQ ID NO: 48528 - DNA, 201 bp, Homo sapiens
accaccgcatctcagcctgggcaacagagcgaaactctgtctcaaaaaaaaaagaaaaaagaatgcatatacatatatgacatataaacataatttttgcrccaaatgttttttttttttattttgtagaactaaaggtagcatttttataagaccagggaatgataaactgaggcacaaggtacctctattctgctgccc

SEQ ID NO: 48529 - DNA, 201 bp, Homo sapiens
atgttttttttttttattttgtagaactaaaggtagcatttttataagaccagggaatgataaactgaggcacaaggtacctctattctgctgccctgacwgttcattaattaaccacatggccttgagcaagtcactttctgtctctgagcctgattctcccttccctgaaaactgggtctaatgatactacagtggctt

SEQ ID NO: 48530 - DNA, 201 bp, Homo sapiens
ttttttttttattttgtagaactaaaggtagcatttttataagaccagggaatgataaactgaggcacaaggtacctctattctgctgccctgacagttcrttaattaaccacatggccttgagcaagtcactttctgtctctgagcctgattctcccttccctgaaaactgggtctaatgatactacagtggcttgaagg

SEQ ID NO: 48531 - DNA, 201 bp, Homo sapiens
ctggaaaaagccttgggtgggaagcggattatgtttcatgttatgattgacagaaaataattgagaaagatttcctgtctcaatttctcttcctccctgcytctgcctgcccccttctcatacccaagtgaatgtgcacacccgcacactcacatgccctctcacacatctttatctttgtgttagaaagctctaagcaat

SEQ ID NO: 48532 - DNA, 201 bp, Homo sapiens
gcctgggggagggagacgcggagaaagagaaattaagacatgaccgctgcataggacagcaagtgtctcctgttttgaccaccgttttttttttttttttyctctcttgggataagatagcctttgtctatttctcagaggctgcatttttttttttcaaaaggattttattatcacagccttgtctcatctttgctccct

SEQ ID NO: 48533 - DNA, 201 bp, Homo sapiens
ctgcataggacagcaagtgtctcctgttttgaccaccgttttttttttttttttcctctcttgggataagatagcctttgtctatttctcagaggctgcatttttttttttcaaaaggattttattatcacagccttgtctcatctttgctccctaaaaactcctttagaactggtctcatgataaagcacactccataag

SEQ ID NO: 48534 - DNA, 201 bp, Homo sapiens
cagagaaagattgaaattgggtttctgatctcagagcctgtgctcttcactgttaggtttcattgcctcctccttcccatcttggacccctgatgagtagyagcccagttcttaaaaaggaagtttctcctcaaatgcaccccaatgtggctgcctccccaccacatgactgagtgcacatgtgaccctcctacgtcttca

SEQ ID NO: 48535 - DNA, 201 bp, Homo sapiens
tcaagctctttcatctgtttcctccaccattcctgaaccagaattcctgcacagattcccccgagtgccccagtgcaccctgatatgctcatatacccagrcatgcagggagcccacatgtcagaatctcaaggcagctagagataatcaaggacaggttcctcattgtacagatagggaaactgaggcctatagaggaag

SEQ ID NO: 48536 - DNA, 201 bp, Homo sapiens
tctggcccgggctccccccaagtgcaggaatcccctctatgtgcatcctcactgaggttccctggagcctgttcaagctccagttttttagaaagttctcraaatctgcaattgtaatttttccacccaaactgaacccactttgggttgtcacagagaatgtgtgtctctgccacctgacaacattttgcatgcttgtat

SEQ ID NO: 48537 - DNA, 201 bp, Homo sapiens
tcttcactgttaggtttcattgcctcctccttcccatcttggacccctgatgagtagtagcccagttcttaaaaaggaagtttctcctcaaatgcaccccmatgtggctgcctccccaccacatgactgagtgcacatgtgaccctcctacgtcttcacaatttcaggcgtatttttctcaaccaatggttgccgcagctg

SEQ ID NO: 48538 - DNA, 201 bp, Homo sapiens
tttacttctctgcacttcattttttttttaagccacaagaggggtatgataataacagttaccacgtaaggttgttatgaagaacaaatgaagatgtgcaygtaaagtgctcacaaaatgctttgcacgtagtagttgttcagtaaatggtgggtaatcataacatgatggttccaacacacatcagaacactctgcaaaa

SEQ ID NO: 48539 - DNA, 201 bp, Homo sapiens
atggtggtggtagtggtggtgctatgatgatgatgataaaaagaagatggtgcagatgatggtggtgttggtggtggtgttgatgatgatgatggtggtgrtgatgatggtggtgccaatggtgctgatgatgatgacagtgatgatgatggtaattgcaaccaggaagaaaagatagtctattcttcctaccaccaaggc

SEQ ID NO: 48540 - DNA, 201 bp, Homo sapiens
gaggacaaaagctagaggtgctttgtgggcaaagtgatgcacctaatgatggatttcagcaactcagcaggagcaagagagaaagggagcggtggaatctwcaacacacccagctcattgcacagatcacagaaggtggctgtgaaagcctttctgccataaggggtgtagagctgcactctccatttgtgagccctgcca

SEQ ID NO: 48541 - DNA, 201 bp, Homo sapiens
caggagagagataaaccaatgataacaaaaccagtgctttatgctcccacctttcattcatggtggggcctccccagtgtgaaactccatgagcagactcyggctacttctaatacattctctgttacaaaccaagctctccagccagccctggcccaagtagtgctgaggtctgcagccctttaggggctggaatccaaa

SEQ ID NO: 48542 - DNA, 201 bp, Homo sapiens
taccattttattttatttcattttattctttaaagaaataattgtaatctggcatgaaaactggggcatccatggagaatagaaaagggaacttccaggatttttttttttttttttttgagacggagtctcgctctgtcgccaggctagagtgcagtggtatgatgtcagctcactgcaacatctgcctcccgggttcaa

SEQ ID NO: 48543 - DNA, 201 bp, Homo sapiens
ttatgaagagtttgtggctcatgttgagtttagatttattcattatgaaatagagggactaaaccaatcaggtctgagattttacaatactgccctggtaytctgtgaagaaaggattgaggaagggtgagtgaatccatttagggttgactgctgaagtccaaaccaaagatgatgattatttgcatagaaaagtgaatg

SEQ ID NO: 48544 - DNA, 201 bp, Homo sapiens
ttattttatttcattttattctttaaagaaataattgtaatctggcatgaaaactggggcatccatggagaatagaaaagggaacttccaggatttttttwtttttttttttgagacggagtctcgctctgtcgccaggctagagtgcagtggtatgatgtcagctcactgcaacatctgcctcccgggttcaagcgattc

SEQ ID NO: 48545 - DNA, 201 bp, Homo sapiens
tgctttgagaaatgctgctccacagttttctcccatccgcctgctgcagtcacacacatgtatgcacacatacacacacacacatgcaaacacacacatgmacacacacacacacacccctcctccccccaccttatcccaactccacgaatgggtcgaatattagtcgagaattttctgaaaggcctttctgatcgtgtc

SEQ ID NO: 48546 - DNA, 201 bp, Homo sapiens
cacatgtaagctggactttgcagggttcataagatttaaagggccaatcatcaggaagaaagattgcaaggcagaggagggaaactaatggacattcttargggttgggcataactggggaaaactagaggttctcagaataagaaaaccaagagaacttgagcggttgaggttgtagaaggaagaaggctgggtaatgag

SEQ ID NO: 48547 - DNA, 201 bp, Homo sapiens
ttttcccctagctacttctttatcaagccagttccttttattctaaggaagggacaattagtctccatcattattctgttcatttattacataaaaaagarcataacccacaggcagatctcctgaggcaggaaggaaaagaaagggtttattgtttgttgtttgtttataccccactgctctaatgtggatgtgatgtgt

SEQ ID NO: 48548 - DNA, 201 bp, Homo sapiens
tgagcagactctggctacttctaatacattctctgttacaaaccaagctctccagccagccctggcccaagtagtgctgaggtctgcagccctttaggggytggaatccaaatgcatcacaggcccaggccaaggctccaggaaattggggtcaatttcctactccccagagggcccaggagaatcatggggcctagagcc

SEQ ID NO: 48549 - DNA, 201 bp, Homo sapiens
gccagatactgttccagttctgggaatacattggtgttagtccagtgaaaatagtaactatgctctccttgagtcatctatgatatcttcttgcctgtcatccatccatccatccatccatccatccatccatccatccatccatcgttttactaaataaacatttatggaatctatatttgataaagttttgcacaaata

SEQ ID NO: 48550 - DNA, 201 bp, Homo sapiens
ggcactctgagagctggactggacctgacatgacttcactgactcctcactagagcccttcgaggtcttgataaagacccttgtcttacagatggggaggmtgaagtccacaagatgccagggacttgctgaaagtcatacagtttctgtataaagtctacaacatattacttacaagcatgtagtggagacaaggaggct

SEQ ID NO: 48551 - DNA, 201 bp, Homo sapiens
ccagatactgttccagttctgggaatacattggtgttagtccagtgaaaatagtaactatgctctccttgagtcatctatgatatcttcttgcctgtcatccatccatccatccatccatccatccatccatccatccatccatcgttttactaaataaacatttatggaatctatatttgataaagttttgcacaaatac

SEQ ID NO: 48552 - DNA, 201 bp, Homo sapiens
atccatccatccatcgttttactaaataaacatttatggaatctatatttgataaagttttgcacaaatacgagacattttgctagcaatctaggatacasaaatggatgatgcgcacagtatagtgaaggagatagacaattaaagagagaattttaaaatcctgaagagctatcacaaaatcaaatacaagaggctatg

SEQ ID NO: 48553 - DNA, 201 bp, Homo sapiens
atctatatttgataaagttttgcacaaatacgagacattttgctagcaatctaggatacagaaatggatgatgcgcacagtatagtgaaggagatagacamttaaagagagaattttaaaatcctgaagagctatcacaaaatcaaatacaagaggctatggcagcagacagcatcctgaggctattaggggtggcatttt

SEQ ID NO: 48554 - DNA, 201 bp, Homo sapiens
agggcaggtcttggtgggtttatgttgtgtctgttaaaacacaacctcagacaccactttagagatgctgaatttggaatcaagagatctgactcccacaycagcaccagccttgctgtggaacagctttcttccattgtttaagcttaagttccttcccttggacaaagtgggtgactgtccatatagtctaacaaggag

SEQ ID NO: 48555 - DNA, 201 bp, Homo sapiens
ctactcttccatccattacccatctattaactctccttccctccctttcttccttcctccctacccccttatctccccccactccctcccttttttccttstttccttccatccacccttccatcaatccatcccctttcatccccattcattccctaatccatccacccttcttttctgctatccatccatctatccatc

SEQ ID NO: 48556 - DNA, 201 bp, Homo sapiens; identical to SEQ ID NO: 13881

SEQ ID NO: 48557 - DNA, 201 bp, Homo sapiens
aggactaattatctccattttagcacatgagaaaactgaagttcagcatccacaggagcactgttcaatggatttttctgcaatgatggaaatgtgttctrtgctgtccattacagtagccactagctacatgtggttcctgaatacttgaaatgtggctactatgactgaggattggaattttaattataattcatttca

SEQ ID NO: 48558 - DNA, 201 bp, Homo sapiens
tttaagggcagtgatgctgaccttttgggctgattccctaattgaccatgatgaaaagcctagggaactgaacatcctttctcctggccaatatgatttayagagcaatcaccaggggtgtctggtgtagaaggttatctgaatgtgcatagagccaacatgatcttcatccagcaaacagagagttatcactgcatgtcc

SEQ ID NO: 48559 - DNA, 201 bp, Homo sapiens
aaaattatttgctgtatgggactgccctacatattgtgaaatgtttagcatctttggccctgtttatgagaatttcatgggatctgttagtgattgtgacmggcccagaagtattgtgacgatacacacacacatactcatatactcacaggtccacatacccttagttctcgtttttctggttccttatttctctccatc

SEQ ID NO: 48560 - DNA, 201 bp, Homo sapiens
caagctcagatctctggtgccaaacttctggttctgagctggtggtacaacgatgcttccctttcagaccctaaaataagactactgttgattaagttatrttcatatagaaataaaaccccattgccaccatacacccccaaccttattgaagctcggtgattttctttcactacttatactccaggtaaatatttccct

SEQ ID NO: 48561 - DNA, 201 bp, Homo sapiens
gcatggaggatgggctgtggtccttcccagaggccctgtgtgagctcatgtgcctcgctccaccccctgtgcccaatgcagacctccagaccgcccggtgycgagagaataagcacaaggtgggctccttctgcaaatacaaatgcaagcctggataccatgtgcctggatcctctcggaagtcaaagaagtaagtggggt

SEQ ID NO: 48562 - DNA, 201 bp, Homo sapiens
cccatattaactagcagaagattcttcatttaacaaatctttattggaaatctactgcatttcattagcttcatttctaagaaggtaaatacagtcatagractgcttgcctttgttcatagacagtggttgcactcctaccccttgagcaaaaactgtatttcatacatgaatatttttgagatatttgatgccatgttt

SEQ ID NO: 48563 - DNA, 201 bp, Homo sapiens
tttatcttcatttaaacaagcttcgtatacattaactgttccacgttttatgccaggtactgtatccatcctacctttaagaaacttacaggggaatcctygtccttggcatcatgcctttatctacttggtactcatgaaatctttccatcagcactgtcaagaccctaagactcaaccaggtgaagtgacctgccagtg

SEQ ID NO: 48564 - DNA, 201 bp, Homo sapiens
gacttatgttttctcaaaagacacttccacatcctttctttcacttgatcacttatacatcagatattccattacacagttctattaatcaactttgctayagtgcacgacaattttccacccatgattttactcagctcctatagtttaaaatacaaagtgggtcttattatatcagctctacatagggacctgaggctc

SEQ ID NO: 48565 - DNA, 201 bp, Homo sapiens
acatacacacacacacatgcaaacacacacatgcacacacacacacacacccctcctccccccaccttatcccaactccacgaatgggtcgaatattagtygagaattttctgaaaggcctttctgatcgtgtctctaccctccagttctgcttctcctcaacccttgttcctgccagggaaatacagaaccatgacacat

SEQ ID NO: 48566 - DNA, 201 bp, Homo sapiens; identical to SEQ ID NO: 13900

SEQ ID NO: 48567 - DNA, 201 bp, Homo sapiens
agctctttggatcctggtactgatgcctgaggcttttctgtttttcccctccacccccaccatcaccatcttcctcagtctatgacatcccagcattctcygaggcagcttcacctctggaactgagaagggcacctgcttcaggcttccacatgggagatttctccttacatagcaagcccgccaggacatggttaggat

SEQ ID NO: 48568 - DNA, 201 bp, Homo sapiens
gcaatccctctcctttcttttccaatcttagccgtgcaatctgatcagcctcaactatctccttctttagaagccttcctggtcgcctgcctgtccctgcwcccacccatgccgtcttcctccctttatcagtgattgacatcacagactttagtagccttgtaacaaccttgactcatacactggactggtcttgactcc

SEQ ID NO: 48569 - DNA, 201 bp, Homo sapiens
aatttaaggtgatgtaaatgcatcttcaagttccaattcataagactgtcaaatctctttattaaattttactctaatatgtgctacctttcctatccagwtattccatttcttttcaaattcagttaggatagaaaataaaacaatatataagacagatggtgaggcatgatgtctcataggaaaaaaaatatattgtgg

SEQ ID NO: 48570 - DNA, 201 bp, Homo sapiens
gagtcctccctccccaggccaggcaatttctccagcaccaaggtaaccactgttttgttctctattgctatggattggttttgcttatttgtaaatttatytgtagacttggtccctatcactacgaattggttttgcttatttgtaaacttcatataattagaaatcatgaggcattttcataagtgtgttttcaacttc

SEQ ID NO: 48571 - DNA, 201 bp, Homo sapiens
ttggatgagatagactattccagtctggagacctagaattctggggtggcagcctgtctcccatcagttcctaagaaatagatccaatttgctcacacatygtcccttgcccagggatgctgagagtgtttcacaatagaaagtgcatctccctatcctcagaaccttataattcctttaggtgctgagaccttggctttt

SEQ ID NO: 48572 - DNA, 201 bp, Homo sapiens
aacttctctgtgccccagttttctcttgtgtaaaccagagtcaaaaatagtacctatctcatagttacggtgagaattaaatgagatgaaagctctgagcycagggcttagagcataatatttattaaatagagaattttgtgccgatgaggatgaggatactgatggtgatgatgatattgacgttggtggaggtggtga

SEQ ID NO: 48573 - DNA, 201 bp, Homo sapiens; identical to SEQ ID NO: 13917

SEQ ID NO: 48574 - DNA, 201 bp, Homo sapiens; identical to SEQ ID NO: 13918

SEQ ID NO: 48575 - DNA, 201 bp, Homo sapiens; identical to SEQ ID NO: 13920

SEQ ID NO: 48576 - DNA, 201 bp, Homo sapiens
tagtctagatgtggataaagtagccaataagctaaatgaaatcataaaccctataattctatcaacaaattaggattcgaggtttacaaaacaaccatcaytcatgcataaaaatctctcaagatattggtatgtccacctatttcatcttcattggcagagcactaaatctccagggatttttggtctacccacaatatt

SEQ ID NO: 48577 - DNA, 201 bp, Homo sapiens
tgaatataacccaaagcagattgataagtactggaattaaaagtagggggcacagaggaaggaggactcattttcagatagaggtgatgatgatgatttgagtgttgttaataatttttgttttgctaacaataatgcagtaaaaggagcctatcctaatcagtgatgccttctctgtgccagtcaccatgctaggcactt

SEQ ID NO: 48578 - DNA, 201 bp, Homo sapiens
acataatatctgtgcaatatggaattgcaattactatttctataaggggaggggtggtatgaaaaaagaatttgcttcacagttggatgaaaccactgatrtgtagaacatgaatcaactcgtaggagtagtacatatatgaaagagacacattagatgactctttctttctgttcatcactaacactaagctagagggga

SEQ ID NO: 48579 - DNA, 201 bp, Homo sapiens
gcagacaggagaggacttgggtggctccttggagatcaattcaatgccctagccatcttaaggattgattgcaaggcattatcctgctactctgacacctyttaaaagcaacaaacattgcccagtgttaattgcctgggtgaaaggaaaagtctaaggcctcttccatgctgtgacaggtcccagctggtctctggggag

SEQ ID NO: 48580 - DNA, 201 bp, Homo sapiens
actctgccctcatgcacacggttgcttttctctctcctccaggcagcagccatggtggtcctgcaatcagcctaaaatgcatgtgaccaggctcacactgrttattgtctatattaagcacctgctgcatacaaagttctgtgcaatgcagggttaagcagcagaaacctttgttagagggctgcagaagacagtggtcat

SEQ ID NO: 48581 - DNA, 201 bp, Homo sapiens
acaaagttctgtgcaatgcagggttaagcagcagaaacctttgttagagggctgcagaagacagtggtcattaaagatatgaagggattggcattagaggycccctgggagcagtggaaagcctctggtgcaggggttggtgagcctgggaaagatttctggacagtgggactcagataagaccaggtttgacactctgcc

SEQ ID NO: 48582 - DNA, 201 bp, Homo sapiens
tctaaagcattgagtcataaactacagacaggctgctgataaaagctgaaggaggtgggataatagtcaaattagtcagacaaaatgtgaagggtccccaraaggggttatactgtgtaatatatctttagctggtgctggaaatgtgttaccttctgagatggaatctagtgcattacaggagatgcagctgtggagaag

SEQ ID NO: 48583 - DNA, 201 bp, Homo sapiens
gcatcaaagctgagctagctatgcacagcaccagctctggatcccctcactaaactagttctgggacctaatcttgggcttggaattgagcttcagagcaygcaagcctggctctccagagagtgttccatacgtaaccaatattctttgaacaaattttgcttgtttgttttgcttaagttatccaaagttggtttttgt

SEQ ID NO: 48584 - DNA, 201 bp, Homo sapiens
gggtgacagagcgagaccctgtctcaaaataaaataaaaaagatgagggagtttccaagaggatgagactgagatcctcctagattcattttatagactgytgttctctaccagattctgtgttctgctgctgatggtgatatttgcttaatacttcttatataccaagcacatttataaactcttattctcgtaacaact

SEQ ID NO: 48585 - DNA, 201 bp, Homo sapiens
atcaacccttgttccatgaatttgggatattttatatgcttgtttactggagccaggtgcagagagtaggtgaaaattataatgtggttcaccatttcttrttaacaaaaaactgaattttaaacatacagtgtagctgggagtggtggcgggcacccataatcccagctactctggaggctgaagcaggagaatcacttg

SEQ ID NO: 48586 - DNA, 201 bp, Homo sapiens
gtcccatcagttgctcattcaactgttcctaagtcggtgcattttccctctttccttggcctcctagagaattgggatcagcatgtcatctttgcctggargggagaatcctggtgcagtatgcttccaacgcttcctccccaatgccctgcagcccatcaggacactggagccctcgtgaagcagaaggtaagccagcct

SEQ ID NO: 48587 - DNA, 201 bp, Homo sapiens
ttgagtctctactgtgcatgaagcactgtgctacattattgtctccttgagttctcccacccaacagccatgtgagataggtcttattataatactttacrgataaacaatgaatacacaaagagattacagaggttttctcaagcttccacatctggtaagatgtagaaccaatacatgaacagagggcccagattctca

SEQ ID NO: 48588 - DNA, 201 bp, Homo sapiens
ctcagggagagaataggctgtttacatggattttccacattttggcccaggtgactcttcattttttaattaaaattaatcaactggcctctcagtcagtygaacaacctctgatcatgtggacttccatagttggttgttcacagttacctgtcactacacatctaagcatgtaccattttattttatttcattttattc

SEQ ID NO: 48589 - DNA, 201 bp, Homo sapiens
acagtttccaatgcagtaaaattggggaaagggaaacttctcactgttctctcccacattaatacatcaaattccagcttttgataaagttgctgtctgakggaacattgaacaactaaacagaggactctccatggagaaagtaccccatcatttgtgggtccaagattgaacttcatatctagactatccagaaaacat

SEQ ID NO: 48590 - DNA, 201 bp, Homo sapiens
acattttggcccaggtgactcttcattttttaattaaaattaatcaactggcctctcagtcagttgaacaacctctgatcatgtggacttccatagttggytgttcacagttacctgtcactacacatctaagcatgtaccattttattttatttcattttattctttaaagaaataattgtaatctggcatgaaaactgg

SEQ ID NO: 48591 - DNA, 201 bp, Homo sapiens
ctaagcatgtaccattttattttatttcattttattctttaaagaaataattgtaatctggcatgaaaactggggcatccatggagaatagaaaagggaamttccaggatttttttttttttttttttgagacggagtctcgctctgtcgccaggctagagtgcagtggtatgatgtcagctcactgcaacatctgcctcc

SEQ ID NO: 48592 - DNA, 201 bp, Homo sapiens
gaagtatacaggataagattcttcatcctagtgtacatgtgggaaaactaaggttcagagaggtgaattaacttgtctgatgtcacacagctagtaaaaawggtgaacagacccatttagtgagggtgctttcagataacagttcctggcaaggaagaagaatacaggcaggagaacagacacaggtgccatcaagggtgt

SEQ ID NO: 48593 - DNA, 201 bp, Homo sapiens; identical to SEQ ID NO: 13899

SEQ ID NO: 48594 - DNA, 201 bp, Homo sapiens; identical to SEQ ID NO: 13901

SEQ ID NO: 48595 - DNA, 201 bp, Homo sapiens
cagagaaggagagaggttactttcctttcatgcctctgcccttacctgctggacctgtttaggtcccacttgtcccctcagccccagtcccatatcaagasacaatcccttcccttacacacccaggctagcgctcagagaaactcacccctgggtgagtttcaagcaccttcctaaatcacaggaattcagttaactgag

SEQ ID NO: 48596 - DNA, 201 bp, Homo sapiens; identical to SEQ ID NO: 13902

SEQ ID NO: 48597 - DNA, 201 bp, Homo sapiens
tcaggttgtgaagaaaataccttttttttcccccttctttttactctcacttgctgaaaagctctcaagtgtttgaagtggggtttggaatcctgcatcascaactcactgactggtactgaggcctgagacaggttagttttgctttaaacattctgaagcctctattttctcatctgcaagatggggagctaataatga

SEQ ID NO: 48598 - DNA, 201 bp, Homo sapiens
acatgcatttctcacagagcaatttttatttgacattgaatattcccaatatttgtataataagccttaatcagccagtcagaacccttgacctctaacawttatgcagcattcagtgagttacttaatctttctaagtttcagttgccactttatacagagaagcacaggaattagaatcatatagaatgtctagagaac

SEQ ID NO: 48599 - DNA, 201 bp, Homo sapiens
ttctgctctcaaggagttgccattctgttttagagagaatacaattatcaagcaaacatttgaagaagtgagatcatgctatgaagggaataaaatagacyagtggtatagacactctagtgaaggtgaaaactattttttgatagtgtgtttagaaaagtcctcactgagaaggtaatggttgagctaagacctaaacaa

SEQ ID NO: 48600 - DNA, 201 bp, Homo sapiens
atacaattatcaagcaaacatttgaagaagtgagatcatgctatgaagggaataaaatagactagtggtatagacactctagtgaaggtgaaaactatttkttgatagtgtgtttagaaaagtcctcactgagaaggtaatggttgagctaagacctaaacaaaaaattagaaaagccatttgataattggggagatgagg

SEQ ID NO: 48601 - DNA, 201 bp, Homo sapiens
atcatcagagtagctttgaagaagagacctatgagcaggcctgaggctctctggagaaggccatggtgtatcgcaaaaggaggagcaatgctttgagctasgagatgtcagttctagcactagtttgctgtgtgactttaggcaagtcactctccctctcagaaccagttttcacatctgaactttgtggtactgtaggga

SEQ ID NO: 48602 - DNA, 201 bp, Homo sapiens
aatctcagatatgcaaagtatattttatttgcaggtgattttcaaacataaagacattttacatccattagagcatttcccacctttaactagtcctttargagatatacagttgtccctcagtgtccacaggggattggttcgaggaccaactccctcaatgccaaaatctgaggttgctcaagtccccaacataaaatg

SEQ ID NO: 48603 - DNA, 201 bp, Homo sapiens
tgctaaagttccatttctatagcaccttttcttggccagctcaacacacatggaaaataaacaataacataagtttggaagtttgccggcctcttaggggstaggagctgccactagctaccagacccccataaactaaatctttttttttcccctttgtacagatctaaagggtgattgatttactattttttttaaagg

SEQ ID NO: 48604 - DNA, 201 bp, Homo sapiens; identical to SEQ ID NO: 13908

SEQ ID NO: 48605 - DNA, 201 bp, Homo sapiens; identical to SEQ ID NO: 13910

SEQ ID NO: 48606 - DNA, 201 bp, Homo sapiens
ggactccttcacgcccaatcaagtcgccagaatgcactgttacctggacctggtctaccagggctggcagccctccaggaaaccagcgcctgttgccctcsccccccaagttctgggccacacaacggactctgtgacactggagtggttcccacctatagatggccatttctttgaaaggtgagtgtgccctgtgtagtg

SEQ ID NO: 48607 - DNA, 201 bp, Homo sapiens; identical to SEQ ID NO: 13913

SEQ ID NO: 48608 - DNA, 201 bp, Homo sapiens; identical to SEQ ID NO: 13914

SEQ ID NO: 48609 - DNA, 201 bp, Homo sapiens
aggaacaacttgacaaaaatgtcctacttttagaccaacaatgaaataggttctaacctccagcaaagccttcagaagccactagcttatccttctgaaaraaatctattctacctaggttcttgagaaaagagccctcatttaacattaactctgacttaaacttgggtaaaatatagttttatcataggaatttttccg

SEQ ID NO: 48610 - DNA, 201 bp, Homo sapiens
gctaacaaggtgaaaccccgtctctactaaaaaaatacaaaaaattagccgggcgcggtggcgggcgcctgtagtcccagctactcgggaggctgaggcaraagaatggcgtgaacccgggaagcggagcttgcagtgagccgagattgcgccactgcagtccgcagtccggcctgggcgacagagcgagactccgtctca

SEQ ID NO: 48611 - DNA, 201 bp, Homo sapiens
atactcatccacatagacatcagttatttgccagcagtgttctttctgaacatgatttaacattaaaggcaatagaaatattgcaaacatgatcagatgaktggtaaattatatcttttaaacttgctgtgtaacaagatagtagcatgtacaagattctgttcctctttgctccccactccacaactaaagtttgccaac

SEQ ID NO: 48612 - DNA, 201 bp, Homo sapiens
accattcacatttatgaaaactgcatatttatttgttatctctattgtatcatattatacaacaatttacaaaatgggtcaaaggcttataaaaacagtgragtattttaactcactacaatgtttaaaccataaataataaacagtgctctggagtgaatattgaatgtgaatatgagtacactgaggcaaatgaagcat

SEQ ID NO: 48613 - DNA, 201 bp, Homo sapiens
tgatgctggttattactgtacattttagtgtagtccattatacttagctaactgatgtagccatagtggacaatagaaagtattggatagctaaatgtgcrtttgatttcaaaaatgagcaagactgatagaacctactccaggggatcaattttccattctctctttgtctgcccagtattgtaattgtataattatgtc

SEQ ID NO: 48614 - DNA, 201 bp, Homo sapiens
gggtttgctcacgtgtaatggagtttctgctcaggtcttaaaatgaggaaacatgatcagataatgccctaagaatctgatgtggtgctttcccacctctrtgcttttgtttatatttatttttcctggatggcttcctcacaaacgtcttcatttttagtcatttgccatctgatacttttccaacagggttgctgtata

SEQ ID NO: 48615 - DNA, 201 bp, Homo sapiens
aagtggcagggaggcagagagccactgtacacacagcatcagaaaagggtttgctcacgtgtaatggagtttctgctcaggtcttaaaatgaggaaacatratcagataatgccctaagaatctgatgtggtgctttcccacctctgtgcttttgtttatatttatttttcctggatggcttcctcacaaacgtcttcatt

SEQ ID NO: 48616 - DNA, 201 bp, Homo sapiens
acctttggcagtcaatgttccttccagtgccgtcaccctgcacaattgaaaggtatcaagaacgccttccccagctcagccttcctttgtctatgggaaayctagaagctgcatccaggccctctttctgggtctcaaacaccaagggtgggatgggttttatctatgctcctgacttcttcctactaattgtatttatgt

SEQ ID NO: 48617 - DNA, 201 bp, Homo sapiens
tcttagtcatttactcatgcctcaatcccagaaggaatatgaatgccttagacctaaccattgagctgaagtgaaagagcctttataacccttaaattctrtgacttcacagttgagccattccttacagcttggaattatagagatctgtctctgtgtgtcagtgacaagcttgggaggactcaaggagcatggttcttg

SEQ ID NO: 48618 - DNA, 201 bp, Homo sapiens
agaagacatacaaactctgggactatcaaccttgaatatccagaggtatccaagataaagaaagggtttggggacccctgagcccctgttttctgcaccaygctgggtccaaagtgatcattcactcacttgttcaccaaagcttcactgagaacctcttatatgccagatactgttccagttctgggaatacattggtgt

SEQ ID NO: 48619 - DNA, 201 bp, Homo sapiens; identical to SEQ ID NO: 13919

SEQ ID NO: 48620 - DNA, 201 bp, Homo sapiens
agtattttggttaatataattatcatttatttccttatgaatacgagtaccaagtgaaataccagaatagcactcctattttagatcaacgaggatagggsagtttttgcacttgggttcagaagtacttgatttgtaaaccccaagacattttctgtaaaaatttgaggttgtgcatatttttctggagtcaaagttctt

SEQ ID NO: 48621 - DNA, 201 bp, Homo sapiens
cttgtacagtgattagaagagattggtagttaattttcaccctgtcagggcttccagtgaagatgttgatagcttgagaggaggagctgggaggctcttaraagttgggcttaggaagaagatgggaattgtatcatgtgcttctcactttccccccagatgctcatactctccctcttctctctctctctctcacacaca

SEQ ID NO: 48622 - DNA, 201 bp, Homo sapiens
ctgacatcccacatccggtgccccatcccctcatacaacactgctaaagttccatttctatagcaccttttcttggccagctcaacacacatggaaaataracaataacataagtttggaagtttgccggcctcttaggggctaggagctgccactagctaccagacccccataaactaaatctttttttttcccctttgt

SEQ ID NO: 48623 - DNA, 201 bp, Homo sapiens
ccacctagcatgttgtaaatttgggatcagggaataaataaatggtcattaatagaaacaaataaataacaataaatatttttaagtgaatgggtacttarattcactttgttattagaaacttggaaacctcttttgctacagacctcttctgggatggaggtaatagtctcatctccatgagctcaggagttgtgattg

SEQ ID NO: 48624 - DNA, 201 bp, Homo sapiens
accacctagcatgttgtaaatttgggatcagggaataaataaatggtcattaatagaaacaaataaataacaataaatatttttaagtgaatgggtacttrgattcactttgttattagaaacttggaaacctcttttgctacagacctcttctgggatggaggtaatagtctcatctccatgagctcaggagttgtgatt

SEQ ID NO: 48625 - DNA, 201 bp, Homo sapiens
gccaagctgacatcccacatccggtgccccatcccctcatacaacactgctaaagttccatttctatagcaccttttcttggccagctcaacacacatggraaataaacaataacataagtttggaagtttgccggcctcttaggggctaggagctgccactagctaccagacccccataaactaaatctttttttttccc

SEQ ID NO: 48626 - DNA, 201 bp, Homo sapiens; identical to SEQ ID NO: 13875

SEQ ID NO: 48627 - DNA, 201 bp, Homo sapiens; identical to SEQ ID NO: 13876

SEQ ID NO: 48628 - DNA, 201 bp, Homo sapiens; identical to SEQ ID NO: 13877

SEQ ID NO: 48629 - DNA, 201 bp, Homo sapiens
tcggcgggcgctgcaccgtccctgcggccccagaggctcgcgggtgtctgggcgcgggtggcgggcgggtcgggggcttgcgggcgtgtctgtgcgagagstgccccgcgagcggcgcagagacatcgggcgagctgagagcctcactttgctccatcggtggaatgggcacactcggaaggcgtagctgctccatccctg

SEQ ID NO: 48630 - DNA, 201 bp, Homo sapiens
cgtactgtgccaaatcatcagtagtgaggtcgacactcttatgcacaatttgttctttcattcactctccaaatatttctttagtccctactatgtgtcargcacaagggctagactgaggctttcatcggccttcctcttcgaatcttttgtgtttcaaggagtttattggagatctgggctgggatgggctgggcttcc

SEQ ID NO: 48631 - DNA, 201 bp, Homo sapiens
atcagagtagctttgaagaagagacctatgagcaggcctgaggctctctggagaaggccatggtgtatcgcaaaaggaggagcaatgctttgagctaggasatgtcagttctagcactagtttgctgtgtgactttaggcaagtcactctccctctcagaaccagttttcacatctgaactttgtggtactgtagggatta

SEQ ID NO: 48632 - DNA, 201 bp, Homo sapiens
tggtctcaaactcctgacctcaggtgatccgcccaccttggcctcccaaagtgctgggattacaagcatgagccaccgcacctaacctctccaaactattyttagaaagagctgctaagagctaggtggaattgtaagggatgtgtccatgctcctcctgcaatcttcacctagaatataagaggatgaggatggcacact

SEQ ID NO: 48633 - DNA, 201 bp, Homo sapiens
ccccacctaattaactcctactcatctttatgatctcagctgaagcgtcatttcttcagggacttcactgagctccctgtctagatcaaatctttctactytttaatagcatcacaaacctcttctccatagctcttatcagagttgaaattggttaattagatgtgtgattatgtgattaaagtctgtctcttcaccaga

SEQ ID NO: 48634 - DNA, 201 bp, Homo sapiens
actctgcagacctcatgaggtacttcagttctccttgaacaaacttatagtcactgcccataccttcaaattcaggctgttcccattccctgacaaggtgsccctgttccatgatgccctggagttccctaggacactccattaacttagggaatgatgaaataacctagtcattcccatttcctctttacaattcagttt

SEQ ID NO: 48635 - DNA, 201 bp, Homo sapiens
aattgagtcggttgtggtggcaggcacctgtaatcccagctacttgggaagctgaggcaggagaatcgcttgaacccggttcaagcggttgcagtgagccragacggtgccattacattccagccttggtgatgagagggaaaatccatctcaagaaaaataaaaataaaataaaatacaaaccatactataccttgtaat

SEQ ID NO: 48636 - DNA, 201 bp, Homo sapiens
gcttcctaacatatttgcatatattttattacaaattacgtttttaattacatactgctgaaaaaagtgggagaaggaggcttacatttcctggtcatttmtttgagtaaaatgagccctctttcaggaagatgtaagccatctattttgtggttttgcatacccaagcacacaagagtatgtctctcagcataaccatac

SEQ ID NO: 48637 - DNA, 201 bp, Homo sapiens
agaattgggtacggaagcaggtaataaaactgcaataagtactttcggaaaggaaggacaaagtgcttggggggctaggcaaggggtcagagaaggcactscagagcaagaggcatctgcactgaaacttgagggataagaggaaggggtgaggaggtggtcaaaagaacggtgtctggagcaggagactggcatgtaaaa

SEQ ID NO: 48638 - DNA, 201 bp, Homo sapiens
ggaagaaatcctgtgctctatacccaatgccgaagtcacttctaaggggctctctgccccttccttgcctgctctgcctgctatggccttcaccaaagcaytcatctcctctcattagtgaaatgagagagcctttgccaatggtggtggaaggaggaaaggcgaagggaacatgctgaaatttcagagacaattccaagc

SEQ ID NO: 48639 - DNA, 201 bp, Homo sapiens
gaaatgagagagcctttgccaatggtggtggaaggaggaaaggcgaagggaacatgctgaaatttcagagacaattccaagcagttttcccaaatacccaraggatctgctttctcctggtggtttctgaataatttttcaagagcacgtgtgcaagtcatctaaggagacagaacagaaagtaccatggtctagttcagc

SEQ ID NO: 48640 - DNA, 201 bp, Homo sapiens
aaatgagagagcctttgccaatggtggtggaaggaggaaaggcgaagggaacatgctgaaatttcagagacaattccaagcagttttcccaaatacccaarggatctgctttctcctggtggtttctgaataatttttcaagagcacgtgtgcaagtcatctaaggagacagaacagaaagtaccatggtctagttcagcc

SEQ ID NO: 48641 - DNA, 201 bp, Homo sapiens; identical to SEQ ID NO: 13885

SEQ ID NO: 48642 - DNA, 201 bp, Homo sapiens
aaatgctttctttttctttcctgactcaacccattacatgattccctttgacctttgtcttcattttttttctctcaacaaaaatatttattctttctgtyatctacactggagatagtttcccaaggtatgacagtgatgaagagagagccttctgtgcttaccccatggaaacttctagtagactgattacttttggcc

SEQ ID NO: 48643 - DNA, 201 bp, Homo sapiens
cattatccctgagcaaattgaatctggagaaggaacaaaaatgtgtaagagaggaaagcaaggaagggatgggtttggcatttgtaggcatacaacaaacwcatattgattgatcagggaaggtgccacgtggaacggtgagatcctgctttgaatagcgagtcttcatttttcagttgacacttgactcttgacttgaag

SEQ ID NO: 48644 - DNA, 201 bp, Homo sapiens
gccaggacttagaagtcctcgaagtgccccaaagttgctcactgattgaagcctgcctctgggactcaccctcaccccctccacgccatcccatgtcctakcttttaaagcccattgcctgtcactcggggctgggacgagaccttcctaacgcataccccgccagcgttccccagacgcggctgcgaaacggggcgcttt

SEQ ID NO: 48645 - DNA, 201 bp, Homo sapiens
caagcaaatgttgcagtgagcattctcgtacaaacatccttgcaggcacatacatgcaagcattttgctagggtgaatactgagaaattgccggtgataasctatgggcctttttcattttaatggacacaactatgacattctgggcaggtgaactagcttccaccccactagcagtgtgtgccaagacctgctattttg

SEQ ID NO: 48646 - DNA, 201 bp, Homo sapiens
atttgagttctccctcctcaacctccctctctctccccttcgctgttccacagcaaagcctatagtgaaatcggacactttgcgaggattgcaaaccttasaaatgctccagcatccattttcccccctctaaatgaatctgtggaaatgcctttaataaaactggggagcggaggtgggggcggcgctggaagagaggag

SEQ ID NO: 48647 - DNA, 201 bp, Homo sapiens
ttgacatttctgttatgtgctcttaagtaagcatctactcaaatacatttactggataattgcatttcctgttctatgacttgtctattcatatccttaaratgggcctcatctttaatctccttcacacctctatttctcattcgttaaattgggatttcaatgtcagccctattgcatgtccattaatgttatcagaat

SEQ ID NO: 48648 - DNA, 201 bp, Homo sapiens
aaccttagaaatgctccagcatccattttcccccctctaaatgaatctgtggaaatgcctttaataaaactggggagcggaggtgggggcggcgctggaasagaggaggaaagttttgccttttctgtctgggagattccctttctgcacaaacaatcttgccatgtcctgggacgtcttaaagtgagagtaggggttccc

SEQ ID NO: 48649 - DNA, 201 bp, Homo sapiens
gccaagtatttctcagaatgaaatatgggttctgggaatattaggataagcaaaagggcttaacaaaatcaactgatctccagggtcattaacagccataraagtgctatctccaagtgccttctcaattttgaaagggtgaagggctcctgtttggtgctaataccaccaaaattgcttatataaacttttatagattac

SEQ ID NO: 48650 - DNA, 201 bp, Homo sapiens
cttgggtgctgactcttgggccgccaggagccgtcattactctctcatatgcctgcctgccttgcggcttggtgcttatctctccctctgcctgcttgcaratgacgactgtacggactccttcacgcccaatcaagtcgccagaatgcactgttacctggacctggtctaccagggctggcagccctccaggaaaccagc

SEQ ID NO: 48651 - DNA, 201 bp, Homo sapiens
ctccttcgtgtaagtttgggctgggagagccaggaccgaggtgggcagcaaggatcgggtgcgaaggctcaccctctcgcggcgacctcaggtgcccagtktgctgcctgacctctgctggctttctctggctgggcgttgccactttcctaggaatccctggtcacctatcttgagagagcagtcatcgctcagcaggga

SEQ ID NO: 48652 - DNA, 201 bp, Homo sapiens
aagtatttctcagaatgaaatatgggttctgggaatattaggataagcaaaagggcttaacaaaatcaactgatctccagggtcattaacagccatagaaktgctatctccaagtgccttctcaattttgaaagggtgaagggctcctgtttggtgctaataccaccaaaattgcttatataaacttttatagattactct

SEQ ID NO: 48653 - DNA, 201 bp, Homo sapiens
ggtagccggatctaggaagtagctgcatctctttttccagtttgcggctttggctttcaaaaagtggggcctgtttgtaaggcttcccctcttgagttgckggggagtctctctagagtagataatgtatcttggggaacaattagactccttcaaatacctttctttcaatttgatcttctcctctttgacatgctagga

SEQ ID NO: 48654 - DNA, 201 bp, Homo sapiens
catgaactagcttaaaacagaattctgcatctcgagggtttttcatgagttgggtactcttctaggcatttccttgtgcattacctccttgaatttttgtwtcctcctttcttggttgaattttctaattcccatttcacatgtgaggaaattgagataccaagtgacagggtcagttgtccaagatcacagagccacttt

SEQ ID NO: 48655 - DNA, 201 bp, Homo sapiens
tatagcaccttttcttggccagctcaacacacatggaaaataaacaataacataagtttggaagtttgccggcctcttaggggctaggagctgccactagytaccagacccccataaactaaatctttttttttcccctttgtacagatctaaagggtgattgatttactattttttttaaaggaacccctcagctcagtg

SEQ ID NO: 48656 - DNA, 201 bp, Homo sapiens
aatgaaatatgggttctgggaatattaggataagcaaaagggcttaacaaaatcaactgatctccagggtcattaacagccatagaagtgctatctccaaktgccttctcaattttgaaagggtgaagggctcctgtttggtgctaataccaccaaaattgcttatataaacttttatagattactctaatgcactactaa

SEQ ID NO: 48657 - DNA, 201 bp, Homo sapiens
ctgccactcagtgaacaagtagaagtgataaaggctgtgaaacctgggaaagcacctcccatttttccctgcacagaggaaggcaaaatcaaggtccagaratatggaactcgggagtgtgggttgtgtatggccagcctggacatgaactcagtgatcatctgggtcaaacagctcactgtgcaacaggaaagttgagga

SEQ ID NO: 48658 - DNA, 201 bp, Homo sapiens
acaggacaacctcctgtgaagaaggtaaacacattaatccagtgttgggaaccaggtttggctggtggagcgggaacccaacaggcactgggagctaaggscagttttctttcaatccatgaactagcttaaaacagaattctgcatctcgagggtttttcatgagttgggtactcttctaggcatttccttgtgcattac

SEQ ID NO: 48659 - DNA, 201 bp, Homo sapiens
ccatagaagtgctatctccaagtgccttctcaattttgaaagggtgaagggctcctgtttggtgctaataccaccaaaattgcttatataaacttttatarattactctaatgcactactaaactttgtagtaagtgaaccattataggttctcttctacagatgggcaaactgagacccatagaagttaaaaattgaacc

SEQ ID NO: 48660 - DNA, 201 bp, Homo sapiens
tccttcccttcaccttattccacttaaattgtgtgattctacaagcttatgtttaaaggaatatgttcctccattacaaagagtttaaatggatatggacygacattgaggagttattgttaatcttgataggtgtgatatgatattgttgttatgtttttttaaagatcctaatttgttagaaatgcatactgaagtact

SEQ ID NO: 48661 - DNA, 201 bp, Homo sapiens
tggagaaacaggacaacctcctgtgaagaaggtaaacacattaatccagtgttgggaaccaggtttggctggtggagcgggaacccaacaggcactgggarctaaggccagttttctttcaatccatgaactagcttaaaacagaattctgcatctcgagggtttttcatgagttgggtactcttctaggcatttccttgt

SEQ ID NO: 48662 - DNA, 201 bp, Homo sapiens
aagatgagtaaagagataagaaggagccagactattataaaaagataaaaaataacagatgttggtaagggtgtggagaaaagggaacccttatacacttytgatgaaaatgtaaattagtacaacctctatggaaaagagcatggagatttttcaaagaactacaaatagaactactgtttgatccagcaatcccactcc

SEQ ID NO: 48663 - DNA, 201 bp, Homo sapiens
caaagagtttaaatggatatggactgacattgaggagttattgttaatcttgataggtgtgatatgatattgttgttatgtttttttaaagatcctaattwgttagaaatgcatactgaagtacttgtgggtaaaattatgttttgtctattttgtttgtttatttgtttaaaaagctccagaaaaaaaaaaaaaaaggtt

SEQ ID NO: 48664 - DNA, 201 bp, Homo sapiens
taggtgtgatatgatattgttgttatgtttttttaaagatcctaatttgttagaaatgcatactgaagtacttgtgggtaaaattatgttttgtctatttwgtttgtttatttgtttaaaaagctccagaaaaaaaaaaaaaaaggttctgggggtagtggttggtgagagattagcaaactgataacaattgttgaaacc

SEQ ID NO: 48665 - DNA, 201 bp, Homo sapiens
tgcaaactcaagtgaaaatgattatccagggagaactcgaggggaataaaagtgatgaggggagccttaggaggagcatggagaaggggcaagtggaggcytgctctgcaataagaagcttttgagtgagaaaattatttgctgtatgggactgccctacatattgtgaaatgtttagcatctttggccctgtttatgaga

SEQ ID NO: 48666 - DNA, 201 bp, Homo sapiens
tattgcaagtacccgggcaagttctccatgtaaaagccagggtgaggtcaggaattggaaggtcccagaagaggtgaggtggttaaatgtaatgccaacayggaggtgggtccctcccaatcccaagcccatctgacctttctctccctcttcccacagagagttgtctgcactgctggtctcaagtggtatcctcaccct

SEQ ID NO: 48667 - DNA, 201 bp, Homo sapiens
gtccaaagtcacccagcaactgactgtaaaagtggaggctccctgacttgtattctgcctgcatattcatgcattcatttgttcattcattcatgggtcaytgaatgcataaagactgagttcaataacagtcatggtccctgcccagagtgagctgacatcgaagtaaagaagtaattcagtatcagaagggtgcaaaaa

SEQ ID NO: 48668 - DNA, 201 bp, Homo sapiens
tgtgagaattggagtaagaatttctgaggaccctcccagctcagatatccagtgatcccaaagctctggacaaaggatttccccagctattttgcagcttscaattgcagacacaaaaagaaagaaagagagagagagagagaaaaaaaacacattgctagaaaggctgcagtaaacttttatgttactgttctgattgtc

SEQ ID NO: 48669 - DNA, 201 bp, Homo sapiens
atacatatgcatgtttgtatgcatgtgtgtgtgtgcatgtacatgcatgcatgagtacctgcatatgtgtgtgtgtgtgtgtgtgtgtgtgtgtgtgtgtytggagcaggcaaacaaagacctgtgagaccacctgttttcatcatctgctgattctcaaagtgtagtccaatgttctaaagaggtcccatggggtatcgg

SEQ ID NO: 48670 - DNA, 201 bp, Homo sapiens
ccgtccctgcggccccagaggctcgcgggtgtctgggcgcgggtggcgggcgggtcgggggcttgcgggcgtgtctgtgcgagagctgccccgcgagcggsgcagagacatcgggcgagctgagagcctcactttgctccatcggtggaatgggcacactcggaaggcgtagctgctccatccctgggaggaacctgggga

SEQ ID NO: 48671 - DNA, 201 bp, Homo sapiens
gaattgggtacggaagcaggtaataaaactgcaataagtactttcggaaaggaaggacaaagtgcttggggggctaggcaaggggtcagagaaggcactgyagagcaagaggcatctgcactgaaacttgagggataagaggaaggggtgaggaggtggtcaaaagaacggtgtctggagcaggagactggcatgtaaaat

SEQ ID NO: 48672 - DNA, 201 bp, Homo sapiens
tcattgaatccccacagtagcccaaggaggtgcacaagttttacagatgcagaaaatgtggttcaggtagcttaagtatcttgcccagcatcacaaagatwaaacaaggcaaaggtgaaatctaaactcaagtgtttcttactgcagagcctgtgttactaactagtaagtatctgcctcattttctggttgtggggaagg

SEQ ID NO: 48673 - DNA, 201 bp, Homo sapiens
ggtaactactgtaattaagactcacaaaggttaggtcacttacccaagttctacaggtagcccagtggtagaacagggaagtctagaatttgaaaccagarccatgtccctctacagccaggaagaaagaagcagcaagtgatggaggaaaatgtcaattttgtatttttagtgagtagggtgtatctaaatatttgcatg

SEQ ID NO: 48674 - DNA, 201 bp, Homo sapiens
tgacctcatgatccacccacctcagcctcccaaagtgctgggattacaggcatgagccaccgcacctgaccagattccaaattattatagtaactttaccrtatacatatatttgaacaccaagccaccattttggctctctgttcccatactcagttccagtgcagcaatttcagactcccaggccccaagataagcaca

SEQ ID NO: 48675 - DNA, 201 bp, Homo sapiens
gagttcttgtttgagttggaaggtctgcaggatgctgttaaaaacataagtgactgctgtccacctgttcctttcatacatcactgcattgcatcctttgragactcttcctaggaaaaatcaagctcgaggcaacctagacaagagtactgcctcctcttcaaaagcaaaaggaagagagcgaatcatgtagtgattccc

SEQ ID NO: 48676 - DNA, 201 bp, Homo sapiens
gcatttggattaaagctaagtagatttttgttttttatcttcagtgtctaaatctcagtcagtttcaggtttggggctatagagcagaaggcattacccasccctgttttaggattatggtgttttcgtattctggtccagaacttagaagtgtttcagtgctcaacatactgctctagaactgacaatgcctcgggccct

SEQ ID NO: 48677 - DNA, 201 bp, Homo sapiens
cctgcagcccatcaggacactggagccctcgtgaagcagaaggtaagccagccttctggaagctcattgacaggaggagtgtgcaaagaacagctctttcmatgtatatggggttttattatttttatgggtctttcccatgtatcatttcatttgagtaacatcatcctgcaaggttagtagtcaagcgctcatccattt

SEQ ID NO: 48678 - DNA, 201 bp, Homo sapiens
tttctgtttgcatccttaaagattagcctgcaatctgttatgttccactggcactgaggaactgagtttttaatacatcaaacatgaggcaacagcattakagaaagaagggtagaatacccatgagggtgcttgccgagggacacaagagaaagcttcctatggaaatttgcatgatgcttagacctaaagaacgggtgg

SEQ ID NO: 48679 - DNA, 201 bp, Homo sapiens
ctggccaggggtttgcaccctaaatcccaggatttcagacttgtggggaggtgccagcctgaagggtatgagacccctaaggagtgtgaaatgcctaatgygttagggacagatccctggagcaacgaggtgctaatcagcccagagctgagccccaaggctggagggcatccaatgccaagttatcttatcagaaagtgt

SEQ ID NO: 48680 - DNA, 201 bp, Homo sapiens
ctgcgagacacttggcctctgttatcctctttaatcctcttgtcaacacagagaggtcactattcttattcccatcacacagatgaaccagtctgggcttrgagtacatatgggacttgcccaagttcacttggcaaatgagtggggaagcccaagtttgaacccagttctatctgactcaaaagttctgctttttctcct

SEQ ID NO: 48681 - DNA, 201 bp, Homo sapiens
tactctatttttaattcacatgaatcgctgggcaatatatagttttgctttgtgttatttttataaatgacgtcatgatgtacttatccatttgcaccttrtttcttttttcctctcaatgttatgttttgcgatctctccatgttgatgtctatgagcttaccattagggcttcctttttatttggctagagaccatact

SEQ ID NO: 48682 - DNA, 201 bp, Homo sapiens
cttctgtccttcttgcacccttgcaattcttgggaaataacctggcattggaactgcaagcctgaggttaaaatgtggcctaaggagaaatattgagaaayactggctggctgtgtgtgtgtgtgtgtgtgtctgtgtttgtgtgtgttgcacacttgtacatttatgggtactgttagtgtcagtatccatccccgcact

SEQ ID NO: 48683 - DNA, 201 bp, Homo sapiens; identical to SEQ ID NO: 13883

SEQ ID NO: 48684 - DNA, 201 bp, Homo sapiens
cgagtggagacagtgtgattttgaagctgggtagccatttgtgtggatgtaaaaagtctgtgcatttctcccttctccatccatcctctggcctctggccrgctctgccttgtggcccatgagtctctgaattcctggggcaattaagggaaacggttgtgtggtgaaaaaagaacctccttcacctggcttgcagcggca

SEQ ID NO: 48685 - DNA, 201 bp, Homo sapiens
atacgtctcccgaagcccccgctttccagctatcaaaggagagcgatacagtgattccccccaacaacccacaactgacgtcatcgcatgctatttttcctttttttttttcctccgggaagaagaaggagactgaactcattcacttttaactcgcaagccctatttgcccagaggagggtctaatttggaacagaggaa

SEQ ID NO: 48686 - DNA, 201 bp, Homo sapiens
gatacctgcacccatatgtttatcacagcactgttcacaattgcaaagatatggaatcaacctaagcatccatcaatggatgatgggataaagaaaacgasgtatatgtacacaatggaatgttactcagccattaaaaggagtggaatcttgtcgtttgaagcagcatgggtggcactggaggctattatcttaagtaaa

SEQ ID NO: 48687 - DNA, 201 bp, Homo sapiens
aactagagctcagtccctctgggaaactctgggagacggtggagaacatgcctccgagttattgcaactctggaaactggcacatgaatccaacaactccrccattagtttagtggtgcttccaggggcattaactccttggtactttaaactcaccctgcatatggacagagtaagcatcaatgaccagtataataagca

SEQ ID NO: 48688 - DNA, 201 bp, Homo sapiens
tgaatgcattttaactatgtacgtgtgtctacataaatacgtgtgtgtgtgtgtgtatatatatatatacatgtatatatatgtgtgtatatatatatatrtgtatatatatatatatgtatatatatatatataacacctgggattccacaggagactgctttataaatgtctataattcagacaaggagcctctcttca

SEQ ID NO: 48689 - DNA, 201 bp, Homo sapiens
aagtaaaacatctcagacatagacaaatacctcatattctcacttagaagtgggagctaaataatgtgtacacatagacatagagtatggagtgacagacratatggacactcagaagggtgggggaatggaagggggtggatgatgggcaattacttaaggggcacaatgtacattattcagaccgtagataccccccaa

SEQ ID NO: 48690 - DNA, 201 bp, Homo sapiens
ctaaataatgtgtacacatagacatagagtatggagtgacagacaatatggacactcagaagggtgggggaatggaagggggtggatgatgggcaattacwtaaggggcacaatgtacattattcagaccgtagataccccccaaaccctgaattcactctgccatctatgcatgtaataaaattatatttgtaccccata

SEQ ID NO: 48691 - DNA, 201 bp, Homo sapiens
ctgtgtgactttaggcaagtcactctccctctcagaaccagttttcacatctgaactttgtggtactgtagggattatttgcactaaagacacttctacaracacttcctaggattctataatcctcatcaaggctgtcctcagacaaaactgtgaagttggcaatagttccagttttcttccttttctggtgtattttcc

SEQ ID NO: 48692 - DNA, 201 bp, Homo sapiens
agtgtgccacctcgtgcctggaccacaacagcgagtccatcatcctgccaatgaacgtgaccgtgcgtgacatcccccactggctgaaccccacacgggtrgaggtgagtgaccagggacatctacccacctgcagctaagggggagggaaatgatattgttgagcacttgctatgtcccggttctgagttcattctttca

SEQ ID NO: 48693 - DNA, 201 bp, Homo sapiens
atgcaaatctgactctgtcacctctagctgaaagctcttcaataaaatctgaattatttgaaattcccccaaatgcacctggttctttaattatcactttwtttacttggcttatcttctatttccagtgcaccattttgcagaatgtttatgccttcccaggattttgccagagttttctctcttctgagaagcccttca

SEQ ID NO: 48694 - DNA, 201 bp, Homo sapiens
aattgagctgaaagaggaagccacttcttcagagtcacacagccattcaatggcagaacagagaattgaacttagcgctcctaattcccagtccaggtgtktcttcccctatgtaacagagtgttggacattggccagaccttgggactcacatttgaactcagctccctctgatcatagagaagtctcccttgtttgctg

SEQ ID NO: 48695 - DNA, 201 bp, Homo sapiens
ttcattctttcacacatattacctcatttaatcatcacacctgccctgtgggtgtgtgttgcagggaggtggggtagagtcgggaggagacttattcacartcatttctctagtccttaattatttaatactttctctctgtcaggtcctatgtgaagggccttttatttactgtccactaaatgctgatgtcagcctagg

SEQ ID NO: 48696 - DNA, 201 bp, Homo sapiens
tccatcaatctactcttccatccattacccatctattaactctccttccctccctttcttccttcctccctacccccttatctccccccactccctccctyttttccttgtttccttccatccacccttccatcaatccatcccctttcatccccattcattccctaatccatccacccttcttttctgctatccatccat

SEQ ID NO: 48697 - DNA, 201 bp, Homo sapiens
ttcttcagagtcacacagccattcaatggcagaacagagaattgaacttagcgctcctaattcccagtccaggtgtttcttcccctatgtaacagagtgtkggacattggccagaccttgggactcacatttgaactcagctccctctgatcatagagaagtctcccttgtttgctgggaatgaaatcttagagagctgac

SEQ ID NO: 48698 - DNA, 201 bp, Homo sapiens
catcaatctactcttccatccattacccatctattaactctccttccctccctttcttccttcctccctacccccttatctccccccactccctccctttyttccttgtttccttccatccacccttccatcaatccatcccctttcatccccattcattccctaatccatccacccttcttttctgctatccatccatct

SEQ ID NO: 48699 - DNA, 201 bp, Homo sapiens
cacagccattcaatggcagaacagagaattgaacttagcgctcctaattcccagtccaggtgtttcttcccctatgtaacagagtgttggacattggccaraccttgggactcacatttgaactcagctccctctgatcatagagaagtctcccttgtttgctgggaatgaaatcttagagagctgacatagtaacgtcat

SEQ ID NO: 48700 - DNA, 201 bp, Homo sapiens
actgagctcttgttttagcaaagagtttggatacatcttgtctgcctggaacctcctattcattgttcaagatcttttaaaattatcttttcctccttgarccttttactgatcaccagaaaaagaagtgaccattatctcccttcttgtcctgcatgtttggtcgcttgttggatggtacttgtcacatggtattacaga

SEQ ID NO: 48701 - DNA, 201 bp, Homo sapiens
tattctcaacaacaaacacatggtccaaggctctaggacacaacctgcctttttctccaacccccactttcaacccccccaccactctgtccacccttacraagcccagtgttagcagaaatatctgtttacaaacaagtgttccaaaagaacagtatcagtagctcaaacaagcctctgaaacatgcctctgattctata

SEQ ID NO: 48702 - DNA, 201 bp, Homo sapiens
agctccctctgatcatagagaagtctcccttgtttgctgggaatgaaatcttagagagctgacatagtaacgtcatggcagctggtgccggtgatggggtkggtataggaaatgagagaacacatttggctaagctcagggttcatgtgaccctccaagagtcttaatttcaaaacaaactcaaccttttaggttcaagtt

SEQ ID NO: 48703 - DNA, 201 bp, Homo sapiens
agctgattgaagaaggattattaattgggtggatataatagtcacatgataatcatgcagctctaagcctttttctaaggtttcatcgactgaggagctgytattgctgctctctggaagttgagtctactctagctccctattacctatgcataacagctaatatatttaatgcataatatgtgtcgggcactgttcata

SEQ ID NO: 48704 - DNA, 201 bp, Homo sapiens
caggtgtggagtttcctccaaactgttaaatgtcttcccttcaaatctcagtctgacacaaattaccagttaaatctcaggaccgctgttacctcgtcccrggattcgaagctctggatcttttataatttccacattgtccctccattctttcccttctattttgttttattgcaccaagaaagtagaaaatcatttcaa

SEQ ID NO: 48705 - DNA, 201 bp, Homo sapiens
ccacccaaccattttagcgaaacgtttccacttcctttggtataccgtgaatttcagtctaaatgaactgttcttaatctagaaaaatttacctctgtctkgttttatgctgtttctactgctcagagcactatacttatcactcacattttttgatatgtgtgctttctcaaactattaattcattcaacagatattgct

SEQ ID NO: 48706 - DNA, 201 bp, Homo sapiens
caaggctgaactaatcatcctctacctagtgcaacaaaatttaaattatgaagccccaaagagcatctaaaccctatttatccatttagagccttaaagcrttttttgagttgagttatttataatttatgattttctaacagatgtcaaaacaatagaaatttagtagtgtatcaaacctctctctttgaaattgtgctc

SEQ ID NO: 48707 - DNA, 201 bp, Homo sapiens
ttatacaacatgatgactatagttactattgcacacttgaaaattgctaggaaaatagattttaagtgttctcaccacaaaaattctaataagcatgtaarataatgcatacttaattaacttggttcagccattccataatgtatacgtatttcataatatcatgttgtacagtattaatatacataatttttgtcaatt

SEQ ID NO: 48708 - DNA, 201 bp, Homo sapiens
taccacataagtctgtgtattattaaaacttatgggtttcaggaaccctcaggcatactactctcaagcttgcctcacatctggatagccttaaatagttkacaaggaaatatgcatacatttatctcttttctctctcagaagacatctgtgaagtatacaggataagattcttcatcctagtgtacatgtgggaaaact

SEQ ID NO: 48709 - DNA, 201 bp, Homo sapiens
aaagccgagtgcagaggttgacatggagaagtgaaagataacagtatgcacctttttttgtgtgtgtgggttttagtgtggaccgggacctttgctacacrctttactctcattatcttactagaacctcacaacaatcctatgatgtacctgttgatttttttatttttttttaatccaccatttggaaataatggaact

SEQ ID NO: 48710 - DNA, 201 bp, Homo sapiens; identical to SEQ ID NO: 13878

SEQ ID NO: 48711 - DNA, 201 bp, Homo sapiens
cagaacatatagatttaagttattatagtatttttattctaagggctgaagagtaacccattcattacataagaaaaagaaaacttacccaagagcaatcytgtgcactgtctctcttctgttctgtagaggactgcagtgtgtctcaccagcttggagatagaagacactgtggcttgaatggctcatctttttagactt

SEQ ID NO: 48712 - DNA, 201 bp, Homo sapiens
gtgccactgtactccagcctgggtgacaaaacgagactccatctcaaaataaataaataaataaataaataaataaataaataaataataatttggaatcygcacctgaacctcaatctcatgacttcatagtcccacaatgcactctgtagagagagaatccatttggaaagttctctgacctcatgatccacccacctc

SEQ ID NO: 48713 - DNA, 201 bp, Homo sapiens
cattttaaagaagggggaactgagtttctgagacaggaaaagcaaagaatcatagtcaatcatgcctaaagagccctctatgactatcttggcccaaacgyttcattttattaataggggcactgaggcccataaaagaggaatgatttgtcccaggtgacaaagtgaatgatagaaagagtgaggttcctggattccaat

SEQ ID NO: 48714 - DNA, 201 bp, Homo sapiens
cacctgaccagattccaaattattatagtaactttaccatatacatatatttgaacaccaagccaccattttggctctctgttcccatactcagttccagwgcagcaatttcagactcccaggccccaagataagcacagactcttcactaaggaaccccagaaccagttctttgctagctctgaatgcatttcatactgt

SEQ ID NO: 48715 - DNA, 201 bp, Homo sapiens
agttggacatgttcctcaccattaaggggcttccactttagtgggaaagtcatatagaaacataagaaactctgatttgtaaatttagagacacacagtakgacaggagactgaaaaagcagagatttatttgactaggaaaacaaggcaaatcagctggagggggcaagatttgagtaggcatttgagaataggcagcct

SEQ ID NO: 48716 - DNA, 201 bp, Homo sapiens
aatctcagctcctctgtgttttcattctcctcccatgcattgtttctcttttcactctgggcctgggtgagcttggaaatgagggtgaggttgtgggaagygttggacacatctagatttgtacttggccttgtctccagttgtgtgatctctgaacccctcttccttcatctgtatgatggcgataagtgataagaatag

SEQ ID NO: 48717 - DNA, 201 bp, Homo sapiens
ccacacaacggactctgtgacactggagtggttcccacctatagatggccatttctttgaaaggtgagtgtgccctgtgtagtgttgatccctctctctckctcctgccaagaagaaggaaacttggaagggaagcagacttggagagggattttactgcatttcttgttcttgttcaaaaggtatctccaccacctagca

SEQ ID NO: 48718 - DNA, 201 bp, Homo sapiens
gagcagaaacactatgttatgaaacacccatgtttatcatgagagtgaaaaagtgctctgaaatttcaaaggcataagtgatcttttccacctggaaggaytggggacttgttcatgaagtgaatgtgtatgtatgtagagtgtgtgctctgccttgtgtgggggtatagtcatgtatgtaattttaaacatatagccata

SEQ ID NO: 48719 - DNA, 201 bp, Homo sapiens
aagctgcacagcacctgcctctaaccccttggaacatccttttgcagcaggcttgtgtcttgcccaagcgtcttgtcctgccccttgtgggtgatattctkgcttcatagacctccaggaatggagttcttggtatgaactccaggcccagagttaagcactcagcatcttctcccagacttccttcttgccagttttcca

SEQ ID NO: 48720 - DNA, 201 bp, Homo sapiens
gtgtggttgtataaataaagatagatacaaagataaatatctacttgttctcagctgggaggattttatgccccaggagacatttggcaatatctagagaygtttttgcttcttacaaatgggggaatgctactggcatctagtgggtagaagccagtgatgctgctacatgtccacaatgtccactacaaagaattatac

SEQ ID NO: 48721 - DNA, 201 bp, Homo sapiens; identical to SEQ ID NO: 13898

SEQ ID NO: 48722 - DNA, 201 bp, Homo sapiens
tgccccaggagacatttggcaatatctagagatgtttttgcttcttacaaatgggggaatgctactggcatctagtgggtagaagccagtgatgctgctamatgtccacaatgtccactacaaagaattatacagactaaaaagtcaatagtgctgaggttgagaaatcctgagacatatggtgtatgggtagatagattg

SEQ ID NO: 48723 - DNA, 201 bp, Homo sapiens
atgcagggagcccacatgtcagaatctcaaggcagctagagataatcaaggacaggttcctcattgtacagatagggaaactgaggcctatagaggaaggyggctggtccacacaggcagcacaactggaacgacaagctggacttgtgattggcagctcttccaatactaccagctctccttccttttcccacccgaact

SEQ ID NO: 48724 - DNA, 201 bp, Homo sapiens
ccatgcatacacccatccattcaactgcttatactgaccaacattataagataagttgtgtgctgtgctgtgtgaaataaaaagatggttattagatattractttgtcctcaaggacctcacaatctattaggataaactctcctgcatgtcaaaaaaagttttcacagaggaaatgatgtcaaaggtgaacttgaagga

SEQ ID NO: 48725 - DNA, 201 bp, Homo sapiens
ctttggcggtattgaattttgtccctaaaaccacatactcatttctctaagtctgaaagtaaactttctcaagccaggcccaaaggatggggttttgaggkgagttagagtttggctgtgcacaagattttgtttttatttttgtacacacaaatgtgttcatttgtttttgtttgtctttcaagtcccctcgtctctact

SEQ ID NO: 48726 - DNA, 201 bp, Homo sapiens
agttgagcttgctgagcctgctgctttggcggtattgaattttgtccctaaaaccacatactcatttctctaagtctgaaagtaaactttctcaagccagrcccaaaggatggggttttgaggtgagttagagtttggctgtgcacaagattttgtttttatttttgtacacacaaatgtgttcatttgtttttgtttgtc

SEQ ID NO: 48727 - DNA, 201 bp, Homo sapiens
gttgatctagaaatacagttttccttctggtagcaaccgacaaagttttaaagaaacacttctgtctgcctgtgaagttttggcaactgaggaacaaatcsaattaggaacaacatgtggactttttttttttttttttttctaacagaatagtatttggggcatagaaatttaaccagagagagactttgagagtctctt

SEQ ID NO: 48728 - DNA, 201 bp, Homo sapiens
agatagcctttgtctatttctcagaggctgcatttttttttttcaaaaggattttattatcacagccttgtctcatctttgctccctaaaaactcctttaraactggtctcatgataaagcacactccataagcagtttctctgactgcttagggatttttgctccttattctcatcactcatcatttttgtctgtgttat

SEQ ID NO: 48729 - DNA, 201 bp, Homo sapiens
gctgatcttgttgtttcagccccacttgggaggccctggtcagccccgggctggtaaacagacaggggttgggaggggcaggggtggaattttgagctggyccagatgagatcatacttcctttaagatgcaaatcgatacctgaagatcaaaggtcccccagctaatcccctgggctggaggtgaaaactaatcacaatt

SEQ ID NO: 48730 - DNA, 201 bp, Homo sapiens
cctctttggggtactgagtactttccatggactaggcttgatttttcagatgacctcaggatgtgtgaggtcagggtagagaatgaatgagctgaattacrgtcaacttgccaacccacagcctggaagtcaactgtcttcacccaaaagttcctggaccaagggcttctatgtagtagccctatctctattagtcattta

SEQ ID NO: 48731 - DNA, 201 bp, Homo sapiens
tgtgccaggcaaatgatgaccactagctgaatgtagctatggagcacttgaaacatggttgcagcaaatgagcaacaaaatgttaacttttatttaatttraagtaattcaaagttgaaggcaaatagccatacttatacagtggctaccatatcagatagtccagctctagcacttacggtattctcgtctctttaaacc

SEQ ID NO: 48732 - DNA, 201 bp, Homo sapiens
tccttctccaagctttacctgttttggggaaagcaattaataggtgtctagcaaactagtaacatcggttgtttgtggagaacctgccacgttcatgtgtycggtgcttagcacgaagactccattttagcctcagcacagttgtatgagagaagggtcattgtctgcattttccagttgtggacactgaaatctcggaag

SEQ ID NO: 48733 - DNA, 201 bp, Homo sapiens
agccttgtgtgtttaggaagccagtggtccaacctgtacctattatccttgtaatcaagaagtcattcctatgcctgtcccgtatccattcctgttgctcmatgaatctgaaaggtggctcggcagaatgtggccaaatgcatttatatggagggggttattttccccagtgtgactgcagatctttcagctcagaggctg

SEQ ID NO: 48734 - DNA, 201 bp, Homo sapiens
tccattctcaggttctgctgattcctagcagacaaatttattgtggtctttaacataatcaggaagaaattagcctttagaagaactaaaatctaaccccmatttctgtcattccgagaggttttttgctaaggaaattaagtcactttagagactagatcttacccttacagagaacataatcttaccctatttttcttt

SEQ ID NO: 48735 - DNA, 201 bp, Homo sapiens
tctagcaaactagtaacatcggttgtttgtggagaacctgccacgttcatgtgtccggtgcttagcacgaagactccattttagcctcagcacagttgtaygagagaagggtcattgtctgcattttccagttgtggacactgaaatctcggaagtgaggtgatgggccctgaaccaaggcttgaacccaaacctgagtct

SEQ ID NO: 48736 - DNA, 201 bp, Homo sapiens
accaaggtagtcaggcattcaacatgtgattgcaaaatgtgtgctcacttttgtaataaagtatgggacactaaggatacctgtggaaggaaaccaacatwacccagctatcaaaaaaaaaagcctccctaagcctttctcgttctttaaaccactatttggtcttcctctgctagcactctccaaactctactttgtgtt

SEQ ID NO: 48737 - DNA, 201 bp, Homo sapiens
tatctctcttcctctctttctttccagtgaaccagtataccatctatgccagctttaagtcccttccatgtggctgtccttcggcctctccaaacccattytttttttttttttttttttttttttttgagatggagtctcactctgtcactcaggctggagtgcagtggcacaatcttggcttactgcaacctccacctc

SEQ ID NO: 48738 - DNA, 201 bp, Homo sapiens
aaactaataaaacagtagccatttttttctgatacttggtccacagtcagtatgttaaactatctttcaaaacatttcttcccaagggcatacaatacttyctgtctcagatccttaccaaccacccctcaccaccaataaaaagtgagaccaaagtacctctcagtcaacagaaataaaaggtttccttaaaaattcaga

SEQ ID NO: 48739 - DNA, 201 bp, Homo sapiens
aaactgggagaaagttaccacatcagggaagcttcctttacttctccaacagtattaatggctattaatgtcttgatctctggagtactgagaggaaagacccccccccccaatatttttattagtgacattaaattgacatgtccatgtggctttgcagggacatgtaaaatatgtttctgagcttattagaaacagttc

SEQ ID NO: 48740 - DNA, 201 bp, Homo sapiens
aactgggagaaagttaccacatcagggaagcttcctttacttctccaacagtattaatggctattaatgtcttgatctctggagtactgagaggaaagacccccccccccaatatttttattagtgacattaaattgacatgtccatgtggctttgcagggacatgtaaaatatgtttctgagcttattagaaacagttct

SEQ ID NO: 48741 - DNA, 201 bp, Homo sapiens; identical to SEQ ID NO: 13873

SEQ ID NO: 48742 - DNA, 201 bp, Homo sapiens
cttgcagtgagccaagactgcaccactgcactccagcctgggtgacagagcaagactccgtctcaaaaaaaaaaaaaaaaaaaaagagagaaagaaagacwctgaaaggatcctgaccaaaacgttcctggtagctgtctcaggataatggaatttgagattattctactttaattctttcatatagccttctaatttgct

SEQ ID NO: 48743 - DNA, 201 bp, Homo sapiens
ggtcttcaagaatagctctaatttgaaggatgttagaacaaatctagagatctaatgaacaacaagatcaatacatttggtgtaatagaacaaatctagarggctaatgtatagcatgaggactataggaaataaggttgaactgtatttgggatttatgctaaataaccagattttaaatacttttggcacaaaaccaaa

SEQ ID NO: 48744 - DNA, 201 bp, Homo sapiens
cacaatgcctggcctgccatagaggcttgggagattttgctcattattattaactattatgtaggcatacccaatttatgttaagaaggcactcattatakgtgtgtgtgtgtgtgtgtgtgtgtgtgtatctatatctatatatctatatagatatatagatatagatatagatatagatatatatagacagagagagag

SEQ ID NO: 48745 - DNA, 201 bp, Homo sapiens
aatttggtaaagtaactaaactaaaaacttttccaatatgagcatccattggatattctagataaaatattacagatataactagcatcctttaaaatgcmtgattgagattagaaaaacagaaaaggatatttccaggggcaagacatgcaagaaataaaatagaactgggaactaaacaggtaaaccctggatctaaat

SEQ ID NO: 48746 - DNA, 201 bp, Homo sapiens
gcatgcaagtcagtactgataaccatgcataatgaggccataggtgggattacagttctggtggagacggtggccttgtggtcttggggttgagcactgcmcagtaatatcttattccatttcatatcagaaaaccaaatattgactgcttctcttctctttaacaggcatttattgggcatgtctatcccaccagccttt

SEQ ID NO: 48747 - DNA, 201 bp, Homo sapiens
tactgtgagctgccggacaggctacgtgctccagatacggcgggatgatgagctgatcaagagccaggtatgtgcaggtgctgagctcagagcctctctgsagcccagggaaggcttactgggtgttaaccatgttctctgctaaatacccagcagcacttaaaatagtgctgccacatagtaggtgctcaataaatattt

SEQ ID NO: 48748 - DNA, 201 bp, Homo sapiens
ctttccctatacactgttgtctcataaggaaacatttcctttgtcttctctttattattatttgggaattatttcctttgtcttctcttttttattattattttttttaatgtaacaaggacaatcccctgaggccaggtttttgttgttgttgcttttggactccagttaatgttgttggaagtctcacaaaaggggctg

SEQ ID NO: 48749 - DNA, 201 bp, Homo sapiens
ttctgaacaaagtccacctttactcacaagttccatctgtgagacttgcacacatataactttggtcttaagagcagaatagaggggtgaactgaattaaaagaagaactgttcaaggcccctaaagatgaggttaataaggagctcgaaacagtgacctatgaggaacagtagaagatcaatacagtctagcaaataaat

SEQ ID NO: 48750 - DNA, 201 bp, Homo sapiens
aggggttattatggctgagatccagaccatgagcagagaaaagttcagtttatctcacggaaaactttaatgttaggcttaatcctctgttccttcctccstacattcttcccaccttcccttccttctgtccttttcttctctcaataaatatttgttgaatgctctctctgtgccagcccgatcactgccctcccagag

SEQ ID NO: 48751 - DNA, 201 bp, Homo sapiens
catgagcagagaaaagttcagtttatctcacggaaaactttaatgttaggcttaatcctctgttccttcctccctacattcttcccaccttcccttccttstgtccttttcttctctcaataaatatttgttgaatgctctctctgtgccagcccgatcactgccctcccagagcttaccacctagtgggtaagacagaga

SEQ ID NO: 48752 - DNA, 201 bp, Homo sapiens
tgtgagcagtaaatgcctttctatgagactagccagttagaaaaaagacattccaggtgaactgtggccattctctacagtggtggagaatagccagggasgcaggacttcatctgcagccattagagatgtctccacgcaggtagaatgcacttcacacacccttttataaatgaaatggaaaacctggatattaataga

SEQ ID NO: 48753 - DNA, 201 bp, Homo sapiens
gcttcagaccaaatcacctgattcacttcttctttctgcaggtcaccccattccctatgtcctgtgatctacaaggtgactgtgcttgtcgggacccccasgcccaagaacacagccggaaagacctccggggatacagccatggctaaggaaggacaagaagttgtcaaagaattcccaacgccaggacccacatccctt

SEQ ID NO: 48754 - DNA, 201 bp, Homo sapiens
atcacacaattgccatgagggtctcataaaataatatcccagaaagagttctgggaagagttaaccagcatgcagatgaaagggggcattgttatttttcrgtcactttgttcattcttttccagtaatcatgtaaaagaaattgcttggaattttataatcagaatatcagggtttatttaatgtgactaatattcatta

SEQ ID NO: 48755 - DNA, 201 bp, Homo sapiens
tttatttaatgtgactaatattcattaaagcaataacaggagtcaggtctggtgtagtggaaaaattatgcgtgctagagactgaccagggtttgaatctyggctccgctctgcactagctgtctgaccttggcacattgctcagtaagagccgctggtttctcatctgtaataattgggtgatagcagctatcctgtggc

SEQ ID NO: 48756 - DNA, 201 bp, Homo sapiens
aattctgagtagcaaagcttctacgcagattaagccacacagattaagctacagattaatacacacacagcttaatctacagactaatacatgcacagagktggacagacaacttgcccatagatataggtctatctgtccaactctgcgtgagtctgggattttgattgatttttctgggaagtgagtaatgtttgtttg

SEQ ID NO: 48757 - DNA, 201 bp, Homo sapiens
agatatttgatgccatgttttatctgtagcctataaattagataaatatatatttcttgatctgactgactcaaatcccagttaagatcacttatgcaagyataaaatagatcccaagtgttgggttttccatgagagattagcacatggcactaactgtttttattttttctcatttgtgtgttttctctatttttctgc

SEQ ID NO: 48758 - DNA, 201 bp, Homo sapiens
catgatccctggaaaaagccttgggtgggaagcggattatgtttcatgttatgattgacagaaaataattgagaaagatttcctgtctcaatttctcttcytccctgcctctgcctgcccccttctcatacccaagtgaatgtgcacacccgcacactcacatgccctctcacacatctttatctttgtgttagaaagctc

SEQ ID NO: 48759 - DNA, 201 bp, Homo sapiens
ctgaaccccacacgggtagaggtgagtgaccagggacatctacccacctgcagctaagggggagggaaatgatattgttgagcacttgctatgtcccggtyctgagttcattctttcacacatattacctcatttaatcatcacacctgccctgtgggtgtgtgttgcagggaggtggggtagagtcgggaggagacttat

SEQ ID NO: 48760 - DNA, 201 bp, Homo sapiens
ttacaccatgatccctggaaaaagccttgggtgggaagcggattatgtttcatgttatgattgacagaaaataattgagaaagatttcctgtctcaatttytcttcctccctgcctctgcctgcccccttctcatacccaagtgaatgtgcacacccgcacactcacatgccctctcacacatctttatctttgtgttaga

SEQ ID NO: 48761 - DNA, 201 bp, Homo sapiens
agcctcaaatacaaagcagatttccagaatggttgctccagtggtttcccttcatgacaaaaaaaattcaatttataattggaatcattctaagtaagcaygtgttagggtgtgagggagaaaagggaaacaaccttaacatattcaacataccaaagctttctaaggtgtggtggcctggaacactagttgtggtcatgt

SEQ ID NO: 48762 - DNA, 201 bp, Homo sapiens
gtcattggtctaagaaggctagtgattctataagatatggaaaaataatcaacatcattacatggagagcaaccttcttagcagagtgggtgataacctayattgacaaagggctggatgttgggtagctgacttggggatgtacatcagtgtctcttcttgacctagcagccagaataatcctttttttttttttttttt

SEQ ID NO: 48763 - DNA, 201 bp, Homo sapiens
tctgaacaaagtccacctttactcacaagttccatctgtgagacttgcacacatataactttggtcttaagagcagaatagaggggtgaactgaattaaaagaagaactgttcaaggcccctaaagatgaggttaataaggagctcgaaacagtgacctatgaggaacagtagaagatcaatacagtctagcaaataaata

SEQ ID NO: 48764 - DNA, 201 bp, Homo sapiens
gggtctgtgaagaaattctatgtttcaagttcctttctggccaggtctttgccttctacctttctcagactgagaaggattttcagccagatgagaagttrgaagctatgaaaatcaactcttattataggcagggaaacaagctcagagaagggaagtaacttgtccaaagtcacccagcaactgactgtaaaagtggag

SEQ ID NO: 48765 - DNA, 201 bp, Homo sapiens
ctgaacaaagtccacctttactcacaagttccatctgtgagacttgcacacatataactttggtcttaagagcagaatagaggggtgaactgaattaaaagaagaactgttcaaggcccctaaagatgaggttaataaggagctcgaaacagtgacctatgaggaacagtagaagatcaatacagtctagcaaataaataa

SEQ ID NO: 48766 - DNA, 201 bp, Homo sapiens
acaagagacactgagttaccactcttgagaggcggctcaggggaaagtttctaaatcaggagggacatttcaatctagccaacattttccaaactttgttstttgtactgctgtttggtttttggcaaaggtggaagtgtgtaaggggaggggtgtggaggaggaattatggtcacatatttttgggtacacttcctgtgc

SEQ ID NO: 48767 - DNA, 201 bp, Homo sapiens
gtgtaaggggaggggtgtggaggaggaattatggtcacatatttttgggtacacttcctgtgctatctgtcttactcttattttgcatatttgaggctccraaaattcttgcaattaaaaaaatatgtatttaaccttgtttaacagaccatgtcccaaatccatttgactcagcgacatttttctttaaatattcatcat

SEQ ID NO: 48768 - DNA, 201 bp, Homo sapiens
catctatatgtaaacatgcatttttttaactgtacatttttaaaatcatagcatagatgaaattctgtgttcttttttcacttaatattatgctatctactttttttccatgtcgcagaagtcttatccttaacttcccacccatatttttttcacttaatcacaaaagaaaagcacccttgtgggttattttcccctctc

SEQ ID NO: 48769 - DNA, 201 bp, Homo sapiens
gattggatgaaataatacacagtcaaccttttaggacagcacctggcacatagtgaagtctgaaaatagcagttgttattgctgctgttgtttgggaattkccctcctccgatagatcttctcgcttcttattgtgcatatcccgaaattcttagccccttttcaatcctgagccccctcactacaatctcagtgcgggag

SEQ ID NO: 48770 - DNA, 201 bp, Homo sapiens
cttctccactttcaccacctctactccatctcccaaattccttcagaaatctccctggaaaatgtaaaccagatcattttatcctcttacataaaatctgycagggtctgcttgggactcccaggacactttcaattctccattgcctagtatacaagacccttcctgattgtcttagtttgctgtatattgcttcagagg

SEQ ID NO: 48771 - DNA, 201 bp, Homo sapiens
aagacccttcctgattgtcttagtttgctgtatattgcttcagaggaatacctgaggctgagtaatttacaaaggaaagagatttatttggctcatggttstacagacagtacaagaagcctggcaccagtgtctgcttctggggagggactcaaactgcttcccctcatgcttggaaggggaagaggagccagcatatgc

SEQ ID NO: 48772 - DNA, 201 bp, Homo sapiens
ccttattgttagatcaaagagaatgcatattttatatcctgaatttttttcctgcttccagttttctaacactcacacatacatgagcacacgcaagcatacacacacacaccacacacacactatttccaattcccatgtactaacatttatcatggggcaggcattgctcttagtgccccacacccctgcaccttggct

SEQ ID NO: 48773 - DNA, 201 bp, Homo sapiens
cttattgttagatcaaagagaatgcatattttatatcctgaatttttttcctgcttccagttttctaacactcacacatacatgagcacacgcaagcatacacacacacaccacacacacactatttccaattcccatgtactaacatttatcatggggcaggcattgctcttagtgccccacacccctgcaccttggctg

SEQ ID NO: 48774 - DNA, 201 bp, Homo sapiens
gagggacatttcaatctagccaacattttccaaactttgttgtttgtactgctgtttggtttttggcaaaggtggaagtgtgtaaggggaggggtgtggargaggaattatggtcacatatttttgggtacacttcctgtgctatctgtcttactcttattttgcatatttgaggctccaaaaattcttgcaattaaaaaa

SEQ ID NO: 48775 - DNA, 201 bp, Homo sapiens
agaagaaactctgtggctgaggagcaggagttatgaaagcacacatcacatttagggaagcaatagcagtctggtgcagcttcttttattattaatcttgwaatttgcatcatactaaacattcatgagtacctgatatagttcaggcccttcatcaagcacttgaaaggcattatatcttatcctcacaataacctttaa

SEQ ID NO: 48776 - DNA, 201 bp, Homo sapiens
ccaacattttccaaactttgttgtttgtactgctgtttggtttttggcaaaggtggaagtgtgtaaggggaggggtgtggaggaggaattatggtcacatrtttttgggtacacttcctgtgctatctgtcttactcttattttgcatatttgaggctccaaaaattcttgcaattaaaaaaatatgtatttaaccttgtt

SEQ ID NO: 48777 - DNA, 201 bp, Homo sapiens
gtgaggagactccttcttcccctcgtttctttcctccccagctgcgtgcacttcgcatgtgagaaaactgactgtccagagctggctgtggagaatgcttmtctcaattgctccagcagcgaccgctaccacggtgcccagtgtactgtgagctgccggacaggctacgtgctccagatacggcgggatgatgagctgatc

SEQ ID NO: 48778 - DNA, 201 bp, Homo sapiens; identical to SEQ ID NO: 13880

SEQ ID NO: 48779 - DNA, 201 bp, Homo sapiens
cattttccaaactttgttgtttgtactgctgtttggtttttggcaaaggtggaagtgtgtaaggggaggggtgtggaggaggaattatggtcacatatttytgggtacacttcctgtgctatctgtcttactcttattttgcatatttgaggctccaaaaattcttgcaattaaaaaaatatgtatttaaccttgtttaac

SEQ ID NO: 48780 - DNA, 201 bp, Homo sapiens
tttgtactgctgtttggtttttggcaaaggtggaagtgtgtaaggggaggggtgtggaggaggaattatggtcacatatttttgggtacacttcctgtgcyatctgtcttactcttattttgcatatttgaggctccaaaaattcttgcaattaaaaaaatatgtatttaaccttgtttaacagaccatgtcccaaatcca

SEQ ID NO: 48781 - DNA, 201 bp, Homo sapiens
cggtggtggttctctcttgaaggatacttttaagtgatacggagataataaagatttggtcccaactgccagaagctcattacctgatggaaaagacagawgctcacacagtgaatataacccaaagcagattgataagtactggaattaaaagtagggggcacagaggaaggaggactcattttcagatagaggtgatga

SEQ ID NO: 48782 - DNA, 201 bp, Homo sapiens
ctcacttggaaattctgcattgataagcaattctgcaatgctaattagagtgtgctatttgcaaagggcaggaagaaatcctgtgctctatacccaatgcygaagtcacttctaaggggctctctgccccttccttgcctgctctgcctgctatggccttcaccaaagcattcatctcctctcattagtgaaatgagagag

SEQ ID NO: 48783 - DNA, 201 bp, Homo sapiens
ctcttgttttgtattgtgttatctcagactcgtatgtgctttcattaagttgtttcagaactagaattggagaaaaggcattacactgccccccgcaaggmaaaaaaaaagccacaaaaagaagcaagaaattctcatttacaagtgtatttgtctgcatttgtgtgtgtgtcaaagacatattaggcaaaggacctaaat

SEQ ID NO: 48784 - DNA, 201 bp, Homo sapiens
ttaatttttcacattaccatcagtacctgagtctagaacctaaatttggtagctggcgaatgtgatcatcagggaaggaaatgcacttactatgctctgtrgaaattccccttcccctgccccagccatcctcactgggagcacagagctgggtttgggaaacctcgtgtgacacttcagaggtttccagcaggccataga

SEQ ID NO: 48785 - DNA, 201 bp, Homo sapiens
cacgtgttgactgggttgtttcagttatctgacaattggccatggtatattggaaatagtactggactgaaaaccaagaaacctgggtctgaagtctttgygacctcatccattccctctgcctttggcctcagttttctgatgtgtaagccaaagatgttctaggctttctcaaccaaggttcctcttctaaattttaag

SEQ ID NO: 48786 - DNA, 201 bp, Homo sapiens
cccagcaaatgtgtgtttaattgactgtagatacacacacatacacatacatacatcccattgccacatgcaaatgaacgacactgacagaaaacactcaygcattgcctctctatcacatagaatgtcctgcttcagaaacaacagtgctggggccagcaagagaacaaggaatccaaattcaacactagcatccagttc

SEQ ID NO: 48787 - DNA, 201 bp, Homo sapiens
ataggagacaagttaattcattatatacaatggatgccttggagaaacactgtccaataggatttgctgcaataacggaaatattctatatcagtactaasattatagccattagccaactggggcttgaaatgtgactggtgtgactgaagaatcaaatttcaaattttatttatttttaattaaattaagtttaaatag

SEQ ID NO: 48788 - DNA, 201 bp, Homo sapiens
aatcatcctatattccattgcccagaaattgctgctgataatattttgtttcatagtgttatttgaacattgagatattgctatagatttagctttggatrttactttttcatttaatattatagcttacacattttccatgaagttgcataatatttataaatatttctgcaataactgcttgccattccattaagcata

SEQ ID NO: 48789 - DNA, 201 bp, Homo sapiens
agatttagctttggatattactttttcatttaatattatagcttacacattttccatgaagttgcataatatttataaatatttctgcaataactgcttgscattccattaagcatattaaccatgggctatttaatgattctcttatcactgaatattaatattagtgtgcttgcaaaatttccacctacatatggtttc

SEQ ID NO: 48790 - DNA, 201 bp, Homo sapiens
tatccatccatccatccatccatccatccatccatccatccatctatccatccatgcatacacccatccattcaactgcttatactgaccaacattataarataagttgtgtgctgtgctgtgtgaaataaaaagatggttattagatattgactttgtcctcaaggacctcacaatctattaggataaactctcctgcat

SEQ ID NO: 48791 - DNA, 201 bp, Homo sapiens
catgacgcaacatgataggtagacagagcttatcatggagagaaacaaagctagagtgaagcagaggatagtatgaaagagcattgaataccacattatakggcattaggggataaaatcactgaaagaggtaagcagaggcatgacttgttcatcttgaggtttggggatgatctactgtccgctgtgtggaggaggaac

SEQ ID NO: 48792 - DNA, 201 bp, Homo sapiens
gctggatggttctttaggcatcatttaatccagccctcttattttcagaagaaggaaccatgccatcttcatatttaatgcctaaaacacaagatggtgtytggcacatagtaggtacctgataaatattgtaaaaggagtaaactttgagaacgaaatggagcaagagattttctcataactacattgcaaatcctcagt

SEQ ID NO: 48793 - DNA, 201 bp, Homo sapiens
taatgatgagtagagtaaagagaatggcttggctgtcagagtgattacattatgtagagaactctacactgttttttgtacatttaaacctgtcaaccacygtatgaggtaactactgtaattaagactcacaaaggttaggtcacttacccaagttctacaggtagcccagtggtagaacagggaagtctagaatttgaa

SEQ ID NO: 48794 - DNA, 201 bp, Homo sapiens
gacatgcaccagggagctacggtcaggggtttatgtttcagagagagcaaaattgtatcagtgttcacaggccaggctccagactatctgtccagtagaamcttccatgatgatgaaaatgttctacatatgaatgtcctgttcagtagcctctagccacctatgatattaagccctaggaatgtggttcatgaaactgag

SEQ ID NO: 48795 - DNA, 201 bp, Homo sapiens
gcgaaaagacctggacaatgaaaaagagctggccagggaagagcagtcagagtggagggccattagtggctaaggacacaaaagtaggaaaacagagtatmtggggaaccaataaataaagaagccactgagagtgaggaggagaaggaaaccatgtaagatctgagacttatgtagaaatcagatcatgcaaggccttga

SEQ ID NO: 48796 - DNA, 201 bp, Homo sapiens
agatggaatatcctagatgtattccacaaagtcacagaggatggaaagtaaatgtcctaaacagagaacagcaagtagctgtgagcaagaagagaggtgcwgcttggaaaaggggacggtggaaatgcttaccacagcatcaagcacttatgaatttaaattgaaaagagaaacaaagacttgtggtagccataagtacaa

SEQ ID NO: 48797 - DNA, 201 bp, Homo sapiens
cagatactgttccagttctgggaatacattggtgttagtccagtgaaaatagtaactatgctctccttgagtcatctatgatatcttcttgcctgtcatccatccatccatccatccatccatccatccatccatccatccatcgttttactaaataaacatttatggaatctatatttgataaagttttgcacaaatacg

SEQ ID NO: 48798 - DNA, 201 bp, Homo sapiens
agatactgttccagttctgggaatacattggtgttagtccagtgaaaatagtaactatgctctccttgagtcatctatgatatcttcttgcctgtcatccatccatccatccatccatccatccatccatccatccatccatcgttttactaaataaacatttatggaatctatatttgataaagttttgcacaaatacga

SEQ ID NO: 48799 - DNA, 201 bp, Homo sapiens
ataggcttgtctcattgaatccccacagtagcccaaggaggtgcacaagttttacagatgcagaaaatgtggttcaggtagcttaagtatcttgcccagcwtcacaaagataaaacaaggcaaaggtgaaatctaaactcaagtgtttcttactgcagagcctgtgttactaactagtaagtatctgcctcattttctggt

SEQ ID NO: 48800 - DNA, 201 bp, Homo sapiens
atactgttccagttctgggaatacattggtgttagtccagtgaaaatagtaactatgctctccttgagtcatctatgatatcttcttgcctgtcatccatccatccatccatccatccatccatccatccatccatccatcgttttactaaataaacatttatggaatctatatttgataaagttttgcacaaatacgaga

SEQ ID NO: 48801 - DNA, 201 bp, Homo sapiens
ggaataaacaagattgacctggtccctgccttatgggccacagaattggtgggaggatagaccaaaaaaataaaggagagggagcgggagagagaaagagmcagaataattgagcacttagcatatgtcaagcactgtgtgaggtgttttcatgagttatttcatgtattccttatcacaacctcaggaggtctacacttt

SEQ ID NO: 48802 - DNA, 201 bp, Homo sapiens
aactatatctatattaattcactattgcatccttttccttagcataatgtgtaacacatcgtaggaattaaatacataggatggaataaggataaatgaadggatggatggatggatggacggatggatggataggtggatgaaaggatatggttgcaggaaagaacatatagggtagagtaactagtgatgggactggag

SEQ ID NO: 48803 - DNA, 201 bp, Homo sapiens
ggtctagcttccctgagacatgctttttgttttcatcattgcctactaaagtcaaagtgaccagtatgtgcagagacttatgttttctcaaaagacacttmcacatcctttctttcacttgatcacttatacatcagatattccattacacagttctattaatcaactttgctatagtgcacgacaattttccacccatga

SEQ ID NO: 48804 - DNA, 201 bp, Homo sapiens
ccagttttccacctaaacttcttcccggttcccagggctagggcctccgtgatgccttggcccagcatgatgactgtctgctcccttcattctccctcccttatttgtctgtacagacaccagctgttccccacatccgccttatggggtgacctgggcccggctggcagacaagagcaagacggtgcaggaaactctgtc

SEQ ID NO: 48805 - DNA, 201 bp, Homo sapiens
ggcaaaaacatttatattatattatatattatattatattaattatattgtatcatattatatatgcttatatatggatatatatatttatgtgtgtcacatgtgtgtatataagtacatatttacatataagaatacatatacaaggccgggcatggtggctcactcctgtaattccagcactttgggaggccaaggtgg

SEQ ID NO: 48806 - DNA, 201 bp, Homo sapiens
tccctgcgctgcactgcctttctgatcattactgcttcagaccaaatcacctgattcacttcttctttctgcaggtcaccccattccctatgtcctgtgayctacaaggtgactgtgcttgtcgggacccccaggcccaagaacacagccggaaagacctccggggatacagccatggctaaggaaggacaagaagttgtc

SEQ ID NO: 48807 - DNA, 201 bp, Homo sapiens
cagttttccacctaaacttcttcccggttcccagggctagggcctccgtgatgccttggcccagcatgatgactgtctgctcccttcattctccctcccttatttgtctgtacagacaccagctgttccccacatccgccttatggggtgacctgggcccggctggcagacaagagcaagacggtgcaggaaactctgtct

SEQ ID NO: 48808 - DNA, 201 bp, Homo sapiens
gcaaaaacatttatattatattatatattatattatattaattatattgtatcatattatatatgcttatatatggatatatatatttatgtgtgtcacatgtgtgtatataagtacatatttacatataagaatacatatacaaggccgggcatggtggctcactcctgtaattccagcactttgggaggccaaggtggg

SEQ ID NO: 48809 - DNA, 201 bp, Homo sapiens
agttttccacctaaacttcttcccggttcccagggctagggcctccgtgatgccttggcccagcatgatgactgtctgctcccttcattctccctcccttatttgtctgtacagacaccagctgttccccacatccgccttatggggtgacctgggcccggctggcagacaagagcaagacggtgcaggaaactctgtctg

SEQ ID NO: 48810 - DNA, 201 bp, Homo sapiens
aaaaaaaaaagaaaaaagaatgcatatacatatatgacatataaacataatttttgcgccaaatgttttttttttttattttgtagaactaaaggtagcatttttataagaccagggaatgataaactgaggcacaaggtacctctattctgctgccctgacagttcattaattaaccacatggccttgagcaagtcactt

SEQ ID NO: 48811 - DNA, 201 bp, Homo sapiens
gttttccacctaaacttcttcccggttcccagggctagggcctccgtgatgccttggcccagcatgatgactgtctgctcccttcattctccctcccttatttgtctgtacagacaccagctgttccccacatccgccttatggggtgacctgggcccggctggcagacaagagcaagacggtgcaggaaactctgtctga

SEQ ID NO: 48812 - DNA, 201 bp, Homo sapiens
ctggggaaaactagaggttctcagaataagaaaaccaagagaacttgagcggttgaggttgtagaaggaagaaggctgggtaatgaggaagagacactgaragctgagactgggagagccacgcagaggcagactgtcagtttaggttctttcccagcaggagaaaataggagaccaggatatggggggctcacattttct

SEQ ID NO: 48813 - DNA, 201 bp, Homo sapiens
agtaagagacaacaagcagatggctaagcacactagactaactcttccatgttcaaaaattactggcttctggaatgttattaaaccctctgcctccccctgccccccgctttggaatgtagccctgactttttccttatggatgaagtaggcactcattttagcttggtcctatgatggaatccagcccttctatcccaa

SEQ ID NO: 48814 - DNA, 201 bp, Homo sapiens
gttcccctaggagaggtggggaagagagaggcctggattgctgctgtggagtcttcccccttagggaaatggaggcttcccaaagtatgaaaaaaaaaatsacatacaagccatgaagaggctcccacatcccacttctctgctttgggctaggatgaataccacttcttgaaaagattggcttctgcaattaccactgaa

SEQ ID NO: 48815 - DNA, 201 bp, Homo sapiens
tagaagatgctgctctacacctaaagtacctactttcaaggttcacagacctgagttttaaccttcccttaaacattttaaaattttaaagtttaattatytctctggcagcctgtatgcatctttccaatgcctaaaatgaacacagcacaaatactacccataaattctgctgagatctgttctgtctatctgcccaag

SEQ ID NO: 48816 - DNA, 201 bp, Homo sapiens
agttagccatgagtattagcacatgcctaagtgactggtatccatccatccatccatccatccatccatccatccatccatctatccatccatgcatacayccatccattcaactgcttatactgaccaacattataagataagttgtgtgctgtgctgtgtgaaataaaaagatggttattagatattgactttgtcctc

SEQ ID NO: 48817 - DNA, 201 bp, Homo sapiens
gtgtttattttgggcagcatctctttatccttgatggacttgggggttcttgcaccaagaagcagagtacctagtttgcctgattctctggatttcccctwacaggtggcattgtcttgaacccatctttctatggcatgcctgggcacacccacaccatgatccatgagattggtcacagcctgggcctctatcacgtct

SEQ ID NO: 48818 - DNA, 201 bp, Homo sapiens
tcctgaaaagcagattcccactgggctcccattcccagccaagctgacatcccacatccggtgccccatcccctcatacaacactgctaaagttccatttytatagcaccttttcttggccagctcaacacacatggaaaataaacaataacataagtttggaagtttgccggcctcttaggggctaggagctgccactag

SEQ ID NO: 48819 - DNA, 201 bp, Homo sapiens
acataagtttggaagtttgccggcctcttaggggctaggagctgccactagctaccagacccccataaactaaatctttttttttcccctttgtacagatmtaaagggtgattgatttactattttttttaaaggaacccctcagctcagtgacccattaacagcagaactaattcactgagctacgataacaaacttaca

SEQ ID NO: 48820 - DNA, 201 bp, Homo sapiens
tttggtggtctgactctgcagctgctgatgattgctgaggccaaagaacaaatatttatttattctctccctttctatgtcaatcttttgcagatgaaccyagccggtgctatttccatgatggtgatggggtatgtgaggagtttgaacaaaaaaccagcattaaggactgtggtgtctacacgccccagggattcctgg

SEQ ID NO: 48821 - DNA, 201 bp, Homo sapiens
caagtaaagtagatgtttatacaggaaaaaacctactgtttttcagtgtcattcatcttgagaaatgctttttgtgcccttgctcattgaattctcacaasttcatggtttggagtttatttaaatgcccccaatttatgcacgagggaactgagtcttcaagttgtctcattttttggtcatgtctgattagtattctgt

SEQ ID NO: 48822 - DNA, 201 bp, Homo sapiens
cagaaggtaagccagccttctggaagctcattgacaggaggagtgtgcaaagaacagctctttcaatgtatatggggttttattatttttatgggtctttsccatgtatcatttcatttgagtaacatcatcctgcaaggttagtagtcaagcgctcatccatttgacaaatactttttgagcacttgcactatcctaaca

SEQ ID NO: 48823 - DNA, 201 bp, Homo sapiens
ggagacagactataaatgaataagcatatatatcccataatgtcaggtgaatgtttgtaaagaaaaagttgagaaggaagtctaggaatgctgtgtgggaktggggatgcaggaggagagaggagtgggatatgaaaagagtggtcaagggaggccatcatcagagtagctttgaagaagagacctatgagcaggcctgag

SEQ ID NO: 48824 - DNA, 201 bp, Homo sapiens
cttctgcaggttagctcatgccagcagtcactgggtgaggacactattacaccagtgcatcagagggagcggaatcagtcttctcactgaacaccagtgaraactcctccgctatcctctatatttttagaaagaaggttgaaaagaaaaagccagagatagaataaagcaagggggaaggatcagagaggaaagtgaagt

SEQ ID NO: 48825 - DNA, 201 bp, Homo sapiens
tggtggtgttcatgcagggcatggatctagccatttggtccttgagatgtctcctgtttgatcctttccttgaagacgggccttcaagactcagtgtaccmaggatggcagctggcaggagggagcttgtgttcctgtgacctgtgacccacctccaccaaaattccatgggctctaccagtgtactaatggcttccagtt

SEQ ID NO: 48826 - DNA, 201 bp, Homo sapiens
tcatttgctttttccactctcattctctcctgagagtccagtggagctatctgatagacacatgacatgtgatgtcatttgtgctctgatagctaatggarcacactcttctgtattcttgaatttttaaatttcttagctttagtttataaagcggaaactactaatagatataacctgcataagcaaaagttcagtaag

SEQ ID NO: 48827 - DNA, 201 bp, Homo sapiens
agacacatgacatgtgatgtcatttgtgctctgatagctaatggaacacactcttctgtattcttgaatttttaaatttcttagctttagtttataaagcrgaaactactaatagatataacctgcataagcaaaagttcagtaaggctataagagtttaagtaggttcagaacatgtaaaacaaggtagaggtggcagag

SEQ ID NO: 48828 - DNA, 201 bp, Homo sapiens
aagcagagaatgtccagagcctagagacagccagcccatgcagagggtagggcataagccaggcagtggagagggtgaggagtggtgtatagaagagagcrtggagtttaaggggttattatggctgagatccagaccatgagcagagaaaagttcagtttatctcacggaaaactttaatgttaggcttaatcctctgtt

SEQ ID NO: 48829 - DNA, 201 bp, Homo sapiens
cagtcatagaactgcttgcctttgttcatagacagtggttgcactcctaccccttgagcaaaaactgtatttcatacatgaatatttttgagatatttgaygccatgttttatctgtagcctataaattagataaatatatatttcttgatctgactgactcaaatcccagttaagatcacttatgcaagtataaaataga

SEQ ID NO: 48830 - DNA, 201 bp, Homo sapiens
cactttctgtctttccctgatgcaataaaaatgataaatgcgaaggtgtttattggagttatgtgcctagttctgtgctagagcctgtggaagaaaccaargaactgaaatacccagcctctgacctagtcactgtacaagagttaggagtgagaattctatcaaaggcacattcttatcacaataagtctgcaggatctc

SEQ ID NO: 48831 - DNA, 201 bp, Homo sapiens
gatggatggatggatggatggatggatagtgtctgtgtctctaaacagtggtttttcttttcttttctttttctttttttttttttttttttttttgagakggagtttcactattgttgcccaggctggagtgcagtggcgtaatctcggctcactgcaacctcagcctcacgggttcaagtaactctcctgcctcagcct

SEQ ID NO: 48832 - DNA, 201 bp, Homo sapiens
cctttaccagatagagaatcaggacccagaggacaccagaggaggcatttggtgcttcactaaggttgtcctgatggtaagagcaggatgactttgtaagragactctggccatttcctgaaaaatggctgagcaggaagtaggaggagaggtgtagattggcatagatgctggtccaagactgctggccatgtcagctgc

SEQ ID NO: 48833 - DNA, 201 bp, Homo sapiens
actgtgtgatcttgggcaagttattaaagatgtatggaatctcagtttcctcatctggaagaataatatcttccacatgaagtttttatgaggaatatttygaataatgaaggtgaaagtgtttgtgaactttttattacagtatagacacacaacacaaggtctaccttctttatatattttaaatgtaaagtacaatat

SEQ ID NO: 48834 - DNA, 201 bp, Homo sapiens
ctattcacagggaagtcaggatgaacttcttgaaagagttaccttgcatgctagtcattgggaaatctagaataaagaaaatcagacttggacctaatatrtgacacagaaccttacttaacccgctcctttaccagatagagaatcaggacccagaggacaccagaggaggcatttggtgcttcactaaggttgtcctga

SEQ ID NO: 48835 - DNA, 201 bp, Homo sapiens
caatggcagtaataccacaaggattctaatttattctactgtcccctgcatccaatagggagaacagcaaagaatacagattccaaaatgaaacaaaactyggttccaatgctggcttttacacttcaagttgtatgaacctgatcgattcactctatatttgggagccttagttttatcacctcctaaataagtccttgc

SEQ ID NO: 48836 - DNA, 201 bp, Homo sapiens
gaatatcaactttaacagcacttgtttttgtcttatttcctgaggcagaacagtggttcaaacccatttgatccttagggcctttgcagctttaggtttcygtaactctttctggatgctcactgctcttatgtgaagtagtacttgtctttcatactcacttcccggccagggaggtggctcactcctgtaatctcagca

SEQ ID NO: 48837 - DNA, 201 bp, Homo sapiens
cctgcactcactgcctggttttgtcttgctcggatgccactacatttctttccgctattattttgtttattttcatgtcttctaaggagaagaagtctacygcttctccctcttccttcctcttctcttctttcccttcatcccactggggtacaacagcttacagtcaagagacatggttctgacattggcaacctttgt

SEQ ID NO: 48838 - DNA, 201 bp, Homo sapiens
agttgtgtgctgtgctgtgtgaaataaaaagatggttattagatattgactttgtcctcaaggacctcacaatctattaggataaactctcctgcatgtcaaaaaaagttttcacagaggaaatgatgtcaaaggtgaacttgaaggaggagaaacatcagccaagtgaaaaaagtctgcagaggggatgtgggtaacatg

SEQ ID NO: 48839 - DNA, 201 bp, Homo sapiens
gtgaaaactattttttgatagtgtgtttagaaaagtcctcactgagaaggtaatggttgagctaagacctaaacaaaaaattagaaaagccatttgataaytggggagatgaggtctggattgtatctgcaaaagtaaaatgtgaaaacaacacagcttatagtttttatgtttgagtagtttttagttttcacagcatta

SEQ ID NO: 48840 - DNA, 201 bp, Homo sapiens
tgaggcaggagaatctcttgaatccaggaggcggggttgcagtgaaccgagatcatgccattgcactccagcctcggccacaagagtgaaactccatctcaaaaaaaaaaaaaaaaaaaattactcacttctcaagccacctctctattacttcttccccaaacatcctcagaatttctgtcttaggaggaagaccatctt

SEQ ID NO: 48841 - DNA, 201 bp, Homo sapiens
atgcatattttatatcctgaatttttttcctgcttccagttttctaacactcacacatacatgagcacacgcaagcatacacacacacaccacacacacastatttccaattcccatgtactaacatttatcatggggcaggcattgctcttagtgccccacacccctgcaccttggctgtgttttgagatgagcaatcgc

SEQ ID NO: 48842 - DNA, 201 bp, Homo sapiens
ctcatatgcctgcctgccttgcggcttggtgcttatctctccctctgcctgcttgcagatgacgactgtacggactccttcacgcccaatcaagtcgccaraatgcactgttacctggacctggtctaccagggctggcagccctccaggaaaccagcgcctgttgccctcgccccccaagttctgggccacacaacggac

SEQ ID NO: 48843 - DNA, 201 bp, Homo sapiens
aaaagttgagaaggaagtctaggaatgctgtgtgggagtggggatgcaggaggagagaggagtgggatatgaaaagagtggtcaagggaggccatcatcakagtagctttgaagaagagacctatgagcaggcctgaggctctctggagaaggccatggtgtatcgcaaaaggaggagcaatgctttgagctaggagatgt

SEQ ID NO: 48844 - DNA, 201 bp, Homo sapiens
tggagcgggaacccaacaggcactgggagctaaggccagttttctttcaatccatgaactagcttaaaacagaattctgcatctcgagggtttttcatgarttgggtactcttctaggcatttccttgtgcattacctccttgaatttttgtatcctcctttcttggttgaattttctaattcccatttcacatgtgagga

SEQ ID NO: 48845 - DNA, 201 bp, Homo sapiens
gtctaggaatgctgtgtgggagtggggatgcaggaggagagaggagtgggatatgaaaagagtggtcaagggaggccatcatcagagtagctttgaagaaragacctatgagcaggcctgaggctctctggagaaggccatggtgtatcgcaaaaggaggagcaatgctttgagctaggagatgtcagttctagcactagt

SEQ ID NO: 48846 - DNA, 201 bp, Homo sapiens
cttcctatatacttcaaatcatctctagattacttctaatacctaatacaatgtaaatgctacataaatagttgttatactgtaatgtttagggaataagracaagaaaaaatgtctatacatgtttagtacagatagaattttattttgcatctcttgaattcacagatggagaacccatgaatatggagggccaactgc

SEQ ID NO: 48847 - DNA, 201 bp, Homo sapiens
gagtatggagtgacagacaatatggacactcagaagggtgggggaatggaagggggtggatgatgggcaattacttaaggggcacaatgtacattattcakaccgtagataccccccaaaccctgaattcactctgccatctatgcatgtaataaaattatatttgtaccccataaatttatacaaataaaaaaagaaggg

SEQ ID NO: 48848 - DNA, 201 bp, Homo sapiens
agtagctattctgttcagtttaagatttcataacatagttatcatacgttaaattaaaactgacatttccaaaacatatctaattagggttagcagctacrttgaccatagtctatggctaaaagaagtcagtccacaaattcaataaattgttgtaaagaaatggaactgtctttaacgtatatcactctcccatacaga

SEQ ID NO: 48849 - DNA, 201 bp, Homo sapiens
ctatttcaggagccccagggaaagacaacaagaagtcccaagtccatcttccatgtggctgggattaagaccccgctagcacaaatatatctattctcttrtttaaaaatctcatcacagccctgagagacatgtgggcaggctctcttgaagttaacatctatggttaagaatgtgggctaaacttgtgcctggatttca

SEQ ID NO: 48850 - DNA, 201 bp, Homo sapiens
gggtctgaagtctttgcgacctcatccattccctctgcctttggcctcagttttctgatgtgtaagccaaagatgttctaggctttctcaaccaaggttcytcttctaaattttaagacatggaaaatgatttgtgtaactatttcctcatttctcccaaagatggtatataataagtactattttagtttcataggagac

SEQ ID NO: 48851 - DNA, 201 bp, Homo sapiens
caatgtgttccactctagcttcaggggtctccagtctctttgcagtacttggtataaattcagagacccaagaaaacaggatcaggtttcaaaggagaggkccagttgtgcaattctagccaaatctcagccccacaccaagttgtggaaaggagaaaaggtggggagggaaggatagtgatggggtgtggggtggttaat

SEQ ID NO: 48852 - DNA, 201 bp, Homo sapiens
catttctcgacgtcttcccgagattttgtttccagtccctctgcagaggtcactcagatttgcagttttcagttcacaataagacaggagaagaggactcrttcctctcccttctccacaactgcctcataaacagatgccaaatctggaaaatgagtaggatcccagagactctatagccaaaggaagattgaatccaga

SEQ ID NO: 48853 - DNA, 201 bp, Homo sapiens
cagatacacaagacccaacttggtaggggaagccatcataatattccacttctgggactggtcccattgagggattggctagccccttggaaagccgctamaatgaattagatggcatggtagagaaactgcttttgactgtaaaatcgaggagtgactcatccatccacagaatgtcaaggctggatggttctttaggca

SEQ ID NO: 48854 - DNA, 201 bp, Homo sapiens
gtacacatagaccctgcccccacccagtccctcttgctcttctgcaggttagctcatgccagcagtcactgggtgaggacactattacaccagtgcatcaragggagcggaatcagtcttctcactgaacaccagtgagaactcctccgctatcctctatatttttagaaagaaggttgaaaagaaaaagccagagataga

SEQ ID NO: 48855 - DNA, 201 bp, Homo sapiens
agcagtcactgggtgaggacactattacaccagtgcatcagagggagcggaatcagtcttctcactgaacaccagtgagaactcctccgctatcctctatwtttttagaaagaaggttgaaaagaaaaagccagagatagaataaagcaagggggaaggatcagagaggaaagtgaagttgaaaaacgacggcactgcact

SEQ ID NO: 48856 - DNA, 201 bp, Homo sapiens
ggaggagagaggagtgggatatgaaaagagtggtcaagggaggccatcatcagagtagctttgaagaagagacctatgagcaggcctgaggctctctggakaaggccatggtgtatcgcaaaaggaggagcaatgctttgagctaggagatgtcagttctagcactagtttgctgtgtgactttaggcaagtcactctccc

SEQ ID NO: 48857 - DNA, 201 bp, Homo sapiens
gctttgaagaagagacctatgagcaggcctgaggctctctggagaaggccatggtgtatcgcaaaaggaggagcaatgctttgagctaggagatgtcagtwctagcactagtttgctgtgtgactttaggcaagtcactctccctctcagaaccagttttcacatctgaactttgtggtactgtagggattatttgcacta

SEQ ID NO: 48858 - DNA, 201 bp, Homo sapiens
ctctggagaaggccatggtgtatcgcaaaaggaggagcaatgctttgagctaggagatgtcagttctagcactagtttgctgtgtgactttaggcaagtcwctctccctctcagaaccagttttcacatctgaactttgtggtactgtagggattatttgcactaaagacacttctacagacacttcctaggattctataa

SEQ ID NO: 48859 - DNA, 201 bp, Homo sapiens
ccttatttcttaactcttttgcagaatctgccttttctcacttcttcccccttctctcaactgcaaacagaggtggcctgagcctgggtcccaagccccgrcaaggttctgaactgagagcaccctacagatgtgtaaacattttaccttgctaaccaggctagctgccttccaaaggcaacaggaaaaccagagactggg

SEQ ID NO: 48860 - DNA, 201 bp, Homo sapiens
tcatcggccttcctcttcgaatcttttgtgtttcaaggagtttattggagatctgggctgggatgggctgggcttcctgacctgaatgttctctgagactraaaaaagagaaacacatccttccaaatcaacctaccatttcaactcctttatctcttggtaatttgagtcctgaaccccaccacaaatacctctttgtgt

SEQ ID NO: 48861 - DNA, 201 bp, Homo sapiens
ttggaggtgatttttttttttttttaatctgtaggtctggtttttcctagtctttacctagtaccagtgatttggaaggcattccctggagagaggagagyacagggttatgcaggcatcatcagtgaaagggtagtgaatgcattttaactatgtacgtgtgtctacataaatacgtgtgtgtgtgtgtgtatatatata

SEQ ID NO: 48862 - DNA, 201 bp, Homo sapiens
tcaggacttctactttgtcatcagaaacacaaagcaaggcaaatgtgaaagtatcttataaatccataccttttagaaatctcattttgaagatgaagaarcagagactcagacagagaaagggatttgtgcaaggtctcactgaaggttcatggcccagggagggacttttccatgtccagccatggttttaagactaaa

SEQ ID NO: 48863 - DNA, 201 bp, Homo sapiens
tttggcggcgtgtaaacacctggctctgagccagaaaagactcattctgcatatcctccacatggtacaggctgttggactaaaaagaacctgcttctccytgaattaaaaagcaaacaaacagaggttctttgcagaagtactttttcagctccctccttcgtgtaagtttgggctgggagagccaggaccgaggtgggc

SEQ ID NO: 48864 - DNA, 201 bp, Homo sapiens
tctgcagtggaagatattagagtttatgaagggttcaaggccatgttgtcagtgaatggcagaagctgaaattccaactcacattcctttgatttaaaatrcatgtgtcttctggtgcttagtggaagattcagggaagtggcaggtgcaggggttgttgagaagttcacattgtggatcccagattctcaggcactgcat

SEQ ID NO: 48865 - DNA, 201 bp, Homo sapiens
gagaagaaattattcacatgctcttccttaacctttctgtggaacatttccattcctttctgcatctctatgtgtcaaccatatacctacagatcgaagasggtgagaaatggatataaatctcaactgaagccctgcatgagacctggcagatctgtttttcttttcacatcaaattatcagacagacaggcttggaatt

SEQ ID NO: 48866 - DNA, 201 bp, Homo sapiens
ccaaacgagctcaacagcaacctcaaactgcagtgccctgatggctatgccataggtatgatgggcccgagaggggagcagtaggaggggcaattccttcmagcaatgcagggctaatgcctgggtgggtcattgaacaccctggccacatgagttcctgcgtaggcactacagaaagagagatgaattagtgtagaccat

SEQ ID NO: 48867 - DNA, 201 bp, Homo sapiens
accacagtgcacgggtcagcatggttaggaggagctagaaagtgagagatgtgagggattagtgcaatcaaggtcattcctggaaaggtgcttttattatsatcattcacactgtagatgataaacagtgatggagttagcaaaccttttcatgcctgtgacctcactggagttctttgatgttgggacttcataagtctg

SEQ ID NO: 48868 - DNA, 201 bp, Homo sapiens
aacctcaaactgcagtgccctgatggctatgccataggtatgatgggcccgagaggggagcagtaggaggggcaattccttccagcaatgcagggctaatrcctgggtgggtcattgaacaccctggccacatgagttcctgcgtaggcactacagaaagagagatgaattagtgtagaccatgtcctcccagaaagaggg

SEQ ID NO: 48869 - DNA, 201 bp, Homo sapiens
tggtttatcctctcttttgccctttgaactgtttgaaaccaatggcagtatcttcttcatctttgagtcctccattttgactgagcttcatacattttttwaaaaaattgaacaataaaagtgatgtccagagaaaaatagctgattgggccacaatcacaacaaaaactaataaaacagtagccatttttttctgatact

SEQ ID NO: 48870 - DNA, 201 bp, Homo sapiens
gccacttactgctttatgaccttgaccatttaccgcttctctctggacctcagtgttctcaggatgcaaaaggagggtcaggggtaaaatagcgactttcraactgtcaggggtaaaatagcgactttcaaacttttcaaacttctgggacaagggtgaagggcaggactctgcctctctccttcccttcaccttattcca

SEQ ID NO: 48871 - DNA, 201 bp, Homo sapiens
gaaagggccgggcatggtggctcacacctgtaatcccagcactttgggaggccagggtgggcggatcacaaggtcaggagatcgagaccatcccggctaayacggtgaaaccccatctctactaaaaatacaaaaaattagccgggcgtggtggtgggcgcctgtaatcccagctactcaggaagctgaggcaggagaatg

SEQ ID NO: 48872 - DNA, 201 bp, Homo sapiens
ctaacaagataaacacattattgtgtcatttaaaaaaaaatagtgcatgctcattgtaaaaaaaatctcagaaatgcagacaaagaacaagagaccaggthaaatttgtctatttcctgcccaagcatgcaacaactattttttgagtttctgctctgtgctgggtacagttttaggccttgaggacagaccagtcaacaa

SEQ ID NO: 48873 - DNA, 201 bp, Homo sapiens
ttcagaatgcccagttttgccattggtctcctacctagcgcagctggacaaaaaataaaaacaaaaggctgggcacggtggctcaagcctgtaatcccagygctttgggaggccaaggcgggtggatcatgaggtcaggagatcgagaccatcctggctagagacggtgaaaccccgtctctattaaaaatacaaaaaaat

SEQ ID NO: 48874 - DNA, 201 bp, Homo sapiens
ttccacacctcagcaacactggggaaaaaagaagatggtacaccttcttgctaagtaccattgactggtaacaacttggaatgttactgctccattggtgratactcttttaggacttcccagaaagctttgtgtcacaaagcaatgtaacagtggtagaatttctaagactgactgaagacattatttggggaatattgg

SEQ ID NO: 48875 - DNA, 201 bp, Homo sapiens
aaattaagctaagctaagtgagtaaggttaagcagcaaattggcagtaaaattgaaactaaaatttagatctgttgacttccacatcagtgctctttccaytgggtcactttattttcctttacagtgtggggtgatagttataactatgggtttatattagtaagattactagaaagcatcatacagctgtttaataact

SEQ ID NO: 48876 - DNA, 201 bp, Homo sapiens
ctgttgacttccacatcagtgctctttccactgggtcactttattttcctttacagtgtggggtgatagttataactatgggtttatattagtaagattaytagaaagcatcatacagctgtttaataacttttttaaagaacttcttatgtgccaatctgctgtcctagacattctttaagattcaatgagaaatgaaag

SEQ ID NO: 48877 - DNA, 201 bp, Homo sapiens
gattcaatgagaaatgaaagtttattaggaaaggtaaatgttccttcatttcttccttctttctaaccattcacccttctatttcatatgtagttattcascaatttttatatattatacattgagttaggagataagaattaaaaagaagaacaaggcatagttccatgccttgaggaactcccagtcctagtggtggaa

SEQ ID NO: 48878 - DNA, 201 bp, Homo sapiens
tgaaaaagtgctctgaaatttcaaaggcataagtgatcttttccacctggaaggattggggacttgttcatgaagtgaatgtgtatgtatgtagagtgtgygctctgccttgtgtgggggtatagtcatgtatgtaattttaaacatatagccataaatcaaatgagaacaatcaacacttctggattcatgcctcagctg

SEQ ID NO: 48879 - DNA, 201 bp, Homo sapiens
atttgaatgccttatgtacttgaaacatttagcacaatgcccagcatggagaaagtcatccagttattcatttcacaaatacgctaagtacaattttaacyggggaagcggatgatggtataggaagacctagtgagggtccattagcccttctgggggtgggtttccaggcaggtttttgagaggttaaactgtgaataa

SEQ ID NO: 48880 - DNA, 201 bp, Homo sapiens
ctgggagtctagatgtgatctcagcagagaaaaattcagaagtcgctgcaggctgagatcagtggggatgaggcatcatctccctagggaaagaggagaaraaaccctccttccttctccccgctcctcacccaaccctccccttcctgagtgagacagaacagagtgcggagaagctcagtggtatggaatgactgcatg

SEQ ID NO: 48881 - DNA, 201 bp, Homo sapiens
ccttatcttccctcctcatagcatttatcacactctattgtgatttccttggtatctgtctgtttctccccaattgtctctgagctccttggagcagagascattttggtcttcatctttgcattattccttttacttcgcacaatactagtcatgtcggtgagggctggctaaacaatgttaaatgaacgaacagattag

SEQ ID NO: 48882 - DNA, 201 bp, Homo sapiens
gctgcaggattcccagtagcaagtttattttaagattggaagagccctgtactcctctgtctggggcccagctgcaggctccctgaccaggtggacacctytgggaagtggtgtttttggaaattaagccaaaacagtgcattgccctgtccctagggcagttgaataaaactgttggagggagaaatgcaagcgttctcc

SEQ ID NO: 48883 - DNA, 201 bp, Homo sapiens
aggaaatatgcatacatttatctcttttctctctcagaagacatctgtgaagtatacaggataagattcttcatcctagtgtacatgtgggaaaactaagkttcagagaggtgaattaacttgtctgatgtcacacagctagtaaaaaaggtgaacagacccatttagtgagggtgctttcagataacagttcctggcaag

SEQ ID NO: 48884 - DNA, 201 bp, Homo sapiens
tctttcctatgcagagatgcaggagcaattgaggcatacatatgcatgtttgtatgcatgtgtgtgtgtgcatgtacatgcatgcatgagtacctgcatatgtgtgtgtgtgtgtgtgtgtgtgtgtgtgtgtgtttggagcaggcaaacaaagacctgtgagaccacctgttttcatcatctgctgattctcaaagtgta

SEQ ID NO: 48885 - DNA, 201 bp, Homo sapiens
ctttcctatgcagagatgcaggagcaattgaggcatacatatgcatgtttgtatgcatgtgtgtgtgtgcatgtacatgcatgcatgagtacctgcatatgtgtgtgtgtgtgtgtgtgtgtgtgtgtgtgtgtttggagcaggcaaacaaagacctgtgagaccacctgttttcatcatctgctgattctcaaagtgtag

SEQ ID NO: 48886 - DNA, 201 bp, Homo sapiens
gaaagtcacagaattattctatatggtttctaagccatggctgtgactacagtgttgcaattacaggaggcagctttgagctgagtaatagatgatatcayctccagtcagaatggtcctttttggggagggctttgtctgtgggtgagtgagctccccttcaccagaagcatgcaagtcagtactgataaccatgcataa

SEQ ID NO: 48887 - DNA, 201 bp, Homo sapiens
tttcctatgcagagatgcaggagcaattgaggcatacatatgcatgtttgtatgcatgtgtgtgtgtgcatgtacatgcatgcatgagtacctgcatatgkgtgtgtgtgtgtgtgtgtgtgtgtgtgtgtgtttggagcaggcaaacaaagacctgtgagaccacctgttttcatcatctgctgattctcaaagtgtagt

SEQ ID NO: 48888 - DNA, 201 bp, Homo sapiens
tgcctggggtcatctggcccgggctccccccaagtgcaggaatcccctctatgtgcatcctcactgaggttccctggagcctgttcaagctccagtttttyagaaagttctcaaaatctgcaattgtaatttttccacccaaactgaacccactttgggttgtcacagagaatgtgtgtctctgccacctgacaacatttt

SEQ ID NO: 48889 - DNA, 201 bp, Homo sapiens
gaagccagtgatgctgctacatgtccacaatgtccactacaaagaattatacagactaaaaagtcaatagtgctgaggttgagaaatcctgagacatatgrtgtatgggtagatagattggcagatagacagacacagacaggtggggttgggcagaagagagcgtgcagcttaggcaaacttgaagatgatcagcttata

SEQ ID NO: 48890 - DNA, 201 bp, Homo sapiens
aggcattcaacatgtgattgcaaaatgtgtgctcacttttgtaataaagtatgggacactaaggatacctgtggaaggaaaccaacataacccagctatcaaaaaaaaaagcctccctaagcctttctcgttctttaaaccactatttggtcttcctctgctagcactctccaaactctactttgtgttacaatcacactc

SEQ ID NO: 48891 - DNA, 201 bp, Homo sapiens
ctggggtcatctggcccgggctccccccaagtgcaggaatcccctctatgtgcatcctcactgaggttccctggagcctgttcaagctccagttttttagraagttctcaaaatctgcaattgtaatttttccacccaaactgaacccactttgggttgtcacagagaatgtgtgtctctgccacctgacaacattttgca

SEQ ID NO: 48892 - DNA, 201 bp, Homo sapiens
acaaacacaaacacattttatgtcccaaaacatatcaaacacacagaaagacgcacaaaaggcaaacaaacctcacagacgcatttacatattttattcasatgtctcaactgtacgcaaatgagtacgatacctggctgtcttctctccatcagaacagtggagaaagaggggaaggggtgggagggtggtatttcttta

SEQ ID NO: 48893 - DNA, 201 bp, Homo sapiens
ttccctggagcctgttcaagctccagttttttagaaagttctcaaaatctgcaattgtaatttttccacccaaactgaacccactttgggttgtcacagaraatgtgtgtctctgccacctgacaacattttgcatgcttgtatctagtgagcctgtctcactagtgaccaacacaggcactatatgctgggcactgtctt

SEQ ID NO: 48894 - DNA, 201 bp, Homo sapiens
ctccactggtctctggaggcctcattatccaggaggaaaaaaatgtggtagaaaaagggaggagggcgaagggcagagattgatgatttccaggaataagrcagaaaagctggcctctgctgcacccttgccccttgtgcggtgagagctacagaaatagagctgctggtgccagcatttccaggccagaggaggccctgg

SEQ ID NO: 48895 - DNA, 201 bp, Homo sapiens
cacaaaaaagtttgagctgataaaaatgtatagaaccctgatacagaactaaattatgaatatttccttcttgaatagagatgtagactattttttaaagttttttttttaccatgtactaggccacaaaacaaatttaaacaaatatcaaagtatcagtatcagatagaacataagctctgtccacaatgcagcacatta

SEQ ID NO: 48896 - DNA, 201 bp, Homo sapiens
gtgaagtttgctcctagtttgttcctgaccttcttaaagcatgatatgcagaatggagttcaactggaggcactgaggtctctggttccctgagccaattyggagctccaaggaaacccagcagccttgggttttcctcctatgtaaatttagtacatgtgcaccaggaaaagacactgttctttttttagagcatcctat

SEQ ID NO: 48897 - DNA, 201 bp, Homo sapiens
ttgtgctgctaaaagtcagagaaatgtatgcatcatcagaacagaagccacttaggctcaaacgaggttcttgctgggcaatggggaggcatttcacttayggttatttccagaagccttggcatatgtaggcaggaaagggggaaacacagatttgttgtgtcctctgccccattgactctggcctagtcccatcagttg

SEQ ID NO: 48898 - DNA, 201 bp, Homo sapiens
tgccagacatatctgtatggttggggaaaaaacatggggaatgcaggggagggaaaggaggaggattggaccatggtctcagccctactattgatgtactytgtgcccttgagtgagtcacatagcttctctgaaaatggcattgtatccacagaatgaaaagttgaaatataatatcctttctagctctaatattgcatg

SEQ ID NO: 48899 - DNA, 201 bp, Homo sapiens
gctcaagacataaggatacaacacaacactcctccttaaattagacccatggattgcagaactaatcatcacatccttcccagattcttctttcatagttaaaaaaaaaatgggtggacagaaagaggaaatggcttgtccatggtcaatgagtcaacggtagtatttcatagggaaatactatgaaattaatacagaaaa

SEQ ID NO: 48900 - DNA, 201 bp, Homo sapiens
tattgatgtactctgtgcccttgagtgagtcacatagcttctctgaaaatggcattgtatccacagaatgaaaagttgaaatataatatcctttctagctytaatattgcatggagctgtaacttcttttcatataatcccatattaactagcagaagattcttcatttaacaaatctttattggaaatctactgcatttc

SEQ ID NO: 48901 - DNA, 201 bp, Homo sapiens
tattcttttctccccttccacctttcctcctcccccttccttatcttcttccttcccttctcgctttgtttcttttcttcagctcctgtccttaccttccractacatgtccaatcaatctcccagctgtgttcacttttcctccttaggaattctgacttgccatctccttgcatgctttcttgcagttcatatattgtc

SEQ ID NO: 48902 - DNA, 201 bp, Homo sapiens
acagagatcatgttggcaagcttattctcttggagcctagcctacctctggacacacctggcactgaatagttactctttgaatgcatggaatgaatgggyggatggatggatggatggatggatggatggatggatggatggatagtgtctgtgtctctaaacagtggtttttcttttcttttctttttctttttttttt

SEQ ID NO: 48903 - DNA, 201 bp, Homo sapiens
catgagagaatgaatatatgaatgactgaatgaatgaatggtggtgccccccagtggctaatgcaaacatttgaagaatgtagaatggaaaggtaaagaargaagagagggagggatagaggaagaaatagaggaaaaatctgaatgaacattataagatttcaaaaagattggctaagaaatctcagatatgcaaagtat

SEQ ID NO: 48904 - DNA, 201 bp, Homo sapiens
ttggtctcctacctagcgcagctggacaaaaaataaaaacaaaaggctgggcacggtggctcaagcctgtaatcccagtgctttgggaggccaaggcgggyggatcatgaggtcaggagatcgagaccatcctggctagagacggtgaaaccccgtctctattaaaaatacaaaaaaattagtggggcatggtggcgggcg

SEQ ID NO: 48905 - DNA, 201 bp, Homo sapiens
ggtctcctacctagcgcagctggacaaaaaataaaaacaaaaggctgggcacggtggctcaagcctgtaatcccagtgctttgggaggccaaggcgggtgkatcatgaggtcaggagatcgagaccatcctggctagagacggtgaaaccccgtctctattaaaaatacaaaaaaattagtggggcatggtggcgggcgcc

SEQ ID NO: 48906 - DNA, 201 bp, Homo sapiens
tggccaacatggtaaaaccccatctctactaaaaatataaaattcgccaggcatggtggcacatgcctgtaatcccagctacttgggaggctgaggcaggrgaattgcttgaacatgggagacagaggttgcagtaagccaagattgctccactgcactccagcctggacaacaataatgaaactccgtctaaaaaataat

SEQ ID NO: 48907 - DNA, 201 bp, Homo sapiens
atctctactaaaaatataaaattcgccaggcatggtggcacatgcctgtaatcccagctacttgggaggctgaggcaggggaattgcttgaacatgggagrcagaggttgcagtaagccaagattgctccactgcactccagcctggacaacaataatgaaactccgtctaaaaaataataatagtaaataataataataa

SEQ ID NO: 48908 - DNA, 201 bp, Homo sapiens
gagagttacctgagttatctatgcaaagagtttcgcacaatacctggcacacagtaatcactcggtaagcatcagctgtcattgccctccctgcctagaarggtaattctggagggcaccagccctgcaaagtggagatctgcctgtctggccttgtccctttcttatctccctttgccatctctctcctgaaaggctcac

SEQ ID NO: 48909 - DNA, 201 bp, Homo sapiens
aattcgccaggcatggtggcacatgcctgtaatcccagctacttgggaggctgaggcaggggaattgcttgaacatgggagacagaggttgcagtaagccragattgctccactgcactccagcctggacaacaataatgaaactccgtctaaaaaataataatagtaaataataataataataataaaaacctatattgt

SEQ ID NO: 48910 - DNA, 201 bp, Homo sapiens
atgcctgtaatcccagctacttgggaggctgaggcaggggaattgcttgaacatgggagacagaggttgcagtaagccaagattgctccactgcactccascctggacaacaataatgaaactccgtctaaaaaataataatagtaaataataataataataataaaaacctatattgtaggtgcttgaaaccatataggt

SEQ ID NO: 48911 - DNA, 201 bp, Homo sapiens
gagaggaaagacccccccccccaatatttttattagtgacattaaattgacatgtccatgtggctttgcagggacatgtaaaatatgtttctgagcttatwagaaacagttctctccttcttcttcaattctgtctcatttctctgatacttcccatgtgcatttggttttactttcctcacatacatccttcatgatgcc

SEQ ID NO: 48912 - DNA, 201 bp, Homo sapiens
aaaccatataggtaacaaacaaaaccttaaaattattgaaaggaaataaaagagactattttatgatcttagattaaaggaatgtttattcaacaacataygaaaaacacaaatcatgaaggatacaaaattctcttatcaacaaagcagcataaacataatgaaaaattaggagtcatagaccatgaaatggtatttaca

SEQ ID NO: 48913 - DNA, 201 bp, Homo sapiens
ctcaagcttgcctcacatctggatagccttaaatagtttacaaggaaatatgcatacatttatctcttttctctctcagaagacatctgtgaagtatacargataagattcttcatcctagtgtacatgtgggaaaactaaggttcagagaggtgaattaacttgtctgatgtcacacagctagtaaaaaaggtgaacaga

SEQ ID NO: 48914 - DNA, 201 bp, Homo sapiens
cattcttggctggagggttatatacaaagtgcccagacattaccctctggttcttagctcaaggctacactggaatacttggactcttcctgagccaaagkcatcctaggtggtcccatcttacatcttctaactcagacaatctgggtggtaggtccagacctacacacgttctcagtgcagaattttaaatgctgaagc

SEQ ID NO: 48915 - DNA, 201 bp, Homo sapiens
gaaactgccttttaccctgccccacaatgaccttacatctcccgcagggggaaccaaggctgggatacctgtaatcgctgggatcttggagtcacagaatrtggatggaagggacctctgtgaccatgtggtctaacactcttatatcctaaggaaaggaagtgaggaagcccagagtagggagctattcacccagggacc

SEQ ID NO: 48916 - DNA, 201 bp, Homo sapiens
cctgccccacaatgaccttacatctcccgcagggggaaccaaggctgggatacctgtaatcgctgggatcttggagtcacagaatgtggatggaagggacmtctgtgaccatgtggtctaacactcttatatcctaaggaaaggaagtgaggaagcccagagtagggagctattcacccagggaccacagcacagcatggc

SEQ ID NO: 48917 - DNA, 201 bp, Homo sapiens
aattaaaagacagaaaaacagacccccgcaaaatcacatgacttgtctacagatttcagataggttttaattgacctatcatattaactacataccaatamactttaatttatgcattttaaatgcatatttaagcttaagtcataaggtgcttaccctccttatgtatatattaatattttagataatgatttcacaacc

SEQ ID NO: 48918 - DNA, 201 bp, Homo sapiens
agacattagagccttcatggtggattgagagcaccaatccaccatggaaagcatcttggtggggagctttggctctggagtgaaagagatgagagttagawttgtgattctcccaatccctcgctgggatccttggagggaaaatcaattaacctctctacatctcagtttccttatctgtcaaaagaatactaataaatc

SEQ ID NO: 48919 - DNA, 201 bp, Homo sapiens
gtagtgaatgcattttaactatgtacgtgtgtctacataaatacgtgtgtgtgtgtgtgtatatatatatatacatgtatatatatgtgtgtatatatatrtatgtgtatatatatatatatgtatatatatatatataacacctgggattccacaggagactgctttataaatgtctataattcagacaaggagcctctc

SEQ ID NO: 48920 - DNA, 201 bp, Homo sapiens
atagaggctttcagaaagtgtttgttattattatcattatttatttaaaaataccactttttcacagcagaaatgtcctggtggagttttttctccttctrtatctactctcccaatgagagaaaacaaacaataatacgaattgcatataaattgtcatcctttgctaattatctccaccccgccgcccccagacagtga

SEQ ID NO: 48921 - DNA, 201 bp, Homo sapiens
cttctcttgcatcctggttattatgacgttctttgagctgggccgatagatccagctgaagagttctacatacattagtcttcaaggttcttctctgggcrtttcccatgcagctctctggtagctggggaatgatttgtgagtgcttcctctgctccacagcctcagaggctccagcacaggcttccctcgcgtgctgga

SEQ ID NO: 48922 - DNA, 201 bp, Homo sapiens
aatcagtgttgaaaccaagatgtggtcttccatatcttattctgtttagaaggttagaaacagatgcagaaatgctatgaagtgattatcttaatggcaawtgtaagaatccttcttgtaaccccatatcatatcgtgtatgactcatagagcctgcctgtgataacaggtgatgatccacatcccacctctattccccaa

SEQ ID NO: 48923 - DNA, 201 bp, Homo sapiens
gcgctccagcatgacagtgtgcacaagtgatgctgaaacacacactgggatttggaaaacctcttagacaaggtgcatgcaacagcagaaacaagaatagscaaggatctgctctggtctctggaaaatgtggggacttctggaagctgggaatttatttcctgcacggcatggcctcttttgttcatggatggaaagagg

SEQ ID NO: 48924 - DNA, 201 bp, Homo sapiens
aggacctgtagctcctccttcttcctttccagctggttggacagctctatctcagccagccgctgctggttcaggaggatgagatccctggtggtgtcgtmgggggcgatgtcagaaagatgcatattgagttcttccagctcttgcaggctgcggagcttcggagagcacaggtacaccatgcaccacatggactccatc

SEQ ID NO: 48925 - DNA, 201 bp, Homo sapiens
aaaaaagtgtagtgacatgtttagtgcatgaaggaatccctctgaatacctatttttttttccctgacaggtagaaacaataggagatgcttatatggtgrtaggaggtgtaccagtgcctattggaaaccatgctcaaagagtggctaattttgccttggggatgagaatttctgcaaaggaagtgacgaatcctgttac

SEQ ID NO: 48926 - DNA, 201 bp, Homo sapiens
aatggttgtcaactacacacacattaaattctctaagaatttaaggatatgtcctgagactggcctcattactcagtgacaatgagtagggttcttaactwtaactagaaataatacactcgcacactagttaaatcatagggttcctctgaggaccattctgggacagtatactatttatggaggcagggatgctgtgtt

SEQ ID NO: 48927 - DNA, 201 bp, Homo sapiens
gcttctaaggaaggctgggtccctgttctcagctccgagccctttctgcagcctctctcagtccttcctaagtgtggctgtcaaactttgctgacctttcycccttggggctaatgagtgtcacagctatttttaaccttgggttttctagaagttgagccgttaacctagctcctacagaaggaggatcctgggaggtat

SEQ ID NO: 48928 - DNA, 201 bp, Homo sapiens
tgggggcaacaaatcaaccacaggaaaggcttcctaccaggaatgaggcagctgcgttcccagaaatgcacaaacaaaccaccaaaaaccagatcagggtyctatcttcctctcagacactcttaccttgcattctccctctagtttctttccttaaatgatagaggtttactccagcgacctcccaatggtatcccgccc

SEQ ID NO: 48929 - DNA, 201 bp, Homo sapiens
actgcttttacaataacataacaaacatatctatttttaaagaaatacacatattgagttcaggaagcaaggtttctctggaaattcagatgcagtcagcrtggtgtaggatgcagttgtgtgatgctaaatgagaataccaagacaaaaccctcaggaacactaacatttaaggaatgagattaaaataatgtaagtaaa

SEQ ID NO: 48930 - DNA, 201 bp, Homo sapiens
aacaagttaagccaggcacaacagagaacagactgtattcacgtgaagttcaagagcaagcaaaactagtctgtggcgataatatgatagtaatcggaatrggggcagctgggggtggtaggactgattgagaaggggtaccggggaaatttccatgaccacagagatgttctatatctttattagggtgtgagctacaca

SEQ ID NO: 48931 - DNA, 201 bp, Homo sapiens
gaacccaagaggtggaggttgcagtgagccgagatcatgccactgcactctagcctgggtgacagagtgagactctatctcaaaaaaaaaaaaaaaaaaawatatatatatatatatgtatatacatataatgtcaaatgtatggagtgggtggaaggcaatcaagctaaaaggatagccagtctaggggctattttatac

SEQ ID NO: 48932 - DNA, 201 bp, Homo sapiens
ccaggcacaacagagaacagactgtattcacgtgaagttcaagagcaagcaaaactagtctgtggcgataatatgatagtaatcggaatgggggcagctgrgggtggtaggactgattgagaaggggtaccggggaaatttccatgaccacagagatgttctatatctttattagggtgtgagctacacaatagtgtacat

SEQ ID NO: 48933 - DNA, 201 bp, Homo sapiens
acaagtggttcaggtttaatgagcagccaacttttcctgcttaggaaattgtgtctccaacatgccatctgacaggttcagaactcaggctgaggtgtgargctgcctgcagtcagcaggccaggcaccgtgatgccgtaagatattcagaatggctttccttccaccaagtggccactagcgagacatctgctcgccttt

SEQ ID NO: 48934 - DNA, 201 bp, Homo sapiens
gtggcgataatatgatagtaatcggaatgggggcagctgggggtggtaggactgattgagaaggggtaccggggaaatttccatgaccacagagatgttcyatatctttattagggtgtgagctacacaatagtgtacatttgtcaaagatcatgaaactgcgcacttaatatagaaaaaggtaacagcgaaaaatatccc

SEQ ID NO: 48935 - DNA, 201 bp, Homo sapiens
ggcacagggcagttcaaagaactcatatagccacaaggcagtggtctgtccgggctgtttggccttggctgtgaagaattcttcctgtccaggatcacacygagtagaaaaggaggcccgtagtgtccacacgtgttccccagggtctggcccagacagacagtctgaggctcgatcacttgctcacccctctgtgttctt

SEQ ID NO: 48936 - DNA, 201 bp, Homo sapiens
aagtggccactagcgagacatctgctcgcctttctcacagaaaagtacgcttccaagtctggaagtttgttcacactctaaaagttgaacagttttggagrtgaaaaatgaatgtcctcctccgctggctcagcagatcctaatgctcctgggatggctgagagtggcgtctctctgcctttgatttctaggtccttcctc

SEQ ID NO: 48937 - DNA, 201 bp, Homo sapiens
caaaacaacagtcacagtatcggcagggaggtccattatgtcatggaggagagaaggggaatttccatatagtgaaatttcctccctggctgtctatgcarttgaaaaacatataaaacgtcagccaattttccagacagtttcaaaatctagggactttttttttttttttggtacaagcactgtctatgtcttttcaaa

SEQ ID NO: 48938 - DNA, 201 bp, Homo sapiens
ccagggtgggactgaagagcaaagagacttctgaaaatctcactgttgggctgtaatgcaggaggagatctcctacaactccaaaagctgtggattggctrtacagcattcaaggtcctcagagtcttgctggtgctcagattctaagctctgctgtactgaaagttctgattcagccttcataatatttgaaaccagtgg

SEQ ID NO: 48939 - DNA, 201 bp, Homo sapiens
gcacctcatccactgctatctcccactccctcccacccaccatcatgccagccccacagtacagagggtttctagagagaaggcaaacaaacatcccccccttttctcttcttcgttgtcaagaaatgaacaaagtaaagtggggagggggcatcatatcacgtgatcattggagaggggaaggcagggctggaggctttg

SEQ ID NO: 48940 - DNA, 201 bp, Homo sapiens
aaatacgtacatactgtctatatttacatctatatctatatctaacagaaaactatgatatcagaaatcagaaataaagaattaattttatgggctcaacraagactagacacaatagagaaaaaaatcagggaatttgaagacagagaaatagaaatcacccaaactgaaatgcaaagaagaaaacagggttaaaaaggg

SEQ ID NO: 48941 - DNA, 201 bp, Homo sapiens
agtcaccaatttaacgcaaattaaaaccacagtgagatatcatttcacacccacgagaagaccaaatgatggtgaaaatgggaacaactgaaagtgtcacrtcgctgatagaaatgtaaaacagtaaaacaactttggagaattgctgggtagttttttggcttgttttgttaaaaaataaaattaaatctgtatctacct

SEQ ID NO: 48942 - DNA, 201 bp, Homo sapiens
caaggtaatggaactagtttacattttattttgggtggtggttacagggatataagcacttgtcaaaactcatggagccaaacactttaatatctttttttattttatgtaaattatatctcaacttacaaataaaatcaagagtattagatggtctcttttcagtgatgctgtctctgtacagctcagagtggggatcca

SEQ ID NO: 48943 - DNA, 201 bp, Homo sapiens
gctgaggcaggagaatcgcttgaacccaggaggcggaggttgcagtgagctgagatcacactgcactccagcctgggcaacaagagtgaaactccatctcmaaaaaaaaaaaaaaaaaaaaaagaagaaatgagaatgtagttatctctgctgaagaagatggggagagagcttaactagaaggggcacaagataattttg

SEQ ID NO: 48944 - DNA, 201 bp, Homo sapiens
tgggatatcactgcttttaggccctcttagtggacagtgctggaaaatacatgtcatatacacacacacacacacacacacacacacacatacacacacayacatccatctttctctctctatatatatatctatatatataatatatatctatatataatatatagatataatataatatatatagatataatctatatc

SEQ ID NO: 48945 - DNA, 201 bp, Homo sapiens
gtagtgatgaatgttaagaaaaaaataaaactcagtagagggccagtgaagtcttctgagagggagcagcatttcagctgagacttggatgaaggaagaamccccatgtggctacctgggtaggggcttccaggcagcgctgtgcccaaggcagaaacagccttggcaagttcacaggagacaagaagaccagtgtgcctg

SEQ ID NO: 48946 - DNA, 201 bp, Homo sapiens
accccagttgatcacaagggtaagcaaaaaagagaagctttgtcattagtgttgagtagtttttccactaaccacttcagatatgtttattatttgcaggktcaacacagaaagcatccttgcccaccaccaagctccagggctcagttcaaccatcttgccctgaacactcttctcttgcatcctggttattatgacgtt

SEQ ID NO: 48947 - DNA, 201 bp, Homo sapiens
ggaccgtgggcactcagaggagactcgagaggcaccccatttatttgcccaaggctgtggaaggggccttcaacacctggaaatttaagcccaaagcctgyaaaaaagagtaagtgcttgggctaaatagcatgaccaagatgttctcgtggcctccagacgcttggggtgatccttaaggtgcctccagccccatcttac

SEQ ID NO: 48948 - DNA, 201 bp, Homo sapiens
agtgtggctgtcaaactttgctgacctttcccccttggggctaatgagtgtcacagctatttttaaccttgggttttctagaagttgagccgttaacctakctcctacagaaggaggatcctgggaggtataaatgaactcttcacacacaaggaggtgactaatggaggaacataggattttcagtgtcagggctagcct

SEQ ID NO: 48949 - DNA, 201 bp, Homo sapiens
agagtgtcaggtgtgcggactgctgagtcacttgggcattcattcgcttaacaaatatatgggtcttaacacaaaactgtaagaggtactgcagaggtttktttttttttttttaaatatgatctgttgtgtgcgaagagcttcagacaaatgggacagaggaatccacatgggaagtcaggctcccagccttgtgcaggg

SEQ ID NO: 48950 - DNA, 201 bp, Homo sapiens
tgctcatttttgtaaataaagttttattggaacacagccatgcactttcatttacatatagtctatggctgatgtcatgctacaaaggcagagttgaatcwctgcaacaaagaccatatgatacacaaagtctaaaatatttactatctggtctttatttatataaaaagcgtgctgacctttggtctagcagaagaaaaa

SEQ ID NO: 48951 - DNA, 201 bp, Homo sapiens
caatctgagggtctccatgagaatggtggtcattgagcatcccttccctctgtgtggccggccaagccgaacttaaacctcctgcctcattccttccttcwagcctggggagctccagacagatccttttcaacttctcaggagaagatatggagtgggatgcagagctctttgcgttggagccccagttgtctcctgggg

SEQ ID NO: 48952 - DNA, 201 bp, Homo sapiens
acattctcaaaagtggttgtagtagaatggtgggatagacgttgggctgaagaataaaaagaggagaaagtttgcatgagattaaagcaggtgagaggctrttttgtttgcttctgtttaggatggaagagacataagcacactgaaaagcagaaggagaaaggcaaatggaatgggagatgaagataagcgtggggtggc

SEQ ID NO: 48953 - DNA, 201 bp, Homo sapiens
aagtggttgtagtagaatggtgggatagacgttgggctgaagaataaaaagaggagaaagtttgcatgagattaaagcaggtgagaggctgttttgtttgyttctgtttaggatggaagagacataagcacactgaaaagcagaaggagaaaggcaaatggaatgggagatgaagataagcgtggggtggccaatggagca

SEQ ID NO: 48954 - DNA, 201 bp, Homo sapiens
atcctcggagattgggggacaggatggtgtggtcatggggtgagaagtcacaggctctcacctgtaatcaatgtaattttgtagatgaatcagggcataargtaggaggcacagccaccagcgtatgagtgaggggagcagatgccaaatggaggcccatgaggactgtggtgaaggtctgaactctctaccaacctggcc

SEQ ID NO: 48955 - DNA, 201 bp, Homo sapiens
caaggggaatctcaaagtccagaggttccttatttacacagctattacacgcagtatgtctctttgggacatgtggattatgatgactatttttaaaagtrgggctatcccaaagaaaagatggattatttgaagaatttttaaaattgttgtcataatgctttcattctaatatcagctcactgtagtatccctgtgagc

SEQ ID NO: 48956 - DNA, 201 bp, Homo sapiens
ccactgctactgggatatcactgcttttaggccctcttagtggacagtgctggaaaatacatgtcatatacacacacacacacacacacacacacacacayacacacacatacatccatctttctctctctatatatatatctatatatataatatatatctatatataatatatagatataatataatatatatagatat

SEQ ID NO: 48957 - DNA, 201 bp, Homo sapiens
ccctgtgagctatagttggtttaggccacattttactgttgtagacactgagatacaaatatctaaataaaaaacaagaaataactttggtaataaggacsaggagcagtcctcattagaggttttagccccagaatttccaggctctgggcacctcatccactgctatctcccactccctcccacccaccatcatgccag

SEQ ID NO: 48958 - DNA, 201 bp, Homo sapiens
cccactgctactgggatatcactgcttttaggccctcttagtggacagtgctggaaaatacatgtcatatacacacacacacacacacacacacacacacmtacacacacatacatccatctttctctctctatatatatatctatatatataatatatatctatatataatatatagatataatataatatatatagata

SEQ ID NO: 48959 - DNA, 201 bp, Homo sapiens
tctatagaccttattgagagttttccagttgacccagtgatgtcctttagaacaaaagaaaatcctgaatcatgtcacttatcgtgtctcttcagtattcyttggcttggaacagtttctgagtctctttatgttttataaaattggtatttttggaaagttctggtcagacattttgcaaaatgtccctcaattgaggat

SEQ ID NO: 48960 - DNA, 201 bp, Homo sapiens
ggagaggggaaggcagggctggaggctttggcacaggacagggcagatgggtctcagctgtgcctggctgtaaccccacactgctctctcccactcgttcrctgagggttcccacacttcttagagaaacagtattccggagcaaggtctgagtcagtagaatcaaacccactttcagttctgagctagggaaaagcaacc

SEQ ID NO: 48961 - DNA, 201 bp, Homo sapiens
ctcacggttttttgcagaagcaagtgctcagggaaatgaagacaggagaactgctgccgtcatgagctatgccgacagtcagcagctgatccccgacagaracgcagcagatgcagacggtgagtgcagcaggcctggtctaaaatacttccagccttgcattgctcataaagacaatcggacacttcagaggtcacttca

SEQ ID NO: 48962 - DNA, 201 bp, Homo sapiens
atacaaaaattaaccaggcgtgatggcacacacctgtagtcccagctacttaggaggctgaggcaggaggatcacctgagcctggggaggttgaagctgcrtgagccgtgatagcaccactgcactccagcctgggcaacagagtgagaccctgtctcaaaaaaccgaacaaacaaacaaaaaaacaaacgaaaaaaaccc

SEQ ID NO: 48963 - DNA, 201 bp, Homo sapiens
tcacaaaggaataatgaagaaccagggatgggtggacaacatgaacccctgtagcagcagctcccccatctttttctagaaccctcatgctaggtgatccrtgtggagttaaaagcggcacggccacagtatagaggggatcacatctcatgcattttctaaaaaccatctctggtcactgagacaatttcttaagacaaa

SEQ ID NO: 48964 - DNA, 201 bp, Homo sapiens
aaaaaatacaatactgcaataaactccataattcaaaatgaaagagagtattgggaataataaaattagtagagaatcagcaaaaagcaaaaacaaaacaycctgtatctgaataagtaacagtttccaaagagcataaaatactgctgaatataattcagtcgtgtgtgtgtgcgtgtgtgtgtgtgtgtgtatgtgtgt

SEQ ID NO: 48965 - DNA, 201 bp, Homo sapiens
tcattgagaggggtgaaattgaagtgaaaggtaaagggagaatgaccacatactttttgatccagaacttgaatgccacagaggatgagatcatggggagrtctaaaaccccagttgatcacaagggtaagcaaaaaagagaagctttgtcattagtgttgagtagtttttccactaaccacttcagatatgtttattatt

SEQ ID NO: 48966 - DNA, 201 bp, Homo sapiens
atccttgcccaccaccaagctccagggctcagttcaaccatcttgccctgaacactcttctcttgcatcctggttattatgacgttctttgagctgggccratagatccagctgaagagttctacatacattagtcttcaaggttcttctctgggcgtttcccatgcagctctctggtagctggggaatgatttgtgagtg

SEQ ID NO: 48967 - DNA, 201 bp, Homo sapiens
taccaggtatggaaatggcttagctggccgcagagctatggggcttctgaagtgaggaaggtttccccatagattctccaggatggctaataactggctaygggtaagaagttaaaactcttagaatgtgtgacttcatatcatcttgaccactgctcccaatgtccttgagcttttaaaataagtttccaaaattccaca

SEQ ID NO: 48968 - DNA, 201 bp, Homo sapiens
aatttttctaatctttccaccccattccctaccaatgtcctgtaggtaaccaatctcaatagatccaggtttatccttctggtgtttaattttgcacaagyaggcagatagatgattatttccttgttttcccttctttcttacattaaagaatactaagcatagtataaagtctcccctgcactatcagaaaaacatttt

SEQ ID NO: 48969 - DNA, 201 bp, Homo sapiens
agtgtgggagatgattggttgtccagcgagctcgtctcagtccctactggtgacatactctactgttgcatttctctccatgatggcaaggccagatgatytggatggagtccatgtggtgcatggtgtacctgtgctctccgaagctccgcagcctgcaagagctggaagaactcaatatgcatctttctgacatcgccc

SEQ ID NO: 48970 - DNA, 201 bp, Homo sapiens
cttaataatccatataaaaagtctagctctcgttatctttattagacaatatctctaaagttgagtgttgcttgagcccttggcattggcactgccctgaygcccaaaggcttccctctagcttgatcctagaacctgaggttgagggaatgaatagcagcctcctgttcatttcaggtgagaggagacagagcaaaactt

SEQ ID NO: 48971 - DNA, 201 bp, Homo sapiens
aatagttgtccaacgtattacaggatagaattataacactcataggtccatttgatagtgttccttggaaaactgttgctgctgcaggaatggacaaagcrtctagtcactgtcctgggatctgcaatgctcactgaactaaacacatgagattcctgcctttgggcagcttgtggtttagtagagggaaacagacaatta

SEQ ID NO: 48972 - DNA, 201 bp, Homo sapiens
tccatttgatagtgttccttggaaaactgttgctgctgcaggaatggacaaagcatctagtcactgtcctgggatctgcaatgctcactgaactaaacacwtgagattcctgcctttgggcagcttgtggtttagtagagggaaacagacaattaacatgtaactaaacaaataagatcattggggtagtgatgaatgtta

SEQ ID NO: 48973 - DNA, 201 bp, Homo sapiens
atttcacagcacctcttctaactgtggctttcctggacaaaaagcaacactgaactagagaaggaaaaattgaggccacctcagttttggggggaaactckagcggtgaactggcatttttttggcaactactttgtgccaggcattttacccacattatcttatttacacaacagttatataaggtcccacaactagtaa

SEQ ID NO: 48974 - DNA, 201 bp, Homo sapiens
ggaagtgtctgcatcagtagccatgacctgtcaggactcctcagagaccaacctgcttctcaggctccaggcagctgggtggacgttcaagacttgcttcrttcatcatctctgccaccaatctcaccaggtggtcacctggctgccaaacatgatggctcttcagtggcacaccattccatctgacttggccctcttggg

SEQ ID NO: 48975 - DNA, 201 bp, Homo sapiens
gtgcagtaagaaattggacatttagaaaattggacatgtagaaaattccatacttctcgcagtgtcaagattctatggtgtgctctggataagcttgaatrctctgacccctctctgttcttcaaacatgttctctgctgcctagaagcctgttctctctgtccagaaggctcttctttgcctttccatccttcagtctca

SEQ ID NO: 48976 - DNA, 201 bp, Homo sapiens
ctctttgcgttggagccccagttgtctcctggggaggactattatgagacagagaaccccaaaggacagtggctgcttcgagaaagactttgggagcggayggtgccctgactccatctggattccttgacgtgtctcagactgggtccctgagaagctgtccgctttcagcgcagcatgaggtatttggtagagttgaaa

SEQ ID NO: 48977 - DNA, 201 bp, Homo sapiens
aggaatgagcttgttgtcactggaagcattcaagaagaaactggaaaaccagcagtcagaaatagcgtgcagtaagaaattggacatttagaaaattggayatgtagaaaattccatacttctcgcagtgtcaagattctatggtgtgctctggataagcttgaatgctctgacccctctctgttcttcaaacatgttctc

SEQ ID NO: 48978 - DNA, 201 bp, Homo sapiens
cagatgtttctcctcctttgcttgcagtattttcctctcttatagtctagatttgtagatttctaattataaatcactcttttttttttttttttttttttaagagacagggtctcactctgtcactcaggctggagtacagtggtacgatcatagctcactgcagtctcaaacccttgagcttaagtgatccttccacct

SEQ ID NO: 48979 - DNA, 201 bp, Homo sapiens
acagatgtttctcctcctttgcttgcagtattttcctctcttatagtctagatttgtagatttctaattataaatcactcttttttttttttttttttttttaagagacagggtctcactctgtcactcaggctggagtacagtggtacgatcatagctcactgcagtctcaaacccttgagcttaagtgatccttccacc

SEQ ID NO: 48980 - DNA, 201 bp, Homo sapiens
aacagatgtttctcctcctttgcttgcagtattttcctctcttatagtctagatttgtagatttctaattataaatcactcttttttttttttttttttttttaagagacagggtctcactctgtcactcaggctggagtacagtggtacgatcatagctcactgcagtctcaaacccttgagcttaagtgatccttccac

SEQ ID NO: 48981 - DNA, 201 bp, Homo sapiens
aggagatgaatgcaccatcgtttcgtgtggagagaggagcagatgggaaaatgtttctccattgctactcggatagaagtggtctgtgccacattgtaccrggtatggaaatggcttagctggccgcagagctatggggcttctgaagtgaggaaggtttccccatagattctccaggatggctaataactggctacgggt

SEQ ID NO: 48982 - DNA, 201 bp, Homo sapiens
ctgatgtctgatttgaagcagggcctgggcttggtgaacttcagaatattcatcagaagttttgccatttgattattttatgatttttgctgataaagttsccttcggccatccctcgacaataggtgtccttctgctgcaggtatcattgaggctgtggccaaagacttctttgatattgatgtaatcatggacattctt

SEQ ID NO: 48983 - DNA, 201 bp, Homo sapiens
aaacagatgtttctcctcctttgcttgcagtattttcctctcttatagtctagatttgtagatttctaattataaatcactcttttttttttttttttttttttaagagacagggtctcactctgtcactcaggctggagtacagtggtacgatcatagctcactgcagtctcaaacccttgagcttaagtgatccttcca

SEQ ID NO: 48984 - DNA, 201 bp, Homo sapiens
tatacacaaagactgcctcaagcttattcatcacaatgttgtttatacaatgataagctagataaaatataatcaatactagcttattatttaataaaagwatgagcaaggtaaccagcaaaaattaagatgaatatctatatttaatactatgaaagaatatgttatatattttaagtgaaaaattcagattatgaaaag

SEQ ID NO: 48985 - DNA, 201 bp, Homo sapiens
gaaacagatgtttctcctcctttgcttgcagtattttcctctcttatagtctagatttgtagatttctaattataaatcactcttttttttttttttttttttttaagagacagggtctcactctgtcactcaggctggagtacagtggtacgatcatagctcactgcagtctcaaacccttgagcttaagtgatccttcc

SEQ ID NO: 48986 - DNA, 201 bp, Homo sapiens
tgtataacttcagtctctgcatatttttatttaattggctgtcactgatgtctgatttgaagcagggcctgggcttggtgaacttcagaatattcatcagragttttgccatttgattattttatgatttttgctgataaagttgccttcggccatccctcgacaataggtgtccttctgctgcaggtatcattgaggctg

SEQ ID NO: 48987 - DNA, 201 bp, Homo sapiens
atatatgtcaactgaattgattaggaactcatttaaaggacacctattttacttcttccttctgtgtgttcactggagatagcagtgaaaggtattccccyacccccttgatggatttcttcacccaggcctgggtgatagatccaatgctatagaatttgctagtttcttcattagtaaatgatagagagagtgagagag

SEQ ID NO: 48988 - DNA, 201 bp, Homo sapiens
ttaatgggggtggaaatgaccaaaggaaaagaaactaatttgcattaaggagcaattattgtgccaggatccatgttagacattttacatgtgcagtttcrttaaattttctcaacatttctatgaaggaggtgttgtccataccatattgctgagcaaattgacattcagcgcagctgataaatgaaagaggtggaaact

SEQ ID NO: 48989 - DNA, 201 bp, Homo sapiens
acgcagcagatgcagacggtgagtgcagcaggcctggtctaaaatacttccagccttgcattgctcataaagacaatcggacacttcagaggtcacttcayaggcagtgagaaagagccgggaagggatagcacaggtggagtttggtgtcccggggcaggacgctactgacttgcttgctgtattttgaataaactgttg

SEQ ID NO: 48990 - DNA, 201 bp, Homo sapiens
gtgtaagtcactggtgaaaaataaaaataaaaatggaaagcatagtgtgcgtgtgtgtgtgtgtgcgtgtgtgtgtgtgtgcatgtgtgtatgaaaggggyatagcgccagagatgaaaataatgctacaccaataagaatgaaattagacaatgaattgttggaaactctcaaggtggatttaccaagaaaaaaatagga

SEQ ID NO: 48991 - DNA, 201 bp, Homo sapiens
atttgtgtccactgggaaaaatgtgtgtcttttaattaggagatgaatgcaccatcgtttcgtgtggagagaggagcagatgggaaaatgtttctccattrctactcggatagaagtggtctgtgccacattgtaccaggtatggaaatggcttagctggccgcagagctatggggcttctgaagtgaggaaggtttcccc

SEQ ID NO: 48992 - DNA, 201 bp, Homo sapiens
aggggctacgttgagaacacgttttcttttttctgacgtttccacttgacttgatctgtaaagaatatattttatttcctcaaccatctctggcttagacrtaaactatgtatgtaatatagttacatacataattatacaagtatatacattatgtaattataaaattctgatatgttaccaaaattttcagaatgcatg

SEQ ID NO: 48993 - DNA, 201 bp, Homo sapiens
aagaatgcaagggaaccagagaaatatgtctgggaatagagaacccagcagggtacatcctgcgcttgtgtcattaggttttatctctttcatcttgaagyttcaattatctgcttaactgggtctcaggatgtttgtatacagagcactagacatctatacgattgcattggaaatgcatctttaagccaaaaataaagc

SEQ ID NO: 48994 - DNA, 201 bp, Homo sapiens
caaggaacttgtgttggcatcggtagcatggaggccattgatagatgggagccacttcaatgtaggcaatggacacagctgctagggacagaggggagatragtaaggtctcacagaccttgggtaaaagagaaagagcgtgactgtgcagtaactagaagcacacagtgtgggagatgattggttgtccagcgagctcgt

SEQ ID NO: 48995 - DNA, 201 bp, Homo sapiens
tcagtgatacctgcaaacctcacccctatcctgtccagcctgtcttggggggactcccaggcccttttgtctctccagcagctaacaccaggggaggtttstgtggggctgggttatcaaaaagcacacagcatcgagctttctgcgctcgagtctgagagcgggatgtgtcctctttacagcactgtgctgctcccaggg

SEQ ID NO: 48996 - DNA, 201 bp, Homo sapiens
cctgtctcctgtgtcaatgatgccaacgcataagcagcgcttcccttggggagactccttgcttctctcattgctgcttcagaggctgggggatgtggtayaaaaagtgctaaacttagagttggagcctcttcaacaaatctggcctctgcaactctatgtgactgcagtcaattcacaaagatgactcagccccaacag

SEQ ID NO: 48997 - DNA, 201 bp, Homo sapiens
gcttgtgttaggagccccgagttgcggaaggcaggtggcctgcctggggcacactatccctcactaagcagaagtgttcatgggtcctccttttttttttytctgatggaggaagaagaaagagcacagattaatgagcaaacccagaagacagttctttctgttaacctggtgctgtctttcttattggagtttcctcct

SEQ ID NO: 48998 - DNA, 201 bp, Homo sapiens
acttgctgggggttcaaagataaaaacaggtcacaatgctcatcctcaaggagaccagctagtgggtaagaccaacaatctttatataagttgaggaaatrcatagcctatcctgggtacttgagaaggggtctccgggctcaaactgaggtccagggaaggcttcttggaggagttgacacccaaacactccagtgtctc

SEQ ID NO: 48999 - DNA, 201 bp, Homo sapiens
agtatatacaaatacatgcacacccatacatacatgcctgtgtgtatatatatatgtgtgtgttgacagatacaaaacccgagcgtgtgcatgtgatagttaacacaccatctctgtggtgttgaggacacagaggcatccagcagtgagcctgacagggaatgatggctgggtctggcagagggagaggaaatggttctg

SEQ ID NO: 49000 - DNA, 201 bp, Homo sapiens
ttatcttatttacacaacagttatataaggtcccacaactagtaagtggaagaaatagcatttgatcttcatttcagacttgtttgtctagggcagatcaygtccgtgtgagttcattttgagcatcagaccaagacaattccatagtttccctaagtggtggccactgcacttgaactgcttgggttgacaatggcccag

SEQ ID NO: 49001 - DNA, 201 bp, Homo sapiens
gtgccaggcagcaggtcccacttgctcaccagagggggcggccttatgctttaccccgcaggtgactgaggacccaacagtgtgctccttgcttggaggcyagtgatgagctcctaatttcactgtggactgcccagatttctacaagacaggcttctggagacgctgtggattctctcctgagtgactaggggctggcag

SEQ ID NO: 49002 - DNA, 201 bp, Homo sapiens
aggcagctgggtggacgttcaagacttgcttcgttcatcatctctgccaccaatctcaccaggtggtcacctggctgccaaacatgatggctcttcagtgscacaccattccatctgacttggccctcttgggtgggaaacgggcactcctggccccctctccccggagaggaccgtggatcctgacaaagtatctcagag

SEQ ID NO: 49003 - DNA, 201 bp, Homo sapiens
tcaatagacagcctcatctacaaggcagtcttcctacaggagcttaggggtgtatgcttttctgtgcttgcagaaaggcgttctgtgccgttggcacctcrgggagaagcttcaggtttcaggctgaactcctgagagcttagcatctggggtgtgcacgacttggggtgccaggcagcaggtcccacttgctcaccagag

SEQ ID NO: 49004 - DNA, 201 bp, Homo sapiens
cagctcccagcgtgagcgacgcagaagacgggtgatttctgcatttccatctgaggtaccgggttcatctcactagggagtgccagacagtgggcgcaggwcagtgggtgtgtgcaccgtgcgcgagccgaagcagggcgaggcattgcctcactcgggaagcacaaggggtcagggagttccctttccgagtcaaagaaa

SEQ ID NO: 49005 - DNA, 201 bp, Homo sapiens
cagaagacgggtgatttctgcatttccatctgaggtaccgggttcatctcactagggagtgccagacagtgggcgcaggacagtgggtgtgtgcaccgtgygcgagccgaagcagggcgaggcattgcctcactcgggaagcacaaggggtcagggagttccctttccgagtcaaagaaaggggtgacggacggcacctgg

SEQ ID NO: 49006 - DNA, 201 bp, Homo sapiens
attcttgacatgaatgaagaagtggagaggacagggaagaaggagcatgttgtgtttctgattgtacagaaggctcacaggaagatgagaaagacaaagcyaaaaaggttacaagacagtcagggcatggagagagaccaagaggtactgggtttgctgtgcctttagaaagaacagttgcacttaagtagagctacgagt

SEQ ID NO: 49007 - DNA, 201 bp, Homo sapiens
agatcacctggtttatttgcaacttttcctttatcaaatggaagtatagattaggttagatttgaagattgttgactttggtcttgaggagcccttacctsgagtgccagtgttgcgagacctcacctccattcttgcctgggttctgtacataatgtacaaagtcagatgtatattctctttgcagttctgggaccactg

SEQ ID NO: 49008 - DNA, 201 bp, Homo sapiens
ggttcctccacccaccggctggatggccttgaatgtgctactcgcctgctcccagccccagcttcctaactgtaaaatgaacaaagctcgagtgcctacttcatgggaccctcatgagcacctgatagcataatgcacataaagcccttggcctggtgtctggcagagtaagcacaataaatattcagttcatattattat

SEQ ID NO: 49009 - DNA, 201 bp, Homo sapiens
gagaagacattctgcaacgcttttcctttccacattgtattcgatgaatcagtaagagactcttccctctgtagcttagaattggggctaagccagggaartgagcatgatttacagtccttcatgaacagtggagattttcaagtccctgagaaattcccagggcttgggagactaggctttatcctggcaggaccattg

SEQ ID NO: 49010 - DNA, 201 bp, Homo sapiens
aatgtttcaattggaggaagtacagtctcctgagaaagctgttttgaagaagacagcactgcaccgacttgtggttaagattgggctctgtaggcaggaggtctggcttgaatcttggttcctccacccaccggctggatggccttgaatgtgctactcgcctgctcccagccccagcttcctaactgtaaaatgaacaaa

SEQ ID NO: 49011 - DNA, 201 bp, Homo sapiens
agtccctactggtgacatactctactgttgcatttctctccatgatggcaaggccagatgatctggatggagtccatgtggtgcatggtgtacctgtgctytccgaagctccgcagcctgcaagagctggaagaactcaatatgcatctttctgacatcgccccccacgacaccaccagggatctcatcctcctgaaccag

SEQ ID NO: 49012 - DNA, 201 bp, Homo sapiens
gaggagactcgagaggcaccccatttatttgcccaaggctgtggaaggggccttcaacacctggaaatttaagcccaaagcctgcaaaaaagagtaagtgyttgggctaaatagcatgaccaagatgttctcgtggcctccagacgcttggggtgatccttaaggtgcctccagccccatcttacatgccaaatattattc

SEQ ID NO: 49013 - DNA, 201 bp, Homo sapiens
ggcagatagatgattatttccttgttttcccttctttcttacattaaagaatactaagcatagtataaagtctcccctgcactatcagaaaaacattttarggcacctaagttagtttagttctttcttgcagtttctaaccatttcctgtatatcttggatcccctatgacttagcgggttcttggaatcttaaatacac

SEQ ID NO: 49014 - DNA, 201 bp, Homo sapiens
ttttgcacaagtaggcagatagatgattatttccttgttttcccttctttcttacattaaagaatactaagcatagtataaagtctcccctgcactatcaraaaaacattttaaggcacctaagttagtttagttctttcttgcagtttctaaccatttcctgtatatcttggatcccctatgacttagcgggttcttgga

SEQ ID NO: 49015 - DNA, 201 bp, Homo sapiens
aaaatattcacaagctgattttaaaatttatatggaaatgtaaagaatctagactaacccgaacactcttagaaaataacaaaattggaggatgtacacarctaattttaagacttattctaaagcaacagtaaaaaaaaaacagagtgagattgggagaagaatagacaaagagaccactggagcagcacagagtgtcca

SEQ ID NO: 49016 - DNA, 201 bp, Homo sapiens
ggagctccagacagatccttttcaacttctcaggagaagatatggagtgggatgcagagctctttgcgttggagccccagttgtctcctggggaggactaytatgagacagagaaccccaaaggacagtggctgcttcgagaaagactttgggagcggatggtgccctgactccatctggattccttgacgtgtctcagac

SEQ ID NO: 49017 - DNA, 201 bp, Homo sapiens
gggcaaacattgagtaacagaacagtaattaatgtgtgttgtcagaactataaaacattcttttaaaatgtttgctgtctttcccataaagtggacacttkcttactgtctattccaacagtgtagactggggagcggggaggtgggcagcagctccaactaatgccgcaaatctacctccaggtgttcatcaggcaccta

SEQ ID NO: 49018 - DNA, 201 bp, Homo sapiens
ctgcaggctgcatggaggacctcatttgcacttcaataacatgcttttctttcacttaactatatatcttggtgttagatttgtcagtggagagactcccyagtgcaattaaacgggagtattgagccggagagaaatcagtgtgtgttgactcagatatttaagcaaccacctttcagtattgactcagaaattggcctt

SEQ ID NO: 49019 - DNA, 201 bp, Homo sapiens
ttgacacccttgatagcatcgaccagatgtcaaatcagagctggtcagcacaggcggcatgggtgggagggcagccagaccatctgtggaacaacctgttsatagtatagacggctgagcctcacctgagagggatttggcaagtctgcagtagggctgtgactggttcgttaaccaactttataggggattctgatgagc

SEQ ID NO: 49020 - DNA, 201 bp, Homo sapiens
gttacttcgggcaagtcctcttcaagacatttttctcatcctgaaggcaggggtaatggcgggccttcttcacagggttgctttgagaaatagatgagatrgtatgtagcacctgaaaacagcagagtgtcaggtgtgcggactgctgagtcacttgggcattcattcgcttaacaaatatatgggtcttaacacaaaact

SEQ ID NO: 49021 - DNA, 201 bp, Homo sapiens
aaatgtttcaattggaggaagtacagtctcctgagaaagctgttttgaagaagacagcactgcaccgacttgtggttaagattgggctctgtaggcaggaggtctggcttgaatcttggttcctccacccaccggctggatggccttgaatgtgctactcgcctgctcccagccccagcttcctaactgtaaaatgaacaa

SEQ ID NO: 49022 - DNA, 201 bp, Homo sapiens
cccaaggtaatttatagattcaatgctatccccgtcaagctaccactgactttcttcacataattggaagaaactacattaaatttcatatggaaccaaaraagagcccgcatagccaagacaatcctaagcaaaaagaacaaagctggaggcatcacgctacctgacttcaaactatactacaagtctacagtaaccaaa

SEQ ID NO: 49023 - DNA, 201 bp, Homo sapiens
caataaaatactggcaaactgaatccagcagcacatcaaaaagcttatccaccacgatcaagttggcttcatccctgggacgcaaggctggttcaacataygcaaatcaataaacgtaatccagcatataaacagaaccaacgacaaaaaccacataattatctcaatagatgcagaaaaggccttgaacaaaagtcaaca

SEQ ID NO: 49024 - DNA, 201 bp, Homo sapiens
gacatctgcagaactctccaccccaaatcaacagaatagacattcttctcagcaccacattgcacttattctaaaattcaccacataattggaagtaaaarctcctcagcaaatgtaaaagaatagaaatcacaacaaactgtctctcagaccatagtgcaatcaaattagaactcaggattaagaaactcactcaaaact

SEQ ID NO: 49025 - DNA, 201 bp, Homo sapiens
ctgatggagctgaaaaccaaggctcgagaactatgtgaagaatgcagaagcctcaggagccgatgcgatcaactggaagaaagggtatcagcgatggaagrtgaagtgaatgaaatgaagtgagaagagaagtttagagaaaaaagaataaaaagaaatgagcaaagcctccaagaaatatgggactatgtgaaaagacca

SEQ ID NO: 49026 - DNA, 201 bp, Homo sapiens
tctcagtccctactggtgacatactctactgttgcatttctctccatgatggcaaggccagatgatctggatggagtccatgtggtgcatggtgtacctgygctctccgaagctccgcagcctgcaagagctggaagaactcaatatgcatctttctgacatcgccccccacgacaccaccagggatctcatcctcctgaa

SEQ ID NO: 49027 - DNA, 201 bp, Homo sapiens
aaaccacaaagatggggaaaaaacagaacagaaaaactggaaactctaaaaagcagagcgcctctcctcctccaaaggaacgcagttcctcaccagcaacrgaacaaagctggatggagaacgactttgacgagctgagagaagaaggcttcagacgatcaaattactctgagctacaggaggacattcaaaccaaaggca

SEQ ID NO: 49028 - DNA, 201 bp, Homo sapiens
cattgaaaagaagaaaacagagaccttactttatgccatgctgcccaaacacgtggccaaccagctgagggagggcaaaaaggtggctgcaggtaaggcamcctctcctccacagcgtcctctgagcagagcgtggtatgtcttagtggtcagggccacaggctttgaagccagacagaagtggttttgaattctggctct

SEQ ID NO: 49029 - DNA, 201 bp, Homo sapiens
gggcagactgcctcctcgagtgggtccctgacccctgacccccgagcagcctaactgggaggcacccccccagcaggggcacactgacacctcacacggcwgggtactccaacagacctgcagctgagggtcctgtctgttaaaggaaaactaacaaacagaaaggacatccacaccaaaaaaccatctgtatatcaccat

SEQ ID NO: 49030 - DNA, 201 bp, Homo sapiens
gaacgggcagactgcctcctcgagtgggtccctgacccctgacccccgagcagcctaactgggaggcacccccccagcaggggcacactgacacctcacasggctgggtactccaacagacctgcagctgagggtcctgtctgttaaaggaaaactaacaaacagaaaggacatccacaccaaaaaaccatctgtatatca

SEQ ID NO: 49031 - DNA, 201 bp, Homo sapiens
tgcacgattcttttcagcgatgtagtgacatttactaacatctgtactgcctgtgaacctatacaaatagtgaacgtgctgaattccatgtactccaagtktgacagattaaccagtgtgcacgcagtctataaagtaagtgtctgtgcagtgtggggtgtttcacggtgtgctcacgcagggcgagtgcttgattctaag

SEQ ID NO: 49032 - DNA, 201 bp, Homo sapiens
gatgtggaaattgatcctctcagtccctctgaagcacacacatcaaagttgaactgttctatgtccttttccttcttaggtgaatactagctaatctgttyagccaaaggaatatatttttattctgtcagaagtttcccaagttgtagctaaaaggaatgagaatttcagagacctggcaggcctgggggggtggggggt

SEQ ID NO: 49033 - DNA, 201 bp, Homo sapiens
acttggggtgccaggcagcaggtcccacttgctcaccagagggggcggccttatgctttaccccgcaggtgactgaggacccaacagtgtgctccttgctyggaggctagtgatgagctcctaatttcactgtggactgcccagatttctacaagacaggcttctggagacgctgtggattctctcctgagtgactagggg

SEQ ID NO: 49034 - DNA, 201 bp, Homo sapiens
gcggactgagcccagagggcgagaggggaagcggcatgggagaccggcagggttggtggagcaggcttcacagccaggtgagaaaaacagtctcaattttkattcaaaatcggactgtccacagctgaaagctcactaacctgtctcatgagacccagctctgcactccttctgactgtttctaaaactcaagccctgctg

SEQ ID NO: 49035 - DNA, 201 bp, Homo sapiens
atgtctcttcacctcaatgctcccatcagtcaagggtgtttatgataataggacctacactataggattgtggtaaggctgaattaatattaagtagaacsaaatgcaagtggttcagttcgttcaattctaaagtctttgacctgtaaaaaatggcaatttcatgtggctcattctaaaacatggaaagtgctttgtgcc

SEQ ID NO: 49036 - DNA, 201 bp, Homo sapiens
acaccaaagacaaatgctggaccacatgactcaatggccctaaattcatcaaacagaggcacactatcggggtggtcatgacctagaagtaggtgatgtgkttatcaactagcagcagacttcaaattccccactgcctcagtttcccttgttacacactagaagtttgtctctagtgctcgggcagtgggcatgatgttt

SEQ ID NO: 49037 - DNA, 201 bp, Homo sapiens
cacactatccctcactaagcagaagtgttcatgggtcctccttttttttttctctgatggaggaagaagaaagagcacagattaatgagcaaacccagaasacagttctttctgttaacctggtgctgtctttcttattggagtttcctcctctgttttcctgcactcgttatattctccacacacacacccaggtataga

SEQ ID NO: 49038 - DNA, 201 bp, Homo sapiens
aaatggttctgcagaccaggcagtatcccagtagcctcagagcctggccttgccctgggctgactgggtgagaaaggaggaaactctatccattgaagaartgacatctctgtttggggaagggcggtaggcattttggatgagcctaaggcagcaggagtaggtgataaaatgaaacaaattaagacagttctagagagt

SEQ ID NO: 49039 - DNA, 201 bp, Homo sapiens
acttacttgctgtttgacttgggcaaatgtatttattcaacaagtatttagcttctagaatgtgctgaacaaagtttcaggcactgggaatagaggcaaarggaataggcaagtgctgtgttccctgggaatgtattccaatggggaggacagtaaacaggcaaataaacaaataaatctcaggttgtgcaaagagctaaa

SEQ ID NO: 49040 - DNA, 201 bp, Homo sapiens
taaggagtaaggatgacattggtggtggggaactggaaatatagcccagtaggacaaatatttccatttctggaaaataactaccagagtttagacactcrccttcctgttggcactgggctctttcactttaagaaattcctatatatatgaaaatccaaacttataaaataaatctggagcctgatatttgtgtgacaa

SEQ ID NO: 49041 - DNA, 201 bp, Homo sapiens
gtattggcttattttcaagatgctcgtcctcacgtgggttgggggagaggtggggggcagtggcgtgcgtcccactggactggatttgcatctgggctctrctgctcagagctgtgtgatcttgagcgggttgcttcacctctctgaagctctgtttcctcattgataaagggggaataatgtacctatcttctagggtta

SEQ ID NO: 49042 - DNA, 201 bp, Homo sapiens
tcctcattgataaagggggaataatgtacctatcttctagggttaaggagagaattgagtggtgcaatctacacagaagtgcctagtagaaactcagtaarcatccttcctcctctctgagatataggtgctacattaagattacattatacttgacattattagaaccactttgctgctggtcagataatgatgctttcc

SEQ ID NO: 49043 - DNA, 201 bp, Homo sapiens
gccaccacgtgggaattcattttcaggggctctgggtgaaataagagaggtgtgtctttaaacatgtgtttactgagctcccatagtaggcctggtactaygaaaaacactggaggattgaagaagcaaataagccttttggcctggatggctttagaatctgtggaaacattacaggtatgcctggaacacaggaactag

SEQ ID NO: 49044 - DNA, 201 bp, Homo sapiens
tacaagttggaagaaaatacatgcaatgatacctaacagctatatagtgctttattctgggcaaagtattatagattgtctctttaggcaaaaataacaamgtaagataatgttcactttttttgtgtctatctagtaatttggcagtgcctttaaggtatacatttctggttataactgagcctttaatcttgttatgct

SEQ ID NO: 49045 - DNA, 201 bp, Homo sapiens
tggttataactgagcctttaatcttgttatgctttggccaaacttcattgagtgctaattatgaggcaggtgttgggctaagtaatgtgtcaacattgacktaccttcttgatgccataagagtaggcagtcttatttttcctgttatacggatgagaaaactgaggtccggaaagttcaagtaactgtccccaaatcacc

SEQ ID NO: 49046 - DNA, 201 bp, Homo sapiens
tgttgggctaagtaatgtgtcaacattgacttaccttcttgatgccataagagtaggcagtcttatttttcctgttatacggatgagaaaactgaggtccrgaaagttcaagtaactgtccccaaatcacccaggcatggtggctgagctggacccaaacccacacctgtctccaaagatcctgccctgtgctgttctcat

SEQ ID NO: 49047 - DNA, 201 bp, Homo sapiens
aactgtccccaaatcacccaggcatggtggctgagctggacccaaacccacacctgtctccaaagatcctgccctgtgctgttctcattattctttggaayaataagaactttgtcaaagatcacgtggctttaggtgtacagccttatttctgggctttctattctgttctgtaatgatacctaacggctatatagtgct

SEQ ID NO: 49048 - DNA, 201 bp, Homo sapiens
agtgaaggagtgcctactgagaagggaagaatctttcagcaaacttcggatgccaagggaaagatgctgaagtcttccaggagggcgtgcgatgcctggaygttcgtttcagtggacggccccagtctgtggcgttgtggtcctcgacagactgtcttaaccatgagtcacatccctctagtgccccacacctccacactg

SEQ ID NO: 49049 - DNA, 201 bp, Homo sapiens
aagtaatcatgttatcaccttgatctcagacttccgacctccagaactctgagaaaataaatatctgttgtttaagccaccccatctatggcattttgtcrtggtggccctagtggactaatataagaacttgaatcagcttgtatatctccagaaagaaatactctgtatatatcatatcaccccagtccatttttgtgg

SEQ ID NO: 49050 - DNA, 201 bp, Homo sapiens
cacacaaaagtagaattctgcttatgtgcttaggtgattactgggtaagttgctgtcattaaaatgggtaatgtatcctagcccttttcttctcttgcatrtgtccctaatagagatattcctaaggctcctatagtctcaacttttctcaaatttcagaggaggctgcggtgctcaaggttttcctacgattgactgcaa

SEQ ID NO: 49051 - DNA, 201 bp, Homo sapiens
tataaagaggatagaatgaatattctagcatggctggctgaaaattgtatttattgtattttgttttcattgttagcttagacaaatttctttatgcacakccataactttctcagcagtttcttgctgaagtgtgcttctttcatgttggcaagtcctgggaaaactccagcgtttgatctccctcgacctgttccaccc

SEQ ID NO: 49052 - DNA, 201 bp, Homo sapiens
tgcctccgaagatgcttagaaagcactgtataggcatgggccaaaacaggaactcttacaggtgaaggagaattcaagcagcttctagtcctagaagctasagtcctagatcctcaactgcgtgcacaagcgtttctggggctgtctgagaatccccagtggatgtgtgtgtagcagagaggttaaaaaagatggagaaac

SEQ ID NO: 49053 - DNA, 201 bp, Homo sapiens
tcctagatcctcaactgcgtgcacaagcgtttctggggctgtctgagaatccccagtggatgtgtgtgtagcagagaggttaaaaaagatggagaaacacraatcttgcccagtacctcctctattttacggataaagaaatcaaggcccagagggggaaagtggttttccctcagagcttatttgtgtaaggtataagct

SEQ ID NO: 49054 - DNA, 201 bp, Homo sapiens
ggctgaggaagctggatgtgtgtggtgctcagagtcctctctggtaacaggtggtcacctgcttcccctgcccactctgggccacctgcttcccctgtccwctctgggccacctgctgtctcatctcatcatgttgctctcttggagccacagagacaagcaggggccagagttgccaacgaggcctggcaggtgatggtg

SEQ ID NO: 49055 - DNA, 201 bp, Homo sapiens
cacctgcatcttttgatagaaccaaggttgtgtctgaggctggaaataaggcacaaggagtgaaacagtcatttgctccttcagctcctggaactcaggcrccaagagcagcaacacctcccggatgcttcctaaagccagttcccagcctgccaccacggcagcacttagagggaggacgcaggcagctggcagacaggg

SEQ ID NO: 49056 - DNA, 201 bp, Homo sapiens
taattctttggtgttgatggggtgtctttcacgtcatagtgtgcttagcagcagccctggtcttttcctactagtagaacctcatcccctcatttgtggcmaaacaaaaaagaaagaaaaagaaatgtctcctggcattgccaagtgtctgcgtagtgggggtaatggataaaatcattcccagttgagaattgctgggtt

SEQ ID NO: 49057 - DNA, 201 bp, Homo sapiens
tgccaaagagattacctgttttgttttcttaagcatcactttaattttttttaaaagtatgcgattacgatgttaaatatgcttttgcaaaccagacagamagatcccctcttgatcctaatatgtccaccccacataggcaaagcctaggtgctgcccttgtggctgacaattctgcacatctgtgatcctagtgagggc

SEQ ID NO: 49058 - DNA, 201 bp, Homo sapiens
agtctacagaccaatgtgtgggctggcccacatcacctttccaccgaaagccaacgtacatcactgtggtttctctctgcctagctttgaatgtcaggaaycttttcttcttgtagtttatttccataacatctattggcctatatctatctgaaagagtaaatgagtatggtgaatgcatttttcaaacaagaagttggg

SEQ ID NO: 49059 - DNA, 201 bp, Homo sapiens
acatctattggcctatatctatctgaaagagtaaatgagtatggtgaatgcatttttcaaacaagaagttgggatgcaaaatcgagtgaacacatgtatgrgatgtggaatcaggacagccccaggaagcccgtcgtgattctgtatgtctccaactcccatgagtctgagagagcaagacccatccaaaggaaaggctac

SEQ ID NO: 49060 - DNA, 201 bp, Homo sapiens
ttattctttggaacaataagaactttgtcaaagatcacgtggctttaggtgtacagccttatttctgggctttctattctgttctgtaatgatacctaacrgctatatagtgctttattctgggcaaagtattatagattgtctctttaggcaaaagcattttttttattctgttattctttgccctaattctccactttt

SEQ ID NO: 49061 - DNA, 201 bp, Homo sapiens
ggacagggaagaaggagcatgttgtgtttctgattgtacagaaggctcacaggaagatgagaaagacaaagccaaaaaggttacaagacagtcagggcatsgagagagaccaagaggtactgggtttgctgtgcctttagaaagaacagttgcacttaagtagagctacgagtcttggaaaaatctatgcaaacaacagaa

SEQ ID NO: 49062 - DNA, 201 bp, Homo sapiens
tgaaaaaaagacataatgtaatgtccttgaggcagggatttttgccagtttgagtcactgctgtatcctcaatgcttaaaacagtgtgcctagctcatcgyagggactaactacatatgtaatgaaagaactaatagaaagagaagatttgtggaggggatcgaagttgagttcagtgcagatatccatgaacagatacct

SEQ ID NO: 49063 - DNA, 201 bp, Homo sapiens
gatagatgattatttccttgttttcccttctttcttacattaaagaatactaagcatagtataaagtctcccctgcactatcagaaaaacattttaaggcrcctaagttagtttagttctttcttgcagtttctaaccatttcctgtatatcttggatcccctatgacttagcgggttcttggaatcttaaatacactgat

SEQ ID NO: 49064 - DNA, 201 bp, Homo sapiens
tactaaaaatacaaaaaattagccgggcgtggtggcacatgcctgtaatcccagctacccgggagtctgaggcaggagaatcgcttgaaccctggaggtgsaggttgcggtgagccgagatcgcatcattgcactccagcctgggtgacgagcaaaacttcgtcacacacacacacacaaaaaatctcaagaacaaaaatc

SEQ ID NO: 49065 - DNA, 201 bp, Homo sapiens
tggccaaggcctggagtctcactcttcctctgggctacgaggacctgcttgttctttacaatcacccgttctcccccgccctttctttttcaccctttctytcttttccaactccccttcagctcgagttgtgtgtgagagaaagaaggcggctcacgtgcccggctgaggaatgagatcatttctctccccgtgtagcgg

SEQ ID NO: 49066 - DNA, 201 bp, Homo sapiens
aaatcattaggtggaaattctgtaatgagagatgactacttttgagctgaaaatctggagttttgacagagcttaggaaataaaacggcaaaaaagcttasaatgggtagtgaaattaagcccacctttagtcttttcttgattttattccaagggatcccagcagcagaaggacgtagtggctgtatcgtgtagtcttga

SEQ ID NO: 49067 - DNA, 201 bp, Homo sapiens
ttagaaatactaattggcatctttgagtttgtgctctatggggcattgcgtgactcacttggtataaatcatctagtttaatgatcataacaaccctggarggcaggtgttatttctccatttttcatatgaggaaaactgaggcccagagagcttcagtaactcatccagggttacaggtcaagtagtggcaatgctggc

SEQ ID NO: 49068 - DNA, 201 bp, Homo sapiens
cagaatcttttttactttgacataatttcaaacttgcaaaaggcttacaagaatagtacaaagaattcccatgtagtatttatccatattccccaaatgtygacattttaccatatagtgtctatccttctctttatatctagatttatactttttttcttgaaattgttagtatattgcaaatgtgatgccttcttgtcc

SEQ ID NO: 49069 - DNA, 201 bp, Homo sapiens
ggaactgaattggagtagaatgtcaaacatatatgtgtgaaaattccaagacagccttgcagttctgcgctgaccaagtcttgtttgaattgtcagaggcrtcaacccaaattgatggagtcaggtttggcttgtccaactttcactgtgctgtttcagttcattttctcagcacagtcctagctgattgtcctttctgtc

SEQ ID NO: 49070 - DNA, 201 bp, Homo sapiens
ttaaataactacagtacaacaatcaaactcaggaaatgaacatagatatagtgctattatctaatctatagaccttattgagagttttccagttgacccartgatgtcctttagaacaaaagaaaatcctgaatcatgtcacttatcgtgtctcttcagtattctttggcttggaacagtttctgagtctctttatgtttt

SEQ ID NO: 49071 - DNA, 201 bp, Homo sapiens
caggtgatgatccacatcccacctctattccccaaggcaacagcatttcctcacattccatgctgctatcgctgcagccactaccacccccaactccccarcctccaagtttgtgtttgacaatctcacatgataggtgttttccaaatgggaagatttcttctgcaaccattcttttcatttaatctgttcttgatctac

SEQ ID NO: 49072 - DNA, 201 bp, Homo sapiens
tcttttcttgattttattccaagggatcccagcagcagaaggacgtagtggctgtatcgtgtagtcttgatttggtctgagccctctgcgaaagaacatckcgttgttattccagaatgagaatggagggtggattcttttccgtcacaccagctgtgtgaccttgggctagaatttcactgagagttgatctcctgcaaa

SEQ ID NO: 49073 - DNA, 201 bp, Homo sapiens
aggccggccaggatgcacccacaagcaaagaagccaacggaggcaattaacacaggccattaccactggcttctctaccatcccaagcttcgtctagattsagatccgactaatcaatttttggaaaatatgtataactcatcttggaaaatatgtacaactcatctctgacaaaactagaccaattcagtggggactcta

SEQ ID NO: 49074 - DNA, 201 bp, Homo sapiens
ctgtaaaaaggacatgataataaggttagctaccttataagagctgggcaaacattgagtaacagaacagtaattaatgtgtgttgtcagaactataaaayattcttttaaaatgtttgctgtctttcccataaagtggacacttgcttactgtctattccaacagtgtagactggggagcggggaggtgggcagcagctc

SEQ ID NO: 49075 - DNA, 201 bp, Homo sapiens
aagaaatgtctcctggcattgccaagtgtctgcgtagtgggggtaatggataaaatcattcccagttgagaattgctgggttaaggttaagtggatatatrctgggaagcattctgggatgcacctgagcctggacaatttttcacctataacaataaccatatgaaggatttgaaatttgaatttgatggcttttttttt

SEQ ID NO: 49076 - DNA, 201 bp, Homo sapiens
gaattgctgggttaaggttaagtggatatatactgggaagcattctgggatgcacctgagcctggacaatttttcacctataacaataaccatatgaaggrtttgaaatttgaatttgatggcttttttttttcaatcctcctcaaataaattgatctttccagtcttcagtgcccacttctgcagctggaaccagtcata

SEQ ID NO: 49077 - DNA, 201 bp, Homo sapiens
cctcttgaacatggggaaggggtcatgccaactcaagccactgctctgtaagagttgtgagcataactatttaagtttgattgttaatccatttctatggwtaaaatatatgtcaactgaattgattaggaactcatttaaaggacacctattttacttcttccttctgtgtgttcactggagatagcagtgaaaggtatt

SEQ ID NO: 49078 - DNA, 201 bp, Homo sapiens
actgaaaaaaagacataatgtaatgtccttgaggcagggatttttgccagtttgagtcactgctgtatcctcaatgcttaaaacagtgtgcctagctcatygcagggactaactacatatgtaatgaaagaactaatagaaagagaagatttgtggaggggatcgaagttgagttcagtgcagatatccatgaacagatac

SEQ ID NO: 49079 - DNA, 201 bp, Homo sapiens
acaaaacaccctgtatctgaataagtaacagtttccaaagagcataaaatactgctgaatataattcagtcgtgtgtgtgtgcgtgtgtgtgtgtgtgtgkatgtgtgtgtcagagagagagaatatgtaatagcaatcaaatgaacatatagctaatgatatctgtacttagctaactctggttgcgccataccctataa

SEQ ID NO: 49080 - DNA, 201 bp, Homo sapiens
acagagctgggcatccacaaacaaaataaccagagcctggaacaaacagcttcatggattttttaagtttaaagatttgaaagtcaaacaggcagtctttyacccaaagctgccactcttacttgaatataactttgcttggcttacacgcagcccagtcctcctggcagaggttcttgggagaaggggggccgctgggac

SEQ ID NO: 49081 - DNA, 201 bp, Homo sapiens
gtccttcctaagtgtggctgtcaaactttgctgacctttcccccttggggctaatgagtgtcacagctatttttaaccttgggttttctagaagttgagcygttaacctagctcctacagaaggaggatcctgggaggtataaatgaactcttcacacacaaggaggtgactaatggaggaacataggattttcagtgtca

SEQ ID NO: 49082 - DNA, 201 bp, Homo sapiens
caccaaaagcaatggcaatgaaagccaaaattgacaaatgggatctaattaaactaaagagcttctgcacagcaaaagaaactatcatcagagtgaacagrcaacctacagattgggagaaaatttttgcaatctatccatctgacaactggctaatatccagaatctacaaagaacttaaatttacaagaaaaaacaacc

SEQ ID NO: 49083 - DNA, 201 bp, Homo sapiens
gaatggacaaagcatctagtcactgtcctgggatctgcaatgctcactgaactaaacacatgagattcctgcctttgggcagcttgtggtttagtagagggaaacagacaattaacatgtaactaaacaaataagatcattggggtagtgatgaatgttaagaaaaaaataaaactcagtagagggccagtgaagtcttct

SEQ ID NO: 49084 - DNA, 201 bp, Homo sapiens
gttattggcattttaccgaggaggcaagtgacggcttagagagtagctcgatagtgtcacacagccaggatgtgaaccctttggaaataaatgaagaccayacaaaggacaacacacacctccaggagattttatttagggggtatgctttggtttctacaggtgtctccatggaagccatcctgaaactctttggagaat

SEQ ID NO: 49085 - DNA, 201 bp, Homo sapiens
tgtgattgtgttggcactagtttctgcaaagcttggatttggtgaccatggtttttaactttaaaatgtcaggctctaattgtccttccattgcctctcawtatttgtgccgggtgacatggagacatcatctcccctgtcctaagaaaaagtttttggagacacaattggaatcactcccaacaggtgatgggtggagag

SEQ ID NO: 49086 - DNA, 201 bp, Homo sapiens
tgatgggtaataatgctctggtaaatcagtctttttttttttttttgagatggagtttcgctcttgttgcccaggctggagtgcaatggtgcaatctttgytcactgcaacctctgtctcccgggttcaagtgattcttctgcctcagcctcctgagtggctgggattacaggcatgtgtcaccacgcccagctaaatttt

SEQ ID NO: 49087 - DNA, 201 bp, Homo sapiens
gaggcctgtgtgttcactccctaaagagttccctccctggcttatctattttcctcaaacatctcaactaggtcaggccctgtcattaaaaaacaagtggrtctcccctagtttcccggctaagaagatctggcctctgccttaggccctgactagggggccccgtgctgcaataactggttgtgcagcccacccagccta

SEQ ID NO: 49088 - DNA, 201 bp, Homo sapiens
cctcaggctcccaagtgctggtgctagctgtggtaggcaggggcggggtgatcctcagttctgcagtggaatgcttggtgggggtggcaatggctgtgctktggtcctactgctggggagggcggggttgctttcagtggcagcaaccacagacaggtggttggagagcacatgcttcagccccaggtggcagctataagc

SEQ ID NO: 49089 - DNA, 201 bp, Homo sapiens
ttggagtagcattgtttttttttttttttttcctttggttattgatgggtaataatgctctggtaaatcagtctttttttttttttttgagatggagtttygctcttgttgcccaggctggagtgcaatggtgcaatctttgctcactgcaacctctgtctcccgggttcaagtgattcttctgcctcagcctcctgagtg

SEQ ID NO: 49090 - DNA, 201 bp, Homo sapiens
cctgggctcaagcgatcctcctgcctcagcctcccaaaaggctgggattataggtgtgagccactgcacctgtcccttatttttaattttaagcaaaaagrggactgactctgaagttcaagaagtcatcaagaaatgctgatgggttacttcagaattgtttcagattaaaggacagcctggtgtcactctgtgactatg

SEQ ID NO: 49091 - DNA, 201 bp, Homo sapiens; identical to SEQ ID NO: 14048

SEQ ID NO: 49092 - DNA, 201 bp, Homo sapiens; identical to SEQ ID NO: 14050

SEQ ID NO: 49093 - DNA, 201 bp, Homo sapiens; identical to SEQ ID NO: 14052

SEQ ID NO: 49094 - DNA, 201 bp, Homo sapiens; identical to SEQ ID NO: 14056

SEQ ID NO: 49095 - DNA, 201 bp, Homo sapiens
tgaatatataaaaagcacaaaaagtaatacggcaatcatctaatgaccaaacattaaaatcaaacatgctaacattttacataatttgcttcaggtctctgaaaagaattgtagatataaccaaagcaccgtcccctactccttcctcctgcctgtcatctcagaagttgtccggaaattgctgctgcttgttctcattca

SEQ ID NO: 49096 - DNA, 201 bp, Homo sapiens; identical to SEQ ID NO: 14053

SEQ ID NO: 49097 - DNA, 201 bp, Homo sapiens; identical to SEQ ID NO: 14055

SEQ ID NO: 49098 - DNA, 201 bp, Homo sapiens
gaataattgggggaagaaagagaacaaagttgatctaaattagtagaacatctgaaatagtaaatttggtttaaaatatttaatgttatcattttcaagayatagaaatgtaatattttctagagcttgaactctggaggcagcctctaagaacagaaactctgggatttttctgctttccagtactgtggccttgagcca

SEQ ID NO: 49099 - DNA, 201 bp, Homo sapiens; identical to SEQ ID NO: 14058

SEQ ID NO: 49100 - DNA, 201 bp, Homo sapiens
gtttacattcttggttgttattgatatgtgagggattattcctgtcattttgttaattgatttttggttgtttcatgtatcctttttcctttctttcttaytgtttatcattgtggttttgtggttttctttagtggtaacatatgaattctttctcttcctcatttgtgtgtttgctctaccagtgggttttacactttt

SEQ ID NO: 49101 - DNA, 201 bp, Homo sapiens
ttgagacttttttatgtggtctattctgggaactgttccatgtgctgatacaaagaatgtatattctatagcagttggatgaaatgttctctaaatgtctrttaggtccatttttgtgtaaagtgtagtttaaatccaatgtttatttgttaatttttttcccaatgctgagagtggggtgttgaggtcaccaaccattat

SEQ ID NO: 49102 - DNA, 201 bp, Homo sapiens
gtgcgcactactatgccttttttttttgtagagatggcatctcactttgttgcccaggctggtcttgaactcctgggctcaagtgatcctcccaccttgamctcccaaaattctgggattacgggcatgagccactgagcccaacgtggtatattatctttttgatgtgttattagattcagtttgctgatattttgttga

SEQ ID NO: 49103 - DNA, 201 bp, Homo sapiens
ttcttatgagaaagtgtattcatatcctttgcccactttttaatgagattatttgcttttttttttttttaactcttgacttgtttgagttccttccttgkatactctggatattataccttgtcagatgaatagttagaaaatattttatcccattcaaccagttgcctctcattctattgattgttttaaaacatttag

SEQ ID NO: 49104 - DNA, 201 bp, Homo sapiens
tacagggtacatgtgatattttattacacacatagaatgtgtcatgatcaagtcaggctattcaggctattcatcacctcatgtacttattatttctgttragatatgttgggaacacatccatgtgttcctatccatatcaatgtgttgggaatgttttaagttctctcttcttgctgtttggaaatataccatacattt

SEQ ID NO: 49105 - DNA, 201 bp, Homo sapiens
gggcaataccaatggctggtttttaagcatgatcttgtattaagctgcttttgagtgagtactggatcttaataattatttttagttgtgaaatacttatytggcataaatcatgtgctaccttagaaattagtatttgtaaattacaaccctatggcgtataggtactgttattgatttgttatccttattttccagttg

SEQ ID NO: 49106 - DNA, 201 bp, Homo sapiens
ggttaatggcctaggttggtagctagctagccagatccttgttctttctttcacttattttttttattcattcaacaaatgtttatagagcacttactatrtgccaaaaattttgttaggtaataatagacacagtggagtaaaaatagtctgatgacagaagtaaacaataatcacattataaataaaaataaattacac

SEQ ID NO: 49107 - DNA, 201 bp, Homo sapiens; identical to SEQ ID NO: 14054

SEQ ID NO: 49108 - DNA, 201 bp, Homo sapiens
ctctcccacagccacacagctaggaagtataggaacggggattcaaggtcaggagctgggattcaaggttgggcacttgggtttcagaacccatgtgtttktcccctccatgttattctacttccctttaatcaaaacaactagcagcacatgctgtatttagttataacatttgaacagcaagcagtgtgtgctattaaa

SEQ ID NO: 49109 - DNA, 201 bp, Homo sapiens
tataaatattgtaaataataagcaaatatattcttatcaatgatgttgaagaataagtaaacatgttataaagcattttcactccacactttaaaaaatawgctgcatctaatctaagtatattttacttgtagaacattgtcaaagggtcacctactctttggaggttacgttgggtcctccaaaaagaaaaaaaattct

SEQ ID NO: 49110 - DNA, 201 bp, Homo sapiens
atgctgtatttagttataacatttgaacagcaagcagtgtgtgctattaaattgaaacactgtgatctcatttgtttctgttgaaactgcctagctgtgcygactgggctttgtttccctgggcagagaaagcttttaagggagcaatcttttcttccttttgcttctgatgaccctcatttcatccacccttttccactg

SEQ ID NO: 49111 - DNA, 201 bp, Homo sapiens
aagcgattctcctgcttcagcctcctgagtagctgggattacaggtgcccaccaccatgtctgactaatttctgtatttttagtagagagggggtttcacyatgttggccaggctggtctcgaacttctgacctcaagtgatccacccactttggcctcccaaagtgctgggattacagatgtgagccactgtgccctgga

SEQ ID NO: 49112 - DNA, 201 bp, Homo sapiens
ctctcacttcttctcaggcatattataccctcccaatttttaattcctggtgtattttctactctttcaatatttagctgctaattttcatgaaatatagmgttcttatccagaatcctcttagtataggattttaaatctgaactagaccttatgtataagttagtccaatttcctcatttcacagatgataaaattgag

SEQ ID NO: 49113 - DNA, 201 bp, Homo sapiens
aaaaaaaaaaaagtgtggaatgctaagtaaaaaatgtgatgtagtgtagttgcaaaggcgttagctgtattctaattccagatttgccacttactcgttgrattgactttgggcaatccacttaacctttacgacaacttctttatctgtaccacgaaggacttcgctacgtcagtgtttctccaggtgtggtccaagggc

SEQ ID NO: 49114 - DNA, 201 bp, Homo sapiens
ttccattagcctcctctttgcccagaccattaattgatacttatcgtctctctgcatgtgcttgtgaatgtatacatatgtgagaaaaacataaaaaatayatagtaggcttctgcaggtttatttattgatacataatatttgtacatgtttacagggtacatgtgatattttattacacacatagaatgtgtcatgatc

SEQ ID NO: 49115 - DNA, 201 bp, Homo sapiens
agatcttttgggacttaatacataaaacaagtcagtaattacagataaagttggagcccttttactccttcctaattccattagcctcctctttgcccagrccattaattgatacttatcgtctctctgcatgtgcttgtgaatgtatacatatgtgagaaaaacataaaaaatatatagtaggcttctgcaggtttattt

SEQ ID NO: 49116 - DNA, 201 bp, Homo sapiens
ttttttttttgagatagtctcgctctgtcacccaggctgaagtgcagtggcatgatcacagttcactgcaacctctgcctcccggtttcaagcgattctcstgtctcagcctcccaagtagctgggactacaagtgtgtgccactacacctggctaatttttatatttttagtaggatgggatttcaccatgttggccagg

SEQ ID NO: 49117 - DNA, 201 bp, Homo sapiens
agtctcatgagatctgatggttttataaagggcagttcccctgtacacactctcttgcctgcggccatgtacgatgtgcctttgctcctccttcaccttcygccatgattgtgatgcctccccagacatgtggaactgtgagtccattaaacctctttttctttctttctttttttttttttttttttttttgagatagtc

SEQ ID NO: 49118 - DNA, 201 bp, Homo sapiens
gggtgggtttttcccatgctgttctcatgatagtaaataagtctcatgagatctgatggttttataaagggcagttcccctgtacacactctcttgcctgyggccatgtacgatgtgcctttgctcctccttcaccttctgccatgattgtgatgcctccccagacatgtggaactgtgagtccattaaacctctttttct

SEQ ID NO: 49119 - DNA, 201 bp, Homo sapiens
tgatatggtttgactgtgttcccacccaaatcttatcctgaatcgtagctcccataatcctcatgttgtgggagggacctggtgggaggtaattgaatcaygggggtgggtttttcccatgctgttctcatgatagtaaataagtctcatgagatctgatggttttataaagggcagttcccctgtacacactctcttgcc

SEQ ID NO: 49120 - DNA, 201 bp, Homo sapiens
ataaaaataacaatctcaatatagccaacacctagattcagtaataacattttgacacagttgcttcacttgctccttttttgggggatgaagtattttargatccctagcattgtcatcttttaaaaaatccccttatgttaatatgcatatctaaaaaataatttgcttaaataaccacactgccatcatcacacttag

SEQ ID NO: 49121 - DNA, 201 bp, Homo sapiens
gtgtggcttacctctttggggaagaagagggagacactgtttttctagtttgttctggttggaaacgatcaccatggaagctaaattactccttatgtctkacattctctgtactagggtcagtatgcggccctactcttcctgtgttgtttatactcttacatcaaggagttacattttcctcattttacgttgagggaa

SEQ ID NO: 49122 - DNA, 201 bp, Homo sapiens
tgagaaaagggcatgaatatgaacttctcttttcagttttgaggacaactgaatttgggaataatgctatcttatttatgtttttgtttcttgggcagggkgaaattctataacttcgtattacagagaagtttctaattatggtgatttggattttataatgagctttttggaaaagtacttattggactttgtatgagt

SEQ ID NO: 49123 - DNA, 201 bp, Homo sapiens
catgccaggcacttgggtgcatcagtcgtactcctagaaggcataatgcagtgccatgcccaacctggtatcctataaacgttcaagaatgtgtgcatggrtgaatgaattgcatggtgaaggtaaacaacatatgtgactctttagcgtttaggcttgacagatttgttataacttattttgagatcacacaataaggtg

SEQ ID NO: 49124 - DNA, 201 bp, Homo sapiens
atgagtttatattcagtgaggctggtttgagagaatcccgtgtggctggctgtgttgaggtctcgtcctccagagaagtttggtgtttgctagtgttaggyggtgagtgggaggagcatggggatatcaccaactcaggaccttggtttgtgttaatttcttctcctgagggttctcagacttgacaggtagtctaagttc

SEQ ID NO: 49125 - DNA, 201 bp, Homo sapiens
gtagaacagtgggagtggagaaagaacaaagaaatctgtaattggttataatcaattagttgtacacgtccctgcactcagaccagccattaccttctctmataataagcttttagatgcactatcccccattaaagggagtggcgagtgtataaaggatcctctcaaagagatgaatctgggggctttactttcctgtgg

SEQ ID NO: 49126 - DNA, 201 bp, Homo sapiens
ttacatttcactgtagagaaagtctttcttatgtgtgtttctaaagtttctactaatttagtttttcttttcactcattagattttgcagcacagaagtcytaaaattttgattagtcaagttttatcgatgctttttggtcatatttagaaatattcccctcttcagagcttataaatatattttttcattttcttctta

SEQ ID NO: 49127 - DNA, 201 bp, Homo sapiens
ttttttttttaaactagggttagaatcttttgatctagtgtatgaacatgttcatagttagtagtttttgccaaactgtttttcaaagctattgtactaarttttactttcactagcactgtaggactgacctcactgactcttgacattttccaacttggtaatttttgccaacctgatggaaataaattggatctcact

SEQ ID NO: 49128 - DNA, 201 bp, Homo sapiens
gatgttggaatttcatcttagatgatgtatagaagtttgctaagtaagcctaggcaaaggaattatttctattagatattctttataccctgaattgaatraaatattcaattacttttcttgtattgtaattagtatttcacttagctatgacaatagccgttgttaggcatgtacatcttgtataaatccttagagtgg

SEQ ID NO: 49129 - DNA, 201 bp, Homo sapiens
tataaggaaagggattaatttatttttatttttatttttattttttgagatggagttttgctcttgttgtctaggctggagtgcaatggcgcaatctccasctcactgcaacctctgcctcctgggttcaagtgattctcttgcctcagcctcccgagcagctgggattacaggccaccacacccagctaattttttgtat

SEQ ID NO: 49130 - DNA, 201 bp, Homo sapiens
ctgctatttttgatatgcggtggccttagctgtggagcgagaggccgataattgtgatcactccggaaatcctgggaagccagaagtgggagatgggtgtkgtgaggtggcgtggctagggagaccccatcgagtgggtgtgttataagacctgggcgaatccctgtggctgccactctcctgagaatgttccctaggcct

SEQ ID NO: 49131 - DNA, 201 bp, Homo sapiens
tttaatgaagaaaggaagtgaaaagagataaaaagaggcctgtctctgcatactgtactaggcatcttccatgtcagtatcagcattctgccttcctcgayaagactctcagcctgggaaagaaggaaaccaagaattatcctcacaaccagaattgttctagagattttgtggaaacacatttattaaagactgatatag

SEQ ID NO: 49132 - DNA, 201 bp, Homo sapiens
ttagaaaaacttttggttttgtttgttactctattcattgggtaacaaagagcatttttctaatcaaggctgcctaatactacatataaacgaattaataygaacaaatagcttgtgattgtttcaaacaataatagggaagaaagcttgcattgtcacgcctgctgggattgctgtttagttagttgaaagatatgcctt

SEQ ID NO: 49133 - DNA, 201 bp, Homo sapiens
agaaggtaaaaataatttagatatagcatcttcttaggcaagcataataagcagctcactcagtcaccttagcctggtattgtctggcacatcaacttgcwttcttttccagtgaattcagggaccttgtaaagataaatccacattcaagtgtgaaaggcctgaaaatccttttctaaggccaaaacaacaattttttag

SEQ ID NO: 49134 - DNA, 201 bp, Homo sapiens
agcttctactgatgtcttctctcttattatcagttttgcccaagttcaaagaaggtaaaaataatttagatatagcatcttcttaggcaagcataataagsagctcactcagtcaccttagcctggtattgtctggcacatcaacttgctttcttttccagtgaattcagggaccttgtaaagataaatccacattcaagt

SEQ ID NO: 49135 - DNA, 201 bp, Homo sapiens
ttaatgaatttaacattgatcttaaaagaagtctttgttagcttaatggtcccagcctttgaaatagacctgggttcaagttctgactttcgataatagtkttattgagcaagtttattaattaaccttaaccagggtagttgcattattctcaccgtattttgggaatagtggcagcctctgatggttggggaactaagc

SEQ ID NO: 49136 - DNA, 201 bp, Homo sapiens
aatggataatgaaagtcctagaacatacattcttaacatagttatattgccccaagaggacaaaaattgggttttgggagatgaaaaaaatccctccagarcttatacctctatccaacaaaatcttattccttagtatttagttttttctcattagaaaaaatttaaatgtaattaatttttctccttaaggatcactaa

SEQ ID NO: 49137 - DNA, 201 bp, Homo sapiens
gaggggtttacgttctttgcaactcgaagcatcatttctgatttcctgatacagattgaaaaaatgagaatgaacataggaggcacacatatgaattgccraatttagccaataaaaataattgcatgggatatacttatactaaaaaacaaatacttcttttttatttgaaattaaaatttaactgggtatcttgtgttt

SEQ ID NO: 49138 - DNA, 201 bp, Homo sapiens
ttttaaaatgaggatgtctacacagctatatattactccaagatatcgtatggaggaaaaagaaagcaagacgcaaaatagtacttatgggaagataccaytaaaattctaaaacaagactgtgtatttttagggagaagtatatggtacattaatggaaatggataatgaaagtcctagaacatacattcttaacatagt

SEQ ID NO: 49139 - DNA, 201 bp, Homo sapiens
tagaaagacttaatgaattcaggaatgtggacatgattgaaatactattcagtcattttatttatttcttttttttttttctgagacagagtctcattctrttgcccaggctggagtgtagtggcacgatcttgtctcactgcaacctccaccttctgggttccagcaattctcctgcctcagcctcccaagtagctagga

SEQ ID NO: 49140 - DNA, 201 bp, Homo sapiens
agtcactctggagggtaattcaacagtatctattaaaattatacacttctgcacatgccctgctcctgtcttggaatctacattagaaaaccactcacacrtgagcccaaggagtgtataaggaatgtataaagatattcattgaagcattggttgcaaaccaagaagtacaaaattttgtgaatatccaatagtagaaag

SEQ ID NO: 49141 - DNA, 201 bp, Homo sapiens
gtggtactcctttgtatattggtccagtctgagaggaaaggccaagctataaattgaggagctggaatcagtgagtttctgaactaaagcaaaagaggctstatttagacattctttaaaaggtgtgtgtgtgtatatgtatgtgtgcgtgtgtataaaacgatcagacggtagagattagagcactggctttgtttaatt

SEQ ID NO: 49142 - DNA, 201 bp, Homo sapiens
catacaatcactgggggaaatgtgtactctcgtaaattctctgtgggaaagtaaattggtacagtcactctggagggtaattcaacagtatctattaaaaktatacacttctgcacatgccctgctcctgtcttggaatctacattagaaaaccactcacacatgagcccaaggagtgtataaggaatgtataaagatatt

SEQ ID NO: 49143 - DNA, 201 bp, Homo sapiens
aattttcatacgactaaaatctttgtgtatgtcaaagatttgtgtatgaaggcttaacttattgattagttttttaacataccaaattgcagtaactaaaycatctactattgtgagttatttttcctctcacgtttacttttccttagccttattttacagctaaattttataaaaaagatttgattcatttttgaatca

SEQ ID NO: 49144 - DNA, 201 bp, Homo sapiens
tttgtcccaaattgagtataactttgagcaagaatcttaatctctctgaatttcagccccttcatctgccaaatacagaaaatatattttggtgaggatcrtattggataatgaatgtgagagctctttttataggaagtgccacacaaatgtaagttatgaatgttttcgcagctgctacttatagagcagtgacccaaa

SEQ ID NO: 49145 - DNA, 201 bp, Homo sapiens
acatgttaattgtgtgacctagagcagtatatttgacccttctgagcttctattcccatctataactgggtagagtactgtctcccaaatgaggagattgytgagaaaattagatttgttcaagtgcttagcatgctgcctggcacatgctgcggtgaatgtaatgttctcatactttacctgtggctcacatacatgaaa

SEQ ID NO: 49146 - DNA, 201 bp, Homo sapiens
gctgggatgttggattcaaacctatgaaaattcctcaacttaagagtatttggacagatagcacagaagtcgtggcttttagaccttagcttttccctacyggctttctgtttgcattaagctagtatttgacacttgatgtctagggattcttacctcctttggccaatggtacttcacacccatatgctagtcctttta

SEQ ID NO: 49147 - DNA, 201 bp, Homo sapiens; identical to SEQ ID NO: 14057

SEQ ID NO: 49148 - DNA, 201 bp, Homo sapiens
tatcattatcaaagtctactgtctgtccttcctcttttttcctccgtcttagaccagggagcatagtagatgaacatcatgcaggccagcacactgaggcyacgtgtaagcaggtgggaagattatgtgcatgaaacagacagtcgcataccacttttggttacaaacacttgccctggatgagagcaggaattgagacca

SEQ ID NO: 49149 - DNA, 201 bp, Homo sapiens
agacaggcactagtgctgaggactgcccctctctccaaggaaaacacttcccaggtggagcctttttttgtggcaggatcccctttgctagtgctgcaagycacctgctgtttctcattggaggaagggagtcttaggcttggtgagtaaggagagtgctttcctgtcttcttatggtcagcaggtgtattagtctcatgc

SEQ ID NO: 49150 - DNA, 201 bp, Homo sapiens
aatttcctttaattaaactgagataagatcttgctctgtcacctatactggagtacagtggctagatcacagctcactgcagcctcaacctcctggtctcmagccatcgtcctacctcaccctgttttttgttttgttttgttttttgttttgttttttgaaacagggttttgctctgtcacacaggctggagtacagtag

SEQ ID NO: 49151 - DNA, 201 bp, Homo sapiens
ctagtcccttttcttctctaagcctcaattttttcttctgcaaataggtggggttggacggggtgctatctaatcacttgacggtattatggtagtctacytttatccgaagcttcactttccacagtttcagttacctgcagtcaaacttggtccaaaaatattaaatgaaaaatttcagaaacaaacaattcacaagtt

SEQ ID NO: 49152 - DNA, 201 bp, Homo sapiens
tatgtcacatagagcaagataatgtgaattataaatacataagagggagaaaggaaaaatgaaagtaggagtgggcaaaaaataatgccaggaataataartacatgagaaggagaaaggaaaaatgaaagtaggagtgagcaaaaaatagtgccaggaataagttcagtgtaaaacagtgcaccttggggttcctgtaat

SEQ ID NO: 49153 - DNA, 201 bp, Homo sapiens
caaactgttggggaaatgactgctccaaagctcagcatccagtggcctttcatgaaatcccagtctcgcatctttccctctgctgttgttagtaataacgycatatgacatatttgtttggtggatctcatccatttctatttcgctttccttactctaagctaggtgcctctatttaccttttaggcaactctctatatt

SEQ ID NO: 49154 - DNA, 201 bp, Homo sapiens
ctgcctcaaactgttggggaaatgactgctccaaagctcagcatccagtggcctttcatgaaatcccagtctcgcatctttccctctgctgttgttagtartaacgtcatatgacatatttgtttggtggatctcatccatttctatttcgctttccttactctaagctaggtgcctctatttaccttttaggcaactctc

SEQ ID NO: 49155 - DNA, 201 bp, Homo sapiens
atcgtgccattgcactccagcctgggcaacaagagtgaaactgtcccaaaaaacaacaacaacaacaacaacaacaacaacaacaacaacaacaaaacaaaccagaaagattctatcagactgctccaaaatagtgtttcagctcacagtttatatacaggttcagtgcatataaaatcacatcaaagtttgggtgcaaga

SEQ ID NO: 49156 - DNA, 201 bp, Homo sapiens
tctcctctgtaaaataactgaatagtatctgcctcaaactgttggggaaatgactgctccaaagctcagcatccagtggcctttcatgaaatcccagtctygcatctttccctctgctgttgttagtaataacgtcatatgacatatttgtttggtggatctcatccatttctatttcgctttccttactctaagctaggt

SEQ ID NO: 49157 - DNA, 201 bp, Homo sapiens
gatcgtgccattgcactccagcctgggcaacaagagtgaaactgtcccaaaaaacaacaacaacaacaacaacaacaacaacaacaacaacaacaaaacaaaccagaaagattctatcagactgctccaaaatagtgtttcagctcacagtttatatacaggttcagtgcatataaaatcacatcaaagtttgggtgcaag

SEQ ID NO: 49158 - DNA, 201 bp, Homo sapiens
agcagctctctgcctcagcctcctgagtagctgggattacaggcgcctgccgccacgcctggctaaatttttttttttttttttttgtatttttagtagasacggggtttcaccatcttggccaggctggtcttgaactcctgacctcatgatccacccacatcggcgtctcaaaatgctaggattacagacgtgaaccac

SEQ ID NO: 49159 - DNA, 201 bp, Homo sapiens
gcaggtgcatgccaccacacccagcttactctttttttgattagcaaactaatgcatattcattaaggaaaaaaaagaaaatcatttagaattttaccttycataattaaccaaaatattaagttgaatatactgtttctttctagtcctttgctaattaatagtttattcaattcatataatgcataccactttatagat

SEQ ID NO: 49160 - DNA, 201 bp, Homo sapiens
agatcgtgccattgcactccagcctgggcaacaagagtgaaactgtcccaaaaaacaacaacaacaacaacaacaacaacaacaacaacaacaacaaaacaaaccagaaagattctatcagactgctccaaaatagtgtttcagctcacagtttatatacaggttcagtgcatataaaatcacatcaaagtttgggtgcaa

SEQ ID NO: 49161 - DNA, 201 bp, Homo sapiens
tataatgcataccactttatagattctttaaaagattgtcttgagcatttattatgccattaagtaatctttgaaagtgtgatttttctacccaaagttcrgtacattcatatgatgaaatatataatcattagacatttacgttttcttttttttttttttgctattataataacattaagataaatatctcttatgatt

SEQ ID NO: 49162 - DNA, 201 bp, Homo sapiens
aagatcgtgccattgcactccagcctgggcaacaagagtgaaactgtcccaaaaaacaacaacaacaacaacaacaacaacaacaacaacaacaacaaaacaaaccagaaagattctatcagactgctccaaaatagtgtttcagctcacagtttatatacaggttcagtgcatataaaatcacatcaaagtttgggtgca

SEQ ID NO: 49163 - DNA, 201 bp, Homo sapiens
ttgttttaggtatttggtgtggcactcagtaattagcaaggtcattgtcacttggcatggctgcccttgccaggagccagctgggagtgtctttttcccaygtgttttctgtggtagtcatcatggccacctgtcaaccagaagtaaatgcagccagaggttacttgcttggctggcctctgaagccaggagcccttttaa

SEQ ID NO: 49164 - DNA, 201 bp, Homo sapiens
ccaagatcgtgccattgcactccagcctgggcaacaagagtgaaactgtcccaaaaaacaacaacaacaacaacaacaacaacaacaacaacaacaacaamacaaaccagaaagattctatcagactgctccaaaatagtgtttcagctcacagtttatatacaggttcagtgcatataaaatcacatcaaagtttgggtg

SEQ ID NO: 49165 - DNA, 201 bp, Homo sapiens
agattttttagggaatatcagtttagtaaaacttatttttttgtaagcggactccttttgtatcagaattcctttcctttaaaaaatatttttatatttaytattattttttaagtagagatggcatcttgctatgttggccaggctggtctcgaacccctggtctcaagtgattgtcctgccttggcctcggagagtgtt

SEQ ID NO: 49166 - DNA, 201 bp, Homo sapiens
ctcctgtctaactgtaaatatgtatcctttgatcaacatcttcccaactccctctccccacaaccaccccagcctttggtaaccaccactttgctctctayttctgtgggaaaaacttttttagattttgaattaccactttttaagcatcctgtttttgtttgaataagtgcaatatattcttctcgatgttactattgt

SEQ ID NO: 49167 - DNA, 201 bp, Homo sapiens
tcgagtgttagctgccctcaaattaaaaatatctagtagcattcctctgaattcactgtggcaccccaaggttcctgggggcacagtttgggaaccagagycttacagtatttctggtttctggctttacttcagttttgttttctttcatctcattgactcttcttccccagttcctacttttatttcttggttccagct

SEQ ID NO: 49168 - DNA, 201 bp, Homo sapiens
tcttagtattctgggaaaagacgtctatagtgtgacttttaaaatagcaggacatattttgtccttcaaatatattgttattaataagattttttttttttgagatggagtcttgttctattgcccaggttggagtgcagtggcacaatcttggctcactgcaacctccacctcccaggttcaagtgattctcctgtctta

SEQ ID NO: 49169 - DNA, 201 bp, Homo sapiens
ctggagtacagtagcgatccttgcttactgcagcttcaaactcctgggctcaagggattctcccactttagcctcgtgtgcagctaggactatagtcaagygccgtaacgtctggctaattaaaaaaaaaaaaatttgttgttgttgttgagatggggtctcattatgtttcccaggctggtctgggactcctggcctcaa

SEQ ID NO: 49170 - DNA, 201 bp, Homo sapiens
tgggttaaacatttcctggtttattggaggcagatttccttgggccagcaagcattgaaactcccacagtggtgtcatgtgatggttctccagcgaagcaytttggatatggtgacagctgctttagtttaagtatctggaacatctaatgtgggagaacttggctaagtgatgtgagaagttaagagaggagtctgaagt

SEQ ID NO: 49171 - DNA, 201 bp, Homo sapiens; identical to SEQ ID NO: 14062

SEQ ID NO: 49172 - DNA, 201 bp, Homo sapiens
accagcctgatgacatggaaaaaccccatctctacaaaaaaacaaacaaacaaacaaaaaacaaaagttagttgggcatggtggtgcatgcctcttgtccsagctacttggaaggctgagttggaaggatagcatgaggcctgtaggtggaggctacagtgagctgtgatcgtgccactgtactacagcctgggtggcaga

SEQ ID NO: 49173 - DNA, 201 bp, Homo sapiens
atcttactgtcttttttatgatacagcaaagtgaagactgaggatcctgagtgtgcatagtgcatgcatgttatgcgttatatgtgtatgcatacatatgkgtatatatatagttttacaagtttaaaataatatcagtgacttgaaaattgtaagggcttaccagataatctctttgtaggccttggagtagcattgttt

SEQ ID NO: 49174 - DNA, 201 bp, Homo sapiens
agtcatcaagaaatgctgatgggttacttcagaattgtttcagattaaaggacagcctggtgtcactctgtgactatggtaatggcatagtagggaatacwgcttcccactttgctatctctaggttaggagaaccaataacagttcacccaaaatatccacatttcttggaggcttatcctttgcgtattcactgaagaa

SEQ ID NO: 49175 - DNA, 201 bp, Homo sapiens
ctctaggattttgggggagaaactttatcttaaattattctaggtatgaaatcatttacaaatgtaatttttattttaacatggtgggagtgagaaatacrgaccactaaagatgctcacatccttatccctggaacaaaaagatacttttcagatgtgactaagttaaaggccttgagatagggaggttttatgctggat

SEQ ID NO: 49176 - DNA, 201 bp, Homo sapiens
ccattttatctaaattgttgtatatctgtaatagttttctaaagtttttagaataaatttgtcctttccaggtttcagcattgatggtttcttctttcctyctttattgcttttcattcatctattctgttttggagacgaaggctttaaaatctttacccacgtagcttcccccagctacctctgagaagtctgttttat

SEQ ID NO: 49177 - DNA, 201 bp, Homo sapiens
aagtctagctaattaacaaatgcattacctcacatagccaccatttgtttgcggtaagaacagttaacatccactcccttggcattttccaagaataccaygtatcatcattatctatagtcactgtcctacacgatggatctgaccttattcctcctaactgcaatagatctcctgtctaactgtaaatatgtatccttt

SEQ ID NO: 49178 - DNA, 201 bp, Homo sapiens
aatagccatattaatatttttgtatattttataccatttgataactcttactaggaattagtagaagaaaataacatctctctctctcaatagttaatacscaactcttcattttcccttttgctttggttaccagagagctcagagtaaaattttgcactcagttttgaaatacctatttcccttgcttactttaatcca

SEQ ID NO: 49179 - DNA, 201 bp, Homo sapiens
taaacaacaaaaacaaatgagaatttgtaaaatataaaaatcatagtaacttagcatccataataaaatctctattagtgtttgtaagtaccaagtctttycccctccatatttagacatataatttattcaattattgattagaaattataggtaaaaatcatccaaatcatgcaaattctgaaaaactagaaatagcag

SEQ ID NO: 49180 - DNA, 201 bp, Homo sapiens
ccaccatttgtttgcggtaagaacagttaacatccactcccttggcattttccaagaataccatgtatcatcattatctatagtcactgtcctacacgatrgatctgaccttattcctcctaactgcaatagatctcctgtctaactgtaaatatgtatcctttgatcaacatcttcccaactccctctccccacaaccac

SEQ ID NO: 49181 - DNA, 201 bp, Homo sapiens
aatagaattctaggttgtcaactgccttcctcattgcttcattgtcttctagctttcagggttgctgttgaaaagtccagagactttctgattcctaatcytttgcttatgagcttccctacctgctttttgatattttataggacctttttaatatccttacagttaaaaaaacacaactcatgatgacagatgctgtgt

SEQ ID NO: 49182 - DNA, 201 bp, Homo sapiens
tcacatggaagtgtgttgcctgtgatctgaatttttattcctaaataaattagagattaaaatctgtggtttccagttcaagggtagggtaccaaaaaaawttgtctgatgtgggtttttatgtcattaagaaaggcggcaacagctaagtattattggcttttcccttttcttggttgcactggtccttttcccttatct

SEQ ID NO: 49183 - DNA, 201 bp, Homo sapiens
taggtcatgattttgactaggccattattcagtgttaataggatgatgaccttgttaatgctgttcatacctgagccatgtagaattctatgaatcctttycctcttctgcaaattttttgttctatttaaactaattgttcttttgatgtttgcttagttttctatgtgctttttactcattcagtcctaaatgctcttg

SEQ ID NO: 49184 - DNA, 201 bp, Homo sapiens
gttttcttccaatgatgagatgctataaattttatgaacaacatacttaaaatagctttaagacactctacacgaattcgaggctgaaataagactagttaaactataatcagtcaattgattattaaaaccaagcacagacttacacccactacatacacttatgctcacaaatgataaatgccaggatagtttggattg

SEQ ID NO: 49185 - DNA, 201 bp, Homo sapiens
cccacatcctctccagcatctgttgattcctgactttttaatgctcgccattctaaatgatgtgagatggtatctcattgtggttttgatttgcatttctstaacgagcagtgatgatgaacattttttcataagtttgttggctgcataaatgtcttcttttgagaagtgtctgttcatatcctttgcctactttttgat

SEQ ID NO: 49186 - DNA, 201 bp, Homo sapiens
ccgtgagccgctgtacccggccaagaacattttaaagtttttttcataccttagcttatatttgaaaagaagttattttatcttccaactacaaagttatyacaatattgacaatatacacactcagcactagttaatctgccctcaacaaccttaaaaaaaaaaaaaagactttattttggcctatccaaaagaatgaat

SEQ ID NO: 49187 - DNA, 201 bp, Homo sapiens
ccatttagccaggacggtctccatctcctgacctcgtgatccgcccgcgttggcctcccaaagtgctgagattacaggtgtgagccaccatgcccggctgygattttacatttctgtttgttttgtggaactctcaacgtctctttggcatcaggaaagccagacttcattttgtttcatgtgtgacattgtttataattt

SEQ ID NO: 49188 - DNA, 201 bp, Homo sapiens
agttttcttccaatgatgagatgctataaattttatgaacaacatacttaaaatagctttaagacactctacacgaattcgaggctgaaataagactagttaaactataatcagtcaattgattattaaaaccaagcacagacttacacccactacatacacttatgctcacaaatgataaatgccaggatagtttggatt

SEQ ID NO: 49189 - DNA, 201 bp, Homo sapiens
aacatatgtgtgtatgtgtctttatagtagaatgatttataatcttttaggtgtatacccagtaatgggatggctgagtcaaatggtatttctagttctaratccttgaggagttgccacactgtgttccacaatggttgaactaatttacactcctaccaacactgtaaaagcattcctattttccccacatcctctcca

SEQ ID NO: 49190 - DNA, 201 bp, Homo sapiens
aagttttcttccaatgatgagatgctataaattttatgaacaacatacttaaaatagctttaagacactctacacgaattcgaggctgaaataagactagttaaactataatcagtcaattgattattaaaaccaagcacagacttacacccactacatacacttatgctcacaaatgataaatgccaggatagtttggat

SEQ ID NO: 49191 - DNA, 201 bp, Homo sapiens
atgtccctgaaaaggacataaactcatccatttttatggctgcatagtattccatggtgtatatgtaccacattttctttattcagtctatcatttgatgkgcatttgggttggttccaagtctttgctattgtgaacaatgctgcagtaaacatatgtgtgtatgtgtctttatagtagaatgatttataatcttttagg

SEQ ID NO: 49192 - DNA, 201 bp, Homo sapiens
ctattgcatgctacatgtgtgtatacatgcatttaaatgtatatagtagtattatataattgatatcatactcaaggttcccttatcctttaaatttaacrtctaacattttaccataaggttatatcactgtatacttacctgtttgtttgattttagtcattcatgttattaccatgattttcatattgataatttgat

SEQ ID NO: 49193 - DNA, 201 bp, Homo sapiens
gaagttttcttccaatgatgagatgctataaattttatgaacaacatacttaaaatagctttaagacactctacacgaattcgaggctgaaataagactagttaaactataatcagtcaattgattattaaaaccaagcacagacttacacccactacatacacttatgctcacaaatgataaatgccaggatagtttgga

SEQ ID NO: 49194 - DNA, 201 bp, Homo sapiens
gcccatttttttcccattatgatttgatttattttccccatttgatttttttaatgggatttcttttaatttttaaagcttattaacttaaacctgttttkcacttatcatttacttcatagttttcctggaatttgtcacacttttttaaattatggtaaaatacacataacataaaatttaccctcttaaccatttaaa

SEQ ID NO: 49195 - DNA, 201 bp, Homo sapiens
attgacagaagtgagaagtaagacactcagaagtaagcaagagaggaaaagaaggcacactcgttcaatttttcttctttctcagggtagtcagtgtttcrtttttgatgataacgtatggaaaaatagctaaaatctacatctaaggaatttaaaccattcatatccatttacatcttcataattccagaaatttattct

SEQ ID NO: 49196 - DNA, 201 bp, Homo sapiens
gataactgctcattgcagccttgaactcctaggctcaagcaattctcttacctcagctacctgagtagttgggaccacagatgtgcaccaccatgcctggytaatttaaaaatttttttgtagagacagggtctcgctatgttgtccagcctggtcttgaacacctgggctcaagtgatctttctgccttggcctctcaaa

SEQ ID NO: 49197 - DNA, 201 bp, Homo sapiens
ttggttattttggtaagtgtcaggatagcattcctctccatcaggaccacttctaaagtgaaaactatacagctgggaatacagtctttgaaattaagacrgtgtttacttatataagttttggccagtttctccagcttctagaatacctgacctggcccatcatgacctgataaaatacatgtaaaaaggcgcaattgt

SEQ ID NO: 49198 - DNA, 201 bp, Homo sapiens
attgcaataaagtgagtcacacaaattttttggtttcctggttcatatgatagttatgtttgtaatatagtctattaaatgtgcaatagtagtatgtcttwaaaaagtatgtgcataccttaatttaaaaacagcttatttctttaaaaatgctaacagtcatctgagccttaagtcataatcttttgaaaatattttttc

SEQ ID NO: 49199 - DNA, 201 bp, Homo sapiens
cctagctttaccatcaactgagaccaacccagattcaattctgcttttgtggactaccaggatactgagtgtgtatgtgtgtgtgtgtgtgtgtgtgtgtgcgcgcgtgcgtacatgcatgtgtgtgtttgtgtttgttaaaacaataacaattcggcaagcataggataaggcattggttttcactgtttactgtcatca

SEQ ID NO: 49200 - DNA, 201 bp, Homo sapiens
ttgtggagacagagtttcactatattgccctggctggtctcaaactcctgggctcaagcaatcctccggccttggcctctcaaagtgctggaattacaggyatgagccaccatacttggctgaaaattacttctcatgttagaaacatgcacttactcttagaatgaaatatttttcaagactcatctgtggttggaagag

SEQ ID NO: 49201 - DNA, 201 bp, Homo sapiens
aaatttcaaatagccagatatacaagacctttgtgaccttggtcatcttatcttctgctacttctgtttctgatgttacaataaataaccacacttcttcwtcctttttttttttttttttttttttttttgagatggagtcttgctctgtcactcaggctggagtgtggtggtgtgagcttggctcactgcaacctctgc

SEQ ID NO: 49202 - DNA, 201 bp, Homo sapiens
tcctagctttaccatcaactgagaccaacccagattcaattctgcttttgtggactaccaggatactgagtgtgtatgtgtgtgtgtgtgtgtgtgtgtgtgcgcgcgtgcgtacatgcatgtgtgtgtttgtgtttgttaaaacaataacaattcggcaagcataggataaggcattggttttcactgtttactgtcatc

SEQ ID NO: 49203 - DNA, 201 bp, Homo sapiens
tttcctactttgtatacaaacacatcagaaaaccatctttcaaggataactttcttatgttgaggcagttttaaatcacaatcattcaagcactcagtatygattttgattcattctcccaaaggtgcttgaattttaagctacttgaaaccttaaataatggaagatgtctctgttaagagaactctctgctgttgaaca

SEQ ID NO: 49204 - DNA, 201 bp, Homo sapiens
cagtgttcctgaaaataaaaaaatctgatcgcctgccctcctttatccattactaataaacagacaaaccaaaagccactaccaagtagtgaaatggatakagctaaaaatcaaatatttgaccttgaaaataagtccacgatatcacccaggataccaaataaaaagtaaagtgttaaaaatacaaatgaaaaattaaga

SEQ ID NO: 49205 - DNA, 201 bp, Homo sapiens
atcctagctttaccatcaactgagaccaacccagattcaattctgcttttgtggactaccaggatactgagtgtgtatgtgtgtgtgtgtgtgtgtgtgtgtgcgcgcgtgcgtacatgcatgtgtgtgtttgtgtttgttaaaacaataacaattcggcaagcataggataaggcattggttttcactgtttactgtcat

SEQ ID NO: 49206 - DNA, 201 bp, Homo sapiens
tgcactctagtcagggcaacagagccagaccctctctctaaataaataaataaataaataaataaatactttatttaataaatgaagcaaaacaaaaagawcactgatcacagatcaccataacagatataataatgaaaagtttgaaatattgtgaggattaccaagatgtgacacagacaccaagtgagcacatgctgc

SEQ ID NO: 49207 - DNA, 201 bp, Homo sapiens
tgcagtattcagtttctttcctgctctctcgatgttactccaagtcaggagttctcatgactccactgaactgtcatcagtgtcctccttgccactaaatwcattttttcagttttcaggtattttttacttttctcattctctccagtatccagtctgttagccatacatatcagctgtatggtcaaaatgtgtctatga

SEQ ID NO: 49208 - DNA, 201 bp, Homo sapiens
acttccttcatccttaagttggccttcaaagcatatatatccaatgtcactccatagaaactttggttttacaagtaaatatatagttcatttactttatrtgatatatttgttatgttttgtatttgctgactatatgcattttatgtggaaaagcattttaatttaaaaagtttcattctagaagaaaatcagctgttt

SEQ ID NO: 49209 - DNA, 201 bp, Homo sapiens
caaagggtgtgtttgtctggcttttgatacatattgccaaaatcatccttcagggacaggatgagatttttccatactgaaacccctgatcacagtgctcraaagtgcagcaacttcattaaactgaatattataaatttagaaagattatcaatgtgttgggggcaatggcattttatttttaaaattagattatttaat

SEQ ID NO: 49210 - DNA, 201 bp, Homo sapiens
tccctaaagagttccctccctggcttatctattttcctcaaacatctcaactaggtcaggccctgtcattaaaaaacaagtgggtctcccctagtttcccrgctaagaagatctggcctctgccttaggccctgactagggggccccgtgctgcaataactggttgtgcagcccacccagcctagtggccaggccccagtg

SEQ ID NO: 49211 - DNA, 201 bp, Homo sapiens
cgcttcaacctgggtgacggaggttgcagtgagccaagatcatgccactgcactccagcctgcgtaatagagcgagaccccttctgcaaaaaaaaaaaaawaataaaaaaaagcaaaggcatattttgttttaaatgcatttcattgtccagtgtacccaaccatccatatatgacctagcacttctcaaggacaaattat

SEQ ID NO: 49212 - DNA, 201 bp, Homo sapiens
gtttattatttgcaggtgtagaagctcttaagttttagtttgtagtgtttctaaaagtgaggcattctcttgaactgtctttgatgatttgatgttcatayattatgtctgctgtgaatttggaaagcactgcagaatcactttttcaaagatcagaggaatgtgggatagaataaattaagtttctggctaatatttggt

SEQ ID NO: 49213 - DNA, 201 bp, Homo sapiens
cccatttgctatcatgagaacagcacgggcaagaccctcccccatgattcagtcatctcccatggggtcccttccgcaacacatgggaattatgggagctrcaagatgagatttagatgggaacatagagccaaactatgtcaggtaggaaggcaggattcaggaaaataaaattctctgtctgattaaagagttcactaa

SEQ ID NO: 49214 - DNA, 201 bp, Homo sapiens
gtgggtatttgtgcttgtgacatttgctggtatatggtcacagtgtaatgatgtatgtgtaagttcagaagcagcatagaggaggtggtgattaatctggrtggggaataggacccataaaaggcttcattgaaaggctgtgactggaaagatgagtagatatttgccaggcatagaatttggacaagggagggtattcca

SEQ ID NO: 49215 - DNA, 201 bp, Homo sapiens
agcaagacagttcagacaagcagctcactgctggctctgtccaagcatagacattccacattctttgtggagtgctgaattagatacttttcaggatgttycctatgaatattacttcatgcaaaaggatatttttgataagaactgagtagcagtaagttcaaggttattaagctcaatactgcatcctctctttgtggt

SEQ ID NO: 49216 - DNA, 201 bp, Homo sapiens
aagaatgggtaaagattagaattctcttgagacttttttttttttttttttttttttgtgacggagtctcgctctgtcacccaggctggagtgcggtggcrggatctctgctcactgcaacctccacctcccgggtggttcaagcgattctcctgcctaagcctcttgagtagctgggattacaggtgtctgcccccacac

SEQ ID NO: 49217 - DNA, 201 bp, Homo sapiens
gatatagttttaatttactgtaggactagtggcagtgagtctcatattgctgtcatataaaaggtaaaccttccagaagaactttggaaatttcagtagcytaaagaccacgctttgagaaactcgtaaaggtttgtcatagaggttttaaaagtctgatcaaataattttaagctttagttgcctactaaaaagtaggat

SEQ ID NO: 49218 - DNA, 201 bp, Homo sapiens
ttaggagtggaattgctggatcatatgaaaatgctatttaatattttgaggaactaccagattttcacagtggctgcaccttttatattcccaccagcaaygtataagggttccaatttctccacattcttaaccaacacttgttattatgtcttttaaattatagccatcctagtagttatgaagtgtgaatttggcttt

SEQ ID NO: 49219 - DNA, 201 bp, Homo sapiens
aatcctagctttaccatcaactgagaccaacccagattcaattctgcttttgtggactaccaggatactgagtgtgtatgtgtgtgtgtgtgtgtgtgtgtgtgcgcgcgtgcgtacatgcatgtgtgtgtttgtgtttgttaaaacaataacaattcggcaagcataggataaggcattggttttcactgtttactgtca

SEQ ID NO: 49220 - DNA, 201 bp, Homo sapiens
tcactccctatttatcctcttccaaactcctgaaaaacacgaatctactttctttctcatagatttacctatcttggacatttcatgtaaacaggcttatrgatttgtggccttttttgattggcttttcacttagaaaaaaatgcacaatactgcatgttgtagtatgtatctttctttctttttttgttgctgctcaat

SEQ ID NO: 49221 - DNA, 201 bp, Homo sapiens
tatgctggatgcttgctttggagaaatatgcagcatctaagttatatataatccacattttataaaaacccattggatgagggtgatattattttaaaaarattttaaagggctaaggaatcatatggaagatgaattcaattttaatgactacaccaagtttaaggaatattttataagaaatgggcttatgtgaaagag

SEQ ID NO: 49222 - DNA, 201 bp, Homo sapiens
gcgtgagccacggcaactggcctaaatcttttaagactttatatcatagtttgcagtttgacaacacttggaattaattttttttatcctttcagattcascaaacatggaaaaatatgattatcttatgtttatatgctggatgcttgctttggagaaatatgcagcatctaagttatatataatccacattttataaaa

SEQ ID NO: 49223 - DNA, 201 bp, Homo sapiens
gtagttctgatgcataagaacttttccagcatgctaagggggttgaaaggtactgtattagtttgttttcacactgctgataaagacatacccgagactgrgcaatttacaaaagaaagaggtttattggacttatggttcaacatggctgggaggccacacaatcgtggaggaaggcaaggaggagcaagtcacatctta

SEQ ID NO: 49224 - DNA, 201 bp, Homo sapiens
ctggtcttgaactcctgacctcaggtgatccacccacctgggcctcccaaagtgttgggattacaggcgtgagccacggcaactggcctaaatcttttaaractttatatcatagtttgcagtttgacaacacttggaattaattttttttatcctttcagattcagcaaacatggaaaaatatgattatcttatgtttat

SEQ ID NO: 49225 - DNA, 201 bp, Homo sapiens
gaaataatccccaaataatgaaaattcaacaatacaaagtgatgcagagacaatgatccttgacaacagtagtatagatatctgctcattaaaaaaaaaaatcaaaggccttattttagtctatatctagttatttttttctacttttcaatgtttctccctatctttctagaattagttctccagttgtctttttccttt

SEQ ID NO: 49226 - DNA, 201 bp, Homo sapiens
tcttttctattataggtgtttaatgctatggttttcctctttggcactggtttagtgacatcccacaaattttgatatgttttgttttcctcttcatttarttcaaaatattcaattcaaaagattttttaattacctcctttgacttctttgatttataaggtatatacagatacattacttagtttccagcatttgatg

SEQ ID NO: 49227 - DNA, 201 bp, Homo sapiens
ttacaggtgtctgcccccacactcagctaatttttgtatttttagtagagacagggtttcaccatgttggtcaggctggtcttgaactcctgacctcaggkgatccacccacctgggcctcccaaagtgttgggattacaggcgtgagccacggcaactggcctaaatcttttaagactttatatcatagtttgcagtttg

SEQ ID NO: 49228 - DNA, 201 bp, Homo sapiens
aacagaggtcatagtgagccgagatcacaccactgcactctagtcagggcaacagagccagaccctctctctaaataaataaataaataaataaataaatwctttatttaataaatgaagcaaaacaaaaagatcactgatcacagatcaccataacagatataataatgaaaagtttgaaatattgtgaggattaccaag

SEQ ID NO: 49229 - DNA, 201 bp, Homo sapiens
tttgagacttttcttcttttctattataggtgtttaatgctatggttttcctctttggcactggtttagtgacatcccacaaattttgatatgttttgttktcctcttcatttagttcaaaatattcaattcaaaagattttttaattacctcctttgacttctttgatttataaggtatatacagatacattacttagtt

SEQ ID NO: 49230 - DNA, 201 bp, Homo sapiens
actgggtatatatccaaaggattataaatcattctactataaagacacatgcacacgtatgtttattgcagcactatttacaatagcaaagacttgaaacmaacccaaatgcccatcaatgatagactggataaagaaaatgtggcacatatacactgtggaatactatgcagccataaaaaaggtgagttcatgtccttt

SEQ ID NO: 49231 - DNA, 201 bp, Homo sapiens
tctttctcttgctctttctcccaaatctgcagcaacttcctccactgaagtcttgaacccttcaaagtcatccatgagggttggaatgaacttcttataarctcctattaatgttgatattttggcctcctactatgaatcatggatgttcttaatggcatctagaatggtgaattctttccagaaagttttcaactaact

SEQ ID NO: 49232 - DNA, 201 bp, Homo sapiens
tgaatcagttggttttttcagtttatatttttgcttatggatatctaatagttccaccatgattttaaaattgtgacttcatatttaaaagtggagaaaakgctatactacactgtcttaatcatttattatacttttaatgtctctgacagggacaatagtaatgacccctctttcaattttattattagtcatttatat

SEQ ID NO: 49233 - DNA, 201 bp, Homo sapiens
gaggttttaaaagtctgatcaaataattttaagctttagttgcctactaaaaagtaggatgcagtacaagtttgtcctttacttggtaaaaaaaaaaaaaagtctttttctaattaagaatttattttcaccttagataattttattggcatgcctttttgcatgcaagatagaaaaaagacaagtttattcttagttttc

SEQ ID NO: 49234 - DNA, 201 bp, Homo sapiens
atttttttagataggatcttcctctgtcacccaggctggagtgcagtggcacagtcttggtgcattgtagcctctacttcccaggctgaagcaatcctcccacctcagcctcccaagtagctgggccacaggtgtgaaccaccatgcctggcttttgtattttgggtagaaatgacatctcgctatgttgcccaggcttgt

SEQ ID NO: 49235 - DNA, 201 bp, Homo sapiens
ggtgggaggccctgttctctattctgttttgtcttcaatgcacgtttctggagagctacacgttgtcacagagtcaggggctttgggaaagtatgttgacragcagaaatgagcaaatatgtcttcttacatttgttactttggctcacaggtatcttatctaaggaaactttgcttacgcaaagtacacaatgattttct

SEQ ID NO: 49236 - DNA, 201 bp, Homo sapiens
gggaatgctcctggaaggttaggatctggaaggatcctgggagataaaccaagcctagaagaggtaaaaaagggatcaagaggctttctatctccagtttygctactcctgggtaggtcaaagtgcctctctttttacatctggaaaataagaataagaactgatatctggttggtaattctagttttcatttactatgtg

SEQ ID NO: 49237 - DNA, 201 bp, Homo sapiens
ttagaatggaatctctagcccttctccttggacactgtttgcgtcatgaaaaaaactgtaatatggagacgctgtctccagcaagaaatttatggctatayttcaatagtttgttcaaatttagaccatgccagcttctatagttgatgaaagcctgaatatccaaacactatctccattaataaaatctcaatgttccca

SEQ ID NO: 49238 - DNA, 201 bp, Homo sapiens
aacaacaacaaaacaaaccagaaagattctatcagactgctccaaaatagtgtttcagctcacagtttatatacaggttcagtgcatataaaatcacatcraagtttgggtgcaagagtctatctagttatagattacagaagtgtaatcactaaccctgtcaggtgttctcttatgtgtaggaaaaggcaaggactaggg

SEQ ID NO: 49239 - DNA, 201 bp, Homo sapiens
attttcttcccctatgcctaggtggttctctttgaccaacccttaactgccctgattctgaaattctgctctaattgaaggatattcctgggtctttggarggagaaatggttcaggggcagaggaaactttttttccccccatctcaggagcacttaactgactgcctgctatataccaggctttgtgctagttttacta

SEQ ID NO: 49240 - DNA, 201 bp, Homo sapiens
tgtatacctatgtaacaaacctgcacgttctgcatatgtaccccagaacttaaagtataataataataataataataataataataataatataataatawgaccttgaaaacagatatgcaactcactgctgagatcctttacttttctatcttccctagacaactttaatccctaagtaatattcccatgacgtctcag

SEQ ID NO: 49241 - DNA, 201 bp, Homo sapiens
tccagagggccaggaagatggaagaaaacaagcaacagaggatgcttggaggagaaaaattcttgagctgggagctcatttcctcttttttttttttttttcctttcctcaagggactcaataatacttcccccacctcagatcaatctcttgttacctttattatttaaagcttgtgagtttgcttagctaatgcactag

SEQ ID NO: 49242 - DNA, 201 bp, Homo sapiens
gcacgtgtatacctatgtaacaaacctgcacgttctgcatatgtaccccagaacttaaagtataataataataataataataataataataataatataawaataagaccttgaaaacagatatgcaactcactgctgagatcctttacttttctatcttccctagacaactttaatccctaagtaatattcccatgacgt

SEQ ID NO: 49243 - DNA, 201 bp, Homo sapiens
aagtaatctttgaaagtgtgatttttctacccaaagttcagtacattcatatgatgaaatatataatcattagacatttacgttttcttttttttttttttgctattataataacattaagataaatatctcttatgattccttcctcacagagtaatgaatcataatgacttattgttaaatgttcttcagaaagcttgt

SEQ ID NO: 49244 - DNA, 201 bp, Homo sapiens
tttacaggttgcctagttacaatagtaatatacccaggtagccaaaaattcaatgcgatttgatagtggatctcattcaaagggatatttgccataaggtygttataattaagcagctacaactcctgcctctcaggactttttttaaggctaagttccagtgaaaacttcccgcattgccaagtcaatcctaagccaaaa

SEQ ID NO: 49245 - DNA, 201 bp, Homo sapiens
taagtaatctttgaaagtgtgatttttctacccaaagttcagtacattcatatgatgaaatatataatcattagacatttacgttttcttttttttttttttgctattataataacattaagataaatatctcttatgattccttcctcacagagtaatgaatcataatgacttattgttaaatgttcttcagaaagcttg

SEQ ID NO: 49246 - DNA, 201 bp, Homo sapiens
ctatataagctttaaatttggacctgtgccttctttttcatcatcttttctcctttttcttttagttcacagccatgaatgaaccacagtgcttctacaaygagtccattgccttcttttataaccgaagtggaaagcatcttgccacagaatggaacacagtcagcaagctggtgatgggacttggaatcactgtttgta

SEQ ID NO: 49247 - DNA, 201 bp, Homo sapiens; identical to SEQ ID NO: 14061

SEQ ID NO: 49248 - DNA, 201 bp, Homo sapiens
taaaccaaggagaaagtctgaagatagaactttaaaaaaccactgttatttccaggtaaaatatttaatttccaaagaaggttagcatatgttaaaagctwaatcttgttctgcatttgttggctacatttatatgaatttttatatggaagttcctatccagggtatttattagtcattttggaagtttttatccagggt

SEQ ID NO: 49249 - DNA, 201 bp, Homo sapiens
atgtgtctccctgaaattcatatgttgaaatctcagtccccaaggcgatggtattaggaggtgattaggtcataagggctccgccctcatgaatgagattmggggccttataaaagagaccctacagtcggtgtgttgactcacacctgtaatcccagcactctgggaggctgaggcagaagatttgcttgagctcaggag

SEQ ID NO: 49250 - DNA, 201 bp, Homo sapiens
gctgaatcaggaacattacatgactttctttggaggggaaggaagccagtggttagttttaggtataaaagagatcttcaagcacggtctttttaacttcytgtttctgtattatttcaggaaatagaggcagctttccctacattagattgttagcacagaataacagtagaagggttcagaaatgaagctaaaaggaaa

SEQ ID NO: 49251 - DNA, 201 bp, Homo sapiens
ctggaattgaactcagtgggctttagtgatcctcctgcctcagcctcctgagtagctagaactgcaggtgcatgccaccacacccagcttactctttttttgattagcaaactaatgcatattcattaaggaaaaaaaagaaaatcatttagaattttacctttcataattaaccaaaatattaagttgaatatactgttt

SEQ ID NO: 49252 - DNA, 201 bp, Homo sapiens
tatttattttttttgtagagatggggtctcaccatgtggaccaggctggtctcaaactcctggcctcaagcaattctcctgcctcaggcccacagactgcygggattacaagtgtgagccaccatgcctggctcccttcatattttaaagagaagttacacctacagcgctttcgacttttgatggacacatctttctaga

SEQ ID NO: 49253 - DNA, 201 bp, Homo sapiens
actcaggagactgaggcaggagaatggcgcgaacccgggaggcagagcttgcagtgagccgagatcgcaccactgcactccagcctgggtgacagagcgasagtccaactcaaaaaaacaaaaaacaaaaaaaaaccagttctgatgacatgttaattgtgtgacctagagcagtatatttgacccttctgagcttctatt

SEQ ID NO: 49254 - DNA, 201 bp, Homo sapiens
tggggtggaggaagccatggttcatcatataaaaatgtaaaagcaataagcacagtttcttcagtatcctgggccttgaaaagggaggatggggtaggggracgagagagaaggaagaagttggggtcaagggagtactttttctttcttgaataggaaacctagcatgtttatattctgaggactgggaaatgaggagag

SEQ ID NO: 49255 - DNA, 201 bp, Homo sapiens
tgtgagagctctttttataggaagtgccacacaaatgtaagttatgaatgttttcgcagctgctacttatagagcagtgacccaaattaaaaaaaaaaaaaagtgtggaatgctaagtaaaaaatgtgatgtagtgtagttgcaaaggcgttagctgtattctaattccagatttgccacttactcgttggattgactttg

SEQ ID NO: 49256 - DNA, 201 bp, Homo sapiens
agtcacatggaagtgtgttgcctgtgatctgaatttttattcctaaataaattagagattaaaatctgtggtttccagttcaagggtagggtaccaaaaawaattgtctgatgtgggtttttatgtcattaagaaaggcggcaacagctaagtattattggcttttcccttttcttggttgcactggtccttttcccttat

SEQ ID NO: 49257 - DNA, 201 bp, Homo sapiens
cttttttatttgaaattaaaatttaactgggtatcttgtgttttatctggcaactataacacacacacacacacacacacacacacacacacacacacacattattggctgggaaatacagcattttagatagcaatcaattctatattacatggattttctcctttgtcttataggcttccatattatcctggagttcaa

SEQ ID NO: 49258 - DNA, 201 bp, Homo sapiens
agaactagccagcaagggtactatattgtgttttaggtgtcatccttgaaggatagaataaatcagctgtcgtgttctcagtgaaaagtggaaagaagttktaaaggatctgcaaaatagaattatgagacagaggaaagaaagaaacagacaatctgatctctatcttcatcggccaggtaagatttgaagtgtttaaag

SEQ ID NO: 49259 - DNA, 201 bp, Homo sapiens
tcttttttatttgaaattaaaatttaactgggtatcttgtgttttatctggcaactataacacacacacacacacacacacacacacacacacacacacacattattggctgggaaatacagcattttagatagcaatcaattctatattacatggattttctcctttgtcttataggcttccatattatcctggagttca

SEQ ID NO: 49260 - DNA, 201 bp, Homo sapiens
ggagtttctccatgttggtcagggtggtatcgaactctcaatctcaggtaatctgcctgcctcagcctcccaaagtgctggattacaggcgtgagccaccrcgtccggtggaaagggattcatttctatatgtcagattaacatcctatggagaagaagaagggattgacagtgacgtgtatgtgtttcaggatctgaaag

SEQ ID NO: 49261 - DNA, 201 bp, Homo sapiens
tcatgagaattcccctcctttttctttccctttctcttttttgacacacccacatccattcacatctacctacacaccaagtccacgtataatttgatgtkcgagatggtgcttcatttctatgacatagtatgaaattactattgtgttccagcagctgttggctcgaattatactctgtaaatttttatcccgaatgaa

SEQ ID NO: 49262 - DNA, 201 bp, Homo sapiens
atgttactatttttcattccacttggtttttatattaagtttgtgctctctctctcctctcctctctctctcactctctgtgtgtgtgtgtgtgtgtgtgtttgtgtgtgtgttcagttatattcactgagtcagggcacctctggaatctactctttgacaagaactatctggatgattctgggcaagttactttccctg

SEQ ID NO: 49263 - DNA, 201 bp, Homo sapiens
tatgttactatttttcattccacttggtttttatattaagtttgtgctctctctctcctctcctctctctctcactctctgtgtgtgtgtgtgtgtgtgtgtttgtgtgtgtgttcagttatattcactgagtcagggcacctctggaatctactctttgacaagaactatctggatgattctgggcaagttactttccct

SEQ ID NO: 49264 - DNA, 201 bp, Homo sapiens
tgcccagccaatatttttttctaggttctcttttagtttttcaaatgcagctctcaacactggacttgtattgctgtgtataattggctttttttttttttaaggctggagtcggtccagatttagaattcttagaacttgaaaggatccctaaaaattatatcatccaactcccacatcttacaaatgaagagaccgaga

SEQ ID NO: 49265 - DNA, 201 bp, Homo sapiens
aggttactgcagtaacctggtaaagacagtggaggagaagacccaggaagcatcccagctcaatggcacaggtcatagtgcagggctcacctctgacatgmtggattgtgtagagatgactgatgggaacttaggaatgagctgtcatggtcagatgtagatcccacttatgtaagataggtcaagatggagagacttaac

SEQ ID NO: 49266 - DNA, 201 bp, Homo sapiens
agtctgatttaaatcttttgttttagtaggcagtcatcccatttaggtttagcaagaaaatcctggcctaattttgtgggccgtgcatccaatgacaattrcattttcagagactttgtggtgctattttggtcttcttggtttatctggggctgctagggttcctcctggcgtctgctggtgctacctgaaggggtggag

SEQ ID NO: 49267 - DNA, 201 bp, Homo sapiens
gttgggtaatttttcattctatcctggaatttggctatgctgttaggagactcagagtctgatttaaatcttttgttttagtaggcagtcatcccatttargtttagcaagaaaatcctggcctaattttgtgggccgtgcatccaatgacaattgcattttcagagactttgtggtgctattttggtcttcttggtttat

SEQ ID NO: 49268 - DNA, 201 bp, Homo sapiens
aggatggctgctttaaaatctttgtcaataagttcttcttctgtttcatctctgggttagtgtcagttgtcatttcacagtcaagttgtgattttcctgayttttggtttgttgggtaatttttcattctatcctggaatttggctatgctgttaggagactcagagtctgatttaaatcttttgttttagtaggcagtca

SEQ ID NO: 49269 - DNA, 201 bp, Homo sapiens
tcactgatttgtctctaccacacagctggcttctgaggcttataatgggcaattaggacaggaaggagttacttaagttctttttaaggtaacattaattrgattcatctcttaccacatggtgagggtcatggttattacatttaccattttgggtttggtgtttaacctctttattgtggattggttggtcctggacat

SEQ ID NO: 49270 - DNA, 201 bp, Homo sapiens
atgtttgacaggttatagcctctttaaatgcccttggaatccattaacgcatgtttcatagagttcacacagggtaaagtggtactttggtcagaacatgstttgctgaatgtcactgatttgtctctaccacacagctggcttctgaggcttataatgggcaattaggacaggaaggagttacttaagttctttttaagg

SEQ ID NO: 49271 - DNA, 201 bp, Homo sapiens
aaaaatgccatctaacaatcccatttttattgatcccattgtaattgtaaatgtttgacaggttatagcctctttaaatgcccttggaatccattaacgcrtgtttcatagagttcacacagggtaaagtggtactttggtcagaacatggtttgctgaatgtcactgatttgtctctaccacacagctggcttctgaggc

SEQ ID NO: 49272 - DNA, 201 bp, Homo sapiens
gccagcagcaaatgactactgaacttggactattaacctgccaagttcttgttttaattttgacctttgtataatatcttgtgtattccagtgtgcaatgtactgaatgattcacatacttttgtgcctctttgggttgtttttcaggttgaaataatcattttgaggctataggagctagtgtttcagtgtacatttgcc

SEQ ID NO: 49273 - DNA, 201 bp, Homo sapiens
caaggcctctggaggttgtgaatgggagcagaacaggcagtttggagtttaatcatgattgtggtgtcaaagggcagattggcagaaaggagcatgggagrtatcaggctggtgtgaggggagcccagagggctgactatggtatttaggctgggcattgtgagaattgaccttggatagggctggtgaacaggaaagaat

SEQ ID NO: 49274 - DNA, 201 bp, Homo sapiens
aattatatataattatatattatatattatgatagataaataaacatatattattctgttttaaactgtctcaatcctttttaaagtgattattataaatwttgtaaataataagcaaatatattcttatcaatgatgttgaagaataagtaaacatgttataaagcattttcactccacactttaaaaaatatgctgcat

SEQ ID NO: 49275 - DNA, 201 bp, Homo sapiens
aagagatccgaaagaatggctcggatcattcaagtggtggttggtaagagagagagaaggatgggaaggatgggagtttggggggcttcttgcctgatgtycatcaacttctccatgatggatgtgcaaactggggagttcctttaggggatttaaggcttggaagaggcgccgagagaaatggcagcactgatggcttct

SEQ ID NO: 49276 - DNA, 201 bp, Homo sapiens
tgaaaagtttagacttttatctaacgtgcactcataagcccttaaaacatgtccagtggggaaacagcttgatcaactttgtcttttttttttttttttttgagatggagttggggtcttgctttgttactcaggctggagtgcagtggcatgatcttggctcactgcaacctccacctcccgggttcaagcgattctcct

SEQ ID NO: 49277 - DNA, 201 bp, Homo sapiens
tctacttctacctagaagtaacaaatgtgtgtttttatttctactgattgttttttaacacactgttatataaggcgatatagtctgaatcatatttttartagcctgataataatccattaagctgttaaactgttcattcaaccattgccctatttttacacagttttatttcctttgtacttgctgttttaaaaagta

SEQ ID NO: 49278 - DNA, 201 bp, Homo sapiens
taagttttataaccctatgaagaacaattatttagaatcatgttctgtgggttttaatgcttgctgccagggtcttgtatttattgtgtgtgtgtgtgtgtatttatttttttcttttctcaagagttaaatactatatacactttctctacgaaggaagtgtagatgaaatgtagatggcattctttctgaatactcaca

SEQ ID NO: 49279 - DNA, 201 bp, Homo sapiens
atatatactgtgaaatgagtactattaagtatcgtcaccatgctgtacgttagatccccagaacttactcataactggaagtttgtaccctttgaccagcrtcttccctttcccccatcaactcagcttttcttaccagtatattaaatcatttgattcaaatacatttcaacattatttttttgtaattcaatatattca

SEQ ID NO: 49280 - DNA, 201 bp, Homo sapiens
gccaccaagcccggctaattttttgtatgtttttttttttagtagagacggggtttcaccatgttagccaggatggtctcgatctcctgtccttgtgatcygcccgcctcggcctcccaaggaactttttaatggcagcctaagctaatacaacattccactaatttgggtagggaataaaagtaactctgtccagtagcc

SEQ ID NO: 49281 - DNA, 201 bp, Homo sapiens
ttaagttttataaccctatgaagaacaattatttagaatcatgttctgtgggttttaatgcttgctgccagggtcttgtatttattgtgtgtgtgtgtgtgtatttatttttttcttttctcaagagttaaatactatatacactttctctacgaaggaagtgtagatgaaatgtagatggcattctttctgaatactcac

SEQ ID NO: 49282 - DNA, 201 bp, Homo sapiens
actagaaacaggttgggtgtgaaggggctggggtcatggggttagggtaggttcaaggtagacaaagccaggaagaggcacagagcatgtagatgcctggyctagaattccataaaaggcattctggatagccctaagagagaagtggtgtagacaaaagtctaaagctcccaggagaaatttattttcagagttggaagc

SEQ ID NO: 49283 - DNA, 201 bp, Homo sapiens
tacaaaattgtcattctatgtattgcttatgctttcctcctattttgcactctgtttttctccagtaatacaaaaagttgccattctgctttagtgtattwttcagttcagtggtttttgaatcagcatatttaactttatttttgaaaacttgtcacatttaaatcatctcatttttacttgagtaataagagaaaatta

SEQ ID NO: 49284 - DNA, 201 bp, Homo sapiens
cctagagctaaagcatttaactcattatcttcactctgtgggatccatttgggagaggtattcaggagctttataggttcacacttgctccccagtacctstgtgtcacaggaggatatacactggttttcagttgcatgtcagaggtggaactgacttggatgtctttgaattgctgttgaatctggagatgctagggta

SEQ ID NO: 49285 - DNA, 201 bp, Homo sapiens
ctttttttctctctttcaatttgttagagtggttaattatgtaaccacattttttaaatgttaaatcatctttgcattctggaggaaaccctatttagtcrtaagaaattgatatacatacaacccatttagtcatatatacacacaccccatcttctgtgtgtttgtgtgtatcttgaagatacatatttgatttacttg

SEQ ID NO: 49286 - DNA, 201 bp, Homo sapiens
tgatatgaatgttttgaaagtgaatgcttaaatatgacaattagtgtacatgtttgatagctacttttcaataagttagggaaattaattatcttctaatyatagattgtcagaatatcatgaaagtgtattaaaaattgccaagcacattttccatgtcttttgagatgatcattggctttttttctctctttcaatttg

SEQ ID NO: 49287 - DNA, 201 bp, Homo sapiens
tttgtttataggtgtcttgcattttctgtgtaactgattatattatgtgtggttaaaaataaggttttttaaaaatttccagtttttttttttttttttttagacagagtcttactgtgtcacccaggctggaatgcagtgatgctatctccgctcactgcaacctccgcctcccaggttcaagcaattctcatgcctcag

SEQ ID NO: 49288 - DNA, 201 bp, Homo sapiens
actttggctttgattctgagtatgtgaagtagtgtagtctccatataatttctttggctgtaaatgcatcagtagtgtctgtaatttttttttttttttttgagaccaagtttcactcttgttgcccaggctggagtgacatggcacgatcttggctcaccacaacctctgcctcctgggttcaagccattcttctgcctc

SEQ ID NO: 49289 - DNA, 201 bp, Homo sapiens
accatgttgttatgtgaggtgaagtgtttcctgaatgcagtttttcatatctcaattgcttatcaaactctttgtgttttgctcaaaataataatcatcamtgtctcataattgcttgattttagtaacgtccaaaataaaattttaagttgactatcgttaaattttttctgattttctcaggaaatgagtatttcattt

SEQ ID NO: 49290 - DNA, 201 bp, Homo sapiens
ccttgagccagttatataaactttctgggtctcagttccttcatctgtacaatggggatattagtttctatgtcatatggctactgtgaaaattcaataarttattactggtaaagcatataggacagcactatgtgggtagttgttgaataaaaataaaacatagatcttgtcattgaaaatcacaatttccaaacaggc

SEQ ID NO: 49291 - DNA, 201 bp, Homo sapiens
ctaattccttgaggctggaccaaatccatgaccccagtccaagcctgcatccaccaaagccagcgccatttaaatctgaagatgcaaatgcccttctgggrttgctcctacttccgctctgcctgattacacatatgtagcctgcctgattacacatatggggcccattaggtgaggtgtaatgggacacagtggtgccca

SEQ ID NO: 49292 - DNA, 201 bp, Homo sapiens
cttacaccttttaaattttaacatgggaagaaattataaacaacaaatgacagtgtttgaattctctcacttttgagcaaagtcaagcagcttaagtatgwgagaataaagatattcccttctgttgcccagaaggagaaaaagatcattttatttaaaatctagctattgagatgcatgttccttgtgtctaatcaagtt

SEQ ID NO: 49293 - DNA, 201 bp, Homo sapiens
tcctggtggcatttagaatggaatctctagcccttctccttggacactgtttgcgtcatgaaaaaaactgtaatatggagacgctgtctccagcaagaaayttatggctatatttcaatagtttgttcaaatttagaccatgccagcttctatagttgatgaaagcctgaatatccaaacactatctccattaataaaatc

SEQ ID NO: 49294 - DNA, 201 bp, Homo sapiens
aaaggagggggaggggggcgcagaatttccatatgattggttttagatgttgatttcggaggcctgtactgtgagtcactgaaattattggattgagtctygaagatccaaacacagagtgttgggactgtgtggttgggcttaatcctagtacaaaaaccagttcctttcagtgaagaagataaaggagaggaatccagg

SEQ ID NO: 49295 - DNA, 201 bp, Homo sapiens
gtttgaatggagcttgacaagtcaattactttcaagtttaagttcctcctctgggaaatagcacaaatagcacacatgacaccacttcataggatgtgctraagagtaactggcttaatgctgttaacctcccaaccttgttcgtatgacagtgctttctgaggctgaaaatctgatcttcccaggtttgaccagttgctc

SEQ ID NO: 49296 - DNA, 201 bp, Homo sapiens
aagctctgcagactattgtaatgtgtggctagggttgagaatgtatgctggactggacaaatttcaaatagccagatatacaagacctttgtgaccttggwcatcttatcttctgctacttctgtttctgatgttacaataaataaccacacttcttcttcctttttttttttttttttttttttttttgagatggagtct

SEQ ID NO: 49297 - DNA, 201 bp, Homo sapiens
atgacagacctcagtagatactggctattgcatgctacatgtgtgtatacatgcatttaaatgtatatagtagtattatataattgatatcatactcaagkttcccttatcctttaaatttaacgtctaacattttaccataaggttatatcactgtatacttacctgtttgtttgattttagtcattcatgttattacca

SEQ ID NO: 49298 - DNA, 201 bp, Homo sapiens
ttttcaaaaatgctgttttaaaggaattgatgttgttaggttgaaggctaaaggatggaatgttatgtatttaaatgtatacttagtttttaaaaagtttktgccaggaatattagtcatctgttaaagaatgtatcatctagtactttctttttgaagttttctttaattttggctacagagacattactcttctctgag

SEQ ID NO: 49299 - DNA, 201 bp, Homo sapiens; identical to SEQ ID NO: 14051

SEQ ID NO: 49300 - DNA, 201 bp, Homo sapiens
tatatatactacaatatctttgtagacatattatctgtgatgatttttatgaaattgtaggtatgatagtgcagatagtgttttacccattttagagatgrtaaaacagattcagagagatgacgtgaattactgaaggaaattaagtatttgctagaccccataccctaacctaggacttgtagtttcaatgctggtgct

SEQ ID NO: 49301 - DNA, 201 bp, Homo sapiens
gccccgtaggctctgatgtggtttggtagctggctgtaggtcaattgatgtgttctaaattctacaggacttcttcagttcacaactccagggagcattaygtccatcataacctgccctaatggcatgcctttcatgtggctggccattagcttctgtctgtggcggtctccctgcaatgtgggtgggcttgtcctccac

SEQ ID NO: 49302 - DNA, 201 bp, Homo sapiens
gaatggcagtgttgaacaccaaactagatggagtaaaattggtatcagggtggaaataatatagaacaataatactgtggagatacctcaggtaaattatrtagtttcaatagtcaggaaaaaagattttttaattaatctgggttattcttttagaaaaagcgttaatctcaaaaagccatccacatacacccccattat

SEQ ID NO: 49303 - DNA, 201 bp, Homo sapiens
ttctagagtaccagtagatgagaactacttatttagagtggcagagcatgctatagaaacaaaatatgagtaattctaactgtagttatgttatattagcrtagtgagatagtaacattaatagaattccttagtggaatttcttaatgcttcagttcaatctaaattagtattaatactttaaggcaggaaatctgtccg

SEQ ID NO: 49304 - DNA, 201 bp, Homo sapiens
ggagagtgacttagtgcaaattgatttatgcttgttttgtacaagctggactttagggaagcagtgtggaggaagaggaattggttaagagcctgttgcarttggcagataaaaggtattgctcacttggctaggatggtagcagtggagaagtggttttacctggcttttcagcacctgaatggtctgtaagaatggcac

SEQ ID NO: 49305 - DNA, 201 bp, Homo sapiens
aggggcaggtcacacaggcacaggcaatgtttggcaatgtgtaggtccaagtaggtactaggcacaggtgctcaatgctagtactagaaacaggttgggtstgaaggggctggggtcatggggttagggtaggttcaaggtagacaaagccaggaagaggcacagagcatgtagatgcctggcctagaattccataaaagg

SEQ ID NO: 49306 - DNA, 201 bp, Homo sapiens
tttttttaatttgttgttaaatatcttcttaagctgattattatatggaaaccagccaggactccaggctcctgatctgagacaaggcaggggcaggtcayacaggcacaggcaatgtttggcaatgtgtaggtccaagtaggtactaggcacaggtgctcaatgctagtactagaaacaggttgggtgtgaaggggctgg

SEQ ID NO: 49307 - DNA, 201 bp, Homo sapiens
tgtataatgacaagcaaaactgtatttaagttctacttatgatggtgatatacatatatactgtgaaatgagtactattaagtatcgtcaccatgctgtaygttagatccccagaacttactcataactggaagtttgtaccctttgaccagcgtcttccctttcccccatcaactcagcttttcttaccagtatattaaa

SEQ ID NO: 49308 - DNA, 201 bp, Homo sapiens
tagctgggaatagagtgatgagtaaagcagtcgttatcactggtggcatgaagcatagagtctagtgggatggagcatatgaaccaaaaaaaaaaacatcsaaatgtataaatactctgcatgataaattctgtgggggaaaagagcaaaagcgattaaatggggaacctcatctgactttgggggtgattcaggatttcc

SEQ ID NO: 49309 - DNA, 201 bp, Homo sapiens
tttcctatgataatttgttcattttcattttaaaaagtactggttataactcatacattttgaaaacacttatctagtcatgaactgcagtttgaaagacrctgatctagtctgttgctgtgctgtctaaaatcaggttcattcatttttcaacatccatttgttaaatacagtatcggttattttgctagtagctgggaa

SEQ ID NO: 49310 - DNA, 201 bp, Homo sapiens
cactttggctttgattctgagtatgtgaagtagtgtagtctccatataatttctttggctgtaaatgcatcagtagtgtctgtaatttttttttttttttttgagaccaagtttcactcttgttgcccaggctggagtgacatggcacgatcttggctcaccacaacctctgcctcctgggttcaagccattcttctgcct

SEQ ID NO: 49311 - DNA, 201 bp, Homo sapiens
tggtaattccctcagcttttgcttgtttgggaaatacattatttattctacatttatgaaggataactttgctgggtatagtatctttactggcagttttktttgtttgtttgtttgtttgtttttttcctccttcagcacttcgaatgaatgtgtcatcccatcccattctctcctggcctgtacaatttctcctgacaa

SEQ ID NO: 49312 - DNA, 201 bp, Homo sapiens
gactaggcacagaaaagtaaaggttcaaaggctagggcaagatgactgacttttccagatttagcacaatctgttctctggtcactttgagacgctgtcartttagtttcatgcagctgatatcttggagaacttctgtgtccttacgtttggctgaggacactaaattttttttttttttttttttttttgaggcagagc

SEQ ID NO: 49313 - DNA, 201 bp, Homo sapiens
atggggatagggaggcaaggaggaagtattacataacctcaagatgtggaaagacactgagtaacacatattggggcagagtgaggggtgcgatgatggayggaggactgggcttttattccattacaatccgtgtaacttatggctgctacgttttaagacactattgcctgtttactcaaattatataaaggttgtaga

SEQ ID NO: 49314 - DNA, 201 bp, Homo sapiens
tcttccttgacccaatggtcattcagtagtattttttttaattccatgtatttgtatagtttccaaagttactcttgtaattgatttgtgtttttttttttctattgtggtctgaggagataattggtatgatttttatttaaatttgttgagacttttttatgtggtctattctgggaactgttccatgtgctgatacaa

SEQ ID NO: 49315 - DNA, 201 bp, Homo sapiens
cccaaccccccgacaggcccccatgtgtggtgttcccctcccggtgtccatgtgttcgccttgttcaactcccacttatgagtgagaacatgcagtgtttsgttttctgttcttgtgatagtttgctgataatgatggtttccagcttcatccatgtccctgcaaaggacacgaactcatcctttttttatgccctaatct

SEQ ID NO: 49316 - DNA, 201 bp, Homo sapiens
gcgagaaaccggtgggaggttatcttattgtgttagagcagtaggaaaaggtaggagggggaagtgagaggtccagagggccaggaagatggaagaaaacmagcaacagaggatgcttggaggagaaaaattcttgagctgggagctcatttcctcttttttttttttttttcctttcctcaagggactcaataatacttc

SEQ ID NO: 49317 - DNA, 201 bp, Homo sapiens
tgtttattgatttgcatatgttgaaccatcattgcatccatgggataaatcctacttgatcatggtgcatggtgcatggtgcattattattattattattwtttttttttttttgagacagagtatcactctatcacctaggttggagtgcaatggcataatcatagctcctgggctcaagggttcctcttgcctcagcct

SEQ ID NO: 49318 - DNA, 201 bp, Homo sapiens
tgctttgtatagtatcagccttttgatagatacctgacgtatgttagttctttcccttttccccatgattagtctggaagttcttttttttttaaattttrttattattacactttaagttttagggtacatgtgcacaatgtgcaggtttgttacatatgtatacatgtgccatgttggtgttctgcacccattaactcg

SEQ ID NO: 49319 - DNA, 201 bp, Homo sapiens
atgttcagtgtattgtccttctgcagttactgatttataactttaatagtaacagatgtagctttattactaggaagcttattgagatcatgggacatttwgacccattgttttgattaaactttgaggacatttttgtactatctttataaatatggatatttaaatcagaattacagtaacattgatttttattgagaa

SEQ ID NO: 49320 - DNA, 201 bp, Homo sapiens
caagaagtacaaaattttgtgaatatccaatagtagaaagacttaatgaattcaggaatgtggacatgattgaaatactattcagtcattttatttatttcttttttttttttctgagacagagtctcattctattgcccaggctggagtgtagtggcacgatcttgtctcactgcaacctccaccttctgggttccagca

SEQ ID NO: 49321 - DNA, 201 bp, Homo sapiens
gcctcctgggttctagtgattctcctgcctcagcctcctgagtaggtgtgtgccaccacgcccagctaatttttatattttaagtagagatggggtttcamcatgttggtcaggctggtctcaaattcctgacctctaatgatctgcccccactggcctcccaaagttttgagattacaggcctgagctgctgtgcccagc

SEQ ID NO: 49322 - DNA, 201 bp, Homo sapiens
cagcacctgaatggtctgtaagaatggcactagcatacaagtcatttcaatgtggactttccaaggtacagttgcaggatgagagttagagtctgttgtasggtatggaacttgtacgtgcgcaatacacactacttaatgttaaggagagtacaccagagggaaggcagctttggcattctcttgggcacaggaaagtag

SEQ ID NO: 49323 - DNA, 201 bp, Homo sapiens
caaagcaccgtcccctactccttcctcctgcctgtcatctcagaagttgtccggaaattgctgctgcttgttctcattcatgtgcttgcacttttattatrtatctgtgcactcatttaaaaaaccctcacacttaaaaataatttggccaggtaatacaggttaaaattataggatacaaattctgaaccttcaaaagtg

SEQ ID NO: 49324 - DNA, 201 bp, Homo sapiens
tttccttgcttttgcttctgtcttttcttttccttccttttgataaattgagttttcttttcaaactgttttgttcttccttcctttttaaaaaatttttstttgtttctttagtggtttgagtggtacatccaatatctatttttaatagtggctaactttaaattttaaaaacgtactttaaaaaattcaagatatagg

SEQ ID NO: 49325 - DNA, 201 bp, Homo sapiens
taaaaatagtctgatgacagaagtaaacaataatcacattataaataaaaataaattacacctgtgataacttctaccatggagtgttttatagtgctgasagcatattacaaagggatttttgacttaatcagggaaggcatcccagaagtagcggtaagtaaagtgtgagtaggaattagattgcgaggagagcaggta

SEQ ID NO: 49326 - DNA, 201 bp, Homo sapiens
tatcctttcagattcagcaaacatggaaaaatatgattatcttatgtttatatgctggatgcttgctttggagaaatatgcagcatctaagttatatatawtccacattttataaaaacccattggatgagggtgatattattttaaaaagattttaaagggctaaggaatcatatggaagatgaattcaattttaatgac

SEQ ID NO: 49327 - DNA, 201 bp, Homo sapiens
gtgcacattatgtaaaagaaaacaaatcttactgtcttttttatgatacagcaaagtgaagactgaggatcctgagtgtgcatagtgcatgcatgttatgygttatatgtgtatgcatacatatgggtatatatatagttttacaagtttaaaataatatcagtgacttgaaaattgtaagggcttaccagataatctctt

SEQ ID NO: 49328 - DNA, 201 bp, Homo sapiens
acttctctatttatgcttatttaagttatttacagcttttaaaataaagaatactgcaaatctttgcacatgcataattgtattgtgtgtaaatatatctrtaggataagtttctatcagcgatattgttgcagtttatttagacagctttagaactgattgacttttgcttaggatttacgggctagtcagaatttgctt

SEQ ID NO: 49329 - DNA, 201 bp, Homo sapiens
gacctgagcatatagtatgcgtccttaagaatggaatcttatgtgcttgattttttgctttttagttgtattattgatatattcatttatgtcacatagarcaagataatgtgaattataaatacataagagggagaaaggaaaaatgaaagtaggagtgggcaaaaaataatgccaggaataataaatacatgagaagga

SEQ ID NO: 49330 - DNA, 201 bp, Homo sapiens
agttgacagtctggggctctggtaaggcgggggttcatctgtcaaagtgagccagcttactcagctagatactgtatggcatgattacttagggtaatgtmttttttgtcttgtttagttcccccatgatttgtgcagttttgtaaataagttgagaagtaaatagatttcatgatataattttaagacttcactcccaag

SEQ ID NO: 49331 - DNA, 201 bp, Homo sapiens
tgcctcccaggttcaagcagctctctgcctcagcctcctgagtagctgggattacaggcgcctgccgccacgcctggctaaatttttttttttttttttttgtatttttagtagacacggggtttcaccatcttggccaggctggtcttgaactcctgacctcatgatccacccacatcggcgtctcaaaatgctaggatt

SEQ ID NO: 49332 - DNA, 201 bp, Homo sapiens
ttttcccaagccagacttccatggcaccaacttggttttctgcagtggcacttctgtcttttgtagttttaaatttttagtttctgcagtgatttttttttatttccttaaaaaattttaaaatcaaacttgtaaatgtttataatttaaaaatgtataggtagatactttatttggcaaacaatgttagctatcactttt

SEQ ID NO: 49333 - DNA, 201 bp, Homo sapiens
aattcatgtagagccagctgaatgggtgactggagttttattactcaaatcagtctccccccaaatttggagactgaagtttttaaagaataatttcgtgrgtagggggccagggagtagggagtgttattggtggcactggagatgaaattattgggagttgaaatattatataaacatatatattatataaacatatgt

SEQ ID NO: 49334 - DNA, 201 bp, Homo sapiens
gcatatttttttccaaccaaatgcagatcagaaatatagtattcatggtatgcgaaccccacaggtatggagggccaactttatatatatatatatatatacatgtaggttccacagggctgtctgtggtgtaactgcccaatgggttctccttacctactccccaggtggaactgatttatcaagacaggagacttgcaa

SEQ ID NO: 49335 - DNA, 201 bp, Homo sapiens
tgcatatttttttccaaccaaatgcagatcagaaatatagtattcatggtatgcgaaccccacaggtatggagggccaactttatatatatatatatatatacatgtaggttccacagggctgtctgtggtgtaactgcccaatgggttctccttacctactccccaggtggaactgatttatcaagacaggagacttgca

SEQ ID NO: 49336 - DNA, 201 bp, Homo sapiens
gctatttaatattttgaggaactaccagattttcacagtggctgcaccttttatattcccaccagcaatgtataagggttccaatttctccacattcttaaccaacacttgttattatgtcttttaaattatagccatcctagtagttatgaagtgtgaatttggcttttgtttccctaatggctaaaggatatccagtgt

SEQ ID NO: 49337 - DNA, 201 bp, Homo sapiens
atgatctccaccttcccgtattcaaagccaccattatctcttgtctgatttactgcgtgagtttctagctgctcttcttgtatccacacttgctcttccasagtctccaaatattattcccctctaaaatgtatcttacttattttgtattttgttgattgtctttctcatttatcttagaacctaaactcaatgaaggca

SEQ ID NO: 49338 - DNA, 201 bp, Homo sapiens
ttcaggtattttttacttttctcattctctccagtatccagtctgttagccatacatatcagctgtatggtcaaaatgtgtctatgatctccaccttcccrtattcaaagccaccattatctcttgtctgatttactgcgtgagtttctagctgctcttcttgtatccacacttgctcttccacagtctccaaatattatt

SEQ ID NO: 49339 - DNA, 201 bp, Homo sapiens
tttagtagagacagggtttcaccttgttagccaggatggtctcgatctcctgacctcgtgatctgcccgcctcggcctcccaaagtgctgggattacaggygagagccactgcacccggccaatgtgttaacaatagttttgtaaaacatactaattcatgcccatagccacttttctattctcttccagtgaaactgctt

SEQ ID NO: 49340 - DNA, 201 bp, Homo sapiens
ccacttcagtaggaacaagaattctggtctactcgaagttcttctctttgtaaattagtccattgataatctggttattttactttagtttgtgtacattkggtttttagtatttgtcttcactgccagattgccaggtttgtgagggcaggcaggattgtaatgattgtttgttttctccacgttgccacattgcctgtc

SEQ ID NO: 49341 - DNA, 201 bp, Homo sapiens
tgccttcaaaactgaagaccagagccgtagtgaattcactacagtaaatgccactttattcagctatgtgggagccaaacctagcgacacctttatgttcyatgccttctaaaatacaacagcctggaaaactcctggctacaatgggtgctcagtaaataatatgtttgttttacttccatttattctgggaatgattac

SEQ ID NO: 49342 - DNA, 201 bp, Homo sapiens
aggtcaggagctgggattcaaggttgggcacttgggtttcagaacccatgtgtttgtcccctccatgttattctacttccctttaatcaaaacaactagcmgcacatgctgtatttagttataacatttgaacagcaagcagtgtgtgctattaaattgaaacactgtgatctcatttgtttctgttgaaactgcctagct

SEQ ID NO: 49343 - DNA, 201 bp, Homo sapiens
accatggtgactgtcaccagtggtgacgaaagtggcaggagtcagataagtttaagaccatagttttcttattcactctgatgaaagatttaatttggctrctgtcctattagcaaatctatatgtgcttctcttttcagtttacttcaacaagcatgttgttgagtgccaattgtgtgctaagggataagagaaaaaatt

SEQ ID NO: 49344 - DNA, 201 bp, Homo sapiens
aacattatattatacaaattaagaagtaggattttttcctttttttaatgaaacacattacaccaagttgggaagggttaacattgtcctacatataatakaagacagagaatggaccagcaatgtagtcagaaggttgattctagagttccagggatcttagaagtcccaaacataagcagggagaattttggctttaga

SEQ ID NO: 49345 - DNA, 201 bp, Homo sapiens
gggaaaataattccatagaacataagagactgaggaaatgtatagagccttttaaatccttacatattactgataagaaaatgcaagccctttaacttttrtggtaaatggtgcaattaaggtgtttatacttatttataaaacatagcaggctgggtgccgtggctcacacctgtaatcccagcactttgggaggccgag

SEQ ID NO: 49346 - DNA, 201 bp, Homo sapiens
caactatgaaaaaagatagccatttcaaatacctagaaatttcatagtaaattgaagcttcctaatgatttcacagtgtgaagaagagaactcatcctaartatcctatattctgattcttgatgtgtaacaaaatgtagccagtatttccattcttaacattccattcttaacattaattctccagagcaatcatttgtg

SEQ ID NO: 49347 - DNA, 201 bp, Homo sapiens
gaccactgagaatcactgtttcctaggggttgagagtttagatctggagtaagataggccagagtttgaagttcacatcctggctccttgcttacgagttscatagtcccaaataactgacttaacctctctgagtcttggtttcagaattaacaaagtaagaatcatagggcctttctcaagtggttgtgagcattagat

SEQ ID NO: 49348 - DNA, 201 bp, Homo sapiens
ttgccaggaaaagtcgacacctatacctgaaacataacgagaatataattttctatggtgttttacagtctgtaatggcctggttgaggtttcagaatgtcttcaggtgttttttgttattgttacagcagtagaattcacaggcagctgtttcatctggaaatgtatagttctgtttttgaggggtttacgttctttgca

SEQ ID NO: 49349 - DNA, 201 bp, Homo sapiens
ttgggagacgatgaagggttccccaagatcaaatgaacaccaattccttataggcagagtcctcacataatgtatcatccaaactgagatgcttttgggartgaaaacaggcactaactgttgggaatctgggataacaggagtaaatcaagactgtttagggcaacctaggatgaatggtcaccctcctccaaggctctg

SEQ ID NO: 49350 - DNA, 201 bp, Homo sapiens
ctccctcccgccctccctccctccttccttccttccttccttctttccttctgttttaaaattttactttaagttccgggatacatgtgcagaacatgcagtttcttacataggtatacatgtgccatggtggtttgatgcacctatcaactcgtcatctaggttttaagccccgcgtgcattagtaaccctgtgttcttt

SEQ ID NO: 49351 - DNA, 201 bp, Homo sapiens
tcctccaaggctctgctctctgtttgttcttttttttgttttagagccagggtttcaccatgttgcctaggctggtgttgaactcgtgagctcaagtgatmtgctcacctcagcctcccaaagtgttgagatttcaggtgtgagccaccatgcccagccaatatttttttctaggttctcttttagtttttcaaatgcagc

SEQ ID NO: 49352 - DNA, 201 bp, Homo sapiens
actggcaggacaaggatttgaacctaggcagttggattccctagcgtactgtacttgtaactactatgcagcactgcctctcttcctccttttcttaaaaraagaaatgtatgtgctttatttgaattctgactcaaccaaccaaactgttaaaagttataagaaaatcaggggattgtgaacttaccgaatatttgatga

SEQ ID NO: 49353 - DNA, 201 bp, Homo sapiens
gaaaggatccctaaaaattatatcatccaactcccacatcttacaaatgaagagaccgagacccccaggttaattgagaacttcaggtcttagttagctcmtgatccaagccaggatccaagtttcctgacttccactaaggtgctatttttactgcccctgccttgttcagtcccatccacactttccatcttcatcttt

SEQ ID NO: 49354 - DNA, 201 bp, Homo sapiens
gttagctcctgatccaagccaggatccaagtttcctgacttccactaaggtgctatttttactgcccctgccttgttcagtcccatccacactttccatcwtcatctttttttgggaacttcagccatgtatttatgtggctagccaggattaggtgtaaacattgtggctgtgaaggtaactggttctcaaaggaagagt

SEQ ID NO: 49355 - DNA, 201 bp, Homo sapiens; identical to SEQ ID NO: 14059

SEQ ID NO: 49356 - DNA, 201 bp, Homo sapiens
ggagtctcactctgttgcccaggctggagtgcaatgtcgtgatcttggctcgccacaacctctgcctcctgagttcaagcgattctcctgcctcagcctcytgagtagctgggactacaggcgtgtgccaccatgcctggctaatttttatatttttagtagagatggggtttcactatgttggccaggctggtcttgaac

SEQ ID NO: 49357 - DNA, 201 bp, Homo sapiens
tgagattacaggtgtgagccagcatgcccggcccatcatctaggttttaagcccgcatacaataggtatttgttctaatgctctccctccccttttccccmactcccagacaggccctggtgtgtgatgttcccctccctgtgtccatgtgttctcattgttcatctcccacttatgagtgagaatatgtggtacttggtt

SEQ ID NO: 49358 - DNA, 201 bp, Homo sapiens
taccaggatactgagtgtgtatgtgtgtgtgtgtgtgtgtgtgtgtgcgcgcgtgcgtacatgcatgtgtgtgtttgtgtttgttaaaacaataacaattyggcaagcataggataaggcattggttttcactgtttactgtcatcagaaatgccagagatgtgtatttaaatgcagagttttcagcctgctcacagtgtt

SEQ ID NO: 49359 - DNA, 201 bp, Homo sapiens
tatgtgtgtgtgtgtgtgtgtgtgtgtgcgcgcgtgcgtacatgcatgtgtgtgtttgtgtttgttaaaacaataacaattcggcaagcataggataaggyattggttttcactgtttactgtcatcagaaatgccagagatgtgtatttaaatgcagagttttcagcctgctcacagtgttcacaattcagataatttgg

SEQ ID NO: 49360 - DNA, 201 bp, Homo sapiens
tgctcaggctggaattgaactcagtgggctttagtgatcctcctgcctcagcctcctgagtagctagaactgcaggtgcatgccaccacacccagcttactctttttttgattagcaaactaatgcatattcattaaggaaaaaaaagaaaatcatttagaattttacctttcataattaaccaaaatattaagttgaata

SEQ ID NO: 49361 - DNA, 201 bp, Homo sapiens
atgacttattgttaaatgttcttcagaaagcttgtgccaatttatcacaaggggattgggagtcttttgtcacattcatgacaatattggattttttttartggcactatgttacaaccatttgtgttatctttattcatgatgataaacattagcaaacctaaaaaagagatggaaactttttaaggatttagaaaccaa

SEQ ID NO: 49362 - DNA, 201 bp, Homo sapiens
gctcagcctgggggagttcttggctctgcccaggaaagaattcaagagtgaaccaacagtgaaagaaagcaagtttgttagcgtaacagtgtacagccaartgaccactccaaaggcagagcagggctatctcataggcagggtagcacagaacagcactaatggattgctggctagttatatttatacccattctttttt

SEQ ID NO: 49363 - DNA, 201 bp, Homo sapiens
acatcttacaaatgaagagaccgagacccccaggttaattgagaacttcaggtcttagttagctcctgatccaagccaggatccaagtttcctgacttccrctaaggtgctatttttactgcccctgccttgttcagtcccatccacactttccatcttcatctttttttgggaacttcagccatgtatttatgtggctag

SEQ ID NO: 49364 - DNA, 201 bp, Homo sapiens
ccatctccattcaaatattttttctcagaagaaacgtttaaacagaaacagaaaccaaaaataccacatgaacctaacagagttccttttgaagtgtggayagaggaaccagaacatgaagctcttattttaggtctgttgagagtgattcaggccttgtctggccgagactcttgttcatccaaatatgaatgttggaaa

SEQ ID NO: 49365 - DNA, 201 bp, Homo sapiens
agtcttcctaaaattatagaattagcgttagggaaacatgggtcccagtggtgcagtataaatgatgatgatgtaaaagatgtcattgaagagtttggctrtctaatattgaaaataccagaattaccagtcaaactcattcatttttcttacagcctaaattgtgaaacttttgcattgtggtttctgtattacatattt

SEQ ID NO: 49366 - DNA, 201 bp, Homo sapiens
ctggccacatgggtggtcaaaagtaggatgtgcttagaaagaagttgtttttctttccattttctattattaagtatttaaaaactgtgatgtagtcacaytgtttctgcattgatactgtgctttcctttctccctcccacagccctcagtaacccagacgtttattcttctatctacctaccttcacttcctatcaccc

SEQ ID NO: 49367 - DNA, 201 bp, Homo sapiens
tttctattattaagtatttaaaaactgtgatgtagtcacactgtttctgcattgatactgtgctttcctttctccctcccacagccctcagtaacccagaygtttattcttctatctacctaccttcacttcctatcacccaagggtttctgccttttaggttttctttagactgagatactgtctccctagcctttctgc

SEQ ID NO: 49368 - DNA, 201 bp, Homo sapiens
ctttgccaagatccatcagagaaatcactatctatggcagctctagctttacaaaatatacttattaaataagacttgaaagtcaaaattactccttgatycatgggctgcagaatggatattgggttagcagtcatgaacacaacattaatatccctgtacatgtccatcagagctcttaggcgactaggtacattgtca

SEQ ID NO: 49369 - DNA, 201 bp, Homo sapiens
gaaggcttaacttattgattagttttttaacataccaaattgcagtaactaaatcatctactattgtgagttatttttcctctcacgtttacttttccttrgccttattttacagctaaattttataaaaaagatttgattcatttttgaatcaaatcaaatttattctaatatgtaataaactttattgcgtgcagtttg

SEQ ID NO: 49370 - DNA, 201 bp, Homo sapiens
ctatgaaagtcttaggtggaattttctctctgcacttattggtcagttatgttgtgaaactaacctgctctaaaaataacatttgggccagatgtggtggytcatgcctataatcctagcactttgggaagccgaggcaggtggatagcttgagcttaggagtttgagaccagcctgggcaatatgatgaaaccctgtctc

SEQ ID NO: 49371 - DNA, 201 bp, Homo sapiens
gccacctatgcagacttggaataggatagcatggtaaactgaggaagaagtgagagcatgttaagttggtggaccatgattggcatcagccaattttcatrtagttcctttagttccaaggatttgttatagttgatctaaaaggatgccgaatgaacagcagtaaataggtgaccctgctttgcttattggtgttcccta

SEQ ID NO: 49372 - DNA, 201 bp, Homo sapiens
ccgaatgaacagcagtaaataggtgaccctgctttgcttattggtgttccctaccagaggtgggaaagaaatgaataattcctctaagtggaaatggtccrtgctccagtaggtttatgctacatttgaagtgtcttccttctgtcacttcctctcctctctactctggggtttgtgagagcttggagtgtgtcatacaat

SEQ ID NO: 49373 - DNA, 201 bp, Homo sapiens
ggtttcttgagctcactgtttttgctattaaatattttcttccttcctccagaaattctgtgtttgaggattttatgtatcccttgtgaaataatccccarataatgaaaattcaacaatacaaagtgatgcagagacaatgatccttgacaacagtagtatagatatctgctcattaaaaaaaaaaatcaaaggccttat

SEQ ID NO: 49374 - DNA, 201 bp, Homo sapiens
ataaaagatgaatacatacctttaaagtcctccaagttacccagcctcggagattaaaataaattttatttccaagatatctctatttttcttcctccccrctaactagcttcttaagttcccatgtgaatattgtcattcatttccttaattattaaacatgttttgttttaaactggtaaataatgtttaataaaggtt

SEQ ID NO: 49375 - DNA, 201 bp, Homo sapiens
atttttgtagagatggggttccaccgtgttggccaggctggtctcgaactcctgacctcaggtgatccgcctacctcagcctcccaaagtgctgggattasaggcgtaacccaccgtgcctggccaataaaaagttttaaatacagaaaaaagcttacagaataaggatttaaagaaagaaagaatttttgtacagcttat

SEQ ID NO: 49376 - DNA, 201 bp, Homo sapiens
agctccacaagagcccttccatgagccctcaacctgggatctcgtgtatctttgttggaatggacattaggtttccaagtccaggcctgtgatttagaagkgtcaggttgggtaggagagaggagagtcttggaggggctgctccatgggggtcacacctctctcctgtgggttttcgctggtgattgagttctgaggcat

SEQ ID NO: 49377 - DNA, 201 bp, Homo sapiens
aggaccagagaactgatttacagaagtgacatgaaaacattccatcccagaatttgcagtagctcaaattaagtttctagctattaaaaagaaaagaaaayaaaactaaacaaaacacacccaccctgctcacttagaagcaacactgagtaattttaagtagttcgagaaaatgtatgtggtttgagggtcagggttgtc

SEQ ID NO: 49378 - DNA, 201 bp, Homo sapiens
gtggtcagcagccgcacttgaccacaaggtttataggcccttaatgacctggccttgtgcacagccgacaaagcaccttctaattatttcattttgtgcarcaatggagaggtgcatgaagactccattccaaactccaaagctcagggactttcttccgaacagtctatactctgttgtagtattattcccttccatcga

SEQ ID NO: 49379 - DNA, 201 bp, Homo sapiens
gcagtgctggctgagcagcgatcccagtgcagtttgactttattctttgctcaaataggtgaaggcccacggtcccggcctcgaaggtggtctcgtgggcmagcctgccgagttcaccatcgataccaaaggagctggtactggaggtctgggcttaacggtggaaggtccgtgcgaggccaaaatcgagtgctccgacaa

SEQ ID NO: 49380 - DNA, 201 bp, Homo sapiens
gctgtatggctgaaggggccaggtgggagtcccattcaggctgttaaacttggttccagggctccttattctagacaccttgtgtgtgccatcatgggagrgtaggagaggtgatcatcaatgtatgtggcttgatgtcagtcttgctgggcacagagaagtgattatgtatttctcacctatctgtcacctataggtcac

SEQ ID NO: 49381 - DNA, 201 bp, Homo sapiens
ttgaaagcagtgctggctgagcagcgatcccagtgcagtttgactttattctttgctcaaataggtgaaggcccacggtcccggcctcgaaggtggtctcrtgggcaagcctgccgagttcaccatcgataccaaaggagctggtactggaggtctgggcttaacggtggaaggtccgtgcgaggccaaaatcgagtgctc

SEQ ID NO: 49382 - DNA, 201 bp, Homo sapiens
agtggtctgaaggcaaatgaacctacacacttcacggtggactgtactgaggctggggaaggtgagaaagggctttgttcaacccagtgatcattgctccktggggaaggcagttcttttcataacgtttcaatgccttttgaactaggaagtagtccatctgaataggtaatcatctactgagcctctgagtcattcctt

SEQ ID NO: 49383 - DNA, 201 bp, Homo sapiens; identical to SEQ ID NO: 14133

SEQ ID NO: 49384 - DNA, 201 bp, Homo sapiens; identical to SEQ ID NO: 14132

SEQ ID NO: 49385 - DNA, 201 bp, Homo sapiens
ggaatgaccaagcctgtgcttctctccccagatagcaaagccattgtggatgggaacctgaagctcatcttgggtctggtgtggacgctgatcctccactwctccatctccatgcccgtgtgggaggatgaaggggatgatgatgccaagaagcagacgccaaagcagaggctgctggggtggattcagaacaagatcccc

SEQ ID NO: 49386 - DNA, 201 bp, Homo sapiens
caaatgttttgaagcaaatttcagcattacatcatttcactcttaaatatctcagtatggttctctaatagttgaagactccatttacatttatataaggwgcataatttacacttgtgtaacccaaaggaatgaccaagcctgtgcttctctccccagatagcaaagccattgtggatgggaacctgaagctcatcttgg

SEQ ID NO: 49387 - DNA, 201 bp, Homo sapiens
atcagcggcccacctttcgccagatgcagctcgagaatgtgtccgtggcgctcgagttcctggaccgtgagagcatcaagctcgtgtccatcggtgagttmtctggccgggcccaggcgcccactgtggtgccgacccgcccccgcgcgtgcacccctgcggagggcgaggatttcccgcagcgcgcccccacctcggaga

SEQ ID NO: 49388 - DNA, 201 bp, Homo sapiens
aagtgtggtgcacttgtagaggaaacacacccttttaaaaaaaaatttttttttatatgtgtgctttttgcatttttttaattgtgggaaaatatccatarcataaaattcactattttaaccatttttaagtgtggcattaagtgtattcacgttgttgtgcaaccgccactgctatccatctccagaactttttcaact

SEQ ID NO: 49389 - DNA, 201 bp, Homo sapiens
atgatcacttgttatggttcaggaatgtggctggtcattgccatttccttcatctgcctcttagcaagtgtggtgcacttgtagaggaaacacaccctttwaaaaaaaaatttttttttatatgtgtgctttttgcatttttttaattgtgggaaaatatccataacataaaattcactattttaaccatttttaagtgtg

SEQ ID NO: 49390 - DNA, 201 bp, Homo sapiens
gcaggagaatcgcttgaacccaggaggcagaggttgcatcgagccgagatcttgccactgcactccagcctgggtgacagagtgcgtgagcctccgtctcaaaaaaaaaaaacgagaaagaaaatgttatcccagtgggataatagttatacacacagtattctgtatatcttctcccagaattgacagttgttaccattc

SEQ ID NO: 49391 - DNA, 201 bp, Homo sapiens
tgatcacttgttatggttcaggaatgtggctggtcattgccatttccttcatctgcctcttagcaagtgtggtgcacttgtagaggaaacacacccttttaaaaaaaaatttttttttatatgtgtgctttttgcatttttttaattgtgggaaaatatccataacataaaattcactattttaaccatttttaagtgtgg

SEQ ID NO: 49392 - DNA, 201 bp, Homo sapiens
gttatggttcaggaatgtggctggtcattgccatttccttcatctgcctcttagcaagtgtggtgcacttgtagaggaaacacacccttttaaaaaaaaatttttttttatatgtgtgctttttgcatttttttaattgtgggaaaatatccataacataaaattcactattttaaccatttttaagtgtggcattaagtg

SEQ ID NO: 49393 - DNA, 201 bp, Homo sapiens
atcacggctaactgcagccttgaccttctgggctcaagtgattctccctcctcagcttccctagtagttcggaccacaggtgtgcaccaccatgtccagctttttttttttttaatattttagtttgagaccagcctggccatgttgcccaggctggtctcaaaatcctgagctcaagcaatccccctgccttggccccct

SEQ ID NO: 49394 - DNA, 201 bp, Homo sapiens
accgtgttgtgaaaatatggcacattgtagttggtccatgaagttttgttgtataagcaagtggtgacttggctgtcttgggaggccacagtgaccctgtytgatagagacagtgtgagggccacctctggtcctagctctggcttttttgcaggatggggaaggccaacgcattgacatccagatgaagaaccggatgga

SEQ ID NO: 49395 - DNA, 201 bp, Homo sapiens
gctgaggcaggaaaatcgcttgaacctgggaggtggaggttgcagtgaaccgagatggcgccactgcactccaggctggcgacagagctagactctgtctcaaacaaacaaacaaacaaataaaaattcatgataaagcagcagctcaaggtgctgtaagaaattcatgatatttataagataattgaaaatttgaacact

SEQ ID NO: 49396 - DNA, 201 bp, Homo sapiens
ctgaggcaggaaaatcgcttgaacctgggaggtggaggttgcagtgaaccgagatggcgccactgcactccaggctggcgacagagctagactctgtctcaaacaaacaaacaaacaaataaaaattcatgataaagcagcagctcaaggtgctgtaagaaattcatgatatttataagataattgaaaatttgaacactg

SEQ ID NO: 49397 - DNA, 201 bp, Homo sapiens
tgaggcaggaaaatcgcttgaacctgggaggtggaggttgcagtgaaccgagatggcgccactgcactccaggctggcgacagagctagactctgtctcaaacaaacaaacaaacaaataaaaattcatgataaagcagcagctcaaggtgctgtaagaaattcatgatatttataagataattgaaaatttgaacactga

SEQ ID NO: 49398 - DNA, 201 bp, Homo sapiens
gaggcaggaaaatcgcttgaacctgggaggtggaggttgcagtgaaccgagatggcgccactgcactccaggctggcgacagagctagactctgtctcaaacaaacaaacaaacaaataaaaattcatgataaagcagcagctcaaggtgctgtaagaaattcatgatatttataagataattgaaaatttgaacactgaa

SEQ ID NO: 49399 - DNA, 201 bp, Homo sapiens
cctcaaaaggagggctggcttcatgaccacatgacccgtgtgctcagaagggccctgtacttggtttattgctctgctgttgctgtcttgaagttcttaattttttttttttttttggcactggggagttgcagtttcaaacaacacttattcattgtctcacagtttctgtgggccaggagtccagccatggcttaagac

SEQ ID NO: 49400 - DNA, 201 bp, Homo sapiens
ctcaaaaggagggctggcttcatgaccacatgacccgtgtgctcagaagggccctgtacttggtttattgctctgctgttgctgtcttgaagttcttaattttttttttttttttggcactggggagttgcagtttcaaacaacacttattcattgtctcacagtttctgtgggccaggagtccagccatggcttaagacc

SEQ ID NO: 49401 - DNA, 201 bp, Homo sapiens
ggttcacaagaggacattttccttgtttgaacatgattaggttgcaaggaacagaaatccatcaagtttgctgaagtcaatgaggaatctatgtgtatggrcacatgggacagcctcctagaaatccagttgcaagatacatggccagacctcttaagggtgggaacgcttgttctggttgccttttgcctttctccatta

SEQ ID NO: 49402 - DNA, 201 bp, Homo sapiens
cgtccccttgtatcctcacatgctggagaacggagggagccagctgtctgggactcttacaaggccactgaccccatcacagggtcgctccactttcatgaccttatctaatcctaattgcctcctcaaggcccatgataatcccatcacattgttgggggtagggtttcaatatttgaattttggagggacacaaacatt

SEQ ID NO: 49403 - DNA, 201 bp, Homo sapiens
tctgagctccctctagcaggagctcttaaccttttgtgtgccattgactcttgccatctggcgaagcctatggggactgttcttgggataatgttttaaarcacataaaatgaaatatgtcacattataaaagaaatcattgatattatagtacagttaccaaaatcttacaagaacaaatatgcaacatagaaacatgca

SEQ ID NO: 49404 - DNA, 201 bp, Homo sapiens
catagaaacatgcatatcttcgttaatacattaaatcataagatttggtgacagtatattaactgtcatcaaagtgacaaagtaataagtgaaaatgataygtcaaaataactgtaaaatgacataaaaatatatgatttttaatggtgatgtaagtcatatgtacttataatgtgctgtgatttcttgtcaacatttctg

SEQ ID NO: 49405 - DNA, 201 bp, Homo sapiens
ccagaagcgcatgtaccgcaagtaccatcagcggcccacctttcgccagatgcagctcgagaatgtgtccgtggcgctcgagttcctggaccgtgagagcrtcaagctcgtgtccatcggtgagttctctggccgggcccaggcgcccactgtggtgccgacccgcccccgcgcgtgcacccctgcggagggcgaggattt

SEQ ID NO: 49406 - DNA, 201 bp, Homo sapiens
gacagcaactactgccctatctctaatgatctgcttctgcaagtcacttagagagttcagggcttaacactgtcctgggcatgtgttgcttagaaaatggygcctgttaattaaataaggtgctgtctaataattatctcaaaagtaatgccagggctggatgccgtggctcacgcctgtaatcccagcactttaggaggc

SEQ ID NO: 49407 - DNA, 201 bp, Homo sapiens
cttgccttttttgataagtgaccatgtttcctcctccagcacttaaaatgtgcctttctcccacatagaggacagtgtgcctaatttcttacgtaatctgsattttcctcgccaatgatatgttcttggattcacagaagtggcaaatggggttttccctctttgaagaggaaccttctccttcatggggttcagcaggag

SEQ ID NO: 49408 - DNA, 201 bp, Homo sapiens
ttttctaggtatatccatagacatgtttgagcatcaagttgagtcttttatccaaattccaatgaaggagttggtgcttagaagcaagacttgggtttagsttccagactccaaaatcctgtgtcttcccacattggtgctcagtttctcattggatttggagaaacatttggtcctattaggtggcttggcatgaaaatc

SEQ ID NO: 49409 - DNA, 201 bp, Homo sapiens
aggtatatccatagacatgtttgagcatcaagttgagtcttttatccaaattccaatgaaggagttggtgcttagaagcaagacttgggtttaggttccasactccaaaatcctgtgtcttcccacattggtgctcagtttctcattggatttggagaaacatttggtcctattaggtggcttggcatgaaaatctgaaaa

SEQ ID NO: 49410 - DNA, 201 bp, Homo sapiens
tccagactccaaaatcctgtgtcttcccacattggtgctcagtttctcattggatttggagaaacatttggtcctattaggtggcttggcatgaaaatctraaaacttccatggagtggaaagtacccatttttattaaccactggtttgactatatatggcattctccacccttttctttctgtgttgctgtgaaatagc

SEQ ID NO: 49411 - DNA, 201 bp, Homo sapiens
atccacaaagaagatgtttccaagatgcttctgaagattgcctaaaaatagccggtttccacccccgtgaatgcatccattctagaatgctccttcaccaggaccagagaactgatttacagaagtgacatgaaaacattccatcccagaatttgcagtagctcaaattaagtttctagctattaaaaagaaaagaaaaca

SEQ ID NO: 49412 - DNA, 201 bp, Homo sapiens
ctgaaactgaggtggtggcaccttcagggaagtcacctgtccaggatgggtctagtcttgctcctaagctgaatatcaagagaagttcacccattccctattttttttttttttttttgagatggagtcttgctctgtcacataggctggagtgcagtggcacgatctcagctcactgcaacctccgcctcctaggtacaa

SEQ ID NO: 49413 - DNA, 201 bp, Homo sapiens
agtcttgctctgtcacataggctggagtgcagtggcacgatctcagctcactgcaacctccgcctcctaggtacaagcgattctcctgtctcagcctcccragtagctgggactgcaggtgtatgccaccatgcctggctaattttgtatttttagtagaaatggggtttcaccatgttggccaggcttgtcttgaactcc

SEQ ID NO: 49414 - DNA, 201 bp, Homo sapiens
ccatgttggccaggcttgtcttgaactcctgacctcgtgatccacccacctcggcctcccaaagtgctgggattacaggtgtgagctactgcgtctggccttttttttttttttaaagagacagcgtcttactcctctgttacccaggctggagtgcagtggcatgatctcggttcactgaaacctccacctgctgggttc

SEQ ID NO: 49415 - DNA, 201 bp, Homo sapiens
ggctgtgtttttagctttgaaataatctcccaggctttgaggggagaggtcccatactctggggcagcccacttggtttttatgtatggtttatgttttgtcagtgtggctgcctctctgttcttgtccttttgattctcattttgggcctaggattgtgttggaaagattatctccttccttcccacagagggtctggag

SEQ ID NO: 49416 - DNA, 201 bp, Homo sapiens
tcatcgcgctgctcgaggtgctcagccagaagcgcatgtaccgcaagtaccatcagcggcccacctttcgccagatgcagctcgagaatgtgtccgtggcrctcgagttcctggaccgtgagagcatcaagctcgtgtccatcggtgagttctctggccgggcccaggcgcccactgtggtgccgacccgcccccgcgcgt

SEQ ID NO: 49417 - DNA, 201 bp, Homo sapiens; identical to SEQ ID NO: 14130

SEQ ID NO: 49418 - DNA, 201 bp, Homo sapiens
gcttgggcagaagcctgagctgaatacttgccttttggccacacctctgggtctgtcattcagggtcttccacagattgactccagtcttctcttccactmctccctgaacaaactgttcttgccaccctccctattactcctacgcacttggctcatatctaccaatgtgcttttagttcatgcttttctgcatttcctg

SEQ ID NO: 49419 - DNA, 201 bp, Homo sapiens
acaggtgtgagccaccgtgcccagcctcagttgaggttttatatactgatggccagaataataagagtcttgccctgctctcttcccacattggccattcwttggttcctccctcagagcctttgcacatgctgttctttctgtcacttattttcgtaggaccatattttattcttggcatttagcataatttgcaattct

SEQ ID NO: 49420 - DNA, 201 bp, Homo sapiens
ttatatagaaaaacctatttgcatgagaactgtcacccacagttttgggtagggtcagtgtgtgccactgagcaggaacgccgagggccataacctgtctratgtattaaattctcaggaatcgggattaaaagttaaccagccagcatcctttgctataaggttgaatggcgcaaaaggcaagattgatgcaaaggtgca

SEQ ID NO: 49421 - DNA, 201 bp, Homo sapiens
tccatcggtgagttctctggccgggcccaggcgcccactgtggtgccgacccgcccccgcgcgtgcacccctgcggagggcgaggatttcccgcagcgcgyccccacctcggagataagggggagtcgtccccaggggtgggatatagggggcctagaccccctccccggtgtcttcccctgggatgggacctgttgtgat

SEQ ID NO: 49422 - DNA, 201 bp, Homo sapiens
ccaaactgctgggattacaggtgtgagccaccgtgcccagcctcagttgaggttttatatactgatggccagaataataagagtcttgccctgctctcttsccacattggccattctttggttcctccctcagagcctttgcacatgctgttctttctgtcacttattttcgtaggaccatattttattcttggcatttag

SEQ ID NO: 49423 - DNA, 201 bp, Homo sapiens
catttagatccaagaagctcttctaaggaacagagactgttttacagggttactgcaaagattagatgaggtcaggcatgaaaaatgcttagcacagtgcyaggtacatgataactattattatatgcttttgaaatgttgagaacccaactctgatggcggctcccatgaaaagcagcacatttctgccttttatgagta

SEQ ID NO: 49424 - DNA, 201 bp, Homo sapiens
taaagggatctgtgaccctctactctccctaccaaaaaacaaaacaaaactagattgtattaagccatcaattctgtctgtttccactagaggcactaatwggaaaatatgtcagggttttccatgaatgttttctacatcttgacaacatcctaaatagcatttctctatgatccacaggaccaagaaggaaaacccaaa

SEQ ID NO: 49425 - DNA, 201 bp, Homo sapiens
tcattctcctagataagtatgctgttcgcttcatccctcatgagaatggtgtccacaccatcgatgtcaagttcaatgggagccacgtggttggaagcccyttcaaagtgcgcgttggggagcctggacaagcggggaaccctgccctggtgtccgcctatggcacgggactcgaagggggcaccacaggtaacccactct

SEQ ID NO: 49426 - DNA, 201 bp, Homo sapiens
cacaggtaacccactcttctgcttcttgaagccttaactgaaccagctccagggaccaagccagatggaaatcctcaagccccatgaaagctttttacacrtactccccgtggaaactggggtcatgcacacttcggaggcgcttgctgtccaaagctgttttgggagttgcggtttgacccacgataaatccagagtgag

SEQ ID NO: 49427 - DNA, 201 bp, Homo sapiens
ggccataacctgtctaatgtattaaattctcaggaatcgggattaaaagttaaccagccagcatcctttgctataaggttgaatggcgcaaaaggcaagaytgatgcaaaggtgcacagcccctctggagccgtggaggagtgccacgtgtctgagctggagccaggtgagcaggaggcctgctggggggtcccagcacca

SEQ ID NO: 49428 - DNA, 201 bp, Homo sapiens; identical to SEQ ID NO: 14120

SEQ ID NO: 49429 - DNA, 201 bp, Homo sapiens; identical to SEQ ID NO: 14122

SEQ ID NO: 49430 - DNA, 201 bp, Homo sapiens
aagagcccttccatgagccctcaacctgggatctcgtgtatctttgttggaatggacattaggtttccaagtccaggcctgtgatttagaagggtcaggtygggtaggagagaggagagtcttggaggggctgctccatgggggtcacacctctctcctgtgggttttcgctggtgattgagttctgaggcatttgctgca

SEQ ID NO: 49431 - DNA, 201 bp, Homo sapiens
gtcctttcttgggaatgggtagcacaatggagtgtgatgtgataaacctgctgggtcacacgcacgataaatgcccaagcgtatttgtgcattgtgatatygacactctggattgttgggtgtcaggaaagaggacatatttctatttctgagagtgtgtctctctcctgcttcctctccgccatccccttacaagcccca

SEQ ID NO: 49432 - DNA, 201 bp, Homo sapiens
aggtgagattccagtccaaggtcacccaggtagcaagtggcagggcagggattcgaacccacaccgtcaggctctatgagcctctgcttgtaattgccacrctctcccacctcttaggggccccagcattatcgtggaagcaccttacctttggctctcatatttcctcttcttcctgtgcctgtcctgatgcatccgggt

SEQ ID NO: 49433 - DNA, 201 bp, Homo sapiens
tgcttctgggattgcttaagccctgtgggtgtcctggtcattggtgtgcccctcactgatcagcccatcacgatgatccctgctttttctgtaataagatyacctttgcgtcaccatccgtgctccacgaatcgccagccgtcgtgtctgtgatcacgctcggtgcagtttgtctctgtgtttaaagagaaagacagacag

SEQ ID NO: 49434 - DNA, 201 bp, Homo sapiens
ctgagtctgtcatacaggagttcctttctcccctcagcctcttttcaatggcccacttctctttggtttgatgctctatgtatccagctggtttcatggtsttctcaagtcctttctgagcttgattttgccagttgtagaaaactctttaagagttgtctgctatattttgtggaagccaaatggaactggaaaaaaaaa

SEQ ID NO: 49435 - DNA, 201 bp, Homo sapiens
tgctggtaccacagtgttctttgctcaaaggtggccacaagtcttgactagccagcccattggttaatttttgctcttcacaattctggactctttggcartgtctcagctgtagagtaaaattgccacatcctaagcgtgcctaaccagcttgaaaggttatattgtgtcttcaacacacatcatccacatacaccctcc

SEQ ID NO: 49436 - DNA, 201 bp, Homo sapiens
ccttgttggcagcttggaacttgggtttggtaaggctagcgggccatatagggacaaagccctgaagtgcattggaacttgccttttttgataagtgaccrtgtttcctcctccagcacttaaaatgtgcctttctcccacatagaggacagtgtgcctaatttcttacgtaatctggattttcctcgccaatgatatgtt

SEQ ID NO: 49437 - DNA, 201 bp, Homo sapiens
ctgtgcaggcagaggatagggctgttccaaatgtcgctcacagagctgcctttgcctttctgcagatcccaagatacacacaaagcagttaacatgggtamataggccttcctctgtaggagagggcttctgattcttattctttcttatggcggaagagggtgttgagaggggttcccttgctgttggttctgttgaatc

SEQ ID NO: 49438 - DNA, 201 bp, Homo sapiens
ttggtgggcttggcataactgttgagggaccatcagagtcgaagataaattgcagagacaacaaggatggcagctgcagtgctgagtacattcctttcgcrccgggggattacgatgttaatatcacatatggaggagcccacatccccggtgagctattcctcagagaggaccccagagaataattgattttgcaggaaa

SEQ ID NO: 49439 - DNA, 201 bp, Homo sapiens
ccaggattgtttttcttatgttgtgattgaaggaataatactgcgtagaccctctctgatgtcctaggatggcgggggatgggaggtgcatgtgcatctcyttctgtctcttcatgcctctgcttaggaggcgccagacctgtagagaggtggacgtcaagatgccagttgtccagggtcttcgttcaccccttaatgagc

SEQ ID NO: 49440 - DNA, 201 bp, Homo sapiens
caggcaggtatgaggtgccttcaactaacaaaaattcctatattttattttatttttgagacagagtctcactctatcacccaggctggagttttagtggyatgatctcggctcactgtgacctctacctcctgggttcaagcgattctcctgcctcagcctcctgaatagctgggattacagcacccaccaccacaccca

SEQ ID NO: 49441 - DNA, 201 bp, Homo sapiens
tatcaatttcttagaggaagcagcagtatttgggctgtcatatgtaatatggtggcgactgtttcattatgtgtttcagcatttgtgagggggtgggttgstctggatgtggcagatggtggggtttggaggtgataactcattgagatatcttggtgtccatgtggtacataccagaacctctgggaatgccaggcacat

SEQ ID NO: 49442 - DNA, 201 bp, Homo sapiens
atctgcacgtagtaggtgttctgtgagaatggttgacaacaatgagtaggcacatgagcagtgcacacagtgaggcagggggagctgaccgaggcctgcayggccgaggtcccgggggagcagcagtgctattctgggtgtgcacaaggtggtctccaattcccagcttgtgctcagaatcccacaacctctcttccaggc

SEQ ID NO: 49443 - DNA, 201 bp, Homo sapiens
cgtggcacaacatctgcacgtagtaggtgttctgtgagaatggttgacaacaatgagtaggcacatgagcagtgcacacagtgaggcagggggagctgacygaggcctgcatggccgaggtcccgggggagcagcagtgctattctgggtgtgcacaaggtggtctccaattcccagcttgtgctcagaatcccacaacct

SEQ ID NO: 49444 - DNA, 201 bp, Homo sapiens
gttgtgggttcctggggggtgttaaccgctcaggatccagcacgtggcacaacatctgcacgtagtaggtgttctgtgagaatggttgacaacaatgagtrggcacatgagcagtgcacacagtgaggcagggggagctgaccgaggcctgcatggccgaggtcccgggggagcagcagtgctattctgggtgtgcacaag

SEQ ID NO: 49445 - DNA, 201 bp, Homo sapiens
atggaacaggggagtggcggataatgcttggggtctgccatcttggacagtttatcttacccgggtttgttggtttttggctactctcatgctgagctcasacaacttctagtggaggctctgacttaaagattggcctcagaggtagtcccttgccatcagctgttgacattgaaatcctcaactgtcactctctaaagt

SEQ ID NO: 49446 - DNA, 201 bp, Homo sapiens
ccaccttctaatttgctttcatggtaattctgggtgcttaaatattagcctagtttttcctggcctggttaaaaacccggagtggagttatttttaacaaygtgtcctgtcttacccgtaatggcatgttgatttcctgtggtaggccagctgtggttggttggtggcggctccctagaccactggattgactggggttca

SEQ ID NO: 49447 - DNA, 201 bp, Homo sapiens
cagaatctctagttttttggcaaaggcagaaatcttgatttttctctggaaactcaacatacaacatgttggcatttaattggaaaaaagtttaaaatgtrgtgttgtctaacacctgcatgccacacagcaggttagtcttcaacctttaacctgtcctcgagcccggtgtgagcagtcgtgttgtcacttagccgtggc

SEQ ID NO: 49448 - DNA, 201 bp, Homo sapiens
ataacaacagaaagacactcatttgtggttttcccatcaggtgtggatggtgcctttttatgtttcaggctctctgttgcctcccagagagccaaatgccrgcttttccagaaccccagaactttcccaggcagagatatttagtgaagtgttggttggttttctaagcatcaggcttcttagctaaggcaacctatgggg

SEQ ID NO: 49449 - DNA, 201 bp, Homo sapiens
ctagttatctactcaaatgattgtcacccccacacattttatttatttatttcaatagctttggggtacaagtcgtttgtggttacatggatgaattctayagtggtgaattctgagaccacctcccccgcccccatttctaaaagggcaggcaagtgtgtggtgtggacagaagaccgagggctggggctgttctgggcc

SEQ ID NO: 49450 - DNA, 201 bp, Homo sapiens
agggacaaaatcacttcagcctgaaccactgctgtaaagattcaaacaataaataaatatatgacttaagtagtgaaagaccctcctccatttgttttggsgggaggactctccataggttctagttatctactcaaatgattgtcacccccacacattttatttatttatttcaatagctttggggtacaagtcgtttgt

SEQ ID NO: 49451 - DNA, 201 bp, Homo sapiens
tataatcaggtcactgcactgaagccggagtgacagagtgagaccttgtctcttaaaataaatttgtgtcattgtttgttgtttttatggtgttatgacartgatccatcttaaccctttatgtagtggtaactaactttctcttttcctaaaagctgatttgagttttaggttctcttggagtctgtgacaattgtaaat

SEQ ID NO: 49452 - DNA, 201 bp, Homo sapiens
gaatttattgtgacaggaagcctgatggagcctcttgcctgtgtgcagcccccagccaggtttctgagttctgatgaactaccagaaacttccaccacggsctgtgattacactgttggcccaatgccctggaaaaattggcttgctctcggggaacactccaggagctgcaaagggggtgtcaggactgttgtgcagctc

SEQ ID NO: 49453 - DNA, 201 bp, Homo sapiens
tgtatatctccactacctggagatcggaagcctgcgatattctgatatagatattttcagtcttcttgtggatgcctgtttcttctgtttcacgggtttcrctttttcttttggttaatggctggatggtgttttcccgaatgagagtagtctgtttaggatgactgacttgaatatttgcttggttggggtggagtggct

SEQ ID NO: 49454 - DNA, 201 bp, Homo sapiens
actcaccaccttgggctttagtgaattcacctggaatgatggccttagcgttctcttagactcttagactatgatgcatttggagtaaatgctcttgaagrgagcatttataatgtaattaattaattccagtcaagtataggttcacatgaaacccaacccaattaccccccaaaaatttcagagatgagaacagtgact

SEQ ID NO: 49455 - DNA, 201 bp, Homo sapiens
tgagatgacatccaggtgacctatagggcaagggctgagagagcctgtcttgcaggagagtggggtgacccaggagtacacttttcattggaagaaagccstcaacagcacataaaggccaatcccatcatgtacctgcccagactttggaatacagactgtactcaccaccttgggctttagtgaattcacctggaatga

SEQ ID NO: 49456 - DNA, 201 bp, Homo sapiens
tggaattctggcattcgaactatagggaaacgggtggggatttgtggcaggcactatgtaaatttgccgcaagcccataaattcagactttaagatgaaaratggcaagcagcagtcagctttccttcaacaggcaggaacggtgctaccttccgcctgtgctgagtgtgactgagggagaggcaggcctcctagggaggc

SEQ ID NO: 49457 - DNA, 201 bp, Homo sapiens
tgtagttgttactctttgcaaaaaattgcaagaacacagaaaaatataaagaaaaaaatcacctgtgaagaattttaatgaatctttttctacttttaggsgattttgcttacagctgccttttaatcagaatagggaagaaagagattcctttctcaggaaaaaagtgactgtggactggaaatgctttgtgaaataatt

SEQ ID NO: 49458 - DNA, 201 bp, Homo sapiens
ctaattcctggacctgggggtggtctctccagactagatgaagaagcaatctaattatctaggaaggtgaaaggtggttgggaatactcccagaaataggycaaagataccgcctcctacctaacagactctttttagaagaagaggcaacctgggtttttggataactgttgagtaggaaccatcatgagtggcatttct

SEQ ID NO: 49459 - DNA, 201 bp, Homo sapiens
agacttaatgagcttggttttggaagaaagggatacaaacagatttcaatcttctggccaacacttggcttttagggaggcagcgggaatgagctgtcgtracatagaataggtgctttccaccatataaccagggagacccttccacctccaccccctagggtttgccattgaaggcccctctcaggcaaagattgagta

SEQ ID NO: 49460 - DNA, 201 bp, Homo sapiens
ccctgcccttttgggccctcacagtcaagatgaactgatttttggttggtcaaaatattgcattagggccaaatgggtgcggtggctcatgcctgtaatcmaagcactttggaaggccaaggcagaaagattgtttgaggccaggagtttgagaccagcctgggtgacatagtaaaactccatctctaccaaaaaaaaaaa

SEQ ID NO: 49461 - DNA, 201 bp, Homo sapiens
tgagcaattttcctaatgaaatggtccaggaaccccagtgtgctcggggtataccagaagggcctccttccttaactgccttgaagaacaagcagtgctgygtttaacatgcattaaactcacaggaactgagctggacatatttgagggggtgggggaagaccgccacgcccagagatgttttgtggtgtcagatacagg

SEQ ID NO: 49462 - DNA, 201 bp, Homo sapiens
ggcggcttgagaggctgggagatagaccagggagctccagattctttggagccgctgagcaattttcctaatgaaatggtccaggaaccccagtgtgctcrgggtataccagaagggcctccttccttaactgccttgaagaacaagcagtgctgcgtttaacatgcattaaactcacaggaactgagctggacatatttg

SEQ ID NO: 49463 - DNA, 201 bp, Homo sapiens
tctttctctgggtcacgctgagaggggaagggcaggttgaggggcccactgctgggttctgggttaactctcaggcagctggagtgtccactgaccacacrctttcctgattccattcctgcttcccccttaccacatggaaatgtgcacacacactcacactcactctctctcacactgatcagaaagtattgacattca

SEQ ID NO: 49464 - DNA, 201 bp, Homo sapiens
ataaaatgccatttcattcaatggaactattggtgatagaaaaagagagattccatttcatgtctagatgcatcaaccttcgttactcatctctgtgcctmagctcccatcatcagggctgctgtgacatttgccaccctgtgctcaggctgtgggctggatgcccaggagtgggctgggctggtgcatttcagatgctgc

SEQ ID NO: 49465 - DNA, 201 bp, Homo sapiens
cagagcttgtgggaaccgacttattttgctgaggcagcgtcatcttttcatcctaccaactccttttcctttctgagcatccttcaagctataggtccttstgcctgcattgtcttttatgcctcatgaccattggcaaaaatgggattgtctttgttttttagatgatgaaactgaggcttgcaaggtttagagccccct

SEQ ID NO: 49466 - DNA, 201 bp, Homo sapiens
agtatgtcctggtttcttgagtctcttgtgtgtgtacccccaccccgcataaggagagtgggatggagcagacttgcctcccaggggtgaggggtgagtgrctgcatggttgcctggcatccagccctaggagcaagtgacctgtgtggccaaggggccctctccgggtgcaggagtgactggtgggctggcaggctgccc

SEQ ID NO: 49467 - DNA, 201 bp, Homo sapiens
aaaatgccatttcattcaatggaactattggtgatagaaaaagagagattccatttcatgtctagatgcatcaaccttcgttactcatctctgtgcctcarctcccatcatcagggctgctgtgacatttgccaccctgtgctcaggctgtgggctggatgcccaggagtgggctgggctggtgcatttcagatgctgcca

SEQ ID NO: 49468 - DNA, 201 bp, Homo sapiens
ttctgttcctgtgcttgttgctggaattcacggcaaagtgggtgggctggcaggtcacagtggctgcacccggtctgcagcacagtgcctggggtgagggytgaggaggaagggaggagatgcttggcctccctggcttctccaagtctacccggagaagaaaggacagtcagaggggcccacgcctcccccacacccctg

SEQ ID NO: 49469 - DNA, 201 bp, Homo sapiens
cagagcctatgcgctgaacccccgagcttggccccctctctaagtggctggctcacccagaggcagtgactgcatccccagcccactttggggatgtcctmaaccaggacccctgtcctcccagccactcaggagtactttccaggcagcagtgctggcacttgggccctgacaaggtactcacctttgagggcccaggtg

SEQ ID NO: 49470 - DNA, 201 bp, Homo sapiens
gagcctatgcgctgaacccccgagcttggccccctctctaagtggctggctcacccagaggcagtgactgcatccccagcccactttggggatgtcctaamccaggacccctgtcctcccagccactcaggagtactttccaggcagcagtgctggcacttgggccctgacaaggtactcacctttgagggcccaggtggg

SEQ ID NO: 49471 - DNA, 201 bp, Homo sapiens
aggtctgtgtggtcccaggggagaggcccagagcttgtgggaaccgacttattttgctgaggcagcgtcatcttttcatcctaccaactccttttcctttstgagcatccttcaagctataggtccttctgcctgcattgtcttttatgcctcatgaccattggcaaaaatgggattgtctttgttttttagatgatgaaa

SEQ ID NO: 49472 - DNA, 201 bp, Homo sapiens
cgtgcagaagttgagaaagcatgttaggatgttaggtggttttctatctctaacaggaaagaatacatattgaaatcttacgtatttgtttagatcagggyctgaaaaatcccctgatttctaattttcacttgaaaaataatcaaaaagttttcctatacttataaaaatgtgtctcctccaaaacactggaaaaaatac

SEQ ID NO: 49473 - DNA, 201 bp, Homo sapiens
caccatggctggtctcaaactcctgagtttcgccaggctggtttcaaactcctgatttcaggtgatctacctgccttggcctcctaaagtgctggcattayaggcatgagccacagcacctggctggcagttaggaaatatttattgaatatgagaaaagaaaaatagagcaaattgaatcttcaagtagtatgtgagtaa

SEQ ID NO: 49474 - DNA, 201 bp, Homo sapiens
ggatctatgtgtgtccctcaccacggcctcagtgctcccaggaaagccctccaagtcatcaacacagcattttctattcctttctcccaggtatccagtcrgaattctttattaacaccacccgagcaggtccagggacattatccgtcaccatcgaaggcccatccaaggttaaaatggattgccaggaaacacctgaag

SEQ ID NO: 49475 - DNA, 201 bp, Homo sapiens
gctgggagatagaccagggagctccagattctttggagccgctgagcaattttcctaatgaaatggtccaggaaccccagtgtgctcggggtataccagamgggcctccttccttaactgccttgaagaacaagcagtgctgcgtttaacatgcattaaactcacaggaactgagctggacatatttgagggggtggggga

SEQ ID NO: 49476 - DNA, 201 bp, Homo sapiens
cgcagtgtggactcactggggcatgtttgcatttggtgttactttggaccctcttgggaaagcagtatgtcctggtttcttgagtctcttgtgtgtgtacycccaccccgcataaggagagtgggatggagcagacttgcctcccaggggtgaggggtgagtggctgcatggttgcctggcatccagccctaggagcaagt

SEQ ID NO: 49477 - DNA, 201 bp, Homo sapiens
agccagcttcccctacaacacattggctttaagggaggcggatggggactgttggaggatgttcagtgccaaaggacgtagggtgcacagcttcatggagrtgcacctctgtggagacgtccagaggcagggagaagagctttggggaacacaaattctgagagggatgaagagtactaggcaccagggagagaccgagag

SEQ ID NO: 49478 - DNA, 201 bp, Homo sapiens
aaacagcatcaaagtcgctgggctagggtgacagaggaggctgccaacagggaattctgtggctcctgggacaggaatggatatgggaggttgggggccartattttcggttctcttgaggagttggcgagtattagtctttgccctgatggatagaaggaatctgtctgtgtcttgcatgaaccgtgtacttcccccagt

SEQ ID NO: 49479 - DNA, 201 bp, Homo sapiens
gcacgtctgccttcccctctcactgacctggacacatgcccactgctgagtcatttcctgtggctaaagaaatgccatgtgctcattgactaaggcttagygaagaaggatttttccctgatccactcagggaccacacctggacatggcggtggagccagcttcccctacaacacattggctttaagggaggcggatggg

SEQ ID NO: 49480 - DNA, 201 bp, Homo sapiens
caagccaactcacacaataaaggggcccagtaagttgcataactagaaagttcaagacatccaagacaggtttcagcaatttgatttggtcattgagctgygccctgcaaggcgtcaaatatttctgctgttctgctttgtgggcctggttctggccttcctcttggtggcaggatggccttcctcttggtggcaggatgg

SEQ ID NO: 49481 - DNA, 201 bp, Homo sapiens
tgcgtgcctgtaatcctagctatgtggggtgggggctgtgatgggacgatgtctgagatgggagcctgggaggttgagtgagctgagattgcgccactgcrctccagcttgggtgacagaggaagaccctgtctcaaaaaaaaaagaaaagaaaaagaaagaaaatttctaccttattttgtgcttggctccttattcatg

SEQ ID NO: 49482 - DNA, 201 bp, Homo sapiens
gtctcagaaagaaagaaaaaggaatgtaggctctgtgtgaacatttagatctatgtttcctagtaggcagaaaggcagtggggagcctcaggaggaacaartgtaaaggatggggtcagatcctggttttagtctgaaaggccaagtggcaagctggtgctcccagagtggtccatttgaggaagcagtggcactggaaat

SEQ ID NO: 49483 - DNA, 201 bp, Homo sapiens
gaggtgggaggattgcttatgtccaggaggtcgagactgctgtgagctgtgatcatgccattgcactccagcctgggtaacacagcaagaccctgtctcaraaagaaagaaaaaggaatgtaggctctgtgtgaacatttagatctatgtttcctagtaggcagaaaggcagtggggagcctcaggaggaacaagtgtaaa

SEQ ID NO: 49484 - DNA, 201 bp, Homo sapiens
aggaaggtataaggctcaaagagttgctcaaagtttagtgaaggcctggccaaaaagcagatgatgaccccaaatgatcactagtaccacaggagaactgwgaagcaaatggtaaagatggtcagagcaggagagagaaatagtttctgcctcggtgagttcaggagggcttctcagaggaggtgacatttgatgtgggcc

SEQ ID NO: 49485 - DNA, 201 bp, Homo sapiens
tttaggaaattggagtaggctggcacttggggtgggggtgggatgggagtgatctggtgatcaaagaccctctaattctgtgttctgtcctccctcctcastctatatcccctagggcagcacagtccaatagtaggttctgcagtgatcaaaatgcttcaagtctatgctatgcagcatgatagccactaaccatatgtg

SEQ ID NO: 49486 - DNA, 201 bp, Homo sapiens
gctgctgccgcaggagaagtgtgttcatcagcatcgccccctgttcttcccgggtcatttgatgccgagtgatatgtaaattattgatcagagattttgcrgaggcccacgcaagcaacatctggtgctggttagcaaagagaggcatgtatcgttttgtcttgcttttgagactttttaggaaattggagtaggctggca

SEQ ID NO: 49487 - DNA, 201 bp, Homo sapiens
tttgtggccaacttaactaaaacctacggagggagataaacccagcacttattgagggcaggagctgccctcatgcatctcgaagatttctttcaaatctkccgaggcatttatctccctcttgaggatttagcggcaagcggattcaggtaatgtaaatgattctgtctaaaaggagctggtttggaaaaatcccctcca

SEQ ID NO: 49488 - DNA, 201 bp, Homo sapiens
ttttatttatttatttatttatttatttatttattttttttttttttgaggtggagtctcactctgtcgcccaggctgaagtgcagtggcatgatctcggytcactactacctcctcctcctgggttcaagggattcttctgcctcaggctcctgagtagctgggattacaggcgcccaccaccatgccaagctaattttt

SEQ ID NO: 49489 - DNA, 201 bp, Homo sapiens
caattgatgcccgagatgccggggaaggcctgcttgctgttcaaataacggtaacttggagttattttctgagccaaaccttaatcctaagacttaatttytgggccagatttaagaacaagggtttcaataaccgatttctgactcaatgcaagttgtttgttagattttcccaccaaagagtcagtaaatgtgcagaag

SEQ ID NO: 49490 - DNA, 201 bp, Homo sapiens
cggtggactgtactgaggctggggaaggtgagaaagggctttgttcaacccagtgatcattgctccgtggggaaggcagttcttttcataacgtttcaatkccttttgaactaggaagtagtccatctgaataggtaatcatctactgagcctctgagtcattccttagtgatatctttgctaatccatcatccctttccc

SEQ ID NO: 49491 - DNA, 201 bp, Homo sapiens
tatgtggatactgtaaaaccagacacaggtcattttgttcttcccccaccccctggttacctgtctttgtataagggtttagttggggcattacacagaargagacttactatctgcctttgcttcaggttcgagcatacgggccaggtttggagaaatctggatgcattgtcaacaacctggccgagttcactgtggatc

SEQ ID NO: 49492 - DNA, 201 bp, Homo sapiens
ggtgatctgcccggctcggcctcccaatccgcttattcttaagacgacacatggctagggcagtgatgctgaccacgtgctgttctcacctcagtggtcgrgtcttctcatctgactttttgggcatgatttagaccggcagatagttctggaacaaaccccttaccatttgaggttccgtttgcagtgggttgtgaggtg

SEQ ID NO: 49493 - DNA, 201 bp, Homo sapiens
ttttccatttactgtgtattctgtatttactgggcacattagtatttagttagttagtggttcttgacatactcaaagcagaactagtgtcagttgggtargggagggctgaaggcctcattcttacttgagagcctataagttggtgtcatccaggaaaaattcaaagtgcagcattaattgatttcctaatatcctctt

SEQ ID NO: 49494 - DNA, 201 bp, Homo sapiens
gccccaagtgacttcagtgctgggcacagcataggagcagtactaatgatatggacagtatgctcagaggacgttagggagcacagctttgtgtaaagggmatgccctgccctgtccggatttaaagcagctatagcactgaaaccccatggtcacccttgcatttctacacttctgcctgtgccaagtctagtttgtgtg

SEQ ID NO: 49495 - DNA, 201 bp, Homo sapiens
gcagggcctgcattccagcaaggctgctggattcttggggggaactcgtctctccctcacactttcctgttacattatgcctggccgattgtggtgaaggsgatcttgatctactgagacagccatgagatttcttggagcctcgatttggagggagggaacttggccaaccatggagagaagaagccggctgtgtgccag

SEQ ID NO: 49496 - DNA, 201 bp, Homo sapiens
cccccttccttattacaaaaggaatgtgacaaaatatacataggccaaatgctacacccttttaacacttgatcagcaacagctttcagcagggcctgcaytccagcaaggctgctggattcttggggggaactcgtctctccctcacactttcctgttacattatgcctggccgattgtggtgaaggggatcttgatcta

SEQ ID NO: 49497 - DNA, 201 bp, Homo sapiens
tttggcagttggcttcacctctgtgggcctctgttatgtcatctgtaaaatgggattaaccctaaaagccaccctcacagggtcattgtgaggattgcacraggtgatgcaagtggcacagggtctggcccaggagagggggctggaagagagcgagctgccattgtattttggttgctgtggatctaaggagaagagatg

SEQ ID NO: 49498 - DNA, 201 bp, Homo sapiens
ggagtgcagtggcatgatctcggctcactgaaacctctgcctcccaggttcaagtgattcttctgcctcagcctcctgagtagctgagactccaggcacgygccatcacacccggctaatttttggatttttcgtagagatggggttgcaccatgttggccaggctggtctcaaactcctgacctgaggtgatccacccca

SEQ ID NO: 49499 - DNA, 201 bp, Homo sapiens
gaacatctggtcagcatcaagaaaaatggcaaccatgtggccaacagccccgtgtctatcatggtggtccagtcggagattggtgacgcccgccgagccaragtctatggccgcggcctgtcagaaggccggactttcgagatgtctgacttcatcgtggacacaagggatgcaggtctgtgtggtcccaggggagaggcc

SEQ ID NO: 49500 - DNA, 201 bp, Homo sapiens
aatgtggtccatgaggactcaagtctctaggtcctgccagcttcttgtctttgctgcaagcaggcatgaatcccatcattcttcattggttgggtctactsagtgttcaaggctcattttttttcacttaactttgtgtaattagttcttgcgtgttcatccgtgaacagcatatggcatggcagctctgtgaagccaggg

SEQ ID NO: 49501 - DNA, 201 bp, Homo sapiens
ctaccctggctggctgccccagaagagtggccttggcatctgagctccctctagcaggagctcttaaccttttgtgtgccattgactcttgccatctggcraagcctatggggactgttcttgggataatgttttaaagcacataaaatgaaatatgtcacattataaaagaaatcattgatattatagtacagttaccaa

SEQ ID NO: 49502 - DNA, 201 bp, Homo sapiens
tgaggactcaagtctctaggtcctgccagcttcttgtctttgctgcaagcaggcatgaatcccatcattcttcattggttgggtctactcagtgttcaagsctcattttttttcacttaactttgtgtaattagttcttgcgtgttcatccgtgaacagcatatggcatggcagctctgtgaagccagggtaaccacatgt

SEQ ID NO: 49503 - DNA, 201 bp, Homo sapiens
tgtctctatttcatttttcacttaatattattttcccctgcagttgactcacttgtaaaacaaatgtatttgaaaaggagactttgtgtcactataataayggaaaaacagcgtcactaggtaaatggaaggtaaccataaataaaccccaaacagttattaaattccagccagcactgttgcctgttcacaacatgaggc

SEQ ID NO: 49504 - DNA, 201 bp, Homo sapiens
gaaagcagctataggaatacgtaaacaaacgtgtgtggccatgttccagtaaaactttatttgcaaaagtaagcaatgggccagatgtggccttcagactrtcgtttagcaacccgttttaggtaatagcaataagcaaaagagaaaaataagaaatcacatttaattttcccttctagagagatgatatgaatcgtcttg

SEQ ID NO: 49505 - DNA, 201 bp, Homo sapiens
aggagcagttagagcaaatgggctgtgtgtctagatgcccgcatataaactgagattctctttttcaatgaactcctttgttcatgaatgccacggggcaraatctgctgtggtttacattaagaccgtctacgtgagtgctgtcaggggccaagggacgcagtctacagctttgccttgtgggcattgcacttgcccctc

SEQ ID NO: 49506 - DNA, 201 bp, Homo sapiens
tgccatcacatgggggggacaccacattccaaagaggtgaggctcctgctgcagaggggtcttctctggagggtactcggcccagggcggactcatgggtrgttgcttcccgggctgcaggagggaaagagatctgctttgttgaaaacttttttttttttttttcggagcagcacagacatttggcctgttctcaaaagc

SEQ ID NO: 49507 - DNA, 201 bp, Homo sapiens
cccagcaccccggggagatacagcattgccatcacatgggggggacaccacattccaaagaggtgaggctcctgctgcagaggggtcttctctggagggtrctcggcccagggcggactcatgggtggttgcttcccgggctgcaggagggaaagagatctgctttgttgaaaacttttttttttttttttcggagcagca

SEQ ID NO: 49508 - DNA, 201 bp, Homo sapiens
ggcccctcgtagccaagcaagatttctaaagccaattagctgggaaatcctccatttcctcataccttgaagcagagatggctgtgtttttagctttgaartaatctcccaggctttgaggggagaggtcccatactctggggcagcccacttggtttttatgtatggtttatgttttgtcagtgtggctgcctctctgtt

SEQ ID NO: 49509 - DNA, 201 bp, Homo sapiens
cttttgtttgtgaggtctagaaaccagaggtgaggaaggaggtgtccctggaactccccctggctgcagggctcacagcacacaccatgacaccacaggggtgtgtgtgtgtgtgtgtgtgtgtgtgtgtgtgtgtgtgtgtgtgttgaggggagtgttgttgagagccaactatgccaggagatccttggtgacagcgga

SEQ ID NO: 49510 - DNA, 201 bp, Homo sapiens
ttttgtttgtgaggtctagaaaccagaggtgaggaaggaggtgtccctggaactccccctggctgcagggctcacagcacacaccatgacaccacaggggtgtgtgtgtgtgtgtgtgtgtgtgtgtgtgtgtgtgtgtgtgtgttgaggggagtgttgttgagagccaactatgccaggagatccttggtgacagcggac

SEQ ID NO: 49511 - DNA, 201 bp, Homo sapiens
tttgtttgtgaggtctagaaaccagaggtgaggaaggaggtgtccctggaactccccctggctgcagggctcacagcacacaccatgacaccacaggggtktgtgtgtgtgtgtgtgtgtgtgtgtgtgtgtgtgtgtgtgtgttgaggggagtgttgttgagagccaactatgccaggagatccttggtgacagcggaca

SEQ ID NO: 49512 - DNA, 201 bp, Homo sapiens
ctgaaagctcttttgactaaatgggtcacctttctgagtattttcataaggctgtcagcctttaccgtgccagacaagttttctggaatttcctttccagaaaaaaaaaaaaaaaggctactaaagaggttggagttatttggaacacagggtggaattctggcattcgaactatagggaaacgggtggggatttgtggca

SEQ ID NO: 49513 - DNA, 201 bp, Homo sapiens
tccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgct

SEQ ID NO: 49514 - DNA, 201 bp, Homo sapiens
cctcggcctcctaaagtgctgggatcaggcttgagccaccgaactcggcctttttttttttttttttgaaatgatgtctccttttgttgcccaaactgcartcttggctcactgcaacttctgcctcctgggttcaagtgattctcctgcctcagcctcccgagtagctgggactacaggcacgtgccaccatgcccagct

SEQ ID NO: 49515 - DNA, 201 bp, Homo sapiens
tttttttttttttgaaatgatgtctccttttgttgcccaaactgcaatcttggctcactgcaacttctgcctcctgggttcaagtgattctcctgcctcarcctcccgagtagctgggactacaggcacgtgccaccatgcccagctaatttttgtatttttatagagacaggccaagcttgtcttgaactcctgacctca

SEQ ID NO: 49516 - DNA, 201 bp, Homo sapiens
gacagagaaagtgttcacaagttgctgcacaagtctcattgcagtgcctcccagaggcgcgaagagcaacacctttcacctgggctgtcctagaaggcccrtggcagggtggggttggtgaacactggggcttaagggggtgaattcagaagacaaaggaccttctgggcaaagaagggcccagtagtgggaagtgcagga

SEQ ID NO: 49517 - DNA, 201 bp, Homo sapiens
tgggttcaagtgattctcctgcctcagcctcccgagtagctgggactacaggcacgtgccaccatgcccagctaatttttgtatttttatagagacaggcyaagcttgtcttgaactcctgacctcaagtgatccacctacctggccctcccaaagtgctgggattacaggagtgagcccctgtgcccagcctgaaattca

SEQ ID NO: 49518 - DNA, 201 bp, Homo sapiens
tccctccaggagcctgtcgtccatatgctgaatgtgatccttaaatgctctgtcttacaggggccagacattgtggctcatgcacttcagggggctgaggygtgcagatcacttgaggccaggagtttgagaccagcctggccaacatggcgaaaccctgtctctactaaaaatacaaaaattagccggaggtggtagtgt

SEQ ID NO: 49519 - DNA, 201 bp, Homo sapiens
aaaacagaccatccttagggtgtcaggatgatattttgacaaaggcattcatgcttagcaggatttctctccccctacccccaccccaagtgttgaaacgsctgagctaattaccttagaatgtaaggcttcctctgttgcttgtgaacgtggcagacttgggattctcagagacagagggcttcagaagcttgcctctgg

SEQ ID NO: 49520 - DNA, 201 bp, Homo sapiens
tggtctgggaacagttttttgtcttgtcaagagacagtctgtacatagatgaattcaattatattacttctgtagtaccctgtactcaaatttgaacctgycatacacattgcttttatcatttcataatacctgttgattttcccacgttagtacctatagatcctgacaagcaattttgttaagatgaagagttcttca

SEQ ID NO: 49521 - DNA, 201 bp, Homo sapiens
aattagccggaggtggtagtgtgtgcctttaattccagctacttggaaggctgaggcaggaaaatcgctagaacctgggaggcggaggttgcagtgagccragatcatgccactgcactccagcctgatcaacagagcgagattgtctcaaacaaacaaacaaaaaatgttctgccttacagagttcttaggtataaaaga

SEQ ID NO: 49522 - DNA, 201 bp, Homo sapiens
aaaagctaggtgtagtgacatgcacctgtggtcccagctactcaggaggctgaggtgggaggattgcttgagcccgggaagtcaagactgcagtgagctgmgattgcatgactgcactccagcctgggcaaaagagtgagacattgtctcaatctccccacccctgccaagaaaacccaaaaaatattgaggtataattgt

SEQ ID NO: 49523 - DNA, 201 bp, Homo sapiens
aaaagagtgagacattgtctcaatctccccacccctgccaagaaaacccaaaaaatattgaggtataattgttatacaatgaagaacacattttgattagyttatacacacactcctgtgtacacatgtacactcacacatcaggaaaccatcaccataatcaagacagcgaacctctctatccagccccagaagtttcct

SEQ ID NO: 49524 - DNA, 201 bp, Homo sapiens
aatgaagaacacattttgattagtttatacacacactcctgtgtacacatgtacactcacacatcaggaaaccatcaccataatcaagacagcgaacctcyctatccagccccagaagtttccttgtgcctctttgtaattcttgccttttatctctccatgtcttccacacccatgctcaagcattcactgatctgcttt

SEQ ID NO: 49525 - DNA, 201 bp, Homo sapiens
agaagtttccttgtgcctctttgtaattcttgccttttatctctccatgtcttccacacccatgctcaagcattcactgatctgctttctgtcattatcastcagttttcatcttttagccttttatataaatggaatcatatagtatgctgtttttttttttttgagacaagagtctcactctgttacccaggctggagt

SEQ ID NO: 49526 - DNA, 201 bp, Homo sapiens
gacctcaggtgatcacccgccttggcctcccaaagtgctaggatcacaggcatgagccactacgccctgccagtatgtactctttttgtctggcttcttcyagcatagttattctgaaattcatccttgttgcatgtgtcaatagtcctattcctttttattgctgagtagtagtccattgtatggatatactacattttg

SEQ ID NO: 49527 - DNA, 201 bp, Homo sapiens
ttgaaggctgaggatggagtagttcagctgaatatagtagagggaaatggccctctcagcacctggagaaatgatagggattgaggcctcaggctctttgwcttggcagcctttcgagttctgtttgagatgacatccaggtgacctatagggcaagggctgagagagcctgtcttgcaggagagtggggtgacccaggag

SEQ ID NO: 49528 - DNA, 201 bp, Homo sapiens
gggtttcaccacattggccaggctggtcttgaactcctgacctcaggtgatccacctgcctctgcctcccaaactgctgggattacaggtgtgagccaccrtgcccagcctcagttgaggttttatatactgatggccagaataataagagtcttgccctgctctcttcccacattggccattctttggttcctccctcag

SEQ ID NO: 49529 - DNA, 201 bp, Homo sapiens
gagctccagaaagttaatatttgacttcacagcaccaggctttgggtcaggctgtgccctgagggtagccgaggttctagactgcccagacctggagtcargctgcttggggactgtcttccctcccagattattccaacaggagccaaggagggtgtgtgtgtgtgtgtgtgtgtgtgtgtgcacgcgcgtgcatgcctc

SEQ ID NO: 49530 - DNA, 201 bp, Homo sapiens
gacactatctacctgaagttagtgcagacgccattaagggctcagtccctcaaaactgcccctgacttcagaggccagtcagaagtggtgggtcctcaggyaacccacagcttctgtccaggtttgctacaaatcagaaggtcccattaccccttcctcatgttatgttatttgctagagtggctcacagaactcagggaa

SEQ ID NO: 49531 - DNA, 201 bp, Homo sapiens
tggggacacgtttgtttttaaaggtttatttaagagaaacaaaggaagcctgttcataactggttaagggataacaagggctttcaaaacaaaaccaacayaaaaataacagtgcagtgatgttttagcctgctgttgttggctgcctttcttcaagaaagtcagttgcaacttactgtgattcattaataagtgtgcagg

SEQ ID NO: 49532 - DNA, 201 bp, Homo sapiens
aatactgataacactaaatgcagaacggatggagagaaactgaatctggatcactcactcatacattgctggtgggaatgtaaaatggtgtagctactttrgaacactgtttggtagtttcttaataaagaaataggctgggcacagtgactcccttctgtaatcccagcactttgggaggctgaggctggaggatcactt

SEQ ID NO: 49533 - DNA, 201 bp, Homo sapiens
atatattaatattaatatcttctatgagccacgcagagacctaaatgctttgcttatattaactcatttacttctctccaaaacacatgtacaggagagtmattatcctcatggagggaggtgggactgaggcagtgggaggactcggtagcataactgaagttagcagcagcaacatgggccctgcagcctccattgctt

SEQ ID NO: 49534 - DNA, 201 bp, Homo sapiens
gcagggaggccaggaaaacagtcagggcccaacattgaccttatgcctatcccttttctgccagggctacttcagcagtaagtggcttactttgtcctcartatattaatattaatatcttctatgagccacgcagagacctaaatgctttgcttatattaactcatttacttctctccaaaacacatgtacaggagagta

SEQ ID NO: 49535 - DNA, 201 bp, Homo sapiens
gccgaggcgggcagatcacctgaggtcaggaattcgataccagcctgaccaaccttatgaaacccagtctctactaaaaatacaaaaaattagccaggtgwggtggtgggcacctgtaatcccagctactcgggaggctgaggcaggagaatcgcttgaaactgggaggtggaggttgcagtgagctgaggtcatgccgtt

SEQ ID NO: 49536 - DNA, 201 bp, Homo sapiens
ccatcgaaggcccatccaaggttaaaatggattgccaggaaacacctgaagggtacaaagtcatgtacacccccatggctcctggtaactacctgatcagygtcaaatacggtgggcccaaccacatcgtgggcagtcccttcaaggccaaggtgacaggtaacgaacaaccaccttcggagttactctcccttcctgggg

SEQ ID NO: 49537 - DNA, 201 bp, Homo sapiens; identical to SEQ ID NO: 14116

SEQ ID NO: 49538 - DNA, 201 bp, Homo sapiens
gtcagcaggcccagcagggctccaccattcaggggcatccgggcagcctgcagacactcctcagccgctttgcagggagcagctctcggcagcaggctggrgaatgcagcgttggtacccctgtgaaaccaaacagtctgggaccctagcaggtccagctgatttctggaagggatgatgtagctcagtgtcttgggtcac

SEQ ID NO: 49539 - DNA, 201 bp, Homo sapiens
aaatacatgggcagccacatccctggtaagctgagtcagcaggcccagcagggctccaccattcaggggcatccgggcagcctgcagacactcctcagccrctttgcagggagcagctctcggcagcaggctggggaatgcagcgttggtacccctgtgaaaccaaacagtctgggaccctagcaggtccagctgatttct

SEQ ID NO: 49540 - DNA, 201 bp, Homo sapiens
catgctggatttggcaagattgcaggtcccaggcagatgtccggacttagactctggctcttttttttttttccagacagggtctccctctgtcacccagkctggagtgcagtggcgcgatctcggctcaccacaacctccgcctcccaggttcaagggattctcctgcctcagccccctgagtagctgggattacaggcg

SEQ ID NO: 49541 - DNA, 201 bp, Homo sapiens
ccaggctggagtgcagtgttgcgatctcggctcactgcaagctccgcctcccgggttcgcgccattctcctgcctcagcctcccgagtagctgggactacrggtgcccgccaccacgcctggctaattttttgtatttttagtagagacggggtttcactgtgttagccaggatggtctcaatctgctgaccttgtgatct

SEQ ID NO: 49542 - DNA, 201 bp, Homo sapiens
attcttagtctagagataatattaagtcttttagtgtatccttctagacttttttctctatatatgcatgcaaatattgatttggtacagaaaatatcttrgacaagtctttatatctttatgcgtaaatatagggtatgccttcattttccatagcttccatggaattccattgtatggctctatccattgtcagcctct

SEQ ID NO: 49543 - DNA, 201 bp, Homo sapiens
atccctggcagccccttcacagccaagatcacaggtagggttgtctggcttctggggtcttcctcgtgggaagtatggctgcctctgactgccaccctccktatcagacccctggcagcaggctagacgtctctttgagtttaggtttcacagagacttgttgaggaggagcaggggatggaatgcaattttggattagct

SEQ ID NO: 49544 - DNA, 201 bp, Homo sapiens; identical to SEQ ID NO: 14119

SEQ ID NO: 49545 - DNA, 201 bp, Homo sapiens
ggctggagtgcagtgttgcgatctcggctcactgcaagctccgcctcccgggttcgcgccattctcctgcctcagcctcccgagtagctgggactacgggygcccgccaccacgcctggctaattttttgtatttttagtagagacggggtttcactgtgttagccaggatggtctcaatctgctgaccttgtgatctgcc

SEQ ID NO: 49546 - DNA, 201 bp, Homo sapiens
aaaatatcttggacaagtctttatatctttatgcgtaaatatagggtatgccttcattttccatagcttccatggaattccattgtatggctctatccatkgtcagcctcttcagttatttccagggttttgctataaaaacagtgctgactgtgtatccttggtaattgccttcagataaaaacccagaagtggatttgg

SEQ ID NO: 49547 - DNA, 201 bp, Homo sapiens
agattttcttcaaaaggtgaaatttgcagagaagcaaattctatgttaagagactttgcagttgcacagactttggttcgaattaaggccgtggtgtgaartaactgtgactgtgtctgccccttagccacaccgagactcagctttctcatttgtacagtggggggtggtcggcggggagaggttgagaacacccatggg

SEQ ID NO: 49548 - DNA, 201 bp, Homo sapiens
cacttgtaggtggtctggacttggctattgagggcccctcaaaagcagaaatcagctgcattgacaataaagatgggacatgcacagtgacctacctgccractctgccaggcgactacagcattctggtcaagtacaatgacaagcacatccctggcagccccttcacagccaagatcacaggtagggttgtctggcttc

SEQ ID NO: 49549 - DNA, 201 bp, Homo sapiens
tccgcctcccgggttcgcgccattctcctgcctcagcctcccgagtagctgggactacgggtgcccgccaccacgcctggctaattttttgtatttttagyagagacggggtttcactgtgttagccaggatggtctcaatctgctgaccttgtgatctgcctgcctcggcctcccaaagtgctaggggattacagacgtg

SEQ ID NO: 49550 - DNA, 201 bp, Homo sapiens
tcttggacaagtctttatatctttatgcgtaaatatagggtatgccttcattttccatagcttccatggaattccattgtatggctctatccattgtcagsctcttcagttatttccagggttttgctataaaaacagtgctgactgtgtatccttggtaattgccttcagataaaaacccagaagtggatttggtggtgc

SEQ ID NO: 49551 - DNA, 201 bp, Homo sapiens
caactgccttccaaaagggcagtaagaaagtgtccttcgctagagtgagtggctcactgcagttcaagatggagcagtgggggaagcagctctgtggtggyagtctactgagtgtatccttccagtatggttcccaactaatctccatttgccactgaccaggccacagatggggaagtcacagccgtggaggaggcaccg

SEQ ID NO: 49552 - DNA, 201 bp, Homo sapiens
ctctcaaaggcctttgtgggccagaagaagttccttcctggtggactgcagcaaagctggtaggtgtctgggccttttcaagggtggggtggggcaggggyaggctgggcaccctgggtacactggccttccctgctgaggtctcctgcagtgcccacccccatgtaggccagccgtttgcaagtaaccatcgtcatgacc

SEQ ID NO: 49553 - DNA, 201 bp, Homo sapiens
atatactacattttgtttatacatccttctgttgataacatttgggtggtttcttatttatttatttatttttgagacggagtctcactctgttgaacagsctgaagtgcagtggtgtgatcttggctcactgcaacctccacctcccgggttcaagcaattctcctgcctcagccttctgagtagctgggattacaggca

SEQ ID NO: 49554 - DNA, 201 bp, Homo sapiens
cctggcctcaagtgatccacctgcctcggccctcccaaagtgctgggatgacaggtgtgagccaccacacccagcccaggcctacatttgaaaaaaaaaawatatatatatattttccaccccttccatctctactgaagacttaatgagcttggttttggaagaaagggatacaaacagatttcaatcttctggccaaca

SEQ ID NO: 49555 - DNA, 201 bp, Homo sapiens
gttaatatcacatatggaggagcccacatccccggtgagctattcctcagagaggaccccagagaataattgattttgcaggaaaatgggtttgattttgsttatctctctgagtggggaaaacaatctgatatttgtaatagctgcaaaaggagagtttttcttagggctacatctccaagattatctcaactcccagta

SEQ ID NO: 49556 - DNA, 201 bp, Homo sapiens
catgttggtcatgctggtctcgaactcctgaccttaggcgatccgctcacctctgcctcccaaagtgcagggattataggtgtgagccaccacgcctggcygggtggtttctaaataaagctatcatgaacatcttttactactctttgtatggatgtatatttctatttttctgagtggaatgttaggatcatacatcat

SEQ ID NO: 49557 - DNA, 201 bp, Homo sapiens
tccctccccccaccagttgtcttgtaatgaactgctttaatggctaaagatcactttaatatcaaaacctcccccacctcccattagaaaaagaaatcatrttagggaacttcaaattgaatttacggaccttgtgtttaattttctatcagcagtggccccagcctggcccctgcagactgccccggaatctgtgggagg

SEQ ID NO: 49558 - DNA, 201 bp, Homo sapiens
catgatcacagctcactggaacctctgcctcctgggttcaagtgattctcgtgccttagcctcccaagtagctggaactacaggcatgtgccaccacagcyggctaatctttgtattgtttagtagagatggggtttcaccatgttggccaggctggtctcgaactcctggcctcaagtgatccacccgcctcggccctcc

SEQ ID NO: 49559 - DNA, 201 bp, Homo sapiens
ttattcatgggtggtggggagggtagcactagtgtatgctcccagcaaagaggaacatctcacgttgtgaagagatgcgcaaaactaagccagggcagggygtggtggctcatgcctgtaatcccagcactttgggaagctgaggtgggcagatcacctgaggtcaagagttgaagaccaccctggccaacatggtgaaac

SEQ ID NO: 49560 - DNA, 201 bp, Homo sapiens
ttactcaattgaatttggtttcaaagtcacatacctcaacttttcctttaatcaagaacagcccccctgccttttacacatttttttgtctttcgtgaccktgtcatttttgaagaaatcaggcccgttgtcttgtagaactggtgtttctcaagtgtgcttgggagggtcttggtaaaatgcacattctgattctggaga

SEQ ID NO: 49561 - DNA, 201 bp, Homo sapiens
tcctttcttgtggtttcctcccttttctgtggtgatggtcagagccagcggttataaattatttggaattttcctcagcttggttcctactcaagactttmaattaggagttttgttcccttttatgacttcacaatctttgggcaggctgccatctctacagcaggctaatatgagttgtaacttgaggtgagttacagg

SEQ ID NO: 49562 - DNA, 201 bp, Homo sapiens
gtttgtcttctgaactgagttgcaatgctgagtatgagtttgagagtcccaagaccatctaaagcaagcctgtccaacccacagactgcaggctgtaggcrgcccaggacagctctgaatgcgccccaacacaaattcgtaaactttcttaaaacattatgagatcctttcgcatttgttttttaaagctcatcagctatc

SEQ ID NO: 49563 - DNA, 201 bp, Homo sapiens
ccacagcgtcactgcatacccaagaggttagcaccgatacagtaataacatcttgtgtaaaacttcccaaaatgctcccaagtgtcctttatgacagtttwaaaaaaaatggcattttttgggatccaggaaccaattaacgattactcaattgaatttggtttcaaagtcacatacctcaacttttcctttaatcaagaa

SEQ ID NO: 49564 - DNA, 201 bp, Homo sapiens
accccggaccctgtctcaaaaaaaaaattccccagttctcagggtgtggtagaggccgagtcagtcatggctgagacaaggggactgtgctctgtgtgctyctgtgccctgtgtttatatggttcatacgctgcctgtccaccatgtttttcccgagagcctcggcagcgcaggcatcatgggaatgactgagtcaggtgg

SEQ ID NO: 49565 - DNA, 201 bp, Homo sapiens
atggggtttcaccatgttggccaggctggtctcgaactcttgacctcatgatatgcccgcctcggcctcccaagtgcgggggttacagccctgagccaccrcgcccagcccggtcctccttttattttcgaatccactcaggccctagctactcccattgtcccgacgttccagggttagttagcttcccttcctctgtgc

SEQ ID NO: 49566 - DNA, 201 bp, Homo sapiens
tttttattgaatcatttgaaagtactcagctcgtatcatgacccttcacccccacatactccaacaagcatctctaagaaaaaggacattctcctaaccasagtgtctctgcattcccaggacattcttctaaccacagcgtcactgcatacccaagaggttagcaccgatacagtaataacatcttgtgtaaaacttccc

SEQ ID NO: 49567 - DNA, 201 bp, Homo sapiens
ttgtaagtatttttattaaagttggttgcaaggcatatgcctgcgttgtacttgcagtcctagccagtgcaattagataagaaaaataggctgggtgtggyggctcacacctgtaatctcagcacttcaggtggccgagacgggacaattgcttgaggccaggagtttgagaccagcctggccaacatggcaaaaccccat

SEQ ID NO: 49568 - DNA, 201 bp, Homo sapiens
actacattttgtttatacatccttctgttgataacatttgggtggtttcttatttatttatttatttttgagacggagtctcactctgttgaacaggctgragtgcagtggtgtgatcttggctcactgcaacctccacctcccgggttcaagcaattctcctgcctcagccttctgagtagctgggattacaggcatttg

SEQ ID NO: 49569 - DNA, 201 bp, Homo sapiens
gagaagtcacagtccgttgttaaataactgagctattcatagccaaatcatttttaaaaacacaaatataagcaaaaacaaaacatttatttatttatttwttgagacggagtctcgctgtcacccgggctggagtgcagtggcgctatctcagctcactgcaacctctgcctcctgggttcaagtgattcttctgcttca

SEQ ID NO: 49570 - DNA, 201 bp, Homo sapiens
tgggtgtggctgccaggactttctccagtggaaaagggattccctctaggctgagcctcccctgggccttagggcctcacccttcccttcccccacacctstcctggcaggtaaggctgcttcctgcttcctgggcccagatggcagccgcaccacccagctgatctccagcagccctccccctccccaagggtggcttcc

SEQ ID NO: 49571 - DNA, 201 bp, Homo sapiens
gagctgaaattgcaccgctgcactccagcctgggcaacaaagtgagactccttctcaaaaaaaaaaaaaaaaaaaaaaaagagctgtactgatcgtttgtrgtcataaacagttcgtgtgcctcaaggtggggggaggaagtgtcacctcccagagagagcttggttcacattttaggtacagagttggaccctggctgcc

SEQ ID NO: 49572 - DNA, 201 bp, Homo sapiens
gggtttattgcagggatgcaaggcctcgttcactattagaaaatcagtcaacagcctggctcggtggctcacgcctgtaatcccagcactttgggaggccraggtgggcgatgggcggatcatgaggtcaggagatcaagaccatcctggctaacacggtgaaaccctgtctctactaaaaatacaaaaaattagctgggc

SEQ ID NO: 49573 - DNA, 201 bp, Homo sapiens
tcctcaggggtcagagtcatgaactgctctgcccagatcctgtggggctggagggtgcagtttcatactggctctaggtgatggcagtgctccgtgccccrcatgcggccgcctggcctcaccacggcagtgcaggcacagtcgttggcatgacgtgagcagctcacggagagtgatgtggtcttgcgtcctagcactggt

SEQ ID NO: 49574 - DNA, 201 bp, Homo sapiens
ggcatccttctagtatttctctttcattcctgaaattagaacgagggctgtgctgcagaactcgctgggccacatctagccctttggtggtgaattgttcytcttgggccccgattagccagtcaacaggtcacacagtctgtctgaaatgtgttccaagttctttctataaagaatccttccagagggaagccactgtga

SEQ ID NO: 49575 - DNA, 201 bp, Homo sapiens
ttctaaataaagctatcatgaacatcttttactactctttgtatggatgtatatttctatttttctgagtggaatgttaggatcatacatcataggtgtaygtttaactgttcaagaaactgccaaactgtttcccaaagtggttgtattgttttacatttccacgagcagtgtttgagagctccagttcttgcacatcct

SEQ ID NO: 49576 - DNA, 201 bp, Homo sapiens
ccttggctctgcttctctgattctgttgtctctccacagacgggtgggtgtagcagtcccaggcccgcagccacaccccacacctcccagaggaagaaggygggccctgatcccagcagtcccaggaaagccctgaggttcactgtgattggaccagcctatgtcacctgctcacatctcagcccaccactggcaagggtg

SEQ ID NO: 49577 - DNA, 201 bp, Homo sapiens
gctgaggcaggagaatcgcttgaacccaggaggcagaggttgcatcgagccgagatcttgccactgcactccagcctgggtgacagagtgcgtgagcctcygtctcaaaaaaaaaaaacgagaaagaaaatgttatcccagtgggataatagttatacacacagtattctgtatatcttctcccagaattgacagttgtta

SEQ ID NO: 49578 - DNA, 201 bp, Homo sapiens
gggaaggagtgcattttatttctcatttttcataattaagaaaatatcggccgggtgtgatggttcatgcctataatctcagcactttgagaggccgaggygggcagatcacctgaggtcaggagttggagaccagcctggccaacatggtgaaaccctgtctctacaaaaaatacaaaaattagccaggcatggtggcgg

SEQ ID NO: 49579 - DNA, 201 bp, Homo sapiens
gagcatcaagttgagtcttttatccaaattccaatgaaggagttggtgcttagaagcaagacttgggtttaggttccagactccaaaatcctgtgtcttcycacattggtgctcagtttctcattggatttggagaaacatttggtcctattaggtggcttggcatgaaaatctgaaaacttccatggagtggaaagtacc

SEQ ID NO: 49580 - DNA, 201 bp, Homo sapiens
agcgatcctccaacctcagtctcctgagtagctgggactacaggagtgagccaccatgctcggctaattttttttttttttttgggtagagagggagtttygccatgttgcccaggctggtcttgaactcctaagctcaaagcaatcctcctgcctcggcctcccaaaagtgctggggttacaggagtgtgccactgcacc

SEQ ID NO: 49581 - DNA, 201 bp, Homo sapiens
cctcctcacaacaggacgcatttgtgtcatggcttactcttaagaatgactgacgtgtcagaatagcaaatatgaaaatgattgataacacctagcattgktgagatttgcagggataactagctggcctcttaaatctatagataggaatgtaaacagaaacaaactttttatagggaaaagatatctaggacataatga

SEQ ID NO: 49582 - DNA, 201 bp, Homo sapiens
agctttttactagctgttgcttggaggctaacctcaggttttacaggctacgctcatatctctgccatgaggccttctgcataggcaattcataacacagstgcctgtttcctcacagccagcaagagaatctgtctcctgtctgctaaagtggagtttcatgcatcgtaatatggtcatgggagtaatagcccgtcacct

SEQ ID NO: 49583 - DNA, 201 bp, Homo sapiens
tgcagagaaggcaagggcagggaaagtggaaacaaatggcagtgagactcctggaaggtgctggccaggggcatggcatggcatgttctgttaagcaaggraaggactagaaaggggccatgattttggctgggcacttatcctcctcacaacaggacgcatttgtgtcatggcttactcttaagaatgactgacgtgtca

SEQ ID NO: 49584 - DNA, 201 bp, Homo sapiens
ggcagaggtgcacgtagccccttggtgatgggcgtggtagcctgaggcatgctgccgttcgctggatggggaggtccccctccacagtggagtccatgagygtccttggcctagcccttgtttctctgtttagcacttctctagcaaatcactatctcctctcctcgactcctctgtgcttcatctttaaaactgacaccc

SEQ ID NO: 49585 - DNA, 201 bp, Homo sapiens
ttccaaataacatagtatagcatgcagacttcgatgctagatgaaactctgaagtagagaatcatttttcacaaataggggatttgtatgcaaatatgcgkttctgtttgttgttttgagcaggtctccatgtagtggaggtgacatatgatgacgtgcctatcccaaacagtcccttcaaggtggctgtcactgaaggct

SEQ ID NO: 49586 - DNA, 201 bp, Homo sapiens; identical to SEQ ID NO: 14138

SEQ ID NO: 49587 - DNA, 201 bp, Homo sapiens; identical to SEQ ID NO: 14139

SEQ ID NO: 49588 - DNA, 201 bp, Homo sapiens; identical to SEQ ID NO: 14140

SEQ ID NO: 49589 - DNA, 201 bp, Homo sapiens; identical to SEQ ID NO: 14141

SEQ ID NO: 49590 - DNA, 201 bp, Homo sapiens; identical to SEQ ID NO: 14143

SEQ ID NO: 49591 - DNA, 201 bp, Homo sapiens; identical to SEQ ID NO: 14144

SEQ ID NO: 49592 - DNA, 201 bp, Homo sapiens
atgtgcctcctgctgctgggcgatacactatcaaagttctctttgcatctcaggtacgtggtggggcctgggaggagatgggtggagtaggcctggattckctttggccacttgtgtgcatgtctcatctactttttggtgttttgttagtattattatttttgagatggagtctcactctttcacccaagctagagtgca

SEQ ID NO: 49593 - DNA, 201 bp, Homo sapiens
gttcaagtgatcctcccacctcagcctcccaagtagctggggactacaggctcataccaccacccagctaatttttttttaatttgtttttatttttttatttttttttttgagatggagttttgctcttgttgcccaagctggagtgcaatggcatgatcttggctcactgcaacctctgcctcccgggttcaagtgatt

SEQ ID NO: 49594 - DNA, 201 bp, Homo sapiens
ttgaagaacatttgggttgcttccgtcttttgtctgttgtgaataatgctgggtgtacaaatatctctttgagtctctgcatttaattcttgtgattatamacccgaaatggaattgctggatcatatggaaatctctttttaattttttgagaaactactatactgtattccacagtggctgcactactttacagtcctg

SEQ ID NO: 49595 - DNA, 201 bp, Homo sapiens; identical to SEQ ID NO: 14145

SEQ ID NO: 49596 - DNA, 201 bp, Homo sapiens
aattttttgagaaactactatactgtattccacagtggctgcactactttacagtcctgccaacagcatgcaagggtcctggtttctccacatccttgctracatttgtttttttttctgtttttttttttttttgttgttgttgttgttgatagtgaccatcctgttgagtgtaagatggtgtcttattgtggttttgat

SEQ ID NO: 49597 - DNA, 201 bp, Homo sapiens
aaaaaaaaaaaaaaaaccacaaaaaaaaacattattcttggctgggcgcagcggctcacgcctgtaatcactgcactttgggaggccaaggtggatggatmacttgaggtcaggagtttgagaccaacctggccaacatggtgaaaccccatctctactaaaaatacaaagattagctgggtgtggtgacgcatgcctgta

SEQ ID NO: 49598 - DNA, 201 bp, Homo sapiens
aaacaaaacatttatttatttatttattgagacggagtctcgctgtcacccgggctggagtgcagtggcgctatctcagctcactgcaacctctgcctccygggttcaagtgattcttctgcttcagcctccccagtagctgggactacagacacccactaccatgcccggctaattttttttttatttttagtagagaca

SEQ ID NO: 49599 - DNA, 201 bp, Homo sapiens
cttgtcaccaaggacattccaaggggtttaggaactctggaaccaggggcagagacctatatatataatttcttactattttatacttatgttcacacacmcacacacacacacacacacccctatgcacagatgtttacagcagctttattggtaagagacaactagaaacaacccagatgttcttcagtgggcgaatgg

SEQ ID NO: 49600 - DNA, 201 bp, Homo sapiens
agacacgagaattgcttgaacccagaaggcagaggttgcagtgagctgggatcatgccactgtactccagcctgggtgacagagtgagattctgtctctcaaaaaaaaaaaacttactctttggccctttatggaaagtttgctgacctcttctgtagatggtagggtacggtagaaggtgttcaagccaggagtaacatg

SEQ ID NO: 49601 - DNA, 201 bp, Homo sapiens
gaagattatcttatagggttatgtgagggttcagtgagactaccatgtagagtactgggctttaaaaaaatcagctttctgatttatattctgtggaaatraggcttgtttgtttcaggttattctataatgtcttttggtgtggctgaagctgctgaggccatggggggagatttgtaaacaaggatttaaaaagtatgt

SEQ ID NO: 49602 - DNA, 201 bp, Homo sapiens
gactctggccaaagcagtggcctcagcaaagccacccacaggggtggtgtgagtgctgccagactccccaggcaaatccagcccggctccacgctgaactmtgggcctgcggcttgccttttgtgaaaggcatggtatcattttaccgtaagtgatgtccattttacagatgtggaaagtgagatgcagaggttgagtcac

SEQ ID NO: 49603 - DNA, 201 bp, Homo sapiens
cctttctcccacatagaggacagtgtgcctaatttcttacgtaatctggattttcctcgccaatgatatgttcttggattcacagaagtggcaaatggggktttccctctttgaagaggaaccttctccttcatggggttcagcaggaggttttatcttttgaagctcagggcagaaatggtttgggggaaattaggtcat

SEQ ID NO: 49604 - DNA, 201 bp, Homo sapiens
acaggtgctgctaatacacctgtgttttatggtcttcgtttgtaatgaaaagaaatgccattaataaattttatttatttatttatttatttatttatttwttttttttttttttgaggtggagtctcactctgtcgcccaggctgaagtgcagtggcatgatctcggctcactactacctcctcctcctgggttcaaggg

SEQ ID NO: 49605 - DNA, 201 bp, Homo sapiens
ttggccccagaggccacgtgtgctactgttggcccacacgggcagctgtccataggctgatgtcagtctgggctggtagctaccccgttttggccaaatgmtattcctttgccctctagggcaaatgttgtccgtggtaaagattctgagtcccctcaaagtgggaacgttgaaactgggcatgactagaggtctctgccc

SEQ ID NO: 49606 - DNA, 201 bp, Homo sapiens
gtgtgagtgctgccagactccccaggcaaatccagcccggctccacgctgaactctgggcctgcggcttgccttttgtgaaaggcatggtatcattttacmgtaagtgatgtccattttacagatgtggaaagtgagatgcagaggttgagtcactccccaaacaacactcccccaaaaagcagtcagctgggaggaggca

SEQ ID NO: 49607 - DNA, 201 bp, Homo sapiens
ttacccttaactactctgctaaactccctctggcgctgggggtacgcatttttctcaaatgttagactctctccctctgactttgttgcccctttttttckgttttgttttgttttgttttgttttccaactgtactaccttttctaacccacacttgcctttccctgttctgtcctctgaatctgcgtctgcagacgtgg

SEQ ID NO: 49608 - DNA, 201 bp, Homo sapiens
gtgctgctaatacacctgtgttttatggtcttcgtttgtaatgaaaagaaatgccattaataaattttatttatttatttatttatttatttatttatttwttttttttttgaggtggagtctcactctgtcgcccaggctgaagtgcagtggcatgatctcggctcactactacctcctcctcctgggttcaagggattc

SEQ ID NO: 49609 - DNA, 201 bp, Homo sapiens
gcatgccccgtcagcgggagctgctgttctgttcctgtgcttgttgctggaattcacggcaaagtgggtgggctggcaggtcacagtggctgcacccggtmtgcagcacagtgcctggggtgagggctgaggaggaagggaggagatgcttggcctccctggcttctccaagtctacccggagaagaaaggacagtcagag

SEQ ID NO: 49610 - DNA, 201 bp, Homo sapiens
aatcagaaagccgggccgtagcccttctctgtgacttacaagctacatgatctgggcacgttgctcaacctcactgaacttcagtttgacatagattgaarctctttgtttttatttggagaacatttagatccaagaagctcttctaaggaacagagactgttttacagggttactgcaaagattagatgaggtcaggca

SEQ ID NO: 49611 - DNA, 201 bp, Homo sapiens
gtgatgctaaggttcaccctttgttgaaggctccctgagctctggctgttgcttcaggggctttcctactaagactgtgtctctgctacaggaaatccccrccagccctttcagagtcaaagttgacccttcccacgatgccagcaaagtgaaggcagaaggcccagggctcagcaaagcaggtaagatggcacgtctagg

SEQ ID NO: 49612 - DNA, 201 bp, Homo sapiens
tgcctgtaattccagcactttggaaggcagaggcgggagcattgtttgagcccgggagtttgagatcagcctgggcaacatggtgagaccctgtctctctytttttttttttttttttgagatggagtctcgctctgttgcccagactggagtgcagtggcgcaatctcagctcactgcaaccttcacccccaggttcaag

SEQ ID NO: 49613 - DNA, 201 bp, Homo sapiens
gctcaccacaacctctacctcctgggttcaagctattctcctgcctcggccttctgagtagctgggattacaggcgcccgccaccatgcctgaccaatttktgtatttttagtagagacgggtttcaccgtgttcaccaggctggtctcgaactcctgacctcaggtgattcatctgccttggcctcccaaaatgctggga

SEQ ID NO: 49614 - DNA, 201 bp, Homo sapiens
atgccccgtcagcgggagctgctgttctgttcctgtgcttgttgctggaattcacggcaaagtgggtgggctggcaggtcacagtggctgcacccggtctrcagcacagtgcctggggtgagggctgaggaggaagggaggagatgcttggcctccctggcttctccaagtctacccggagaagaaaggacagtcagaggg

SEQ ID NO: 49615 - DNA, 201 bp, Homo sapiens
tcagtattaaaggctcaaagtcctcgggtttgtttgtgacatcagggatccaggcattagagagtgacctgttatagaaggccctttcccaatgctgggcycttttggcttatcttacccttctgtttacctgtggtaatagaagtctgctcaccactcgctaagtcagagtgatgctaaggttcaccctttgttgaaggc

SEQ ID NO: 49616 - DNA, 201 bp, Homo sapiens
gtgcctggccacgggtgagtacagggcatctcaaggtcaggggcacaggctttgcaatcagaaagccgggccgtagcccttctctgtgacttacaagctayatgatctgggcacgttgctcaacctcactgaacttcagtttgacatagattgaagctctttgtttttatttggagaacatttagatccaagaagctcttc

SEQ ID NO: 49617 - DNA, 201 bp, Homo sapiens
tttgaggtttaaaacttagtttagaacgcaattgctttgaccattttggagtgtctatactttttttcttcttctttaagttttcttttttctttttttcttttttttttttttgagacagagttttgctcttgttgcccagtggcaacaagagtgcaatggcgaaatctcggctcaccacaacctctacctcctgggttc

SEQ ID NO: 49618 - DNA, 201 bp, Homo sapiens
acatgagcagtgcacacagtgaggcagggggagctgaccgaggcctgcatggccgaggtcccgggggagcagcagtgctattctgggtgtgcacaaggtgktctccaattcccagcttgtgctcagaatcccacaacctctcttccaggcagccccttcagggttcctgtgaaggatgttgtggaccccagcaaggtcaag

SEQ ID NO: 49619 - DNA, 201 bp, Homo sapiens
tgggccttgaatgatggaggggcccgaagggcagagtgctccagcctgctcagaagaactatttctaacaatgttttttaatagtattttactgggtccargtggaggagaacttgatgaccttctccatgtcttctctaggtcaacatcgggcaaggtagccatcctcagaaggtcaaagtgtttgggccaggtgtggag

SEQ ID NO: 49620 - DNA, 201 bp, Homo sapiens
actcccccatgccatgcccagggcaggcattgctaatcttcactgcctccattctccatgccctgttcacggaagacatttctaatgcattttagcagtcttttttttttttgctgaatccagatgtggcctcagaatccttctcaacacagtgtactagcaccacttggtgctcctgatctactgtatcatctcttgaaa

SEQ ID NO: 49621 - DNA, 201 bp, Homo sapiens
caggaggagataagccagcttggtccccttcatcctacccaggggcctctggggtacctgagccaaagtgcacagttcattggctgtgtggatggaagggmtatgggacttgaaaatgggacactggtcctgggcagctgaccgacatggtcctccttaacctgctgtctggggagatgggttgcatctggctaggttttg

SEQ ID NO: 49622 - DNA, 201 bp, Homo sapiens
tctcttaccaattgagataggcccatgagacttctggtcttccaaagcccagaacatccccacattatagtttaaccactgtaacaaagaggttttttttktttgtttttttgttttttttttgttttttttttgggacagaatctcgctctgtcgcccaggctggagtgcagtggcatgatcttggctcactgcaagctc

SEQ ID NO: 49623 - DNA, 201 bp, Homo sapiens
tttgtttttttgttttttttttgttttttttttgggacagaatctcgctctgtcgcccaggctggagtgcagtggcatgatcttggctcactgcaagctcygcctcccaggttcacgccattctcctgcctcagcctcctgagtagctggggttacaggcgcccaccatcacgcccggctaattttttgcattttttaata

SEQ ID NO: 49624 - DNA, 201 bp, Homo sapiens
ttttttgttttttttttgggacagaatctcgctctgtcgcccaggctggagtgcagtggcatgatcttggctcactgcaagctccgcctcccaggttcacrccattctcctgcctcagcctcctgagtagctggggttacaggcgcccaccatcacgcccggctaattttttgcattttttaatagagacggggtgtctgg

SEQ ID NO: 49625 - DNA, 201 bp, Homo sapiens
gactggcttgtcctagatcacatgttctacctgaaattggggacattgcagaggattggtggagtggacctcaaggaggtgtttcacgtggcttcctgtgwcactaggttgccatttattctttagaaagcccctttgtttgatgaaaccctggtgtcacaggctgtgtgacttagggtaatccccttgtccacatctgtg

SEQ ID NO: 49626 - DNA, 201 bp, Homo sapiens
agactgagccagaatcagggtcatcaaatagcaccccggctatactttcttctcttcatgacaaacattgctggtcagttgatatgatgttctttcccacygggcccagacttgacattagagtcttttttttttttttttttttttttttgagacagtctcgctctatcaccctggctggagtgcagtggcaccatctca

SEQ ID NO: 49627 - DNA, 201 bp, Homo sapiens
aggtggagtccaggatagtgcccatgtttgtagcttggggtcctggtagaatgggagctggctatggagtatctttgttggagagtgggtatagggaaacrgagagagagagaaagttgcagggggtgcgggagatggatagctgcagagaaggcaagggcagggaaagtggaaacaaatggcagtgagactcctggaagg

SEQ ID NO: 49628 - DNA, 201 bp, Homo sapiens
taaggaaccccaggctaagccacctgggtgccctgcagctcaccaaggaagtcagctccatctctctgctcctctacctagcatgtggcttctgtccttarggtctcctcctggaccataaggctgccagtgctctggccatcacatccacatggcaggccagaaggaggaagaaagaagggaaaaaggggtcctcccagc

SEQ ID NO: 49629 - DNA, 201 bp, Homo sapiens
tttgagcctgcagtatggtgggtggaagtggcaagagtggaaagcggattggatggggtttatgtaggttctgaggtgctgtgtatgtttaaggagctgaytgtgtgcagcgggaaccctggtgaatttggaagcacagaggcacctgacgagaaagatggttctggggttatgtgaacagtgattcggcttcaaggctat

SEQ ID NO: 49630 - DNA, 201 bp, Homo sapiens
tccaggggctcagggcaagatgtagtccaggaacaaggagtctttgagcctgcagtatggtgggtggaagtggcaagagtggaaagcggattggatggggkttatgtaggttctgaggtgctgtgtatgtttaaggagctgattgtgtgcagcgggaaccctggtgaatttggaagcacagaggcacctgacgagaaagat

SEQ ID NO: 49631 - DNA, 201 bp, Homo sapiens
ctttgtctcctaaagtgttgggataacaggcatgagccgccacgcctggccaatttcagagtatttttaagactctccatgcaaacggaaatacagatatrtaagagagtgtcttcccagccttccctcatgtggacgaaccattacatatttgaccatttccctattggagggcattttggttcttcctgccctcgctgt

SEQ ID NO: 49632 - DNA, 201 bp, Homo sapiens
ccccaggattaacaagactcatacttgcaaaagagagtgaagaagagaaactaaaaaaagcaagaggctgtgtgtgaagctagattcaaacagttaaagayagcaacacatggcaaaggatgggaatttgaggaagtgggtagtgaaagcaattcttgagctaaattacaagaaaacacggtgaatttgtatctgtttcct

SEQ ID NO: 49633 - DNA, 201 bp, Homo sapiens
gtgtcttcccagccttccctcatgtggacgaaccattacatatttgaccatttccctattggagggcattttggttcttcctgccctcgctgtccccagtsttgctgcgcaaatcgacttttcccctagtcacctcacactcacaaagatgtatctgtgagatttagttaccagaggaggcaatgctagggccccagtgca

SEQ ID NO: 49634 - DNA, 201 bp, Homo sapiens
attttcgaggcttggggagtctcctatttcatgtggatgggaacctggaggtctttgggcaagtcgccatctttttattgttccaagagtttggtgaagcrtttgaaccttcacctgtcaaaatcagttttggaatgagaactgctctctctctagtccttataatagcagaaggaaggtatcatttatcccaatgagacc

SEQ ID NO: 49635 - DNA, 201 bp, Homo sapiens
gtgccgacccgcccccgcgcgtgcacccctgcggagggcgaggatttcccgcagcgcgcccccacctcggagataagggggagtcgtccccaggggtgggwtatagggggcctagaccccctccccggtgtcttcccctgggatgggacctgttgtgatcgctccccgccatccgccccagcagtgcacctttggctggct

SEQ ID NO: 49636 - DNA, 201 bp, Homo sapiens
tatcaaatttttggagctttgccagtctgatggttggaaagaaacagaatctcagcgttgctttatttgtatttctcttgtgaatgagaccacacaacttyccctatgtctatttgtatttctttttctgtgaactgaacatttggatccacggcctgtttttctatttggttattggcctttgtcatatagtttctaaga

SEQ ID NO: 49637 - DNA, 201 bp, Homo sapiens
aaccctaaagtttacttgactgacttaaaccaggccagcgccagagcaggcagggtgcgtgttcccaagacttcgggtcactaggcagcttccagggtggygggtcactggtccagtcagctccttttccttcctctcccttttgtgctactactaccaaaataatttccaaataaccttaagttctgctctttcttgcat

SEQ ID NO: 49638 - DNA, 201 bp, Homo sapiens
agtatttgtcttgtcttttctctcgtgtaaatctgtttcttctttagagccgcttcgtcttctacccagacagacatttttgaagtcctttgtgttctaaytgaaatcagattcatgctatgaaatactttatgtgacttgtctggaatttaagtgtgttttggttggtgatgtttttgttcttgttgcacatgtatccac

SEQ ID NO: 49639 - DNA, 201 bp, Homo sapiens
ctctggggagaacagcttggttggctaaggttgatcctacttgctaaaatacggctatggactgcctagagggtgtcacctccttgaaaggggctgccccytgctatgttatggctgcctccagggcccattcacaccagctttgtttccaagctggacagggagctccaggcgtctggtcattccagcctcccacccctt

SEQ ID NO: 49640 - DNA, 201 bp, Homo sapiens
gagtagagaggtaaaaggccaccatctccttgacctctggggaactcatccacaaagaagatgtttccaagatgcttctgaagattgcctaaaaatagcckgtttccacccccgtgaatgcatccattctagaatgctccttcaccaggaccagagaactgatttacagaagtgacatgaaaacattccatcccagaattt

SEQ ID NO: 49641 - DNA, 201 bp, Homo sapiens
tacctgcccagactttggaatacagactgtactcaccaccttgggctttagtgaattcacctggaatgatggccttagcgttctcttagactcttagactrtgatgcatttggagtaaatgctcttgaagggagcatttataatgtaattaattaattccagtcaagtataggttcacatgaaacccaacccaattacccc

SEQ ID NO: 49642 - DNA, 201 bp, Homo sapiens
ctgaaaacttccatggagtggaaagtacccatttttattaaccactggtttgactatatatggcattctccacccttttctttctgtgttgctgtgaaatagcatttggtcaggatccagttggagccttttccacccttgatgggctgctcatttcttagtggttgagtgtatatgaaggttgtaattattcccactgga

SEQ ID NO: 49643 - DNA, 201 bp, Homo sapiens
ttcaccatgttggccaggctggtctcgaactcctgacctcagtgatctgcctgcctcggcctcccaaagtgccaggattacaggcgtgagccactgtgccyggccgacacttggcattctctaacctacctactccttataacagccctgggaagtagttgaccatggccatttctatttggtagatgaggaaaaataagg

SEQ ID NO: 49644 - DNA, 201 bp, Homo sapiens
gtttctgcttagatggaaagggcaagtttgctgcttggtgattttagtgcagtagcccattgctcccatttttcagaagaggaatcgcggggtagggagtygggggagtttggtcttgccccagatcaccacagtcagtgatgggggtgggccatctggctgctgattcatttctccttctgttacactaagcctgcctca

SEQ ID NO: 49645 - DNA, 201 bp, Homo sapiens
gaggggccagtttgtgaccagcctgggcaacatggcggaaccctgtctctataaaaaattaaattagccaggtgggtggcatgtgcctgtagtcctagctrcccaggaggctgaggtggaaggatcgcttgagcccaggaggcggatgttgcagtgagcagagattgtaccattgtattctagcctggatgaccgagaccc

SEQ ID NO: 49646 - DNA, 201 bp, Homo sapiens
ggcatgtgcctgtagtcctagctacccaggaggctgaggtggaaggatcgcttgagcccaggaggcggatgttgcagtgagcagagattgtaccattgtaytctagcctggatgaccgagaccctgtctttaaaaaaaaaaaaaaaggaggggccagacccctgacccatatgtgctgctcttttctttcagggaggtctg

SEQ ID NO: 49647 - DNA, 201 bp, Homo sapiens; identical to SEQ ID NO: 14114

SEQ ID NO: 49648 - DNA, 201 bp, Homo sapiens
actacctgatcagcgtcaaatacggtgggcccaaccacatcgtgggcagtcccttcaaggccaaggtgacaggtaacgaacaaccaccttcggagttactytcccttcctggggagctggttgtgtcagatcaatcatagtggaaactatggatggttttagatgtgttaaagctactttgaactttgaatgtcagtaaat

SEQ ID NO: 49649 - DNA, 201 bp, Homo sapiens
ccctcctaattaattgcttggctcagagaagtgacaaattgaacatttcaaccacctgttaattcacaaggtacttcttttcatttcttgctgcttgcacaaaacacttggagtatggcttgtggatgtctggccctagggaagagtgtttggcacatagcaggtacttaagtattaggaaaatgaggatggaggggaggg

SEQ ID NO: 49650 - DNA, 201 bp, Homo sapiens; identical to SEQ ID NO: 14115

SEQ ID NO: 49651 - DNA, 201 bp, Homo sapiens
gcaggtacttaagtattaggaaaatgaggatggaggggagggagggaacattattaagcggccaactgtgagacaggcattgtgcttgactctttctttctttttttttttttttttgagacagagtctctttctgtcacccaggctggagtgcagtggtgtgatctcggatcactgcaaccgcgcctcctgggttcaagt

SEQ ID NO: 49652 - DNA, 201 bp, Homo sapiens; identical to SEQ ID NO: 14117

SEQ ID NO: 49653 - DNA, 201 bp, Homo sapiens
tggccactcttgtggcaggtgtagtatctggggcgagtgttgggggtaaaagcccaccctacagaaagtggaacagcccggagcctgatgtgaaaggaccmcgggtgttgtaagctgggacacggaagccaaactggaatcaaacgccgactgtaaattgtatcttataacttattaaataaaacatttgctccgtaaagt

SEQ ID NO: 49654 - DNA, 201 bp, Homo sapiens
caggctgtgccacgtggggagccgaggtcctgcctgagtaacccaggtccctgattgctggttttgctccctgacacctgcaggcctgccactccacctckcaaagtccctgagtgacagcttgcaggtgcttgcctgcctggggtggatgagtgatgtggatggctgtaggatcctgtgagtcccttgaggatgcaaaag

SEQ ID NO: 49655 - DNA, 201 bp, Homo sapiens
ctcaggcaaagattgagtacaacgaccagaatgatggatcgtgtgatgtcaaatactggcccaaggagcctggcgaatatgctgttcacatcatgtgtgaygacgaagacatcaaggacagcccgtacatggccttcatccacccagccacgggaggctacaaccctgatctggtgaatcagctgctgtgcttctgtcttc

SEQ ID NO: 49656 - DNA, 201 bp, Homo sapiens
cagctcccagttgcagagatccaaagtgagagctcactgttggcttttgtggctggagcagccagctctgagtgtgtaaacgtccactgcccaaccctgtmatgtgtccccttgtcactcctttccccaagacactgagagctttgactccagaacaggaaaagcagggtgccaattaggaaagcctcttttccggtggga

SEQ ID NO: 49657 - DNA, 201 bp, Homo sapiens
gcaacatggcggaaccctgtctctataaaaaattaaattagccaggtgggtggcatgtgcctgtagtcctagctacccaggaggctgaggtggaaggatcrcttgagcccaggaggcggatgttgcagtgagcagagattgtaccattgtattctagcctggatgaccgagaccctgtctttaaaaaaaaaaaaaaaggag

SEQ ID NO: 49658 - DNA, 201 bp, Homo sapiens
ctgatcttcagtttcctcatctgcaccgtggaaatgataagaagattatcttatagggttatgtgagggttcagtgagactaccatgtagagtactgggckttaaaaaaatcagctttctgatttatattctgtggaaatgaggcttgtttgtttcaggttattctataatgtcttttggtgtggctgaagctgctgaggc

SEQ ID NO: 49659 - DNA, 201 bp, Homo sapiens
caaaatcttacaagaacaaatatgcaacatagaaacatgcatatcttcgttaatacattaaatcataagatttggtgacagtatattaactgtcatcaaastgacaaagtaataagtgaaaatgatacgtcaaaataactgtaaaatgacataaaaatatatgatttttaatggtgatgtaagtcatatgtacttataatg

SEQ ID NO: 49660 - DNA, 201 bp, Homo sapiens
gggtcagagtgtctttacttacattatactaatgtgaaattccctatgtgagaggtgtagtaattgagttggggtggctacgtggaatagtttataaaggraatttgcatgaattttggcaataagcagaccagcataaataaatggtgcacatttcactttcttttccactctttccagaggcgcaggaattggtgggct

SEQ ID NO: 49661 - DNA, 201 bp, Homo sapiens
cagaggttgcagtgagctgagactgtgccgttgtactctagcctgggcaacaagagccatctcaaaaaaagaagcaagccagatctttggggtgctgtgayggcaaatcccccagcgctggcctctcaggttctcttgcgggattagtgtttgttgaataataagcaatacaccctgacccagcgagccaaagcaaacagg

SEQ ID NO: 49662 - DNA, 201 bp, Homo sapiens
aaatactggcccaaggagcctggcgaatatgctgttcacatcatgtgtgacgacgaagacatcaaggacagcccgtacatggccttcatccacccagccaygggaggctacaaccctgatctggtgaatcagctgctgtgcttctgtcttcttgtccctggcccctggttcctcacccccatgcccgaagttgccttaagc

SEQ ID NO: 49663 - DNA, 201 bp, Homo sapiens
atacattaaatcataagatttggtgacagtatattaactgtcatcaaagtgacaaagtaataagtgaaaatgatacgtcaaaataactgtaaaatgacataaaaatatatgatttttaatggtgatgtaagtcatatgtacttataatgtgctgtgatttcttgtcaacatttctgaagaaaggaaatggtaaatttcagt

SEQ ID NO: 49664 - DNA, 201 bp, Homo sapiens
gcagcaccagatgtcccaccttcacgccacatcaattaagagagacaccctctcaggattcttagaagtcgagagcctcctttcccagaagtctccagcaygtctgccttcccctctcactgacctggacacatgcccactgctgagtcatttcctgtggctaaagaaatgccatgtgctcattgactaaggcttagtgaa

SEQ ID NO: 49665 - DNA, 201 bp, Homo sapiens
ccttatggcacgagtaagcatattttgatctcactttactctaaaggaaaagtaggttaatgttctgtaaatttaaaaaagaaaatctgggtctctaggcyctaatgtcctaagatttttcttgcttggtgccttggtatatggaattctctgatttaatcaactttaaagagacagtgttaccggtgaacataataaatt

SEQ ID NO: 49666 - DNA, 201 bp, Homo sapiens
ggctacgtggaatagtttataaagggaatttgcatgaattttggcaataagcagaccagcataaataaatggtgcacatttcactttcttttccactcttkccagaggcgcaggaattggtgggcttggcataactgttgagggaccatcagagtcgaagataaattgcagagacaacaaggatggcagctgcagtgctga

SEQ ID NO: 49667 - DNA, 201 bp, Homo sapiens
ggatcaggcaagtggaaagaatgtgcaaaggaactgcagcttatggctatagtgacaccttactttactcttctttgatgcttcttctattcctttccctrtagcccctttgaagttcaagttggccctgaagcgggtatgcagaaagtccgtgcttggggccctgggctccatggtgggattgtcgggcggtcagcggac

SEQ ID NO: 49668 - DNA, 201 bp, Homo sapiens
ctctcggaaggtcgtgccatgcctagtgacacctgtgacaggccgggagaacagcacggccaagttcatccctcgggaggaggggctgtatgctgtagacrtgacctacgatggacaccctgtgcccgggagcccctacacagtggaggcctcgctgccaccagatcccagcaaggtcagcctttgcttttgtcccagaac

SEQ ID NO: 49669 - DNA, 201 bp, Homo sapiens
gctggcaggctgcccgggactctggccaaagcagtggcctcagcaaagccacccacaggggtggtgtgagtgctgccagactccccaggcaaatccagccyggctccacgctgaactctgggcctgcggcttgccttttgtgaaaggcatggtatcattttaccgtaagtgatgtccattttacagatgtggaaagtgaga

SEQ ID NO: 49670 - DNA, 201 bp, Homo sapiens
tttccaaataacatagtatagcatgcagacttcgatgctagatgaaactctgaagtagagaatcatttttcacaaataggggatttgtatgcaaatatgcrtttctgtttgttgttttgagcaggtctccatgtagtggaggtgacatatgatgacgtgcctatcccaaacagtcccttcaaggtggctgtcactgaaggc

SEQ ID NO: 49671 - DNA, 201 bp, Homo sapiens
caagaccctcagagcaacaccaagaaccacctaaaattctttctcagacgtgtccttcttgcagagatctcacgtgccccaggttcgctgcagcgttaggrgtcagcctccctttggagcaggagagcaggggccttggaggtggcagtcatggccctcctaattaattgcttggctcagagaagtgacaaattgaacatt

SEQ ID NO: 49672 - DNA, 201 bp, Homo sapiens
gcctgtaatccaagcactttggaaggccaaggcagaaagattgtttgaggccaggagtttgagaccagcctgggtgacatagtaaaactccatctctaccaaaaaaaaaaatttttaaagacgaacttaggaatgaaacagcttgttaaaaaatggtggaactttcccctgcagccacatcatttcaacttcactttaaaa

SEQ ID NO: 49673 - DNA, 201 bp, Homo sapiens
gggaacaggacctagcattgtcagcagaatctctagttttttggcaaaggcagaaatcttgatttttctctggaaactcaacatacaacatgttggcattwaattggaaaaaagtttaaaatgtagtgttgtctaacacctgcatgccacacagcaggttagtcttcaacctttaacctgtcctcgagcccggtgtgagca

SEQ ID NO: 49674 - DNA, 201 bp, Homo sapiens
atcgcttgagcccaggaggcggatgttgcagtgagcagagattgtaccattgtattctagcctggatgaccgagaccctgtctttaaaaaaaaaaaaaaargaggggccagacccctgacccatatgtgctgctcttttctttcagggaggtctgataaaatatcagtagttcaattcttttttttttttttttttttttt

SEQ ID NO: 49675 - DNA, 201 bp, Homo sapiens
ctgaggcaggaggatggcttgagcctggaagattgacgctgtggtgagctgtgatcatgccaccgtactccagcctgggcaacagaggaagactttatctaaaaaaaaaaaatattagtaataaggccgggtgcgttggctcatgcctgtaatcctagcactttgggagaccaaggtgggcagatcacttgaggtcaggag

SEQ ID NO: 49676 - DNA, 201 bp, Homo sapiens
tacctactccttataacagccctgggaagtagttgaccatggccatttctatttggtagatgaggaaaaataaggttcagagatggattgttcaaaccgaygtatctagtcaagctactggttcccgagcctgtgtttgcaacccctctaccatgtagcctctccgggtggtagagatgagggggcagagtgcacagtgca

SEQ ID NO: 49677 - DNA, 201 bp, Homo sapiens
gagctcaagaccagcctggccaacatggtgagaccccatctctactaaagaaatacaaaaattagctgggcatggtggcgagtgcctgtaatcccagctamtcaggaagctgaagcaggagaatcgcttgaacctgggaggcggaggttgcaatgagccaagatcatggtactgcactccagcctgggcaacagagcgaga

SEQ ID NO: 49678 - DNA, 201 bp, Homo sapiens
tcatgaaactatttagcaaaccaggagtcaatcaagctctataacttgataatgtaaaaatttgtagccaaccttgtaagtatttttattaaagttggttrcaaggcatatgcctgcgttgtacttgcagtcctagccagtgcaattagataagaaaaataggctgggtgtggcggctcacacctgtaatctcagcacttc

SEQ ID NO: 49679 - DNA, 201 bp, Homo sapiens
ataaagaatgtaggttcatcgcaggaaaattagaaaattcagatagaaaaatcatcctttctcatccacagaatcattttttgatatttcattatatgtcrtcccaaacttttacactgcttatacatagactattttatgtcaatagaaagatgtgaattccacaggcacatctttggtgggtagggggtggggggattg

SEQ ID NO: 49680 - DNA, 201 bp, Homo sapiens
gagttctgtttgagatgacatccaggtgacctatagggcaagggctgagagagcctgtcttgcaggagagtggggtgacccaggagtacacttttcattgraagaaagccctcaacagcacataaaggccaatcccatcatgtacctgcccagactttggaatacagactgtactcaccaccttgggctttagtgaattca

SEQ ID NO: 49681 - DNA, 201 bp, Homo sapiens
ttttcatgggaaactgagtccatgtactgggaagaaagctttttggggaaaatgattagaaaaccaaatgggtctctttatgactgaagtgatgaaccagyaggtgagagtaggtatagatggtacagaggacggaattactgggtattttaatcaggcccacttagtatcacaatttattattctattctatttttatta

SEQ ID NO: 49682 - DNA, 201 bp, Homo sapiens
ggattcttctgacacctggctgtcaattgggatcaattgtttgcctctgagaggagggaggaagagagtggaggaaaggtcctctcctcccggagggagcwgccttatctgtggcctgcaccaggaagcactgcttcctggactcctatctgagaaggtccgtgggcttcgggattctgcagtggcgggcagttcccccac

SEQ ID NO: 49683 - DNA, 201 bp, Homo sapiens
ctgaatccagatgtggcctcagaatccttctcaacacagtgtactagcaccacttggtgctcctgatctactgtatcatctcttgaaaaactactaacatraaaagacctgccaagtcaactttatattaactgaacccttgacacagtgatggataaaaattaattcaaacagcttctttgtgatctttgagtagttcat

SEQ ID NO: 49684 - DNA, 201 bp, Homo sapiens
gcagggcttttgtttgtgaggtctagaaaccagaggtgaggaaggaggtgtccctggaactccccctggctgcagggctcacagcacacaccatgacaccrcaggggtgtgtgtgtgtgtgtgtgtgtgtgtgtgtgtgtgtgtgtgtgtgttgaggggagtgttgttgagagccaactatgccaggagatccttggtgac

SEQ ID NO: 49685 - DNA, 201 bp, Homo sapiens
gattcttctgacacctggctgtcaattgggatcaattgtttgcctctgagaggagggaggaagagagtggaggaaaggtcctctcctcccggagggagcagccttatctgtggcctgcaccaggaagcactgcttcctggactcctatctgagaaggtccgtgggcttcgggattctgcagtggcgggcagttcccccact

SEQ ID NO: 49686 - DNA, 201 bp, Homo sapiens
ggataatttatgaagcagtacaccatcatagatactatgagctgaaagttcaccaaactctctatcccaaaataacaataaggtatttatgaagtgattcrttccaactatttgaggcaaaaattgtccagcaagtgagagagaacagaaggaatagttggcaaaatagggaatttgaagtctgaggttatgcataaggaa

SEQ ID NO: 49687 - DNA, 201 bp, Homo sapiens
ttatgctggcatgaattccttttctcatagagatctgaaagctcttttgactaaatgggtcacctttctgagtattttcataaggctgtcagcctttaccrtgccagacaagttttctggaatttcctttccagaaaaaaaaaaaaaaaggctactaaagaggttggagttatttggaacacagggtggaattctggcatt

SEQ ID NO: 49688 - DNA, 201 bp, Homo sapiens
ctgtgtgcttctgtgccctgtgtttatatggttcatacgctgcctgtccaccatgtttttcccgagagcctcggcagcgcaggcatcatgggaatgactgrgtcaggtggaaattcagaggccctgccctggtgggcagagaagcctggcttacctcccaagcacagcatgtgtgtggatcacttctgtgcactgtctcct

SEQ ID NO: 49689 - DNA, 201 bp, Homo sapiens
ttgatctgactttgtaacaaagctcaacttttgtaagtttgcaattaaaggataaatacctatcctatttattattattattaactttttattataaaagrggaaaaaactcccaggaaacatagcctaatatgagggacaaaaagccaaaaggttttttttttcttcctttaaaaggtcctcaatgtcttgccctgtgga

SEQ ID NO: 49690 - DNA, 201 bp, Homo sapiens
gtcaagatttattataaaagtaacagatgggtagggcatggtggctcattcctgtgatcccagcactttgggagaccgagatgggaggattgcttgagccygggagtttaagacaagcctgggaaacctggcgaaatcctgtctctacaaaaattacgaaaattagccaggcatggtggtgactgtcccagctacttggga

SEQ ID NO: 49691 - DNA, 201 bp, Homo sapiens
tggcctcccaaagtgctgggattctaggtgtgagccaccgtgcctggccactcagctaattgttttgcatttttagtagagacggttgcccagactgctcycgagctcctgacctcaggcccacctggcctcccaaagtgttgggattataggcatgagccaccacatttggcctcctttttggtgttttactgacaggga

SEQ ID NO: 49692 - DNA, 201 bp, Homo sapiens
gtcccatctctcagttccctgaaagagatgcagtgggcgatggctcatgacacaccctcgcctggcttctaacatgtctgtgtaaacctgtggcaggaatygagcccactggaaacatggtgaagcagccagccaagttcactgtggacaccatcagcgccgggcaaggagacgtgatggtgtttgttgaggacccagaag

SEQ ID NO: 49693 - DNA, 201 bp, Homo sapiens
tgctatcttacattaaaaatgcagaatggctcacctgccctttgttgtcatatgttatatagaaaaacctatttgcatgagaactgtcacccacagttttrggtagggtcagtgtgtgccactgagcaggaacgccgagggccataacctgtctaatgtattaaattctcaggaatcgggattaaaagttaaccagccagc

SEQ ID NO: 49694 - DNA, 201 bp, Homo sapiens
ctcttaaaagaggacacttttttgacctggaacatactgggttttctggcctgcatgggcattattttggatgctgagatgatagtccttttgaccaggaygtctcaagtatccaagcccagaaatcatctcttctaggctgaatcaagatggtttgcataagagaccatgcagatgcacgtctctgctatcttacattaa

SEQ ID NO: 49695 - DNA, 201 bp, Homo sapiens
gacaggggctctgtggggctcagtcactaaccaggtttctctttgctctcagctgagttcagcatttggacccgggaagcaggcgctggaggcctctccaycgctgttgagggccccagtaaggccgagattacattcgatgaccataaaaatgggtcgtgcggtgtatcttatattgcccaagagcctggtatgtattca

SEQ ID NO: 49696 - DNA, 201 bp, Homo sapiens
gaatttagttatcactagtgatgcttaggaaacttcagcaatggaccttggaccttgcttgggttctgcttggggttggagaaagaggaaagggctagcarcagacgaaacctagcactgcaggtttgaacaaggatggaagagggacaggggctctgtggggctcagtcactaaccaggtttctctttgctctcagctga

SEQ ID NO: 49697 - DNA, 201 bp, Homo sapiens
gaagtagttgaccatggccatttctatttggtagatgaggaaaaataaggttcagagatggattgttcaaaccgatgtatctagtcaagctactggttccygagcctgtgtttgcaacccctctaccatgtagcctctccgggtggtagagatgagggggcagagtgcacagtgcatggcatcctgttccccagatggcca

SEQ ID NO: 49698 - DNA, 201 bp, Homo sapiens
tgcctgattttccttgtcaaggcagtttgtccccatttcccacatgggatctgcagggctgggtcccatctctcagttccctgaaagagatgcagtgggckatggctcatgacacaccctcgcctggcttctaacatgtctgtgtaaacctgtggcaggaatcgagcccactggaaacatggtgaagcagccagccaagtt

SEQ ID NO: 49699 - DNA, 201 bp, Homo sapiens
ccgctgagcggccctggtgtgctgggttagtctgtgagccacaggaaatgttgtcagggcctctgggcttttggatgtcagcaggccttcagtggtgaggrggttgtggctggactcagaggactccttgcttttgctgaacgaccctccccaccaaccaccaccaccaccaccagtgggactagcccatgagctgtaagc

SEQ ID NO: 49700 - DNA, 201 bp, Homo sapiens
attcttctgacacctggctgtcaattgggatcaattgtttgcctctgagaggagggaggaagagagtggaggaaaggtcctctcctcccggagggagcagccttatctgtggcctgcaccaggaagcactgcttcctggactcctatctgagaaggtccgtgggcttcgggattctgcagtggcgggcagttcccccactt

SEQ ID NO: 49701 - DNA, 201 bp, Homo sapiens
ttcatggtcttctcaagtcctttctgagcttgattttgccagttgtagaaaactctttaagagttgtctgctatattttgtggaagccaaatggaactggaaaaaaaaaaaagaaaagagcaaatggtctctcccattgtgggacttgaatgttttaggcagcaacgaatgttcttgggtctggaaacctttattttgaat

SEQ ID NO: 49702 - DNA, 201 bp, Homo sapiens
tagtggaggtgacatatgatgacgtgcctatcccaaacagtcccttcaaggtggctgtcactgaaggctgccagccatctagggtgcaagcccaaggacckggattgaaagaggcctttaccaacaagcccaatgtcttcaccgtggttaccaggtaggcaaggccctacatttggtgtcttgagtctcacttttgtggct

SEQ ID NO: 49703 - DNA, 201 bp, Homo sapiens
tctgtttatcttactgccacgaccgtttatcacgggccagagttcaggggcacactgataaatctcttttaggaggatgatgtaaccctcagcattttccycctacttggttctgagtttttaaagcttttgtaacaccatcatgtccttgtttgggcatcttcctgtgtactcccgtttgggtctccagggtgaaatagc

SEQ ID NO: 49704 - DNA, 201 bp, Homo sapiens
gacactgcagctggggttcttgttgagccgggaagcagcttctgactaaggtgcagactgtttagatgagctggtcataaagagccctgactgtggactgygtctccagccacggcagcagctggtggatggggtgatgccttggatatttatcgtgtgtttcttgcctggcctgcccttggacagtgcgcctcaggaatg

SEQ ID NO: 49705 - DNA, 201 bp, Homo sapiens
aatgtagtgttgtctaacacctgcatgccacacagcaggttagtcttcaacctttaacctgtcctcgagcccggtgtgagcagtcgtgttgtcacttagcygtggctactctagaaaggccttctttgggatggagggggttaatattcttgatttgagagttagaaaaaccagttttccagttactgaaattggacttca

SEQ ID NO: 49706 - DNA, 201 bp, Homo sapiens
gctgagcggccctggtgtgctgggttagtctgtgagccacaggaaatgttgtcagggcctctgggcttttggatgtcagcaggccttcagtggtgaggagrttgtggctggactcagaggactccttgcttttgctgaacgaccctccccaccaaccaccaccaccaccaccagtgggactagcccatgagctgtaagcca

SEQ ID NO: 49707 - DNA, 201 bp, Homo sapiens
acagggcctttggtcagaaaaaccagactgacttcagtcttatctgtttagagaagccccagaagctgcaaaaattgcagcttccagactttagtgtgccrtggtcatgacatcggtgtggatggcaggttgtcatctgagcagtcagggtggcagcacacagcttgcgggctggctgatggccgaggtgtgtgaactgac

SEQ ID NO: 49708 - DNA, 201 bp, Homo sapiens
ggactcagaggactccttgcttttgctgaacgaccctccccaccaaccaccaccaccaccaccagtgggactagcccatgagctgtaagccaaccttttcmttcctaacttaattttccaaagaatagtaacttacccaccaccactgcagtcactgggccgggaagacaagcactcttgccttgaatccatgccttgagc

SEQ ID NO: 49709 - DNA, 201 bp, Homo sapiens
atcaagggcaggtcctctccagtgagtgatgggcttgcctctcacttctctaacacccttctgcttccttgtgcaagatttcactattagtggctattctyttttacagaagaaaaagggagacgcatgcctcttccagttcactgttcaccattgcagcatatttattccaagggactggccgaatcatccctttctttg

SEQ ID NO: 49710 - DNA, 201 bp, Homo sapiens
ttcctagagttttgtctgcattattgggttgttttgagaacataaaccttaaactctagctatgtaaactggataagtcattttggtaatttggcattccytttgttttttttttttttttttgagacagagtttcactctgttgcccgggggaatgatctctgctcactgcaacctctgcctcccaggttcaagcaattc

SEQ ID NO: 49711 - DNA, 201 bp, Homo sapiens
tggatatgccatggagttgtcccaggaatcaagggcaggtcctctccagtgagtgatgggcttgcctctcacttctctaacacccttctgcttccttgtgyaagatttcactattagtggctattcttttttacagaagaaaaagggagacgcatgcctcttccagttcactgttcaccattgcagcatatttattccaag

SEQ ID NO: 49712 - DNA, 201 bp, Homo sapiens
tagaggaaatctgtgccatcaaaagagttggacctgatcacacttttgcttttgaatatgctttgtcccagcctggccatttgtcacttgggaccccctgrgtctctctgaccccactgtaaaatggatatgccatggagttgtcccaggaatcaagggcaggtcctctccagtgagtgatgggcttgcctctcacttctc

SEQ ID NO: 49713 - DNA, 201 bp, Homo sapiens
gcctgggcaagtggcattttagaggaaatctgtgccatcaaaagagttggacctgatcacacttttgcttttgaatatgctttgtcccagcctggccattygtcacttgggaccccctgggtctctctgaccccactgtaaaatggatatgccatggagttgtcccaggaatcaagggcaggtcctctccagtgagtgatg

SEQ ID NO: 49714 - DNA, 201 bp, Homo sapiens
cactggcatgtgcttctgggcaaataggcctctcccagcatttgttttggctctgtgaaatggggtaatatttgttcctattgcgggtgaagcgctgctgytgggatgctcaggtaactcactccgtgggtagctgatattgcctgggcaagtggcattttagaggaaatctgtgccatcaaaagagttggacctgatcac

SEQ ID NO: 49715 - DNA, 201 bp, Homo sapiens
aagggccaggaggctggtgcaaagcagcgtggcttgagtgccaacccagtggccacctgagctcccagaagcagtcacattacattatattgttgacatarcagtagctatgggtgagaggcctgcaggaggaagggcttggctgcagtttgggatgccagatgaaaggatcaggcaagtggaaagaatgtgcaaaggaac

SEQ ID NO: 49716 - DNA, 201 bp, Homo sapiens
aagcagagatggctgtgtttttagctttgaaataatctcccaggctttgaggggagaggtcccatactctggggcagcccacttggtttttatgtatggtwtatgttttgtcagtgtggctgcctctctgttcttgtccttttgattctcattttgggcctaggattgtgttggaaagattatctccttccttcccacaga

SEQ ID NO: 49717 - DNA, 201 bp, Homo sapiens
cagatttcaaggttgacaccaaagctgcaggaagtggggagctcggtgtaaccatgaagggtcctagtaagtgttcctttgtttctctatctcaggtgtgrttttggctaactttgcagccatggcatatggatttcatcccacggccagttgtcctcaataatcccagaaggctatgtcaaggatttgaggctatctggg

SEQ ID NO: 49718 - DNA, 201 bp, Homo sapiens
agtggccgaggcctacaacccaaaggcgtccgtatccgggagaccacagatttcaaggttgacaccaaagctgcaggaagtggggagctcggtgtaaccaygaagggtcctagtaagtgttcctttgtttctctatctcaggtgtggttttggctaactttgcagccatggcatatggatttcatcccacggccagttgtc

SEQ ID NO: 49719 - DNA, 201 bp, Homo sapiens
gcctccaccgagtgctttgtcacagacaatgcggatgggacctaccaggtggaatacacaccctttgagaaaggtgagccgccctgtcctcggactggacsctcgttcagagctgcccttggtcattgcctcctggtggctggtactgatgcctgccccatgtgctaggcctgtctcagcagggccacgtgcagagtgaca

SEQ ID NO: 49720 - DNA, 201 bp, Homo sapiens
gaaggaggcgcccacaaggtgcgggcaggaggccctggcctggagagaggagaagcgggagtcccaggtgagcattgcgggcaggattttcacttgggaaraatagagttgagcccaggcagtgtgggcacccacatacttttttgccccatttgaaagagaagacttctgataggtggcattaagggcattatttaaaac

SEQ ID NO: 49721 - DNA, 201 bp, Homo sapiens
ttggtgaaggaggcgcccacaaggtgcgggcaggaggccctggcctggagagaggagaagcgggagtcccaggtgagcattgcgggcaggattttcacttkggaagaatagagttgagcccaggcagtgtgggcacccacatacttttttgccccatttgaaagagaagacttctgataggtggcattaagggcattattt

SEQ ID NO: 49722 - DNA, 201 bp, Homo sapiens
ttggtgtcatccaggaaaaattcaaagtgcagcattaattgatttcctaatatcctcttctttacttccatttaaggacacattttaggatacctctttcyaatttaaacctgggagtttttactctagtcctttacctcatgtgcttacaaaggcttttaagataattctaggtttgtgcctttgagcaagtggattttt

SEQ ID NO: 49723 - DNA, 201 bp, Homo sapiens
tttttcttaaactaaattattgggaaatgaatagaaatccagagtatagtaacaaatgacctagtgtctttaacagattggtagctaggaaaaggaagtgrtggagagacagccggagattaaatgagacttaagagacttagcaaccatttgtaatatgtgaccttatttggatcctattcaaactaatggttaaaaaaa

SEQ ID NO: 49724 - DNA, 201 bp, Homo sapiens
gaactaccagaaacttccaccacggcctgtgattacactgttggcccaatgccctggaaaaattggcttgctctcggggaacactccaggagctgcaaagrgggtgtcaggactgttgtgcagctccccttaaattggggaggaggggtggctgatgtggaaactgttcattagactgctcagggtagtgtgagaaaacgt

SEQ ID NO: 49725 - DNA, 201 bp, Homo sapiens
gttgactctcggccgctgacccaggttgggggtgaccacatcaaggcccacattgccaacccctcaggggcctccaccgagtgctttgtcacagacaatgyggatgggacctaccaggtggaatacacaccctttgagaaaggtgagccgccctgtcctcggactggaccctcgttcagagctgcccttggtcattgcctc

SEQ ID NO: 49726 - DNA, 201 bp, Homo sapiens
caactaatttttgtatttttagtagacatggggtttcaccattttggtcaggctggtctcaaactccgcctgccttggcctcccaaagtgttgggattacmggtgtgagccactgtgcctggccaattttagaatatttttattgcctcagaagaacccctgtatccattagcagtcactctccctttcccttccccaacc

SEQ ID NO: 49727 - DNA, 201 bp, Homo sapiens; identical to SEQ ID NO: 14136

SEQ ID NO: 49728 - DNA, 201 bp, Homo sapiens
ggaatgaaaacttactgtatatgagagccactgtttttccttctatagtctcacagctaaagaaaaaaaacttttctcatcttctctactactcctctcartatttcgcttccggtcaccaaaatctatggatttctgtcccccatactgacaagttctccaattttatgtggacaacaagtaggtgtcctataatcaatt

SEQ ID NO: 49729 - DNA, 201 bp, Homo sapiens
aaaacaggattaataacaggacccacctaataggcttgtttggagctgtagaggaggtaacagccaagtagtagctcttgtcccataacccctgctttctsttttcccacctcgtcttccctgcccttttgggccctcacagtcaagatgaactgatttttggttggtcaaaatattgcattagggccaaatgggtgcggt

SEQ ID NO: 49730 - DNA, 201 bp, Homo sapiens
ctgcctcagcctcccgagtagctgggactacgggtgcccgccaccacgcctggctaattttttgtatttttagtagagacggggtttcactgtgttagccrggatggtctcaatctgctgaccttgtgatctgcctgcctcggcctcccaaagtgctaggggattacagacgtgagccaccgcgccctgcctttttttttt

SEQ ID NO: 49731 - DNA, 201 bp, Homo sapiens
atgctcagaggacgttagggagcacagctttgtgtaaagggcatgccctgccctgtccggatttaaagcagctatagcactgaaaccccatggtcaccctygcatttctacacttctgcctgtgccaagtctagtttgtgtgcctcctccattttgtgtgtacatgggggtatttttttctgctaggcaactgctatttat

SEQ ID NO: 49732 - DNA, 201 bp, Homo sapiens
ccgcctgtgctgagtgtgactgagggagaggcaggcctcctagggaggccggggcaggaaaggtttcttggtggctaaaataggatttctcagtttccccygtgtcccaagaaaataagttcttatcatgcttgtaccacacttcttgtgcgtatcaccctggtttccctgcacctccttgaagtggtttatcagattcca

SEQ ID NO: 49733 - DNA, 201 bp, Homo sapiens
tcttttgagtacaagtgagagaaactcacttgagctggcttaagtgaaaaaattctttgtcaggagagttttgtgaatttctgtttagtggcaagttgtaraaaccacttgaaactgcttaaaggcaaaagagggagccacttgtcccagtaactgagacatcccagagccgactgcccccaagcattacttggtcccaag

SEQ ID NO: 49734 - DNA, 201 bp, Homo sapiens
catcagggatccaggcattagagagtgacctgttatagaaggccctttcccaatgctgggcccttttggcttatcttacccttctgtttacctgtggtaayagaagtctgctcaccactcgctaagtcagagtgatgctaaggttcaccctttgttgaaggctccctgagctctggctgttgcttcaggggctttcctact

SEQ ID NO: 49735 - DNA, 201 bp, Homo sapiens
tgacacagtgatggataaaaattaattcaaacagcttctttgtgatctttgagtagttcatgagcaagaaagagaattggaaatccagccaacttcggccsccttgtctacttgtattttactgtggtttatgttttctcttaccaattgagataggcccatgagacttctggtcttccaaagcccagaacatccccacat

SEQ ID NO: 49736 - DNA, 201 bp, Homo sapiens
ggtttcattaagtgtaatttggcatgtgttcaaccagcattcaggtggctcttggtgggtggctggggagacaccaagatgcagatagctcagtcactccycaacaagcggcttagttctggaatgaggtgggaggccaaggaactcacacataaatgctggtgggagtgaagtgccaccagctgtagaatctggtgtcag

SEQ ID NO: 49737 - DNA, 201 bp, Homo sapiens
tctctcccccaacctccctccctctttcagaaatcaacagcagtgatatgtcggcccacgtcaccagcccctctggccgtgtgactgaggcagagattgtrcccatggggaagaactcacactgcgtccggtttgtgccccaggagatgggcgtgcacacggtcagcgtcaagtaccgtgggcagcacgtcaccggcagcc

SEQ ID NO: 49738 - DNA, 201 bp, Homo sapiens
attgcagagacaacaaggatggcagctgcagtgctgagtacattcctttcgcgccgggggattacgatgttaatatcacatatggaggagcccacatcccyggtgagctattcctcagagaggaccccagagaataattgattttgcaggaaaatgggtttgattttggttatctctctgagtggggaaaacaatctgata

SEQ ID NO: 49739 - DNA, 201 bp, Homo sapiens
gtcagagtgtctttacttacattatactaatgtgaaattccctatgtgagaggtgtagtaattgagttggggtggctacgtggaatagtttataaagggartttgcatgaattttggcaataagcagaccagcataaataaatggtgcacatttcactttcttttccactctttccagaggcgcaggaattggtgggcttg

SEQ ID NO: 49740 - DNA, 201 bp, Homo sapiens; identical to SEQ ID NO: 14151

SEQ ID NO: 49741 - DNA, 201 bp, Homo sapiens
aaccacattatttccacaattttatatagactcctgactgaggttctctgaatatcaaaattggatattacttcaataacatgggcaaaattaaggctttygacctgcctgattttccttgtcaaggcagtttgtccccatttcccacatgggatctgcagggctgggtcccatctctcagttccctgaaagagatgcagt

SEQ ID NO: 49742 - DNA, 201 bp, Homo sapiens
gaggctgctggggtggattcagaacaagatcccctacttgcccatcaccaactttaaccagaactggcaagacggcaaagccctgggagccctggtagacrgctgtgctccaggtaagtggccagggctgcctaaaccatctgtccaggatgggggtgtgtgggtcccaaacattctggttttcaacgggaatgctatctt

SEQ ID NO: 49743 - DNA, 201 bp, Homo sapiens
tctccaattttatgtggacaacaagtaggtgtcctataatcaattcccttcaattctgacactatctacctgaagttagtgcagacgccattaagggctcrgtccctcaaaactgcccctgacttcagaggccagtcagaagtggtgggtcctcaggtaacccacagcttctgtccaggtttgctacaaatcagaaggtcc

SEQ ID NO: 49744 - DNA, 201 bp, Homo sapiens
gttctttctgtcacttattttcgtaggaccatattttattcttggcatttagcataatttgcaattctaagtttacagatggatggtccatttcccccacyggggcagggattgtatctgacttgctcatgttttatttttagtacctaacactgggccctgcatttcataagctttcaatgaactattgagtggataaag

SEQ ID NO: 49745 - DNA, 201 bp, Homo sapiens
ctgcagaacccctgctgacacagcatgctccttactcacacccggcaccttttctaactgttgcccaccttccctcctaggcacaagtgacccctgacagygacaagaacaagacatactctgtggagtatctgcccaaggtcaccgggctacacaaagtaagatgaagcagcatggctgtggcttgggctgctctggggc

SEQ ID NO: 49746 - DNA, 201 bp, Homo sapiens
acaaaaattagctgggcatggtggcgagtgcctgtaatcccagctaatcaggaagctgaagcaggagaatcgcttgaacctgggaggcggaggttgcaatragccaagatcatggtactgcactccagcctgggcaacagagcgagactctatctcaatcaatcaatcaataaaatatctttccttatcatcaccttacag

SEQ ID NO: 49747 - DNA, 201 bp, Homo sapiens
aattagtttgtcagaaaagaaactgtcacctgtgtcctaaaaaagaaaaaaaaacgtaagttttaagggagatataagagtcttgaaaaattctgaaatayagggaatgtagactgacagaatatatcacagaggtaaggctttggagtcagatgtacctggatatatatatatatatactccgactcctgcatttgacag

SEQ ID NO: 49748 - DNA, 201 bp, Homo sapiens
gagcaaatgtaaactccaagttttgctaataattgataaggccgtaagttctgtttacaagggccaaccaagagggccacagtgtccctgaaaaaatggaracattccaaagccggtttcctgagagattcatcttaaagtacataggactggctacttctcaagatagagcattcaggcttttctgttgaccgaattgtt

SEQ ID NO: 49749 - DNA, 201 bp, Homo sapiens
ctccctcagaaggatccaagaattttttcttgtctcttagcttctggtagttgccagtaatgttggacttcccttgcattaactccaaaaggccagtgggktactattgtttaatatccccaaggacgttaatatagattttaagataacctatatagcactcagaaatcccttgaaccttctaaatgtatagcatattat

SEQ ID NO: 49750 - DNA, 201 bp, Homo sapiens
cacctgcttcggcctcccaaagtgctggaattacaggcatgagccaccgggcctggccgatctgtatctattttacatttagcaccattattttttctttkttgccatttatttcttttatgaggtaattttatagttttagagttagtctatggttagattactaattctaccatccaccaacttgtgagcttgatgtat

SEQ ID NO: 49751 - DNA, 201 bp, Homo sapiens
atgttggccaggctggtctcgaactcctgacctcaggtgatccacctgcttcggcctcccaaagtgctggaattacaggcatgagccaccgggcctggccratctgtatctattttacatttagcaccattattttttctttgttgccatttatttcttttatgaggtaattttatagttttagagttagtctatggttag

SEQ ID NO: 49752 - DNA, 201 bp, Homo sapiens
cctgggttcaagcgattctcctgcctcagcctcctgagtagatgggattacaggcacccatcaccatacctggctattttttttgtattcttagtagagayggggtttcaccatgttggccaggctggtctcgaactcctgacctcaggtgatccacctgcttcggcctcccaaagtgctggaattacaggcatgagccac

SEQ ID NO: 49753 - DNA, 201 bp, Homo sapiens
atttttcacattttgccaaagcaatctatatacagcagcatgatgtgtgtgtgttaagtagagctaggcattttccctggattcttatattttacttagayttgttatagaaataaaaattaataagacatcttaaggctatgaaccccactttccaccacatatcaacttcattataatttctgtattgccttctatttt

SEQ ID NO: 49754 - DNA, 201 bp, Homo sapiens
gagcatgggcttttgaggctttgtaaagctggtttcctccccactccctccattgttccctctcttgttccttccctctcttgttccttccctctcttgttccttccctctctcgttccttccctctctcgttccctcgttccctccctctctcccaccctccctcactccctcccttcctttcttccttcgttccttcgt

SEQ ID NO: 49755 - DNA, 201 bp, Homo sapiens
agagcatgggcttttgaggctttgtaaagctggtttcctccccactccctccattgttccctctcttgttccttccctctcttgttccttccctctcttgttccttccctctctcgttccttccctctctcgttccctcgttccctccctctctcccaccctccctcactccctcccttcctttcttccttcgttccttcg

SEQ ID NO: 49756 - DNA, 201 bp, Homo sapiens
tagagcatgggcttttgaggctttgtaaagctggtttcctccccactccctccattgttccctctcttgttccttccctctcttgttccttccctctcttgttccttccctctctcgttccttccctctctcgttccctcgttccctccctctctcccaccctccctcactccctcccttcctttcttccttcgttccttc

SEQ ID NO: 49757 - DNA, 201 bp, Homo sapiens
aagtgaatgcaaaatttctggacaaaatagaaacaggtacatgggctaatataggaatatacacaatactgttaactgtcccaagatttttcattgattaygtcttccatggtgagatttcaggcataaaattggtttgggttagtacaaagtctggcccaacatatgcttacttgtagttcttcctaataagtcaaacaa

SEQ ID NO: 49758 - DNA, 201 bp, Homo sapiens
gcaacctggtgagacctcgtgtctacaaaaaaattacaaaattagctgggcctagtggcatgcatctgcagcccagctacttgggaagttgaggtgggagratcggttgagtctgggaagtcaaggctgtggtggaccatgatcatgccacttcactccagcctgggtcacagagtgagagttattttttttaagagcatt

SEQ ID NO: 49759 - DNA, 201 bp, Homo sapiens
taacaacaaccctctgaaacactaaaggtaagtaaatatgaaaaaagaagtaatatatttttattgaaattttattgagatagttgtagattgacacgcasttataagaaataataagagagaacttgtatatccttcaccttgtttcccccaaggataacattttgcagatctgttacaaccaggatgttaacataatct

SEQ ID NO: 49760 - DNA, 201 bp, Homo sapiens
atagagcatgggcttttgaggctttgtaaagctggtttcctccccactccctccattgttccctctcttgttccttccctctcttgttccttccctctcttgttccttccctctctcgttccttccctctctcgttccctcgttccctccctctctcccaccctccctcactccctcccttcctttcttccttcgttcctt

SEQ ID NO: 49761 - DNA, 201 bp, Homo sapiens
aataaggagagatcgaatgatgctatcttgatcttcgtatcttgaacttgtttgtttgttcatttgtttcgccagttactttttgaatgggaccaaagacrgtcataagctaaaatcttggctttactttgtacctggttaagtgcattctatttattcttttttctttattgaaaatgggcatattaaaaatattctctc

SEQ ID NO: 49762 - DNA, 201 bp, Homo sapiens
gatgatggtcccataagattgtaatactctattgtaccttttctaagtttaaatatatttaaatacacaagcacatattactgtgttagaattgcctgcartgttttcagtacagtaacatggtgtacaggtttgtagcctaggagcgataggctatatatcatacagcctaggtgtgtagtgggctatatcacttaggtt

SEQ ID NO: 49763 - DNA, 201 bp, Homo sapiens
ctttgtcatatctagatatgatatggaaatgaagaagattcagtagtgccagagaataaaattccaataaggagagatcgaatgatgctatcttgatcttsgtatcttgaacttgtttgtttgttcatttgtttcgccagttactttttgaatgggaccaaagacggtcataagctaaaatcttggctttactttgtacct

SEQ ID NO: 49764 - DNA, 201 bp, Homo sapiens
attataaagccaataatagaatgcatacatgatgatggtcccataagattgtaatactctattgtaccttttctaagtttaaatatatttaaatacacaarcacatattactgtgttagaattgcctgcaatgttttcagtacagtaacatggtgtacaggtttgtagcctaggagcgataggctatatatcatacagcct

SEQ ID NO: 49765 - DNA, 201 bp, Homo sapiens
atcattcctttcaagagttttctttgtcatatctagatatgatatggaaatgaagaagattcagtagtgccagagaataaaattccaataaggagagatcraatgatgctatcttgatcttcgtatcttgaacttgtttgtttgttcatttgtttcgccagttactttttgaatgggaccaaagacggtcataagctaaaa

SEQ ID NO: 49766 - DNA, 201 bp, Homo sapiens
ggtggttcacgcctgtaatcccagcactttgggaggccaaggtgggcagatcacttgaggtcaggagtttgaggtcagcctgatcaatatggggaaaccayctctactaaaaatacaaaattatgtttttgtaaaatacaaaaatacaacatggggaaacgatctgtactaaaaatacaaaaattagccgggcgtggtggc

SEQ ID NO: 49767 - DNA, 201 bp, Homo sapiens
tagtatagagaccatgttttgagtctgctctgcaacctactaagctgtgttaccttaaaaaagttacttaattgtttaccatttcagtttctaaaatatarcactttacctgtctcccaaaaccgctgagagtgccttttagttagccttgagtacatggcaaccattatttttgttagtgacaataacaagagtaacatt

SEQ ID NO: 49768 - DNA, 201 bp, Homo sapiens
ttatactctacctttgttactggcgggtctttgttcttagagcttccaagatagtggcaggtgctacctagatggtggcgggcagctcccaagatggtggmaagccttgtgttctctgatctggggttcttggcctcacggattccaaggaatggaaccttgggccatgcggtgagtgttatagctctattagaagccatg

SEQ ID NO: 49769 - DNA, 201 bp, Homo sapiens
tcaattagcatagtctactacagtagactaaattgcttgcacaagtaactaaatgcacaagtaactaaatgcttgtttctatttgtttgatttttttttttgcagcttctttccacttttgacttaataaagtatgactttcagaaagatgaacccatgagaaatgagcagggttggtgtattcatgtgaaaaaaggtaag

SEQ ID NO: 49770 - DNA, 201 bp, Homo sapiens
ttgacagtctcagaaacattggactatatagtatagagaccatgttttgagtctgctctgcaacctactaagctgtgttaccttaaaaaagttacttaatwgtttaccatttcagtttctaaaatataacactttacctgtctcccaaaaccgctgagagtgccttttagttagccttgagtacatggcaaccattatttt

SEQ ID NO: 49771 - DNA, 201 bp, Homo sapiens
ccaggctggtctcgaactcctgacctcaggtgatccacctgcttcggcctcccaaagtgctggaattacaggcatgagccaccgggcctggccgatctgtrtctattttacatttagcaccattattttttctttgttgccatttatttcttttatgaggtaattttatagttttagagttagtctatggttagattacta

SEQ ID NO: 49772 - DNA, 201 bp, Homo sapiens
tcacacgtagaagattgaacaactctgaattgtttatacatggaataaaacctgacaatgtaaaaataattataacactaacaaaaatgggagtgggggggaggaaaggaagaaatggttattctcctacctgtcatattggcaaatccatagataacaacagaatttaaaatttaccatctaaacttaaattttaaaata

SEQ ID NO: 49773 - DNA, 201 bp, Homo sapiens
gggtttcaccatgttggccaggctcttctttaactcctgacctcaggtgatccacttgcttcagcctcctaaggtgctgggattacaggcatgagccaccrcgcctggccaagattcattttattaagaaagactggcagtgataatgattctttatcccctgcatgactcttctttatcccctacatgactcttttattt

SEQ ID NO: 49774 - DNA, 201 bp, Homo sapiens
aaagaaaaaggatcaaggagaaacataaataaacaaaatgaactaaaaagtaagcacgctcagctcaaagaaaaaaatagaggaaaaaatgtaaatattacacaaatgagcatcacataaaataaaaggaatgtaaacgttgttagggagaaagatgagtggaattaaggagtcccacaaacacaataaaaagagcaagca

SEQ ID NO: 49775 - DNA, 201 bp, Homo sapiens
aagaactgagaattgaaaacagaatacctgattgctttttaattaatttaatttttaggggtgggcatggtggttcacgcctgtaatcccagcactttgggaggccaaggtgggcagatcacttgaggtcaggagtttgaggtcagcctgatcaatatggggaaaccacctctactaaaaatacaaaattatgtttttgta

SEQ ID NO: 49776 - DNA, 201 bp, Homo sapiens
tgctttgtttgaacaaaggatgcctcagtggtttttaattagaaaaagtaaattcgattatttacttttgtttataattttatagactagaaacaaacatwttaatgtgctctgttaagattactggcaaggtgggacagttttccagctgtatttccctttaaaaatgtctcttttgtgtcttgtactcatttatttgtc

SEQ ID NO: 49777 - DNA, 201 bp, Homo sapiens
tccagtttttcatgtttctaacttgtcactcctcctatcatccttggtgatttttcacattttgccaaagcaatctatatacagcagcatgatgtgtgtgygttaagtagagctaggcattttccctggattcttatattttacttagatttgttatagaaataaaaattaataagacatcttaaggctatgaaccccact

SEQ ID NO: 49778 - DNA, 201 bp, Homo sapiens
ttgaatttttttccctagtgcctgtttttgtcttttcttataggtgccacttgtgtgttaaagaagaaattttcagcaagccagttttggagtgactgcargaagtatgatgtgactgtgtttcagtatattggagaactttgtcgctacctttgcaaacaatctaaggtaggcgtaatcattatcagaaaaaaatatgtc

SEQ ID NO: 49779 - DNA, 201 bp, Homo sapiens
ttcactagttaaggaaaaacagattgataagtatttaggtctaacaaatgagtagccacctgaaaaataatccatataaataagtaaatgctttcatttcrttttcaaataaccacaatcagtcactaaggagatgtaagttgggccacagttcttcagaccttggaattagattggactggacagggagagcctgatttc

SEQ ID NO: 49780 - DNA, 201 bp, Homo sapiens
atgatagatttgtgtgtacctgtagtagaaattgctgtcttttgtggcttttatctccttagcatcttatggcattctctatacataatgttatattggcrttgaattgaagagataacctatgtattttagacataattataatcagtttattatgttcataattcttatatattgaatgagtttatatttaagtaaagt

SEQ ID NO: 49781 - DNA, 201 bp, Homo sapiens; identical to SEQ ID NO: 14399

SEQ ID NO: 49782 - DNA, 201 bp, Homo sapiens; identical to SEQ ID NO: 14396

SEQ ID NO: 49783 - DNA, 201 bp, Homo sapiens
gcaggaatggcttctattattttaaaaccaaatacatctttagatttggaaaaagtttatgaacaagttgtaacatttctaccagcttatgcttgtccackatttttaagaattcaggtaattttagtggcggagtttactatcaaatataagacagtaaacaaggaagtagtttaattgcaaaataatattgtatccttt

SEQ ID NO: 49784 - DNA, 201 bp, Homo sapiens
tgaacatcatagagtgtacctacacgaacctagatgacatagtttactacacacctaggcgctgtggtatgggttattgctcctaggctacaaacttgtacaggatattactgtactgaatatcgtaggcaattggaacacaatggtggtaagtatttttaagtgaaaacagaaatggtacagtaaaaacatagtggtatg

SEQ ID NO: 49785 - DNA, 201 bp, Homo sapiens
cactttttttggttggtaggctattaattattgcctcaatttcagagcctgttattggtctattcagagattcaacttcttcctggtttagtcttgtgacrgtgtatgtgtccaggaatttatccattttttctagattttctagtttatttgcgtagaggtgtttatagtattctctgatggtagtttgcatttccgtgg

SEQ ID NO: 49786 - DNA, 201 bp, Homo sapiens; identical to SEQ ID NO: 14405

SEQ ID NO: 49787 - DNA, 201 bp, Homo sapiens
gctgggatgatggtgtctgctaaaaaaaaaaagtgtaatgaaatgttctttagttttttgatctttagtaaaatttcatcttcgtataaaattttattaaycattccactaacttgttacttctccactccacctccccactccctttagaatccttagtttgaagacataattctttaaatgatctgtctcagggagggg

SEQ ID NO: 49788 - DNA, 201 bp, Homo sapiens
tatagagcaatgccttcaaagtcctgcgtaaaaatgactacttacctagaattctttacaagcagccattcaagtgtataggtggaaaaaaaagacatttycaggcacataaggactgacaaaaacttacctcccaaatgctctttatcagatagctactgaaaccaaatgtgtgctaccactgtaattaatttctagaat

SEQ ID NO: 49789 - DNA, 201 bp, Homo sapiens
ttaagaattcaggtaattttagtggcggagtttactatcaaatataagacagtaaacaaggaagtagtttaattgcaaaataatattgtatcctttagatracatgtgagttatgtgagaggcgtggcgtgtagagttgatgcagatcgatgccatgtttgaagcctaattataaagggggcatggtgaaatgctaggacg

SEQ ID NO: 49790 - DNA, 201 bp, Homo sapiens; identical to SEQ ID NO: 14407

SEQ ID NO: 49791 - DNA, 201 bp, Homo sapiens
aattctttagctgagtatagaatgctaggttgacaattattttcttgtactagctttaaaatattatattgtcttccaggcttacggtcattgttgaaatrtcagccataaatattcatgttgcccctttggaaatgatgtttctatttctttctggctgcttttaaaattctccctctctttttaatttttatatatttt

SEQ ID NO: 49792 - DNA, 201 bp, Homo sapiens
acgtgtttttaataaatcgtattttttaaaggcgtccctgctaacgtgctgaatcagtgagtcactgtcctcccaaatgtgaacaagattctgatttctcycagtataaattagttttgcttgtttcccaaaaacagaatctaaatgaaattatatatatgcattcttttgaccttgcttctttgactcagtcagcactat

SEQ ID NO: 49793 - DNA, 201 bp, Homo sapiens
ttgtcctgcactttttttggttggtaggctattaattattgcctcaatttcagagcctgttattggtctattcagagattcaacttcttcctggtttagtmttgtgacggtgtatgtgtccaggaatttatccattttttctagattttctagtttatttgcgtagaggtgtttatagtattctctgatggtagtttgcat

SEQ ID NO: 49794 - DNA, 201 bp, Homo sapiens
ctatccctggccccgctaactttccatccatcatgccaggtgggggcaggttattgttccatcatctttctctccttgatgccctccactggcttccagtyttcttccagggttcaccaatagagtttcacaacataaacagctgtttttttttaaaggctcacctgaccaatattttgcccacctaccactatgcccaat

SEQ ID NO: 49795 - DNA, 201 bp, Homo sapiens
tctgctggatttggtttgccagtattttattgaggatttttgcatcagtgttcatcaaggatattggtctaaaattctctttttttgttgtgtctctgccrgactttggtatcaggatgatgttggcctcatgaattagggaggattccctctttttctattgattggaatagtttcagaaggaatggtaccaattcctgt

SEQ ID NO: 49796 - DNA, 201 bp, Homo sapiens
tggttgatgtagctgagttctgcttgatcaattcaagccacagcttattggttggttcaggaaaaatgaacaagaagagtcagctatgaaagccttagcartaggccagtgcagtagctcatgccgataatcccagcactttgggagtttaaggtgggaggatcacttgagctcaggagttcaagaccagcctgggcaata

SEQ ID NO: 49797 - DNA, 201 bp, Homo sapiens
taaagtagttttttccaattctgtgaagaaagtcattggtagcttgatggggatggcattgaatctataagttaccttgggcagtatggccattttcatgwtattgattcttcctatccatgggcatggaatgttcttccatttgtttgtgtcctctttttatttcgttgagcagtggtttgtagttctccttgaagaggt

SEQ ID NO: 49798 - DNA, 201 bp, Homo sapiens
ctctcttacagtgtgggtttctctctgtctctgtgaatttgtctaagttttaaaatcaaagttctgtgaaaaggaatttgaaagaaagcaactttattccsgtgaactgtttgcaaactgtaagatacagcctttgctgtgaaacttaggtacattccagagaacaaagggaaggttgagtgtttatagcaacagttcctg

SEQ ID NO: 49799 - DNA, 201 bp, Homo sapiens
gcaatgcaggctcttttttggttccgtatgaactttaaagtagttttttccaattctgtgaagaaagtcattggtagcttgatggggatggcattgaatctataagttaccttgggcagtatggccattttcatgatattgattcttcctatccatgggcatggaatgttcttccatttgtttgtgtcctctttttatttc

SEQ ID NO: 49800 - DNA, 201 bp, Homo sapiens
attaaatagggaatcgtttccccatttcttgtttttgtcaggtttgtcaaagatcagatggctgtagatgtgtggtattatttctgagggctctgttctgytccgttggtctatatctctgttttggtactagtaccatgctgttttggttgctgtagccctgtagtatagtttgaagtcaggtatcgtgatgcctccagc

SEQ ID NO: 49801 - DNA, 201 bp, Homo sapiens
  misc_feature (1)...(201): n = A,T,C or G, or insertion/deletion polymorphism (see Tables 1-2)
gagcaatgccttcaaagtcctgcgtaaaaatgactacttacctagaattctttacaagcagccattcaagtgtataggtggaaaaaaaagacattttcagncacataaggactgacaaaaacttacctcccaaatgctctttatcagatagctactgaaaccaaatgtgtgctaccactgtaattaatttctagaatctta

SEQ ID NO: 49802 - DNA, 201 bp, Homo sapiens
aggtgtaaggaaggtatccagtttcagctttctacatatggctagccagttttcccagcaccatttattaaatagggaatcgtttccccatttcttgtttwtgtcaggtttgtcaaagatcagatggctgtagatgtgtggtattatttctgagggctctgttctgctccgttggtctatatctctgttttggtactagta

SEQ ID NO: 49803 - DNA, 201 bp, Homo sapiens; identical to SEQ ID NO: 14400

SEQ ID NO: 49804 - DNA, 201 bp, Homo sapiens
cagctgacactaggctggaggcatttaaataagactttttcattttgagcttggagttcaccaaggagaaacctccagtcgagtttctgacccacctcccygtggcagaagccatccttactcattttttgtctggaatgcttcaaataactatagattccacagattcatagccaagacaaagagttccagataaatgtt

SEQ ID NO: 49805 - DNA, 201 bp, Homo sapiens
tatgtcctgaatggtattgcctagattttcttctatggttctaatggttttaggtctaacatttaagtctttaatccatcttgaattaaattttgtataargtgtaaggaaggtatccagtttcagctttctacatatggctagccagttttcccagcaccatttattaaatagggaatcgtttccccatttcttgttttt

SEQ ID NO: 49806 - DNA, 201 bp, Homo sapiens
tacttatttctaaaatttaccaacttaatgctgcatttagtatcttcatgcaattgagctaatgtaggttttcagaagtgaatgtaaatagccaaagtatrtggatacttttgcgatttatagaaaatatttctaaattgctgttcaacatggttgaagtgatttagaagctcatgcacattgtaggagtatgcctgttgc

SEQ ID NO: 49807 - DNA, 201 bp, Homo sapiens
cttttggtgttttagacatgaagtccttgcccatgcctatgtcctgaatggtattgcctagattttcttctatggttctaatggttttaggtctaacattkaagtctttaatccatcttgaattaaattttgtataaggtgtaaggaaggtatccagtttcagctttctacatatggctagccagttttcccagcaccatt

SEQ ID NO: 49808 - DNA, 201 bp, Homo sapiens
ttgtcaattttggcttttgttgccattgcttttggtgttttagacatgaagtccttgcccatgcctatgtcctgaatggtattgcctagattttcttctakggttctaatggttttaggtctaacatttaagtctttaatccatcttgaattaaattttgtataaggtgtaaggaaggtatccagtttcagctttctacat

SEQ ID NO: 49809 - DNA, 201 bp, Homo sapiens
tcttcaaagaaaaaatgatgtttatcaaataatctgcaaatgcttacctgaatgcaaactgaggaggaaagaaggaaataaatacagctttacccaaaggraaacttaataatttttttttaagcagagaagcattgtactacctaataccctttgttgaactcacacaaaatgagtacaagctgttcttggcattaaaaa

SEQ ID NO: 49810 - DNA, 201 bp, Homo sapiens
tctttaagttctttgtagattctagatattagccatttgtcagatgggtagattgtaaaaattttctcccattctataggttgcctgttcactctgatggyagtttcttttgctgtgcagaagctctttagtttaattagatcccatttgtcaattttggcttttgttgccattgcttttggtgttttagacatgaagtcc

SEQ ID NO: 49811 - DNA, 201 bp, Homo sapiens
ctttacccaaaggaaaacttaataatttttttttaagcagagaagcattgtactacctaataccctttgttgaactcacacaaaatgagtacaagctgttyttggcattaaaaattaggaaaaggagaaagtcattctgttatgacatcttttcccttcaaggagatcttacatttttgctctccaatattcctttcaatg

SEQ ID NO: 49812 - DNA, 201 bp, Homo sapiens
tcttgtagggcttgaatctttgtaatcttggaggagaaacttggattttattcccatcagagtagttgaaaaaagatgaaggaaaaactggaaaaaattakaccactttgggatctatcttgaaggaaagctaacaagacttgttagatcaaggataggaagtgaaggaatgggtagaatcaaggataagtcccaggtttt

SEQ ID NO: 49813 - DNA, 201 bp, Homo sapiens
tttatgctcctgttgtcttattattactgaaatagatttaatgtctccatgtgtgccaattagcatgtacagaattatcttttaaagtttatttggtactyaaaaatgactctatttcaaactttttttcaggttatgaaggaagagcaggaatggcttctattattttaaaaccaaatacatctttagatttggaaaaag

SEQ ID NO: 49814 - DNA, 201 bp, Homo sapiens
aagtcttttcaaactatcttttgtgccttaaaatctttgttaaactgatggctgtcatctctgaaaccacggcccacccaaactcaggcttgagttaaagscaacattgaaaagattttcaggggcagctggaacctgtgctgtcttgaccttgtaggccactcattttaaatactaccaaatcctttcttaaaagaagtg

SEQ ID NO: 49815 - DNA, 201 bp, Homo sapiens
ttggttgtgctggccagatataatatagatacattcatggtgtgtgtaacaatagttttaatcagatggctgcaaaaatgtcgttctttcttgcaggagarcctggacttctcatttctcgagtgaatgcaaaaaatcccttctttggctatgctgggccttataagcacacaaaagacaaattgctttgtgatgttttta

SEQ ID NO: 49816 - DNA, 201 bp, Homo sapiens
tccccactccctccattgttccctctcttgttccttccctctcttgttccttccctctcttgttccttccctctctcgttccttccctctctcgttccctsgttccctccctctctcccaccctccctcactccctcccttcctttcttccttcgttccttcgttccttccttccataaatgtgttgtgaacacttcttat

SEQ ID NO: 49817 - DNA, 201 bp, Homo sapiens
attctacagaacgttggtgtttctggaggggacaaagtccaacaagggaatttggataaatcaaagtttctatcgttgcaggcagggagttgggactctgrtgcattcaggtcactgcagaaatgaccttgctaatgggaccctgcactttttggaacgtttcattaatgagcgctagtagttgtagctcaggtgacagtt

SEQ ID NO: 49818 - DNA, 201 bp, Homo sapiens
ggatacttgtgtgctcatgaccaacataatctttccctagtctcagacctgcaaggaaagctaaattctacagaacgttggtgtttctggaggggacaaartccaacaagggaatttggataaatcaaagtttctatcgttgcaggcagggagttgggactctggtgcattcaggtcactgcagaaatgaccttgctaatg

SEQ ID NO: 49819 - DNA, 201 bp, Homo sapiens
tctctcttaatcttcttccctccactattgcataagttccattatgtattattatatccttagtgcctagaatggtgcctgacacatagtagatcctcaayaaaatttgttaatatttaaacaaaagagagtagcaaatagaacaagtccagttgctgggatacttgtgtgctcatgaccaacataatctttccctagtct

SEQ ID NO: 49820 - DNA, 201 bp, Homo sapiens
tatgtcactaaagcaccatcatacaatctgattgggtctagttctatattttcttaatactaatgttgtctttaatattgattggtgaggaatatgttggwactctagacatcagtgatcctctaggggagtcttgctgcagagtttgtcttatataagcaattccacctaacacagtcaacagttagccatatctaggga

SEQ ID NO: 49821 - DNA, 201 bp, Homo sapiens
tatagtgtttcccattccatgtatttcatttctgtagtataggcaattagagatagactctggccttccctgtccttaaatgatttctagggggtaaatcrtatgttcagggaaggatacagactagtttatgctcctgttgtcttattattactgaaatagatttaatgtctccatgtgtgccaattagcatgtacagaa

SEQ ID NO: 49822 - DNA, 201 bp, Homo sapiens
tctctacaaaagtaaaaaattaggtaggcgtggtgacacatgtctgtagtcccagttacttgggaggctgaggcaggaggattgcttgagcccaggggttsaagaccagcctatgcaacatagtgagacctcatctctacaaaagtaaaaaattagctaggtgtggtggtgcatgcctgtagtctcagctacttgggaagg

SEQ ID NO: 49823 - DNA, 201 bp, Homo sapiens
aaaatgagtacaagctgttcttggcattaaaaattaggaaaaggagaaagtcattctgttatgacatcttttcccttcaaggagatcttacatttttgctstccaatattcctttcaatgacattcccttgaaatgaaggggcagtttctgctgcccagccagtacatcagtggattcaggtagagccagagaatgaacac

SEQ ID NO: 49824 - DNA, 201 bp, Homo sapiens
tttttttcttgtaaatttctttaagttctttgtagattctagatattagccatttgtcagatgggtagattgtaaaaattttctcccattctataggttgmctgttcactctgatggcagtttcttttgctgtgcagaagctctttagtttaattagatcccatttgtcaattttggcttttgttgccattgcttttggtg

SEQ ID NO: 49825 - DNA, 201 bp, Homo sapiens
taggtgtggtggtgcatgcctgtagtctcagctacttgggaaggtgaggtgggaggattgcttgagcatgagaggttgaggctgcagtgagctgagattgycccactgtactccagcctgggtgacacagtgagaccctgtctcaaaaaaaaaaaaaaaaaaaaagaacctcaaactcaaagttaagcagatgtgtgtgag

SEQ ID NO: 49826 - DNA, 201 bp, Homo sapiens
ctaaaaatacaaaaattagccgggcgtggtggcgagcacctgtaatcccagctactcgggaggctgaggcaggagaattgcttaaccccgtgaggtggagkttgtgtgagccgagattgtgccactgcactccagcctgggtgacagagcaagactctgtctcaaaaaaaaaattaatttaatttttaattttaattttta

SEQ ID NO: 49827 - DNA, 201 bp, Homo sapiens
ttgtttgatttttttcttgtaaatttctttaagttctttgtagattctagatattagccatttgtcagatgggtagattgtaaaaattttctcccattctrtaggttgcctgttcactctgatggcagtttcttttgctgtgcagaagctctttagtttaattagatcccatttgtcaattttggcttttgttgccattgc

SEQ ID NO: 49828 - DNA, 201 bp, Homo sapiens
ttggttttctgtccttgtgatagtttgctcagaatgatggtttccagcttcatccatgtccctacaaaggacatgaactcatccttttttatggctgcatrgtattccatggtgcatatgtgcctcattttcttaatcaagtctatcattgatggacatttgggttggctccaagtctttgctattgagaaaagtgccgca

SEQ ID NO: 49829 - DNA, 201 bp, Homo sapiens
tgaaatattctttttaactctctgaatctgtattgcactgatttggaggaaatattatagctttggagaatttgaaagaactgagaattgaaaacagaatrcctgattgctttttaattaatttaatttttaggggtgggcatggtggttcacgcctgtaatcccagcactttgggaggccaaggtgggcagatcacttga

SEQ ID NO: 49830 - DNA, 201 bp, Homo sapiens
tttttctttaaattttttaaagaaatgaaatattctttttaactctctgaatctgtattgcactgatttggaggaaatattatagctttggagaatttgaragaactgagaattgaaaacagaatacctgattgctttttaattaatttaatttttaggggtgggcatggtggttcacgcctgtaatcccagcactttggg

SEQ ID NO: 49831 - DNA, 201 bp, Homo sapiens
  misc_feature (1)...(201): n = A,T,C or G, or insertion/deletion polymorphism (see Tables 1-2)
atatactttgtataatattaagcttaaaaatggcagaacactaaattgtataaatacagtgagctgctaatttttaagaaaagagtaaaaggatatgtttncttgcacagccatatctggctgtgatgacagtgttggatcaggggagatggaggagggaagggagatcagggaagggggttcaaagtgaagttgactcaa

SEQ ID NO: 49832 - DNA, 201 bp, Homo sapiens
  misc_feature (1)...(201): n = A,T,C or G, or insertion/deletion polymorphism (see Tables 1-2)
tgagaccttataaaacaattttctaagttcaattttgaagaaaattacaggacccaggaaaatatactttgtataatattaagcttaaaaatggcagaacnctaaattgtataaatacagtgagctgctaatttttaagaaaagagtaaaaggatatgtttgcttgcacagccatatctggctgtgatgacagtgttggat

SEQ ID NO: 49833 - DNA, 201 bp, Homo sapiens
  misc_feature (1)...(201): n = A,T,C or G, or insertion/deletion polymorphism (see Tables 1-2)
gtgttaaaaattttgatattctctaaaagttcatgaataagggcaaagttaattaaaatatgataattaaatgagaccttataaaacaattttctaagttnaattttgaagaaaattacaggacccaggaaaatatactttgtataatattaagcttaaaaatggcagaacactaaattgtataaatacagtgagctgcta

SEQ ID NO: 49834 - DNA, 201 bp, Homo sapiens
cccagcttttcccggctcgaattcagcctccaactcaagctcgcgggaaagactacctgagaggagaaaagcttctgtccctggaccttcttctgagggtrgtgaggtttgtttagggtcgcagaagcagggaggactgactcagccctcacagagaagaggtctggaaagtcctggggaactcgcagggcacgggccgct

SEQ ID NO: 49835 - DNA, 201 bp, Homo sapiens; identical to SEQ ID NO: 14397

SEQ ID NO: 49836 - DNA, 201 bp, Homo sapiens; identical to SEQ ID NO: 14398

SEQ ID NO: 49837 - DNA, 201 bp, Homo sapiens
gtcgcggttgggaggcgagggcgcagcgctggggttgtagattccaagacccctgagggtggctgtgttggtttctcgcaggagtcggaggctccctgctytccagccgcccagtgacccaagcttaatcttcagcaccacttggggcgaccttttcggtgcaaacctacgattctgtttctcaggattcctccccatccc

SEQ ID NO: 49838 - DNA, 201 bp, Homo sapiens
cttttctcagtgtttttctttaaattttttaaagaaatgaaatattctttttaactctctgaatctgtattgcactgatttggaggaaatattatagcttyggagaatttgaaagaactgagaattgaaaacagaatacctgattgctttttaattaatttaatttttaggggtgggcatggtggttcacgcctgtaatcc

SEQ ID NO: 49839 - DNA, 201 bp, Homo sapiens
tccatattggccaggctggtctcatactcctgacctcaggtcatccgcctgccttggcctcccaaagtgctgaggtgtgagccaccatgcccagcctcaaytgaatttttaaaaatcaaaacagtacttttacacagttataaaaatgaaatagtactcttaggataagaaatatctctgcattatcagtacttgatctct

SEQ ID NO: 49840 - DNA, 201 bp, Homo sapiens
aactatccctctttatctccagaaatgttgctttacttaaggtctactttgtctgatattagtatagttatactagcttcctcttgggtgatgattgtatrgcttacctttttccatccaactactttcaattttgggcttatgtaatatttaagatgtatttttcataaacaggatatagttgagttttatatttttatg

SEQ ID NO: 49841 - DNA, 201 bp, Homo sapiens
aatttaccaacttaatgctgcatttagtatcttcatgcaattgagctaatgtaggttttcagaagtgaatgtaaatagccaaagtatatggatacttttgygatttatagaaaatatttctaaattgctgttcaacatggttgaagtgatttagaagctcatgcacattgtaggagtatgcctgttgcacagtgtctgtca

SEQ ID NO: 49842 - DNA, 201 bp, Homo sapiens
ttgactatttctttacctcctgcttttagcctaattggtattttagtgagctctctttatgacctgattggccgggtgtgagctgagttacaagccccatrtttaaaggtaggtgcagtcaccttccccagctaggcttaggaattcttagtcggcctaggaaatccagctagtcctgtctctcaccttctttcagaacat

SEQ ID NO: 49843 - DNA, 201 bp, Homo sapiens
cggctcaaatgcctgggtttatatctggatctttgtccctccccctgtgctctcaggtgatagatgattgactatttctttacctcctgcttttagcctarttggtattttagtgagctctctttatgacctgattggccgggtgtgagctgagttacaagccccatgtttaaaggtaggtgcagtcaccttccccagcta

SEQ ID NO: 49844 - DNA, 201 bp, Homo sapiens
tcatttgctacttgtatttgtctaaaatgctgtaatttttagaatagaatatttagaatatgatcaatatccaccataaatgaagatgagatattaaaagmcattaaaatcttcagtggacatacattgttgtcaaaattaggttctgcagtcatttaagaacttttttgttagtactatcttgctaattcaaccttacta

SEQ ID NO: 49845 - DNA, 201 bp, Homo sapiens
gagcaaatttacactgcaaaagtaagagccctgaagaaattgctgaggccatctttgcgaacagtctgccatagacactcaataaattagttggtagagcktgtgactcagtagattccattcataaacatgcaagattatgtgtcagtttctagacctcacataatatacaaacagtggagatcatttgctacttgtatt

SEQ ID NO: 49846 - DNA, 201 bp, Homo sapiens
tattggctgggcttctctctccttgtagtcactcaccctcaaacaaactaccccagattcctcaaatgtagtagaaatgttccaagggagtgagtatggamgctgcataaatcttaaggcctagtcttgaaagacacataggttattttaccttcattccattgatcaaagtaagtcatgggccagcctagattcaagatt

SEQ ID NO: 49847 - DNA, 201 bp, Homo sapiens
atttattttaaaaaaactacacaattttatggcatattcagtgttttcctgaggtgaaaagaacagttttctgaggatttggccatgtggtcggagctggstattggctgggcttctctctccttgtagtcactcaccctcaaacaaactaccccagattcctcaaatgtagtagaaatgttccaagggagtgagtatgga

SEQ ID NO: 49848 - DNA, 201 bp, Homo sapiens
tcatggtgtgtgtaacaatagttttaatcagatggctgcaaaaatgtcgttctttcttgcaggagaacctggacttctcatttctcgagtgaatgcaaaamatcccttctttggctatgctgggccttataagcacacaaaagacaaattgctttgtgatgtttttaagaagggagatgtttaccttaatactggagactt

SEQ ID NO: 49849 - DNA, 201 bp, Homo sapiens
gcaaatagaacaagtccagttgctgggatacttgtgtgctcatgaccaacataatctttccctagtctcagacctgcaaggaaagctaaattctacagaamgttggtgtttctggaggggacaaagtccaacaagggaatttggataaatcaaagtttctatcgttgcaggcagggagttgggactctggtgcattcaggt

SEQ ID NO: 49850 - DNA, 201 bp, Homo sapiens
tttcttcctagagcttataattccattacatattttatatataacctctttctttatctctcttaatcttcttccctccactattgcataagttccattaygtattattatatccttagtgcctagaatggtgcctgacacatagtagatcctcaataaaatttgttaatatttaaacaaaagagagtagcaaatagaaca

SEQ ID NO: 49851 - DNA, 201 bp, Homo sapiens
cagaagaaactcaaaaggaagagccccacagaaaacaccacctgaatgtttgaagagaaggagggtatgctgggccatccattgactagatcttgtagggyttgaatctttgtaatcttggaggagaaacttggattttattcccatcagagtagttgaaaaaagatgaaggaaaaactggaaaaaattagaccactttgg

SEQ ID NO: 49852 - DNA, 201 bp, Homo sapiens
tatttttctcttcaaggagaccttgcctcaggtaagggaggtagtcttaatctaaagaaccccaataatacacttagaatgccacaacctcacatattttmtcttctagttttcattgtactttttggtaatgtgatatctggactaggttaatttagggaattaatgccctccagtaagattaaggtcaccttcagttga

SEQ ID NO: 49853 - DNA, 201 bp, Homo sapiens
tttcattttgagcttggagttcaccaaggagaaacctccagtcgagtttctgacccacctccctgtggcagaagccatccttactcattttttgtctggartgcttcaaataactatagattccacagattcatagccaagacaaagagttccagataaatgttttacattttttaaatatttttctcttcaaggagacct

SEQ ID NO: 49854 - DNA, 201 bp, Homo sapiens; identical to SEQ ID NO: 14406

SEQ ID NO: 49855 - DNA, 201 bp, Homo sapiens
ttcatgttatcaaagtaatgatttttttcttcctgaaaaatgctttcttccttacctgacatttacccaaaaaaaaagcctttagtgatctgcaatttagratgagctgttcccagatatggaaaaacacaaactgtattattcttgaccagtgttactttcattaggatttggacacagttctgcaatagacttatacac

SEQ ID NO: 49856 - DNA, 201 bp, Homo sapiens
aataagaaaccactaatcgacatatgaaagaccctgcatctaactactgctgtatatctattttattcaagcacttttgaaacgtttacaaaagttactgkgccagttaggtaattccaacaaatttcaaaggattgaatatatataaattatgctctctgaaaacagtttaattgttggtagaaataatttttttaaaag

SEQ ID NO: 49857 - DNA, 201 bp, Homo sapiens
catgtatgaggaaagcttttggttgataatctctctcctcaggtgtgtttccttagtggcctcacctgttctctgaaagtagcactatcctatagcattgyttttgacatttccagagcaccctactcaagccatatttagaactgcttttgaagagatctttaagaatcccataatgcgaactttggtgcttttttgtca

SEQ ID NO: 49858 - DNA, 201 bp, Homo sapiens
gaataacaatatatttgctttgctgcctctttcattggctctaatcctaaaataggataatattaatttctacatcataggatgttttgatgattacattraatagaactcttaaacacttagcacagtgtccagcatatagttggtgcccaatcaatattaattgctctcatttatattttaattcaaataatgagttgt

SEQ ID NO: 49859 - DNA, 201 bp, Homo sapiens
gaggattacttgaggccaagtgtttgagaccagcctaggcaacacagtgagacctcatatgtacaaaaaaattaaaaaaaatagccagatgtggtggcatrcacctgtagtaccagctactcaggaggctgaggcagttgaatcattctatcccagaagttcggggttatagtgagctgattgcacctctgcactccagcc

SEQ ID NO: 49860 - DNA, 201 bp, Homo sapiens
aaccattttcataagctgttttattgccttaaaagtaggtgtcttttagggatgaggaaagttagacaacttcaaaataagagaacagtccccacaagacsactcccatttctgacacaatttcaggagtcccaaagaccactctcaggtttgataatttgctaaaaggactcacaaaactcaacttattacagctaaagg

SEQ ID NO: 49861 - DNA, 201 bp, Homo sapiens
ccaccatgttgtctcactcctcaagtctacttgtctttacatttttacctctggaacaacaggtatgatccaattcttttgaaggctaaaatgaatgcgasaaatttgcaaagcaacagtgttgggcaaatttctaccatgtgtagtgaccaaccatctgagaatgcatgcttgcaagaagatgtaaggatctcagaggct

SEQ ID NO: 49862 - DNA, 201 bp, Homo sapiens
gggaatttcttattctagatgagagattttgaaattaaagtaatgagtcagttcagagatttgcacttacaagttcaaaacctgagaaagagtcattacarcaaaatctggaacaaacattaaaaagaaagtctagatcctttgcttatccagtttttcatgtttctaacttgtcactcctcctatcatccttggtgattt

SEQ ID NO: 49863 - DNA, 201 bp, Homo sapiens
ctgagtagctgggattacaggtgcctgccaccacacccagctaatttttgtatttttagtagagacagggtttcaccatgttggccaggctcttctttaamtcctgacctcaggtgatccacttgcttcagcctcctaaggtgctgggattacaggcatgagccaccgcgcctggccaagattcattttattaagaaagac

SEQ ID NO: 49864 - DNA, 201 bp, Homo sapiens
aatagcaagccagatgcaacatgccttcttgtgccatttcagtaataattattcattggcaacaggagatgtgttagaaataacatcaaatgaagtgttcractttttcttttttgtataattttggttataataatataatgtataaattgtgttattatgttataataatattcaatctgctcacctcaaaaatgtggg

SEQ ID NO: 49865 - DNA, 201 bp, Homo sapiens
agatcctttgcttatccagtttttcatgtttctaacttgtcactcctcctatcatccttggtgatttttcacattttgccaaagcaatctatatacagcarcatgatgtgtgtgtgttaagtagagctaggcattttccctggattcttatattttacttagatttgttatagaaataaaaattaataagacatcttaagg

SEQ ID NO: 49866 - DNA, 201 bp, Homo sapiens
agactttttcattttgagcttggagttcaccaaggagaaacctccagtcgagtttctgacccacctccctgtggcagaagccatccttactcattttttgyctggaatgcttcaaataactatagattccacagattcatagccaagacaaagagttccagataaatgttttacattttttaaatatttttctcttcaagg

SEQ ID NO: 49867 - DNA, 201 bp, Homo sapiens
attaattacccagagcacagctgacactaggctggaggcatttaaataagactttttcattttgagcttggagttcaccaaggagaaacctccagtcgagyttctgacccacctccctgtggcagaagccatccttactcattttttgtctggaatgcttcaaataactatagattccacagattcatagccaagacaaag

SEQ ID NO: 49868 - DNA, 201 bp, Homo sapiens
tttaatctttgatgataaataatactattgcatctatctcaatcatcttatcttttcccacttatttgttctatatttgttcatttctcttctcctgctttccccccattcatctttccttattattattttatctcacttcattttattacattcatgttagtttaccattttctaactgagcttgtttgattgctgagt

SEQ ID NO: 49869 - DNA, 201 bp, Homo sapiens
ctgaccactgacactgattataatttattttctattttttcttttgaataagtgattatattaggatatctttttgttttactttaaattaaaaaaaaaamcccacattgctttgatttgcacttgtctccttaactgaagaagtcatttccacattcgtttgatcaactgccaccatctgaaaaacagataagcagagac

SEQ ID NO: 49870 - DNA, 201 bp, Homo sapiens
agaagaatggggtgtgaaaattattttgttttcaaattcaaaaatatctagaactataagacctgagttgttagactgaaaaagcctaaaaatttcccagygaaatggatagatgagactggtcccagtaaaagtcatcatgatattacagactactgaaaacaaatagaagattccaaaaatgaaaaaaaatagaaatac

SEQ ID NO: 49871 - DNA, 201 bp, Homo sapiens
ggcatgaacccaggaggtggagcttgcagtgagcagagattgcgccactgtactccagcctgggcgacagagcgagactctgtctcaaaaaaaaaaaaaaraaaaaaaaggagcaccttgtggtctgccagcactcttctagatactatgcttgtaaattgtggtaaatattatcacctttttttttttttaagttgagaa

SEQ ID NO: 49872 - DNA, 201 bp, Homo sapiens
aaaaaattattattgttaatattctgaaagatggggacaaaaaagtgtcaataatataaaaataacatactacaaaaagaggaatattcagagaacataaktgttggaaaatctctcaaaaagtaaagcaaaaggtaagagaaggaaaacaggataggcaacattaggaaaccagtgattctgtccaggagggctgatctt

SEQ ID NO: 49873 - DNA, 201 bp, Homo sapiens
gagacgtaattctggaaaagatgaacttctgaaaataccaggaagaacagaggtttaaaaagtaggggatataaaagaaagtctccctccctataaatatrtatatatgtatatagatagatatacatatatgtatatgttctctttaatatatataacttcttttaatacttgactgttttaatctttgagattcttgtc

SEQ ID NO: 49874 - DNA, 201 bp, Homo sapiens
catgttttatgttcattctgcctttgaatttttttccctagtgcctgtttttgtcttttcttataggtgccacttgtgtgttaaagaagaaattttcagcragccagttttggagtgactgcaagaagtatgatgtgactgtgtttcagtatattggagaactttgtcgctacctttgcaaacaatctaaggtaggcgtaa

SEQ ID NO: 49875 - DNA, 201 bp, Homo sapiens
atcgctgcgcttctcagtcatcatcatcccagcttttcccggctcgaattcagcctccaactcaagctcgcgggaaagactacctgagaggagaaaagctkctgtccctggaccttcttctgagggtggtgaggtttgtttagggtcgcagaagcagggaggactgactcagccctcacagagaagaggtctggaaagtcc

SEQ ID NO: 49876 - DNA, 201 bp, Homo sapiens
caaaattcatggatgtttgctccttatataaaatgatacagtatttgcctatgaggtgtgcacatcctcctgtatactttaaacaggttgcttataatacrtaatacaatgtaaatgctacataaatagggtcgtatggtattttttatttatattttttattgttttattattattttatcttttttaccaaatattttc

SEQ ID NO: 49877 - DNA, 201 bp, Homo sapiens; identical to SEQ ID NO: 14427

SEQ ID NO: 49878 - DNA, 201 bp, Homo sapiens
ccactaaaaatacaaaaaattagccgggcgtggtggtgggcgcctgtagtcccagctactcgggaggctgaggcaggagaatggcgtgaacccaggaggcrgagcttgcagtgagccgagattgcaccactgcactccagcctgggcgacagaatgagactccgtctcaaaaaaaaaaaaaaaagaaaaaaatctttacag

SEQ ID NO: 49879 - DNA, 201 bp, Homo sapiens
gtgccaccacacccaggtaatttttgtatttttggtagagacgaggtttcaccatgttggccaggctggtcttgaactcctgacctcaggtgatccacccrcctcagcctcccaaagtgctgagattataggtgtgagccaccacacctggcctcaggaagtatttttatttttaaatttatttatttatttgagatggag

SEQ ID NO: 49880 - DNA, 201 bp, Homo sapiens
aatggcgtgaacccaggaggcggagcttgcagtgagccgagattgcaccactgcactccagcctgggcgacagaatgagactccgtctcaaaaaaaaaaaraaaagaaaaaaatctttacagtggattacataacaattccagtgaaatgaaattacttcaaacagttccttgagaatgttggagggatttgacatgtaat

SEQ ID NO: 49881 - DNA, 201 bp, Homo sapiens; identical to SEQ ID NO: 14434

SEQ ID NO: 49882 - DNA, 201 bp, Homo sapiens
cagggactcactctgtcacctgggctgcagtgcagtggtacaccatagctcactgcagcctcgaactcctgagctcaagtgatcctcccacctcatcctcmcaagtaattgggactacaggcgcaccccaccatgcccaccttatttatttatttatttatttatttatttattttcatagagatgagggttccctgtgtt

SEQ ID NO: 49883 - DNA, 201 bp, Homo sapiens
gggctgcagtgcagtggtacaccatagctcactgcagcctcgaactcctgagctcaagtgatcctcccacctcatcctcccaagtaattgggactacaggygcaccccaccatgcccaccttatttatttatttatttatttatttatttattttcatagagatgagggttccctgtgttgtccaggctggtcttgaactc

SEQ ID NO: 49884 - DNA, 201 bp, Homo sapiens
cgcctctactcccagaaggccgcggggggtggaccgcctaagagggcgtgcgctcccgacatgccccgcggcgcgccattaaccgccagatttgaatcgcsggacccgttggcagaggtggcggcggcggcatgggtgccccgacgttgccccctgcctggcagccctttctcaaggaccaccgcatctctacattcaaga

SEQ ID NO: 49885 - DNA, 201 bp, Homo sapiens
accatagctcactgcagcctcgaactcctgagctcaagtgatcctcccacctcatcctcccaagtaattgggactacaggcgcaccccaccatgcccaccttatttatttatttatttatttatttatttattttcatagagatgagggttccctgtgttgtccaggctggtcttgaactcctgagctcaagggatccttt

SEQ ID NO: 49886 - DNA, 201 bp, Homo sapiens
agaccccctatcccatggtttctcaggttgcttttcagcttgaaaattgtattcctttgtagagatcagcgtaaaataattctgtccttatatgtggcttyattttaatttgagacagagtgtcactcagtcgcccaggctggagtgtggtggtgcgatcttggctcactgcgacctccacctcccaggttcaagcgattc

SEQ ID NO: 49887 - DNA, 201 bp, Homo sapiens
atagctcactgcagcctcgaactcctgagctcaagtgatcctcccacctcatcctcccaagtaattgggactacaggcgcaccccaccatgcccaccttatttatttatttatttatttatttatttattttcatagagatgagggttccctgtgttgtccaggctggtcttgaactcctgagctcaagggatccttttgc

SEQ ID NO: 49888 - DNA, 201 bp, Homo sapiens; identical to SEQ ID NO: 14424

SEQ ID NO: 49889 - DNA, 201 bp, Homo sapiens
tagctcactgcagcctcgaactcctgagctcaagtgatcctcccacctcatcctcccaagtaattgggactacaggcgcaccccaccatgcccaccttatttatttatttatttatttatttatttattttcatagagatgagggttccctgtgttgtccaggctggtcttgaactcctgagctcaagggatccttttgcc

SEQ ID NO: 49890 - DNA, 201 bp, Homo sapiens; identical to SEQ ID NO: 14425

SEQ ID NO: 49891 - DNA, 201 bp, Homo sapiens
ggatgtgactgggaagctctggtttcagtgtcatgtgtctattctttatttccaggcaaaggaaaccaacaataagaagaaagaatttgaggaaactgcgragaaagtgcgccgtgccatcgagcagctggctgccatggattgaggcctctggccggagctgcctggtcccagagtggctgcaccacttccagggtttat

SEQ ID NO: 49892 - DNA, 201 bp, Homo sapiens; identical to SEQ ID NO: 14428

SEQ ID NO: 49893 - DNA, 201 bp, Homo sapiens
ccatcatgggcacaggggaggagcagagtggatgtggaggtgtgagctggaaaccaggtcccagagcgctgagaaagacagagggtttttgcccttgcaartagagcaactgaaatctgacaccatccagttccagaaagccctgaagtgctggtggacgctgcggggtgctccgctctagggttacagggatgaagatgc

SEQ ID NO: 49894 - DNA, 201 bp, Homo sapiens; identical to SEQ ID NO: 14455

SEQ ID NO: 49895 - DNA, 201 bp, Homo sapiens
aaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgggagc

SEQ ID NO: 49896 - DNA, 201 bp, Homo sapiens
tcatttgaccaaaatgccttggggtggacgtaagatgcctgatgcctttcatgttcaacagaatacatcagcagaccctgttgttgtgaactcccaggaaygtccaagtgctttttttgagattttttaaaaaacagtttaattgaaatataacctacacagcacaaaaattaccctttgaaagtgtgcacttcacacttt

SEQ ID NO: 49897 - DNA, 201 bp, Homo sapiens
cacgaggtcaggagatcgagaccatcctggctaacatggtgaaaccccgtctttactaaaaatacaaaaaattagctgggcgtggtggcgggcgcctgtartcccagctactcgggaggctgaggcaggagaatggcgtgaacctgggaggtggagcttgcagtgagccgagatcgcgccactgcactccagcctgggcga

SEQ ID NO: 49898 - DNA, 201 bp, Homo sapiens
ggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgggagcac

SEQ ID NO: 49899 - DNA, 201 bp, Homo sapiens
actagaaggagaggcgagttgtagacctgggtggcaggagtgttttgtttgttttctttggcagggtcttgctctgttgctcaggctggagtacagtggcrcaatcacagctcactatagcctcgacctcctggactcaagcaatcctcctgcctcagcctcccagtagctgggactacaggcgcatgccaccatgcctgg

SEQ ID NO: 49900 - DNA, 201 bp, Homo sapiens
gctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgggagcacc

SEQ ID NO: 49901 - DNA, 201 bp, Homo sapiens
gtttaactggacatgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacct

SEQ ID NO: 49902 - DNA, 201 bp, Homo sapiens
ctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgggagcaccc

SEQ ID NO: 49903 - DNA, 201 bp, Homo sapiens; identical to SEQ ID NO: 14431

SEQ ID NO: 49904 - DNA, 201 bp, Homo sapiens
aactggacatgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtat

SEQ ID NO: 49905 - DNA, 201 bp, Homo sapiens
tctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgggagcaccca

SEQ ID NO: 49906 - DNA, 201 bp, Homo sapiens
actagctggggtgcccagactagctggggtgcctagactagctgggtactttgagtggctccttcagcctggacctcggtttcctcacctgtatagtagakatatgggagcacccagcgcaggatcactgtgaacataaatcagttaatggaggaagcaggtagagtggtgctgggtgcataccaagcactccgtcagtgt

SEQ ID NO: 49907 - DNA, 201 bp, Homo sapiens
ctggacatgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatag

SEQ ID NO: 49908 - DNA, 201 bp, Homo sapiens; identical to SEQ ID NO: 14458

SEQ ID NO: 49909 - DNA, 201 bp, Homo sapiens; identical to SEQ ID NO: 14459

SEQ ID NO: 49910 - DNA, 201 bp, Homo sapiens; identical to SEQ ID NO: 14460

SEQ ID NO: 49911 - DNA, 201 bp, Homo sapiens
cagaagtagaggcctcagtccctgcaggagacctctcggtctctatctcctgatagtcagacccagccacactggaaagaggggagacattacagcctgcragaaaagtagggagatttaaaaactgcttggcttttattttgaactgttttttttgtttgtttgttttccccaattcagaatacagaatacttttatgga

SEQ ID NO: 49912 - DNA, 201 bp, Homo sapiens
agctcactgcagcctcgaactcctgagctcaagtgatcctcccacctcatcctcccaagtaattgggactacaggcgcaccccaccatgcccaccttatttatttatttatttatttatttatttattttcatagagatgagggttccctgtgttgtccaggctggtcttgaactcctgagctcaagggatccttttgcct

SEQ ID NO: 49913 - DNA, 201 bp, Homo sapiens
aaaattttttgattttttttttttttgagacagagccttgctctgtcgcccaggctggagtgcagtggcacgatctcagctcactacaagctccgcctccygggttcacgccattcttctgcctcagcctcctgagtagctgggactacaggtgcccaccaccacgcctggctaattttttttggtatttttattagagac

SEQ ID NO: 49914 - DNA, 201 bp, Homo sapiens
gtttcatcatgttggccaggctggtctcaaactcctgacctcaagtgatctgcctgcctcggcctcccaaagcgctgagattacaggtgtgatctactgcrccaggcctgggcgtcatatattcttatttgctaagtctggcagccccacacagaataagtactgggggattccatatccttgtagcaaagccctgggtgg

SEQ ID NO: 49915 - DNA, 201 bp, Homo sapiens
ctcaagtgatctgcccgccttggcatcccaaagtgctgggattacaggtgtgaaccaccacacctggcctcaatatagtggcttttaagtgctaaggactragattgtgttttgtcaggaagaggccagttgtgggtgaagcatgctgtgagagagcttgtcacctggttgaggttgtgggagctgcagcgtgggaactgg

SEQ ID NO: 49916 - DNA, 201 bp, Homo sapiens; identical to SEQ ID NO: 14436

SEQ ID NO: 49917 - DNA, 201 bp, Homo sapiens
tggacatgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagt

SEQ ID NO: 49918 - DNA, 201 bp, Homo sapiens
gacatgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtag

SEQ ID NO: 49919 - DNA, 201 bp, Homo sapiens
catgcccaccttatttatttatttatttatttatttatttattttcatagagatgagggttccctgtgttgtccaggctggtcttgaactcctgagctcamgggatccttttgcctgggcctcccaaagtgctgagattacaggcatgagccaccgtgcccagctaggaatcatttttaaagcccctaggatgtctgtgtg

SEQ ID NO: 49920 - DNA, 201 bp, Homo sapiens
catgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagag

SEQ ID NO: 49921 - DNA, 201 bp, Homo sapiens
taattttttttaagttaacctctgtcagcaaacaaatttaacccaataaaggtctttgttttttaatgtagtagaggagttagggtttataaaaaatatgrtagggaagggggtccctggatttgctaatgtgattgtcatttgccccttaggagagagctctgttagcagaatgaaaaaattggaagccagattcaggga

SEQ ID NO: 49922 - DNA, 201 bp, Homo sapiens
tgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagat

SEQ ID NO: 49923 - DNA, 201 bp, Homo sapiens
cctgtaatcccagctactcgggaggctgaggcaggagaatctcttgaacccgggaggcagaggttgcggtgagccaagatcgtgcctttgcacaccagccwaggcaacaagagcgaaagtccgtctcaaaaaaaaagtaattttttttaagttaacctctgtcagcaaacaaatttaacccaataaaggtctttgtttttt

SEQ ID NO: 49924 - DNA, 201 bp, Homo sapiens
gaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagata

SEQ ID NO: 49925 - DNA, 201 bp, Homo sapiens
tcatctcttcaaaaaatacacaaaaaattagccaggcatggtggcacgtgcctgtagtctcagctactcaggaggctgaggtgggaggatcactttgagcyttgcaggtcaaagctgcagtaagccatgatcttgccactgcattccagcctggatgacagagcgagaccctgtctctaaaaaaaaaaaaaccaaacggtg

SEQ ID NO: 49926 - DNA, 201 bp, Homo sapiens; identical to SEQ ID NO: 14430

SEQ ID NO: 49927 - DNA, 201 bp, Homo sapiens
aagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatat

SEQ ID NO: 49928 - DNA, 201 bp, Homo sapiens
aggccaaggcaggaggattcattgagcccaggagttttgaggcgagcctgggcaatgtggccagacctcatctcttcaaaaaatacacaaaaaattagccrggcatggtggcacgtgcctgtagtctcagctactcaggaggctgaggtgggaggatcactttgagccttgcaggtcaaagctgcagtaagccatgatctt

SEQ ID NO: 49929 - DNA, 201 bp, Homo sapiens
gaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgg

SEQ ID NO: 49930 - DNA, 201 bp, Homo sapiens
aggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatggg

SEQ ID NO: 49931 - DNA, 201 bp, Homo sapiens
ggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatggga

SEQ ID NO: 49932 - DNA, 201 bp, Homo sapiens
gaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgggag

SEQ ID NO: 49933 - DNA, 201 bp, Homo sapiens
tcactccattcgcctgcctcagcctcccaagtagctgggactacaggcgctgggattacaaacccaaacccaaagtgctgggattacaggcgtgagccacygcacccggcctgttttgtctttcaatagcaagagttgtgtttgcttcgcccctacctttagtggaaaaatgtataaaatggagatattgacctccacatt

SEQ ID NO: 49934 - DNA, 201 bp, Homo sapiens
gggcgatgcattgggcgctgattcttgttcctgctgctgcctcggtgcttagcttttgaaacaatgaaataaattagaaccagtgtgaaaatcgatcaggraataaatttaatgtggaaataaactgaacaacttagttcttcataagagtttacttggtaaatacttgtgatgaggacaaaacgaagcactagaaggaga

SEQ ID NO: 49935 - DNA, 201 bp, Homo sapiens
gagactccgtctcaaaaaaaaaaaaaaaagtaggctttcatgatgtgtgagctgaaggcgcagtaggcagaagtagaggcctcagtccctgcaggagaccyctcggtctctatctcctgatagtcagacccagccacactggaaagaggggagacattacagcctgcaagaaaagtagggagatttaaaaactgcttggct

SEQ ID NO: 49936 - DNA, 201 bp, Homo sapiens
gctatggtggttccaaactctatttcttttaaaccagtgacaccatgaacattatttatataaattgaaggcaatggagacagaccaaaagtaaacagaamgtagaaaaaaattaaaagtcaaaacctagaaaatgaatggccctaggtgagtttgggtgagtttcttgtttttacaggattttgtctgaggaccaaataa

SEQ ID NO: 49937 - DNA, 201 bp, Homo sapiens
tcaatatacacaaaatagaacctccctaaagcataaatctcacaggacctatataacaataacacaatgaaaaaaaaaaacaaggtatttaggaaaaaaamtagcacgatgaatagaatggtacctcatatctcaatactaacattgaatgtaaatgacctaaatgctccacttaaaagatgcagaatgacagaatggata

SEQ ID NO: 49938 - DNA, 201 bp, Homo sapiens
tagctcacaaaattggtgctggagctgatcagctgcgaagtaataagaaaataattcattttgtgtttttaatgatattattggattaatcatgaaaaacractttttggtttttttcaaatttatttattttaaattgacataaaatcatatgtatttatcatgtacatgatgttttgaagtatatatgcattgtgaaat

SEQ ID NO: 49939 - DNA, 201 bp, Homo sapiens
catatcaccatgccaaacttacaaaaattcagtatctttaaaataccaagactatttagaacaaatacatgatgtggtgttcataaaaacaatattggatkaagagtcacaagagtcatttccttaactcggttctatcttcaacactttaaattctctggtccttagcttctttagttacaggatgagtgactgcaataa

SEQ ID NO: 49940 - DNA, 201 bp, Homo sapiens
tggggtcctatttttagcctcctaaacaaaacaattatcagccaagaattttgtatccagtgaaactaagcttcataaatgaaggaaagatacagttgttyccagacaaacaaatgctaagagaatttgccactaccaagccagcactacaaaaactgctaaaaggagctctaaatcctgaaacaaatcctcaatatacac

SEQ ID NO: 49941 - DNA, 201 bp, Homo sapiens
ttcaagtgatactcctgcctcagcctcccaagtagctgggattgcagatgcccgccaccacgcccagccaatttttgtattttcagtagagacggggtttycccatgttggccaggctggtctcgaattcctgaccttaggtgatccacccacctcagcctcccacagtgccgggattacaggtgtgaaccgccacaccca

SEQ ID NO: 49942 - DNA, 201 bp, Homo sapiens
aaacctgaatacttaaccaggtgtccctagggcaagtttgcatcttctctataggattgcagctgatgcgcttctttttttttttttttttttcttaaacrgagttttgctcttgttgcccaggctggagtgcaattgtgcaatctcagctcattgcaacctcttcttcctgggttcaagtgatactcctgcctcagcctc

SEQ ID NO: 49943 - DNA, 201 bp, Homo sapiens
aataagtctttactgataaaaacagtgcagaattggatttatcacagatctcattattcaatggtacttaatagctgagaacttaatagttttaagtctgrtgtcacttctctggacaaaataatcttaaattcttataatctttcaacttaagtcctttttttataagctttgttttatttccttactttacttttgatc

SEQ ID NO: 49944 - DNA, 201 bp, Homo sapiens
gaaacctgtgtctcctttctccagtttcccagttgggtggcattggggaagttgcttaaaccctcttctgtcctaatctatgcaatgggaataatagcacytatcttgtaggatagctgtgaaagttaaatgaattaatacacataaagttcattaaacagtgtggttgtcagtagtaagctcttaagaggtgttagtatt

SEQ ID NO: 49945 - DNA, 201 bp, Homo sapiens
gacctcctaatttattactaaaattatatcagtaaatgaaatcgtccaattctctggtatatttaagaattgtcaacacagaaacagatttaaaaatctcwtattgaaattagattatctgtcacgacggccatactgggaaaggagctttgtgataaaggcctgtgggttcttcatcacagttttaacaaatcacaattt

SEQ ID NO: 49946 - DNA, 201 bp, Homo sapiens
tgacaaccttcatcgacatgcatcttgaagttatttgtcatttcaagaaagcatttaaaattttgttctctctctctttctctcttcttcctttttttttycccccaaaggccttggatggtatactgtaaattcagcatatggagataccattatcataccttgccgacttgacgtacctcagaatctcatgtttggcaa

SEQ ID NO: 49947 - DNA, 201 bp, Homo sapiens; identical to SEQ ID NO: 14509

SEQ ID NO: 49948 - DNA, 201 bp, Homo sapiens
attttgtgtatttttagtagagactgggtttcaccatgttggccaggctggtctggaactcctggcctcaggtgatctacatgccgcggcctcccaaagtkctgggattacaggcatgagccactgcaccgagcccaatgtgacttcttatatagccagtttacagtcagaggatgcactagctggaagagaagcattgta

SEQ ID NO: 49949 - DNA, 201 bp, Homo sapiens
ttcttccttgactatcagctcaagatttatgaagtgtcatggtataagtaattttcttagctgtccacaattttgacttgaattaaaataccaaagacaakatagtaagaatgctaaaattttaccctttaaaaatcacaagtttgcatgttaattactgtagtgagctttagtcatttttaatacaaagtaatagctaga

SEQ ID NO: 49950 - DNA, 201 bp, Homo sapiens
tgccgaaattctcattgcagtatcagtgtgttttgaaaggaaaggttacagcactaaaggcgccgtgtctacactgaggaagcaagtcttggacagtaagkgcgccttcttcggagccctctgcatagcagagcccggtgggggcgcggtgccaaaggccggcttcatttgagcggggtaactgccttccctgccggccac

SEQ ID NO: 49951 - DNA, 201 bp, Homo sapiens
ttgaaggactaaagaaaagagagtcattgactctcattgtagaaggtaataaaatacttgggcactaattcaaattgttctttgagaattttttacctggyttcttttatgatctcagttcaacatcttattttaattgtaatatttcaggcaaacctcaaataaaaatgacaaagaaaactgatcccagtggactatcta

SEQ ID NO: 49952 - DNA, 201 bp, Homo sapiens
ttccaaagccagccattcaatggacaattactggcagtggaagcgtcataaaccaagcaagtatttgtcttcttgttatatgctgcacttcgtccaatgcrttttttttccttcacgaacctaccctataggttggtttgttaccacataaaatttgcagtgtgtaggttggtttgttaccacatagaatttgcagtacat

SEQ ID NO: 49953 - DNA, 201 bp, Homo sapiens
tacatagagaagaataatgacatttgtcttgagtttggtatccttgacaccaccatgttttgtctgttagcctgccaaatgtgtgtgtgtgtgtgtgtgtgtgttttaatcatctttctctttattagtataatataattttacctgccttgatatcatgtaggcataaggtattagtcttgttccatttgtaaagattcc

SEQ ID NO: 49954 - DNA, 201 bp, Homo sapiens; identical to SEQ ID NO: 14512

SEQ ID NO: 49955 - DNA, 201 bp, Homo sapiens
tgactacagttaagcaaatcaacatatcactctcctcacatagttatcattttttgtgtgtgatgagagtacctgaaatccactctcttagaaaatttctrctatacagtacactattattaaccacagtcatcatgctgtactttacatttctagttgtgtgtcctatacagttgtaactttgtagcctttgaccaacat

SEQ ID NO: 49956 - DNA, 201 bp, Homo sapiens
tgtccttaaacccaagtggagaagtgactagacagattggtgatgccctacccgtgtcatgcacaatatctgctagcaggaatgcaactgtggtatggatkaaagtaagtaatatttttggtactaccctgctgtttggtttgatttctttttaggtttcttatgcactttatattgtattcaagtaggtatattcatgga

SEQ ID NO: 49957 - DNA, 201 bp, Homo sapiens
ctttcatcttttcttctccaaaatattttgactatcttacatttcagagttagcactttgaacagattttctgcttcacagatttggatttgtccttaaayccaagtggagaagtgactagacagattggtgatgccctacccgtgtcatgcacaatatctgctagcaggaatgcaactgtggtatggatgaaagtaagta

SEQ ID NO: 49958 - DNA, 201 bp, Homo sapiens
ttctcattgtagcgaccaagtataatcatctgacattttgcctctatcaaaagggacagcccgaaggaataagaagctcaaatacttacacactaacggaygtgaggcgcaatgcaacaggagactacaagtgttccctgatagacaaaaaaagcatgattgcttcaacagccatcacagttcactgtaagtcacctactt

SEQ ID NO: 49959 - DNA, 201 bp, Homo sapiens
aatttaaattcttaaaagctttgaagttaattctgtattaagaaacaactgagaggttgagtatggcactatttcttcctgaatctgagatcaagcagatktgcctctttcaatcagtttttactaccatgagatttaaagcaaagaaaaaaaaaacagttaatgacagttcaaattcacttagtagagtaacgtgttcta

SEQ ID NO: 49960 - DNA, 201 bp, Homo sapiens
aagtatttcagtcttttccatgtggtttgtttgtttggtttccaattaattacttcctgggggaagcattgggagttgtttcagttatagattcataacaraatgagattcataaactaaatacatgatataatctgaagccctgctaggactcttacagctcgtctttataacctagtattcctttaatgagtaggaaca

SEQ ID NO: 49961 - DNA, 201 bp, Homo sapiens
agcagcttgtactgatgagaaaggggagaggaatgagtggacctctcttcagagcggaaagaaagataagatgaaaagccagcatgaaaaggaacttgctrtttaaaattacaacaaactgtttatgtggaccagtagcatcatgatgtaaaataaattttctttactgctttgccatgacgcttaattgataatacattc

SEQ ID NO: 49962 - DNA, 201 bp, Homo sapiens
ctttctagttcatagaggtgccttcttgctgtaacttcacatgatggcaggaggcaagagagctctccaaagtcccttttaggagggcactaatctcattygtaagggctccacctttacaatttaatcatgtgatggtcatatcatctatttcagggggacacaaacattcagtatatagcagtgactactactcccttc

SEQ ID NO: 49963 - DNA, 201 bp, Homo sapiens
tacatatattacatatatacatgtatacatgtgtacgtataacatatatatacatatttatatatacatatacacatatataatatatacatatattatatatatacacatatatgtaatatatatgctattataacaaaataccataaacggggtggctttaaaaaaaaacaaaacaaatttattttccacagttctgga

SEQ ID NO: 49964 - DNA, 201 bp, Homo sapiens
atacatatattacatatatacatgtatacatgtgtacgtataacatatatatacatatttatatatacatatacacatatataatatatacatatattatatatatacacatatatgtaatatatatgctattataacaaaataccataaacggggtggctttaaaaaaaaacaaaacaaatttattttccacagttctgg

SEQ ID NO: 49965 - DNA, 201 bp, Homo sapiens
tatacatatattacatatatacatgtatacatgtgtacgtataacatatatatacatatttatatatacatatacacatatataatatatacatatattatatatatacacatatatgtaatatatatgctattataacaaaataccataaacggggtggctttaaaaaaaaacaaaacaaatttattttccacagttctg

SEQ ID NO: 49966 - DNA, 201 bp, Homo sapiens
gaaatctttgcttatcccaaaatggcaaaggtattttcctatgttatctcctagaaacttctaaactttgacattgaagggtatgatctatctaaaatttygtgtctagtgtgagataaaggtgggattttgtttggtttttgggtttgctgtatctatttatcaagccattccagcacttgttaaaaggacttcctttca

SEQ ID NO: 49967 - DNA, 201 bp, Homo sapiens
atatacatatattacatatatacatgtatacatgtgtacgtataacatatatatacatatttatatatacatatacacatatataatatatacatatattatatatatacacatatatgtaatatatatgctattataacaaaataccataaacggggtggctttaaaaaaaaacaaaacaaatttattttccacagttct

SEQ ID NO: 49968 - DNA, 201 bp, Homo sapiens
tatatacatatattacatatatacatgtatacatgtgtacgtataacatatatatacatatttatatatacatatacacatatataatatatacatatattatatatatacacatatatgtaatatatatgctattataacaaaataccataaacggggtggctttaaaaaaaaacaaaacaaatttattttccacagttc

SEQ ID NO: 49969 - DNA, 201 bp, Homo sapiens
ataaccatcataatttatattttataaattgtaaaataaatgtatatatattatatatacatgtatacttatataatatatacatatattacatatatacwtgtatacatgtgtacgtataacatatatatacatatttatatatacatatacacatatataatatatacatatattatatatatacacatatatgtaata

SEQ ID NO: 49970 - DNA, 201 bp, Homo sapiens
gttttagcaataatacctgctgaatatctttctttgttaacttatattattcctacatcatctatatttttcctagtcttaatttcttaatttctttttttcttttgtcattttctttttttcttctcctctctctcttcctttcccctttctttctttctcattcttctcatttcatcctttcttcctttttactttcct

SEQ ID NO: 49971 - DNA, 201 bp, Homo sapiens
aaccagtaaaatatatatctaatttaaaatggtttcttttaaattataataaaacatatacatgtaggcacatcttattaaacaatggacaaatgtagaastaaatttcatttccacttaaaaaggcacaggcaggtttcaaatggttctgcatataaacttgctgacatgaataattttaaatcaggccagttatagctt

SEQ ID NO: 49972 - DNA, 201 bp, Homo sapiens
gtttagctcatgtctcctctttttatttcatatgaagtattatcatgcaatatgagtacagtggcatctaatagctttagctatttgctagctgatttttrtccttccaaactataagattcatataatatataattaaatttccctatcataaagccatgcagtttgattgttcctatggtcttttatacataaaataat

SEQ ID NO: 49973 - DNA, 201 bp, Homo sapiens
atagtaaagccagcatacgaccccaggactgctttggttggataaagatgatgtccttaaaattattagaaaacgtatatctcaaaacaatttaagagtttcttgttttcatttcctctaccgtagaatgaaactaatttttctttactaactgcatgctgaaaagaagggtcaatgaggaaatctctgtgagacatatgg

SEQ ID NO: 49974 - DNA, 201 bp, Homo sapiens
atagcagaggtaccagtgtaaatacacatttttatgctgcctttaggcataattcaatatattttattgtactaaatggaagctacattctctgaacactrtcctgacatagagaaaaaaaatatattcctgttaaaaatataaaattgatctggatattctttgttacatattacttgaacctgttcatctctatcacca

SEQ ID NO: 49975 - DNA, 201 bp, Homo sapiens
agaaggggataacatcactcttaaatgcttagggaatggcaaccctcccccagaggaatttttgttttacttaccagtaagtgcttaagtattacttcagytggatgactatcatttttcctgttgtttgacttctacatggatagattaagtgagaaaaaatgttattgctggagacaagagacgccacctataaaatgt

SEQ ID NO: 49976 - DNA, 201 bp, Homo sapiens
ttttgtttggtaggctatttattgctgcctcaatttcagaacttactattggtctattcagggattccacttcttcctggtttagtcttggggtggtgtaygtatccaagaatttttccttttcttctagattttctagtttatttgcataacggtgtttattgtattctctgatcgttgtttgtatttctgtgggttcag

SEQ ID NO: 49977 - DNA, 201 bp, Homo sapiens
ttacattgtatgcacagagtaattcggtacttgacaaaaatggttaacttgtgtctgtaactcttacagatcctacagagcaggtgacaatacaagtgctrccaccaaaaaatgccatcaaagaaggggataacatcactcttaaatgcttagggaatggcaaccctcccccagaggaatttttgttttacttaccagtaa

SEQ ID NO: 49978 - DNA, 201 bp, Homo sapiens
attagtacttgtatagcaagtagctattagcttcaatccttctataaaaaggtatatttaagcaattaccattactagcttcttgagaaaattatgtatartttagtcatttacattgtatgcacagagtaattcggtacttgacaaaaatggttaacttgtgtctgtaactcttacagatcctacagagcaggtgacaat

SEQ ID NO: 49979 - DNA, 201 bp, Homo sapiens
ttctgctcaaaatcaatgcatctcaaatttaatgtggatacaaatcatgtgcaaatattatcaaaattcggattcagtaggtcttagagggtgcggtgccragatttttatttctaacaagctccaattttatatcaataagtaccactttgctttcatatccaagtatatattatattccaatggcttacagtgaaaaaa

SEQ ID NO: 49980 - DNA, 201 bp, Homo sapiens
ttttttctgtagaaaaattcaaataaaatcatctgaaataagtcccctttttcttaaaacatttgaaaataatgtatgaaatgtaattaaacataaacttsaatgttcatatctcaagttctaaatacaatcctggaagaagcagtttctattacacttcccatagaaaactgcttatgtttgaggtagcattttgttttg

SEQ ID NO: 49981 - DNA, 201 bp, Homo sapiens
aagaatatgtcaggaaaatattaacaaaaagaaagcaggtctacaaaacaaaacagactttgagggaaaataaaagcattaaaaaagataaagagagtcamtaaataatgctaagaggttcaatttgttaggaacataacaattgaaaactttatttactgaatagtacagcttcaaaatatataaacaaaactggtttga

SEQ ID NO: 49982 - DNA, 201 bp, Homo sapiens
attattttagtcatataaatcagttctgaatgttcaaatgcagttagaagaaatttattttctttcatcttttcttctccaaaatattttgactatcttayatttcagagttagcactttgaacagattttctgcttcacagatttggatttgtccttaaacccaagtggagaagtgactagacagattggtgatgcccta

SEQ ID NO: 49983 - DNA, 201 bp, Homo sapiens
aatatataaacaaaactggtttgatctatgaagaggcattaataaatccttcactattttaatacagctttcttggttattggcagatcaagtataaaacmatattggcaaggatatttgagatttgaacagcataatttaaaagcttttaggacactgcgttggtttgccaccttccccaagtcccaaattcaccccata

SEQ ID NO: 49984 - DNA, 201 bp, Homo sapiens
tttcggaagaatggaaacttaccagtttcccccactccctcctcaaaataatcattatcttctgaataataaaaaccaactatgagatgttaacattcaaytatcattttatattttaatgcaaaaactttaagtgcaaagaagctttattttttgaattggtgtttgggttcagtaagaacagattctaataccttagat

SEQ ID NO: 49985 - DNA, 201 bp, Homo sapiens
caagtcaaggaaactaaagagatgtctcacatctcagtgtttccttggggcagatggatggagaaatgagctaagagcttgaagggaaaagctggatttcwttgcattttttgagctaaagaaagggatactttctaggatgtcaattagaagcctgaaagaaccatgccttaggaataggagcaagccaaaggtagacca

SEQ ID NO: 49986 - DNA, 201 bp, Homo sapiens
acacagaggtacttcagagcttttatttggattcctcccacttggatactgttctgactgctttatcaaaattaagtgtctttgctttcaccctcctcctraaagtcattcaacctaaaagtaaaattttggggggcattgaggggggaagaagcagaaaatgttctgtttaacaatgagatctacaccagatatttcatt

SEQ ID NO: 49987 - DNA, 201 bp, Homo sapiens
cagtttttccttgtgaatactccacggacatttgaaaaaaaaaaacttgttgggggcttatgggtgtagtgttgtataattgtcatttaggattaggttarggtgaatcatagtttgtttaaatattcttacccttacttacttcttttaaattatacaaaatcacttcacatgtaatgtaagaaggtaacaagcatacac

SEQ ID NO: 49988 - DNA, 201 bp, Homo sapiens
aatcatgttagtctttgtgtagtcccacatttctataaaatatggtggaaattatttctatgaaatacagtaaagaagataattcatctgcagattccackatgttcctttggaatacaccacttacctgttctctagtaaaattggagatctgcaaattttgattgtgtgatagtcaaggattcaaacattcagtagcta

SEQ ID NO: 49989 - DNA, 201 bp, Homo sapiens
gaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagt

SEQ ID NO: 49990 - DNA, 201 bp, Homo sapiens
atgacaaccttcatcgacatgcatcttgaagttatttgtcatttcaagaaagcatttaaaattttgttctctctctctttctctcttcttccttttttttttcccccaaaggccttggatggtatactgtaaattcagcatatggagataccattatcataccttgccgacttgacgtacctcagaatctcatgtttggca

SEQ ID NO: 49991 - DNA, 201 bp, Homo sapiens
ttctagttgtgtgtcctatacagttgtaactttgtagcctttgaccaacatctccccacttctgacatcttcccacccctggtaatcaccatccactctctgtttctgtgtatttgccttttctagattccacatataagtatgattatgtagcatttgtctttctttggcttatttcaattagcataatgttctccaggt

SEQ ID NO: 49992 - DNA, 201 bp, Homo sapiens
tctggcatttagccttaaaaatgtgttgatgctataggtcttttttatatttaacggtgttgattttttcccatatttcttgcagatagtaaaatcaaatyttctcaggtatgaaggtacaagtgggtctgaaaatggagggtagagatcctggtagggagatgtggaatggctatgtaactttgagtaataaaatgtctc

SEQ ID NO: 49993 - DNA, 201 bp, Homo sapiens
tttctagttgtgtgtcctatacagttgtaactttgtagcctttgaccaacatctccccacttctgacatcttcccacccctggtaatcaccatccactctctgtttctgtgtatttgccttttctagattccacatataagtatgattatgtagcatttgtctttctttggcttatttcaattagcataatgttctccagg

SEQ ID NO: 49994 - DNA, 201 bp, Homo sapiens
tgtttaagctattatttaaggctttcaaagtatcaccccattgcttctttcccaggtgcctttccttccatcacctcctacagcccctaaacctcagccayactggctgaacatgattatacccttgctccagcctttctcttgcaaggagtttccttcatccttctttccacttgaagaaattcttatctgtgatgattc

SEQ ID NO: 49995 - DNA, 201 bp, Homo sapiens
tgtttctgtttctgtagttctggtatagggcccgagaatttgcatttcttgcaagttcacaggggatgctgatactgctggtctggggaccataatttgasaaccagccacgttaaagttgctatagcttctgttgtcgatgttctatcataaacttggtctcaataatctggttgttgttgtattcagtaaaacagaata

SEQ ID NO: 49996 - DNA, 201 bp, Homo sapiens
atagagaagaataatgacatttgtcttgagtttggtatccttgacaccaccatgttttgtctgttagcctgccaaatgtgtgtgtgtgtgtgtgtgtgtgttttaatcatctttctctttattagtataatataattttacctgccttgatatcatgtaggcataaggtattagtcttgttccatttgtaaagattccagg

SEQ ID NO: 49997 - DNA, 201 bp, Homo sapiens
gtgtgaacctgggaggcggagcttgcagtgagccaagatcacaccactgcactcaagcctgggcgacagagcgagactctgcctcaaaaaaaaaaaaaaargggggaaattggactatcctttgtgaagcacccaccatgttccaggttactgatatcgtacattcattatcgacttaatgctgaaagataagtgtgattg

SEQ ID NO: 49998 - DNA, 201 bp, Homo sapiens
catagagaagaataatgacatttgtcttgagtttggtatccttgacaccaccatgttttgtctgttagcctgccaaatgtgtgtgtgtgtgtgtgtgtgtgttttaatcatctttctctttattagtataatataattttacctgccttgatatcatgtaggcataaggtattagtcttgttccatttgtaaagattccag

SEQ ID NO: 49999 - DNA, 201 bp, Homo sapiens
acatagagaagaataatgacatttgtcttgagtttggtatccttgacaccaccatgttttgtctgttagcctgccaaatgtgtgtgtgtgtgtgtgtgtgtgttttaatcatctttctctttattagtataatataattttacctgccttgatatcatgtaggcataaggtattagtcttgttccatttgtaaagattcca

SEQ ID NO: 50000 - DNA, 201 bp, Homo sapiens
aatgattctacaactgtatgttcttattaaactctgggttcagcataaaatagtatcttactgatttatcttcagtgctattgtatggtctgcttggctgmaggttgtataagatgacaaagcattgatttagtgaattttttcacagttttgtgaacaaaaagcttgcatatttaataagtaagttattcaaatcttgaa

SEQ ID NO: 50001 - DNA, 201 bp, Homo sapiens
tcttcctactctttcatttctactattttctttctttcttacaaataaaccttccttatcaaatcccattttctgtgctttatttgagcaattgatacatyctactttctttagatatcattttcctttgcctccagatacaactgcatctatggggtctctgatttttatagcttgttagaagaagatgctgtattatat

SEQ ID NO: 50002 - DNA, 201 bp, Homo sapiens
agaatttaaattcttaaaagctttgaagttaattctgtattaagaaacaactgagaggttgagtatggcactatttcttcctgaatctgagatcaagcagwtgtgcctctttcaatcagtttttactaccatgagatttaaagcaaagaaaaaaaaaacagttaatgacagttcaaattcacttagtagagtaacgtgttc

SEQ ID NO: 50003 - DNA, 201 bp, Homo sapiens
cagaacaaaggcattgaagaggtaactcttttggttttaggaatattaaaatgcaatcttcaccagctgtccatttttaaattagatttcagtttttcacrtggggtactgtgtgtgttggttagcattggagtaagaatttaaattcttaaaagctttgaagttaattctgtattaagaaacaactgagaggttgagtat

SEQ ID NO: 50004 - DNA, 201 bp, Homo sapiens
ccttctggctggaggccaacaaacacaaaatcagtgcactaaataaaaacacaaccagggacccttatggtgtccacttcactcccctgataccttcaccrgagcaggctgcgagacctgaaaacggatcacatcacaagactcattgcagacactccccagtaccagcctaagctggtagctccactgggttgccagacc

SEQ ID NO: 50005 - DNA, 201 bp, Homo sapiens
ggagtgcaattgtgcaatctcagctcattgcaacctcttcttcctgggttcaagtgatactcctgcctcagcctcccaagtagctgggattgcagatgccygccaccacgcccagccaatttttgtattttcagtagagacggggtttccccatgttggccaggctggtctcgaattcctgaccttaggtgatccacccac

SEQ ID NO: 50006 - DNA, 201 bp, Homo sapiens
gccatgcacatgttggctttcaacagagtgcatttgaatatattcagatctgtggtgggtgctgaagacttgtctatataggttcagttccataactgaamcagtgagaatctagaaaaccagtgttttcaaaactactccctcatgggtgaatggagcacatactattgaatgatctgctctaaacttaggcattggtgg

SEQ ID NO: 50007 - DNA, 201 bp, Homo sapiens
gagataataagttcaaaatataaacaggtaaggtagaaatggtacacacgaataacaaacataaaagtacagatggaactgtgttaggaggcaggactcawctctggaggtggagctcagataccagacaaaattgaggactaagacaaggactgggcggaagtagctttcctgaagacatgctcactagtgtgccatgtc

SEQ ID NO: 50008 - DNA, 201 bp, Homo sapiens
cttcaagttaatgggcttcatcaaacctgggaaattttctcattgtttctttaaatatagttttgcctcattctctttctcttctgtttgacttcaaatayatgtatgtcagcatatgttagcctgctcactatcatctcacaggccactgaagatctgctcactttttttttttccactgccctggactccaccatctcc

SEQ ID NO: 50009 - DNA, 201 bp, Homo sapiens
aattattgagaaagtgatatcgaatcattcaataaagattgtacatttatttatttctcccttcagttctgtcagtttttactttatacttttattaggtrcatatacttacaattgttataacttccttatatatgaaacctttgtaattacaaaatatctctcattatctctgataattatcaattatatgtaagacca

SEQ ID NO: 50010 - DNA, 201 bp, Homo sapiens
acactgttcccggaccaaactgagggttgggctgttatttctcacagccccataatgagatgcagataaactggggaggaagagagtttttatttctgtamccggttacagggagaagacctggaaattatcactagaccaattcaaaattataaagttttccagagcttatatactttctaggctatatgtctatgtgta

SEQ ID NO: 50011 - DNA, 201 bp, Homo sapiens
ctactctatatgccatatatttcttttgcttgcttttttggcactcataggcacctccaatacacggctgaatagaaatgttcagaatggacacctttgcrtgtttccagtcttagaggggaaattgctcaatagttaccattatgtacgatgttagctgtatgtccctacccagagttagtcaaactgcagagttaaggg

SEQ ID NO: 50012 - DNA, 201 bp, Homo sapiens
agaccaaaagtaaacagaaagtagaaaaaaattaaaagtcaaaacctagaaaatgaatggccctaggtgagtttgggtgagtttcttgtttttacaggatkttgtctgaggaccaaataaataactaaatgtttgtacaaaatgtactatatatacatatttattccacaatttgtagcttagaatttgtatctgtaggga

SEQ ID NO: 50013 - DNA, 201 bp, Homo sapiens
gttagtagttatattcgttgttttgtggattcctatgtaaacaatgattgcatctgcaaatggagataattttactccttcccttctactctatatgccayatatttcttttgcttgcttttttggcactcataggcacctccaatacacggctgaatagaaatgttcagaatggacacctttgcatgtttccagtcttag

SEQ ID NO: 50014 - DNA, 201 bp, Homo sapiens
ccttacactcaacttcaactgccaaaaaggaatgagactgaggaaaggagaaagaaaacaataggaaagccatttattcttatacatgtaggtcaacttaytggtttatcgtcatttaatttgaatgtcacttggaagattttatagtgtggaacagatcgaagttgaaagtgtggggaataaaattttttattgttcagt

SEQ ID NO: 50015 - DNA, 201 bp, Homo sapiens
attctcatcttaccttatacaaaaatcaactcaagatggatcaaagacttaaatctaagacctgaatctatacagattctacaaggtaacataagaaaaayctctctagacattgagttaggcaaagacatcaagaccaagaatccaaaagcaaatgcaacaaaaacaaaggtaaatagttggtacttaattaaactaaaa

SEQ ID NO: 50016 - DNA, 201 bp, Homo sapiens
atagccaggtcagcaaaaaaagaaaataaacaaaggcatgatttttccatttgataaatattcagttgaatgatttagagaaacttagccaagaagactcrgaagcaaaatttggcttaaatcattgcccttgactaaattactttaatgatgcaagtaaatttgtagcattgcttttcccttcaattctatacttggtta

SEQ ID NO: 50017 - DNA, 201 bp, Homo sapiens
agctgtgatgctgagtgcatgcaggtggcttcctgttttcatgcacattcagtacagttgtgttttttctgatccctcagccttttacctaatggttgtcrtattcactattgacctagatggaaaagccattttctgttttcactgaggacacacgcattccctatttctttgtagagtcttagaaattctaaagacata

SEQ ID NO: 50018 - DNA, 201 bp, Homo sapiens
ttccaaataagattcagtgtttcatcaataaatcagagttccaattatgaacattaataacattctattaaaatagtgataatgtcaaggtttactcttaygtgaaaggctttaacccccacacaatatgtttcccagaaactggtgtctattttgagaagcttttttttcttggtcaactttttatcattttatggtcac

SEQ ID NO: 50019 - DNA, 201 bp, Homo sapiens
acatatatgtctagcttactttaattaccttacttcaaaaagtcttgatgttacaagaaaatacctgctttttaacatccaactcccttctaccagcatgwtcttacttcctccttctccagcctgtatcccatggtcttttattatagttagatccttacaaactataactctcttgtcctttttatcttccacttttct

SEQ ID NO: 50020 - DNA, 201 bp, Homo sapiens
ttttagcaacatttagctaagttctttgcattgataattttaaaagtcattggagaaagataagagaaacaatcttttatttctagtaaaatttaagagtrcatttgctaatatacctagtggctatttagccagcattcactccttattccactaatagaagctaaatatttttattataattttcaaaaatggaaaact

SEQ ID NO: 50021 - DNA, 201 bp, Homo sapiens
aagacattgtttttataccagagagcatgtattcagtctttggtcagtgttggaaaataaacgggtcaagaaacccttggaataactctgcattgcctgastttctggagtttccaaattgacagcccctgattgaaccaaggtaataacattgcctttttattttgcagttgggtgactgcatttcagaagacagttatc

SEQ ID NO: 50022 - DNA, 201 bp, Homo sapiens
atgtcaattttctctcctgctgaatacagttagaaggaaaaaaaacacttctcaaaggtgtggtgctgtttcgttaaggattgtgattgtcagatgaaagmccctatcatcagtgttctttattttcttcagcggtggtcataatttttaaaaaggaaatggacccagtgactcagctctataccatgacttccaccctgg

SEQ ID NO: 50023 - DNA, 201 bp, Homo sapiens
tgtgtgtgtgtgcatgcgtgtgtgtgtgtgtggtggaacgtacagaaaagagacgaaaaagagcaatgaagaagtgtaataaaattagtcctcaaatatgkaaagaattaaatggacgtttccatctcttctttcaccctattacctcattctaactattcttagcaggtaaagaaaaaacgtctttactctatttttgaa

SEQ ID NO: 50024 - DNA, 201 bp, Homo sapiens
ggtgattttttattaatagaagagttccatcctgaagaaattacttctcattctgcttggtgcattggtgcagttagatattctgatagtccaattgaggkgtgtgtgtgtgtgtgtgtgtgtgtgtgcatgcgtgtgtgtgtgtgtggtggaacgtacagaaaagagacgaaaaagagcaatgaagaagtgtaataaaat

SEQ ID NO: 50025 - DNA, 201 bp, Homo sapiens
atgatgcacaaagtgttgtatagtctgttttcaaaataattgatttttttttctcttagcatacatttactggaaccccatcaccaagctaatttcagtasaatgtgctccattatcagtcaaggctcacagatatggaaatttttgcctagcggtttgctgtaaaacatttgcttttcaaagacacattaattcaaatct

SEQ ID NO: 50026 - DNA, 201 bp, Homo sapiens
gttgtgggatctacaaaaggatgtctttgtcttattgaaatattcacatattagtaaatatttgtatgtatacctccctacttaaaaaataaagtggaaayataccatatacatcattttgtacctttcctttttcatttaacagtacattttggagattaaaaaattgtctcatagcagcacctatagctctacctcatt

SEQ ID NO: 50027 - DNA, 201 bp, Homo sapiens; identical to SEQ ID NO: 14508

SEQ ID NO: 50028 - DNA, 201 bp, Homo sapiens
tacattttggagattaaaaaattgtctcatagcagcacctatagctctacctcatttttaaaaagtgtgcattggattttactgtactatcatcattaatktaaccatttcacaagttcctggaagtttaggttgtttccaatctttcgttattacaaactagagcagtgaacatcctaatcatgttattgtccatataag

SEQ ID NO: 50029 - DNA, 201 bp, Homo sapiens
actggatgaattacttttgttacatatactttttatatataattttagttatatatatatatttatttatataaactgggaaatcaaatcaagaatatctrtgatccggatatctgtgatattccctttcaccagctacatctaaatggcatgctgccatacccaggattttaaagaaaaaaatgtttaaatctcaataat

SEQ ID NO: 50030 - DNA, 201 bp, Homo sapiens
agtaaaacattccaatataaaaaccttcaggggcacatggtgatccattaataaaacagaaattcaaatgaaaactttagtttaacaattaagatgatccygactccttgctaaattcccattgtcttatgggatacaagaatgcaatatgagatattgtacaatgcctttagtattttttctaatagatttagttccatc

SEQ ID NO: 50031 - DNA, 201 bp, Homo sapiens
tgatctgcataacttggactccaactgctgagataacaggtgtgaaccaccattcctggcccttaattcatattttaaaagaaaaatttcaaaaatctcaagtaagagctttttttgtttccagagaatatattaggaaaatttgaattattatttttactctcattattttagtatagtttgtccatttcagaacaaata

SEQ ID NO: 50032 - DNA, 201 bp, Homo sapiens
taaagcaaaagatcaaactagaatgttaaattgtagcaaaaaaggaagaaattatgtgactctttcatactataatattaccagtttggaaaataggcctrgtaataaagtttgttttactaattctttctaaattccaggccaaaaatatcatgtaactttaacatggctttcatttccagtcatgtacagaagagtcct

SEQ ID NO: 50033 - DNA, 201 bp, Homo sapiens
aatggttgagataccccaagacttaaatcatgggttgagttctttcctcatctgtttcatttaagcttgaaatatctctcttctacttctcttttcttccktttctcttactattgtctgatactccggataattcctcagcattactccctttgctctccagagcagggacgttttgatagaagttgcagcacaaatctc

SEQ ID NO: 50034 - DNA, 201 bp, Homo sapiens
gaaatattttttgccttaaaactgtattctataaatcagttcatgtctgtctttctacatacaaattaatttctgtttgttgattaaaatctgctggggcrgagaggtagctgtttgatgtaattggtctatcaagtttaaatgcaaatgattaagtagggtaaacattagcagggatggcaaacagaaccaaaagcattt

SEQ ID NO: 50035 - DNA, 201 bp, Homo sapiens
attcatttaagctaaaactttaagctaaaagaaaataattaaatttgtttgacctaaaaagaatgtccttgcattttgtagtctccattaaaaaaaaaaaacactccagtaatctttcgaatcttttttcagccaacagctctgtaacatcttgcctctatacatgatactgcctttttagccaattccaacctagagcaa

SEQ ID NO: 50036 - DNA, 201 bp, Homo sapiens
tatctgaattaatacgaatcagagccttttagattaaggaaattttatttttaaaaataaaaatattttcacagaaaaacattcttagaaaaaatattgargactgtttggcacagatcagtaataaataacttattaaattctaatcagatgtttagcatatatcttttacagtctttggattatatcaacaatattaga

SEQ ID NO: 50037 - DNA, 201 bp, Homo sapiens
aatgaggctcacgacattattatcaataaacacataaagaaaataaaaggctatacctatttttctttctaatgttctcaagagtaggccaaaaatataamaagcaagatactagaggtttagttaatctgattgtattgttttcatatagatctctagatttctgcaattggatgtgtttaacatgaaaccttgatatat

SEQ ID NO: 50038 - DNA, 201 bp, Homo sapiens
atagccatgatatggattcaacctaagtatctaccaatggatgaatggataaaggaaatttggtgtacacacacacacacacacacacacacacacacacmtaatggagtactactgagccctaaaaaagcatgaaatcatgtcatttgtggcaacatggatgacacttgaggacattatgataggtgaaataagcaagac

SEQ ID NO: 50039 - DNA, 201 bp, Homo sapiens
ttgaggagagtacagaaaagcaaatgaatggtgaataggagaaaggccatcagccaggcagctgcaggttagacggatggattgacttcccagcagagcarggcacagtttgctcaattacccttttgtacagctgggaaagaaagacaggaacatcagagactgctatctctcagttaccaataacttttgaaagaggta

SEQ ID NO: 50040 - DNA, 201 bp, Homo sapiens
caacttttgaggtttcggctctccaatttaactctttggcaacaggaaacaggttttgcaagttcaaggttcactccctatatgtgattataggaattgtwtgtggaaatggattaacatacccgtctatgcctaaaagataataaaactgaaatatgtcttcacaggtctcccacagctgtctgactcttgtctaaagta

SEQ ID NO: 50041 - DNA, 201 bp, Homo sapiens; identical to SEQ ID NO: 14519

SEQ ID NO: 50042 - DNA, 201 bp, Homo sapiens
gcactccaatctgggtgacagaatgagattctgtctcaaaatataaaaataaaaaaataaaaaactttaatctagatatttaataaaagcgtgagtgtatktatacagccaatatcccaaatcattttaatgaaaagcataacaaacttgtgcacgtgtgtatacatatacgcatatgcttttataggtagtatatgtatg

SEQ ID NO: 50043 - DNA, 201 bp, Homo sapiens
accctcacagacacagccagaataatgtttgaccaaatgtctgtgtaccacatgacccagtcaagttgacacataaaattaaccaccacaacttggtaacmaatatgttctttttctcaatgaacattttacctataaacacttcacatgggtttgtgtccatggcatctatagaaaattcggaagacctgtgctatgtaa

SEQ ID NO: 50044 - DNA, 201 bp, Homo sapiens
taggatgtcaattagaagcctgaaagaaccatgccttaggaataggagcaagccaaaggtagaccaaattttactaaaattgcagtggggctccaacaaargtcaataacctgatagaattgtgtaatcagccccttagcctaacaaaggaaagggggagccatagctgatagaaaataacattctgtagggtctctacag

SEQ ID NO: 50045 - DNA, 201 bp, Homo sapiens
attttgggtttaaaacttttcctttcagcattttaaagatgtttaattatctctggtgtgcactttttttctgatgagacatcacctgttatttatgttaytgttctcctgaacaaattttctgtggcactttcaaacatttctttttatatttgcttttggttagtatgtctatgattaacttgagtgtgtttttccttt

SEQ ID NO: 50046 - DNA, 201 bp, Homo sapiens
cctataggttggtttgttaccacataaaatttgcagtgtgtaggttggtttgttaccacatagaatttgcagtacatgctcagaggaagcttttgctaacytcttaattttcctagaggaagaacatggctcaaagagaaattttatcccagggccatggagaagggaagaaccattgtgtcatggtcagtatctgttttt

SEQ ID NO: 50047 - DNA, 201 bp, Homo sapiens
ataaagcatatatattaaactgttagttgtcttttaaaatattttacatatctacaatctgtatttttttattctttcttacgtatctgaattcccatctsgtgttacttcccttcgaagaacttcctttaatgcttcctttaggaaaggtctgctggtgatacttttttctactttcttttcatttaatttaatatgtct

SEQ ID NO: 50048 - DNA, 201 bp, Homo sapiens
ctgggagacagaggttgcagtgagccaagattacaccactgcactccagcccgggcaacagagcaagactctgtctggaaagaaaaaaaaacagaggctamggtgggatgatcgcttgagtccaggagtccaaggctgcaatgagctataattgtaccactgaactccagcctgggcaacagagcaagaccccatctctgg

SEQ ID NO: 50049 - DNA, 201 bp, Homo sapiens
atggcagactgacaaagcaaaagacttggttgcagccatatagtgcctacgtgtttggctgtgatgggggaaaattaaacaaaagtgtgtaaaagtttaaytggattttagtgcatttaattagatttaaatgcatcttggttttgacaggtagactctaacactgggttttaactctgttgctgactctgttcctcctca

SEQ ID NO: 50050 - DNA, 201 bp, Homo sapiens
attatagtattttattggacttttccaaatgataccagccagattgtgatttactggctgcacctaccactgtcatccccttcacttgtcctgcctcctcyatcctctcactatgctattgttcagttaaaggcatacttacgggatacccccaaagcagtcccctaccccttttgagatttcaaaacaagtgtagaatat

SEQ ID NO: 50051 - DNA, 201 bp, Homo sapiens
taaacttggcccaaggggagactccttctactgagctgtgaccaaagaaggggaaaaaataaccatactcctgggcatgaccctaactacctgcacaggtrtcaatggccggtttgctggaagtggtaactctacactgccaagatgccagtcctaaataccaacagctgtggtaccttctgtggtgtgaggcagggatgc

SEQ ID NO: 50052 - DNA, 201 bp, Homo sapiens
ctcccttgagagccctgtaaaaatagtggactgttatgttcacagctgggccatttctccatttactccttgcttatgttgcttgggtttgaatgtgtctmccatcaggggctagttacagagaaagcagtagcttccagtataacaatattatccagtcctgttccatgaaaataaaataatgaagaaagagaatatagc

SEQ ID NO: 50053 - DNA, 201 bp, Homo sapiens
tgaataatagtgacatacaagtaattataatatcacatgattcacattctgaagaaggtcaaataataaacatataattcatttccatctgccaacatgartatttgttgagtgcctactgtgtgcctggcacagctagcttcacggttctatctggatatatagatggaagacgggtgagtcagagaaagagataaagac

SEQ ID NO: 50054 - DNA, 201 bp, Homo sapiens
aatctcaaaatagtcattgtgtaaatcttggaaacttactgagagatttaccttttgcagctatggaactcaagactattttcatgaaaattagtgtgtawtatagaaataatccgaaaatctaaaagtcagaaataccctttgttagttctgccttatacgatgctttattattccagtactttcttggaagaaaacaga

SEQ ID NO: 50055 - DNA, 201 bp, Homo sapiens
caactgttctcattgtagcgaccaagtataatcatctgacattttgcctctatcaaaagggacagcccgaaggaataagaagctcaaatacttacacactracggatgtgaggcgcaatgcaacaggagactacaagtgttccctgatagacaaaaaaagcatgattgcttcaacagccatcacagttcactgtaagtcac

SEQ ID NO: 50056 - DNA, 201 bp, Homo sapiens
tgttctgactgctttatcaaaattaagtgtctttgctttcaccctcctcctaaaagtcattcaacctaaaagtaaaattttggggggcattgaggggggargaagcagaaaatgttctgtttaacaatgagatctacaccagatatttcattttgattatttaaatataaaagataccttttgctcacagtagttggctta

SEQ ID NO: 50057 - DNA, 201 bp, Homo sapiens
cctgagaattatagaaatttatttaaactaatttattttaaaaactgtaggtttgtgaagatactaaaactactttttctcccacaggataattgtagacrtacattcaaaatagaagtaaattaatggtaatattagttcttctatttttaattaatagattaaacctttggatcacggcatttctcataatctagcaga

SEQ ID NO: 50058 - DNA, 201 bp, Homo sapiens
cttttacattattagagagatgaatcaaatgtttctataatgcctactttcattcaatccacacccaattttagaggactgctgtcacaatgccaaaaaaacatagactgaagttttaataatgtttcttatatgataaagaaattctagggtaattttatagcacagtataagtgctgaacttgtgttatacctttcaaa

SEQ ID NO: 50059 - DNA, 201 bp, Homo sapiens
aaagagagtattctgtaaaagctggaggacaagtgaagcttaaaggagcagcttgtactgatgagaaaggggagaggaatgagtggacctctcttcagagmggaaagaaagataagatgaaaagccagcatgaaaaggaacttgctatttaaaattacaacaaactgtttatgtggaccagtagcatcatgatgtaaaata

SEQ ID NO: 50060 - DNA, 201 bp, Homo sapiens
agagatggggatcttgctatattgtccaggctagtctcaaactgctaccctcaaatgatccacctatcttggcctcccaaagcctggggattacagccatragctacctcgcccagccaagattttgtttctattttgggtgcaccctttataagagatcaagtacaccattaacatgttatgtgtattacttggaaaatg

SEQ ID NO: 50061 - DNA, 201 bp, Homo sapiens
ggctgggccacatttgcccgttttcattgttccaaaagttcatcgttcaagataggttcgtacaattgctctttctttgtgcccacataattacatgccartacctttcctcaaattagaaattatattcaggcaagggattctgctgacaccacattcctcaccaaatgtcagagtctcttaaaaaatactgtaagctca

SEQ ID NO: 50062 - DNA, 201 bp, Homo sapiens
tattagtctatgtttaagttaaatcacatttaagatgaagttgcatagtttgcttcttgattgatgttttgaagtgatttgcaaatgtaacaatgtaagcytagaggatatctactaaaaaaaaaatcacccaaacatacagttaacagaagtgcaaatattcttcagtagaaataaatttatacatgttatggcgagcaa

SEQ ID NO: 50063 - DNA, 201 bp, Homo sapiens
ctgtgggaggctgaggcgggtggatcacgaggtcaggagatcgataccatcctggctaacatggtgaaaccccatctctactaaaaacacaaaaaattagscgggcgtggtggcgggcacctgtagtcccagctactcgggaggctgaggcaggagaatgatgtgaacccgggaggcggagcttgcagtgagccgagatcg

SEQ ID NO: 50064 - DNA, 201 bp, Homo sapiens
gccattctcctgcctcagcctcccgagtagctgggactataggtgcctgccaccacacccggctaattttttgtatttttagtagagatggggtttcaccrtattagccaggatggtcttgatctcctgacctcgtgatctacccgcctcagcctcccaaagtgctgggattacaggcatgagcctgtatttaattttttt

SEQ ID NO: 50065 - DNA, 201 bp, Homo sapiens
attatagtggaaagtttttaattagcttctgattaactgtaagcttatgttttaaatgtaccatgcagaaccttataacaagtaggcataaattaaatagycactaatatgtatgtagcaaaaatattaatacggctgctactagggattttcactggcatatttttaatttttttttttttttactttaaagtggagtag

SEQ ID NO: 50066 - DNA, 201 bp, Homo sapiens
gagactgtctaaatgtagaatatattgcataggctgaagaaattgtgtgtatcacttgtttttaattaatagactatttttatctgttcttagtttatggraaaatttgagtggaaagtaaagagctcctatataggcccgcaattccctgcctccccacccccttgcccctagtttcccctattattaacatctttgcat

SEQ ID NO: 50067 - DNA, 201 bp, Homo sapiens
ggagtacaggcatctcagtattgattcctttcttttaggcatatacccagaagtgggattgctggattatctggtagttctattttaactttttgaggaaycttcacaccgtttttcataattgctgtaccaatttacattgccaccaagagcgtacaaggatttccttttctctacatcctcatcaatacttggtatctc

SEQ ID NO: 50068 - DNA, 201 bp, Homo sapiens
tgctgtattatataggataaaaattattatataatacctatgtatacaaaataataaattcccccataatttaaaaataatgtagtattatagtttaaagtaggttctcttcatctacttcctgaaactctacagtgaggccaaaggaattgaatttaaagaataattctggaatgtctataagttaaatagacgacttga

SEQ ID NO: 50069 - DNA, 201 bp, Homo sapiens
tcaggtcccttcgtgtttttttcatggcttgctggctcatttctttttattgctaaataatatttcattgtctggattaccacaattttttcattcatctrtcgaaggacatcttgtccaagttttagaagttataagtaaagcttgtataaacattcttgttcaggtttttgtgtggacataaacttgcaactcatttga

SEQ ID NO: 50070 - DNA, 201 bp, Homo sapiens
ttaactttttgaggaaccttcacaccgtttttcataattgctgtaccaatttacattgccaccaagagcgtacaaggatttccttttctctacatcctcaycaatacttggtatctcttgttttttcaataagaaccatcttaacaggcatgagatgatatgtcattgtgattttgatttaatttccctaatgatgagtga

SEQ ID NO: 50071 - DNA, 201 bp, Homo sapiens
ccctgtgccattcatctcctctttatcacctttgtactcaagctttggcttttctgaactttccttattttcaaaaatgtcccccagccccacttccaccygagacattcacacaccccatttcctcttccaggaaggctcttatgtcgcctgggtaaacttactcttcaagtctagtgacttttttccagaagctttcct

SEQ ID NO: 50072 - DNA, 201 bp, Homo sapiens
aggtcccttcgtgtttttttcatggcttgctggctcatttctttttattgctaaataatatttcattgtctggattaccacaattttttcattcatctatygaaggacatcttgtccaagttttagaagttataagtaaagcttgtataaacattcttgttcaggtttttgtgtggacataaacttgcaactcatttgaaa

SEQ ID NO: 50073 - DNA, 201 bp, Homo sapiens
ccataaaattaggtagagatggggtaaagcctaaactaattgggagaaactgtgacgtatccagccccatagatcatttcatgcttgtagaataacaaacwatcaggctaaggtaaattaagaaggtaattttctgcacagcaatgtaaatatcgatagtgtatttttaaaactttattgtttgtgtaattcttttctatg

SEQ ID NO: 50074 - DNA, 201 bp, Homo sapiens
gaataggaaactgtgagatagaataggaatacaggattgtctgaatggagtgaattggaacgcctccttatgcaagtgacctagaaaggaagaggaggctkctatgaagtttaaacgctctctagaaaacagcatgaacaaagaaagacttggatttgagaaagctcagagcatgttcagggtactgaaatgtagggtgct

SEQ ID NO: 50075 - DNA, 201 bp, Homo sapiens
tttagtattacattttaatacctctactggccttttaactatacctctttgtgttcgtttactgtggttgctataaggattacaataagaactcaaaacartctactcatgttaaaaatctaagatttttgaagcataatcccatttaacttcctctatctttgttgctattattgtcacatctgttttatctgcatatat

SEQ ID NO: 50076 - DNA, 201 bp, Homo sapiens
ggaggctgaggctggcggatatcctgagcccaggagtttgccaccagtctgggcaaaaccgatggaatgatgaaattccatcttacaaaaaaaaaaaaaaatgcagaaattagccaggtgtggtgctgcgcacctatggtcctaggaactcaggaggctgaggtgggaggattgtatgagcccggaagatggaggttcagt

SEQ ID NO: 50077 - DNA, 201 bp, Homo sapiens
tgagttaggcaaagacatcaagaccaagaatccaaaagcaaatgcaacaaaaacaaaggtaaatagttggtacttaattaaactaaaaagcttttgcacarcaaaaggaacagtcagcagagtaaacagacaacccactgagtaggagaaactcttcacaatctgtacatctgacaaaggactaatatccagaatctacaa

SEQ ID NO: 50078 - DNA, 201 bp, Homo sapiens
tttggtgttagaaatgcatatagggctcctctgcctgtaacctgagtgccccacctacattaaaaagcctcattagacttctggttcctgatctgaaagakgcctatcttcttgaatattcatgattttctattttattttgaaaattagaacagctgccacggacaggacttgtatttcctgggagcaagtgccaaattg

SEQ ID NO: 50079 - DNA, 201 bp, Homo sapiens
ttttacctggtttcttttatgatctcagttcaacatcttattttaattgtaatatttcaggcaaacctcaaataaaaatgacaaagaaaactgatcccagyggactatctaaaacaataatctgccatgtggaaggttttccaaagccagccattcaatggacaattactggcagtggaagcgtcataaaccaagcaagta

SEQ ID NO: 50080 - DNA, 201 bp, Homo sapiens
gtttgcaaatattttctccctattcataggctgactttttattttgctggttgtttcctctgctgtgtagaagctttttagtttaatatagtcttacctgygtattttaattttgttgcctgtgcttttggtgtcttatccaaaaaaattattgccaagtccaatgtcaaagagcttttcccctatgcattcttctaaaag

SEQ ID NO: 50081 - DNA, 201 bp, Homo sapiens
aaatattaccaagtgtgggaaaccatctgagagcaggcacattcccagaagaggggttcatgtcagggtttagtaacactgtcctcatgttcgagttcctrtgtaatcagtctacaggtgccattgacctgctgtaagaacttgttttccttatccagtgtttttgtttatgttttaccaccttgtttgtgatagctagtc

SEQ ID NO: 50082 - DNA, 201 bp, Homo sapiens
caggcaaacctcaaataaaaatgacaaagaaaactgatcccagtggactatctaaaacaataatctgccatgtggaaggttttccaaagccagccattcartggacaattactggcagtggaagcgtcataaaccaagcaagtatttgtcttcttgttatatgctgcacttcgtccaatgcgttttttttccttcacgaac

SEQ ID NO: 50083 - DNA, 201 bp, Homo sapiens
taaatatttttcacctgtaattttttaacccattaaggaaagtaggaataaaatctattttagtcacttttacatagaaaatagcaggatatatatatatrgttttgaaaaattatatgccgaaagtaatatttttaaacaaatgataaatattcataatggaggtaatgtttgtatgcacatactgtaatttaatgagta

SEQ ID NO: 50084 - DNA, 201 bp, Homo sapiens
tgttcaatgtgtttctgcctaattctcctccaggactctgtttgtttctttaatgaccaagatttcttttagatgagtattaaattctttgagtttgtaaygcaacacttgcaaatatttcgctagaaatttatacacacatatctgtcattttattctacaaattgatgttttctcattctataacataaggaactcagt

SEQ ID NO: 50085 - DNA, 201 bp, Homo sapiens
tcttataaatgtgtaaattaagttttgcaatgggatgtctatagctagtggaactttggacttaattttatattatgtctgatatgtcccctttaaaaaaygtaagaaagttgacttaaaagagaatcaaaagaaaaatcagatttaaatcaggacccatgatctcaccttgtaaagatgccagttccaatgaagcaatat

SEQ ID NO: 50086 - DNA, 201 bp, Homo sapiens
ccttacaaattatctaacagtggtttataaggaaaatccgatgaaccagcgaagattcttaacatacacacatgtcttatacttctcatcatctcactccyaaccctagattcagataccattgataggggtggggttccagcatctgcacttttaaaaagtttcactggtgattctgcggcatgctgctagtttcaaaca

SEQ ID NO: 50087 - DNA, 201 bp, Homo sapiens
caaaatataggcagtcttgtactttatatacaatgatccttctggggagacatggaaattcatctgtcttcctcaagccaagtgggactgttctgtcctargagaagggatttttaaggagtggggaaggaaggggaaaaaaaggaaatcttttccttattgtcaccactgcttacccttttcaaagaagtatcttcggtt

SEQ ID NO: 50088 - DNA, 201 bp, Homo sapiens
tgatgcatatatagctgcataactctagatatggaaagccctcaaaagagtaggcacacttgaagtgaatgactcctgatttggttaagtgtgatggggamacacagtaagaaagcatataagaggaggcaaagaagctctgggctcctcaaacctaggaaaatgcagttttcttgatttggaataaagacttgaaccatc

SEQ ID NO: 50089 - DNA, 201 bp, Homo sapiens
cctcccaagtagctgggattagaagcgcatgccaccacaccctgctgatttttgtatttttagtagaggtggggttccaccatgttggtcaggttggtctsgaactcctgacctcaggtgatctgcccacctcagcctcccaaagtactgggattacaggtgtgagccaccaagcccggcccagaattctttctgttagaa

SEQ ID NO: 50090 - DNA, 201 bp, Homo sapiens
gttatagaaatacttttctaggaaaacttattagggttaagaaaccagatatttttcttttaaaaaatatgtaattcatatattttgaacttaataattakattccaaatggtcctaatcacaccctgtggatctttagctcttgaggattcaaaactatgagattttacaatcacgttttagatagtaaagattgaatga

SEQ ID NO: 50091 - DNA, 201 bp, Homo sapiens
ttttgcagtgcaaagtggattttggctctttcaactataggtgatgcatatatagctgcataactctagatatggaaagccctcaaaagagtaggcacacktgaagtgaatgactcctgatttggttaagtgtgatggggaaacacagtaagaaagcatataagaggaggcaaagaagctctgggctcctcaaacctagga

SEQ ID NO: 50092 - DNA, 201 bp, Homo sapiens
tgatttaaacccaagaaattaatatttcattatgtatagcttatctaaaatcaaacttttttaggtgaaggcagaattctttctttcttttttttttttttgtgtgagacatagtctcactctgttgcccaggccagagtgcagtggcgtaatctcagcttactgcaacctccacctcttgaattcaagtgcttctcctgc

SEQ ID NO: 50093 - DNA, 201 bp, Homo sapiens
ccagagcatgacatgtgacaagaacccttaacccatgatgggttcagaaaacacacataccatttgaaataggagttgacaagaattacctttataagaarctgtggagaaatatttttctagagtttctttttgatggaaatatattgatgaaattattttgtattgctttactgcctgccttttgatcctttttaacac

SEQ ID NO: 50094 - DNA, 201 bp, Homo sapiens
aatttatctaaaatttttgtgatactggcatgtgttctacagtaacctagcacttctacatctattttagagaaaagccaggaatgcctgctgagcctttygaaagaatcacctcacctacatttctttttttggttccctagggcacaatatcttatatgagaacaaaagtgaaattcttccaaagttgccctaatatta

SEQ ID NO: 50095 - DNA, 201 bp, Homo sapiens
taattgtctgaaatgtaggccattggctatccttttagagtaaggaagtgtgactgataattggtgatttgagacaaggttatcaccaaaggaaaaggttrtgattgcgatccctccacttaaacccttggctagtatatccaaactcccagtgcatttgttaccagagcatgacatgtgacaagaacccttaacccatga

SEQ ID NO: 50096 - DNA, 201 bp, Homo sapiens
agatttttataaagattgttttccatcaactggatgagaaatggaatagcactttttaaaaatatctgctgctatagtaaattctctctgaagaaacacarctactatctcatggtttttcaatttatcacctgctgtctaaagatgcttgattttccaacatttatgccttactgtctctttatataatatttacctagt

SEQ ID NO: 50097 - DNA, 201 bp, Homo sapiens
ctggtctcaatgaattgtatgagtttaacttccatgagttgtcaccacttatacccaattactcaccattacaaaatctgccaagctttctcatctcttcrcctttgcttatgtgaccaaagttttccttacatcttcccctatcaaagtccttctcaaccatcagaggccacgaacatatagtgttccctttacaaagcc

SEQ ID NO: 50098 - DNA, 201 bp, Homo sapiens
atctttcttaaataacttggttgcaatagatgcagtagagagagaaagcatcgggataagctcaactttgtccagatttgtactgcaatattgaaaccttkcatggctctgataaccgcaacttttggcagtggtacatctccatcttctttctaagtgtcttcaatttgtggtgtcaatgaacaatattcatatagacct

SEQ ID NO: 50099 - DNA, 201 bp, Homo sapiens
gaagctcaaatacttacacactaacggatgtgaggcgcaatgcaacaggagactacaagtgttccctgatagacaaaaaaagcatgattgcttcaacagcyatcacagttcactgtaagtcacctacttcttcatcagcagcttcacctcaaaggcttctaatagcttaatgtagctatcttttcaaataaactgcacgta

SEQ ID NO: 50100 - DNA, 201 bp, Homo sapiens
gtagattaatatctttgcagttgtagctcctctccttaaaacaagattaatttctttgtaggcaaggtcatactttattaagtgtgattttttttttttttactgttagctatagaatagacattttatctttgagtattattacatcatactataatggtaaaggtgactttcatatatcaacaaattttgtttttaatt

SEQ ID NO: 50101 - DNA, 201 bp, Homo sapiens
tttgagatttcaaaacaagtgtagaatattgggaaaatctcaccaaaaaaggtcttaaatcttctgaaaagttatttgaaagtaactttagccctttaaaygcactgcgcttaagggaaattacacagaatgaggagttgagacttagatttaaactctcttctgctgctcttggccatcaagctccctgactcaccttca

SEQ ID NO: 50102 - DNA, 201 bp, Homo sapiens
tgattaaattgtcccagaacatgaggttactacttaagagatttaccgtaaccttatgtaacttcattcattattggtctaatttgctaaaaaagctctgyctttactgacaaatggaaatattcaggcttaagccttttcttgcgaaaaaaaaagagagagagagagagcgagaaagaaaagaagctttattatcatttt

SEQ ID NO: 50103 - DNA, 201 bp, Homo sapiens
ttacatccaactgatctttgacagagcaaacaaaaacataaggtggggaaaggacaccctattcaacaaatggtgctgggataattggcaagccacatgtrgaagaatgaaactggattctcatcttaccttatacaaaaatcaactcaagatggatcaaagacttaaatctaagacctgaatctatacagattctacaag

SEQ ID NO: 50104 - DNA, 201 bp, Homo sapiens
ccacttaaacccttggctagtatatccaaactcccagtgcatttgttaccagagcatgacatgtgacaagaacccttaacccatgatgggttcagaaaacacacataccatttgaaataggagttgacaagaattacctttataagaaactgtggagaaatatttttctagagtttctttttgatggaaatatattgatga

SEQ ID NO: 50105 - DNA, 201 bp, Homo sapiens
tatatttttcctaaaatatttgttttctttctgtgccctctttcttttcaagttacctccacagatttatgtcaaaatattatgttcattatacttttgcyagtggcttgctttgatgcaaccataaatgaatatcattacactttacaaagataatttattttctaggctttgctgtcatgctatatgtagcttgtatag

SEQ ID NO: 50106 - DNA, 201 bp, Homo sapiens
ttccagtataacaatattatccagtcctgttccatgaaaataaaataatgaagaaagagaatatagccagcagatagaaccatatgtggaatagctagctstctattatcattgctcatgatgtctttgggccaataatcaataatctagtgccttagagatggtgtgatgtgcttatttttaagagatgcaaggtacaca

SEQ ID NO: 50107 - DNA, 201 bp, Homo sapiens
aactcatctccctacatttcccttgcatactgtgcaattcatactcataatagagctggagagaattttggaatatttaagtctgatcatgttacctcttrcttaaaatgtctcagtagcctctcataacttctaatatgaagtctaaaatccttgatatgagctataataaaagcccagcatgacatgtcctttgcctaa

SEQ ID NO: 50108 - DNA, 201 bp, Homo sapiens
ttcatgtgaagaaaagagcaaaaaggtatttcaactgatataaacatttttcagtatgaggttagatacttaatgtggaatataccagaagctagcatacyggactagatcactcaaccaattcagaagcagaaatctactactctgctcatttagtagccctaataatccacttttttatccctggtaattcactacctc

SEQ ID NO: 50109 - DNA, 201 bp, Homo sapiens
atattccttaaaatacatcttaaaagatttttttctgtgtcagtttgccaagaataatggcctccagctccattcctgtccctgcaaaggatatgatcttkttcttttctgtggctgcatggtattccatggtgtatatgtactacattttctttatccagtctgtcattgatgagcatttaaccaaatactgcatgttct

SEQ ID NO: 50110 - DNA, 201 bp, Homo sapiens
tttagcaccacctggtggacaaaatatcatttgtttttttctctactgtttaaagtagccccttcacactctatacccgattatgatacaccttaatagayattcagctgtgtaagttctaaattttaaagattgttgtaaataaactaaggttaaaaaattgaaatgtttcccaagtactataaccaatttaaatgcctg

SEQ ID NO: 50111 - DNA, 201 bp, Homo sapiens
ctcatctctggaggtggagctcagataccagacaaaattgaggactaagacaaggactgggcggaagtagctttcctgaagacatgctcactagtgtgccmtgtcagtttaccattgcaatggcagcacctgcgagcgaccaccgcctttccaggcaataacccgatgacccagaagttactacccttttccgggaaattt

SEQ ID NO: 50112 - DNA, 201 bp, Homo sapiens
atccactgtggtctgttctactttccagattccttctgtagagtaatacttacatgcctatgcatatgctgtcattttcccacctttatcatttagcaaayacccatttatgtgtcaaaacccagctccagggtcagttcctccaggaagcttcctagtctcatgtaatgatggctaccaggatccctatgcttgtgtcat

SEQ ID NO: 50113 - DNA, 201 bp, Homo sapiens
tcgtctcttgttggtgtaaatgaatccttatgatttttgcacagtgattttgtatcttgagagatacacaaactaaaattgtgtcctcaggatacagcttyaaattctatatgtttattattttattcaattttgtgttcaaatcatcctatgtgctatcatttttccaattacacagatgagaaaattgaggccctggga

SEQ ID NO: 50114 - DNA, 201 bp, Homo sapiens
aattgtatctactttgtagggtttttgtgggtatcaaatacataaaaacatatgtaaagaataaaatgaagcctgagccatgttatggtatcaaatcctasatactattaattactgtattctcatttaatcctcacaataagcctgttgggtaattattattattctcattttgcaaggagccatgctatcctaaattat

SEQ ID NO: 50115 - DNA, 201 bp, Homo sapiens
gtgtttatacctttgtaaatataattctgaaactgtagcgtatttttgacaagtgctttgcttttgttatcaaataatgctggcagtggaatgaggctcaygacattattatcaataaacacataaagaaaataaaaggctatacctatttttctttctaatgttctcaagagtaggccaaaaatataaaaagcaagatac

SEQ ID NO: 50116 - DNA, 201 bp, Homo sapiens
tatcacaagaacagcatgggagaaaccacccccatgatacaatcaccgcccacttggtccctccctctacacatggggattatggggattacaatttgcartgagatttggttggggacacagagccaaaccatatcaccaacataatataaaatcactttgaaaggacctcaaaatacatcctaaaatttgtttcaaaga

SEQ ID NO: 50117 - DNA, 201 bp, Homo sapiens
gcacagagtaattcggtacttgacaaaaatggttaacttgtgtctgtaactcttacagatcctacagagcaggtgacaatacaagtgctgccaccaaaaartgccatcaaagaaggggataacatcactcttaaatgcttagggaatggcaaccctcccccagaggaatttttgttttacttaccagtaagtgcttaagta

SEQ ID NO: 50118 - DNA, 201 bp, Homo sapiens
gttcccttgtcaactttcctttgcttttaatcaattgaaagaaaaagtcttcatggatttttagtaggaaacatatggagctgtaaatcatcagtaatgtrtgaacttatatttacaggtgcaactgaccttgactgtgcatccttcccaacttacttcttataaatcctgtaatcaataagtgaaatagtattccatacc

SEQ ID NO: 50119 - DNA, 201 bp, Homo sapiens
gaataaatcagtggattataggacagacctcagtggaggatggcaacctttcttcatttgttcatgttctacttgatgtggttattgcaaagacaagatayatcagtagatagagccttagacagtctttcggaattaatcatcagtattacaagcttgattctggcatttagccttaaaaatgtgttgatgctataggtc

SEQ ID NO: 50120 - DNA, 201 bp, Homo sapiens
gagcagtcattatttgaatggtttgtgcaattgacatatgcctcagtttttgtttttgttttttaaccaataagcatggaaaaaaaaaacctcctatgttrgtttcttatttttcatatatagaaagtcatatggaatactcctgctatatggtaagtactccacaaattacagttactaggctacagataaagaaatggt

SEQ ID NO: 50121 - DNA, 201 bp, Homo sapiens
tgaaaactcttgcttatggctataataatcaggctacaaggatttctaagaactgttcttagtttaatttttctgctattgccagatgcttttcaccattytaggtgcccaaatcctgaagccaaatttaataaaggagaaacaggcctaattgataaatggatgttcagtatgcgttttccagtcagaacttgccttggc

SEQ ID NO: 50122 - DNA, 201 bp, Homo sapiens
aaagagggaatcctccctaaatccttctgtgaagtcactatcaccctaataccaaaaccagagaaggacataacaacaacagcaacaacaacaaaaaaaaacaacagatcagtatccctaatgaacatagatgcaaaaatcctaaacaaaatgctagcaaaccaattccaacagcatatcaaaaagatagtccaccaagat

SEQ ID NO: 50123 - DNA, 201 bp, Homo sapiens
gccctatagccctgcccaccgtctgagaaacctgaatacttaaccaggtgtccctagggcaagtttgcatcttctctataggattgcagctgatgcgcttytttttttttttttttttttcttaaacagagttttgctcttgttgcccaggctggagtgcaattgtgcaatctcagctcattgcaacctcttcttcctggg

SEQ ID NO: 50124 - DNA, 201 bp, Homo sapiens
caaaattacaatacacttacagtcctgttgattgtgtcaaggttctccctcagttcataggattcatctttttttaagcagatcttctctcctgcatgccraaatcctcgctggtgttgtttagctcatgtctcctctttttatttcatatgaagtattatcatgcaatatgagtacagtggcatctaatagctttagcta

SEQ ID NO: 50125 - DNA, 201 bp, Homo sapiens
gtttggttttttgtccttgccatagtttactgagaatgatgatttccaatttcatccatgtccctacaaaggacatgaattcatcattttttatggctgcrtagtattccatggtgtatatgtgccacattttcttaatccagtctatcattgttggacatttgggttctttccaagtctttgctcttgtgaatagtgcca

SEQ ID NO: 50126 - DNA, 201 bp, Homo sapiens
gtgaatttccaggacctgctcatagagcctcagttctcagttctgtactgagtcttggaagagagagagagagagagagagagagagagagagagagagaaaaggcaaaattcccaacaactaaaatatctctcgggaaatccctttccacaccctcggggacgtcccctggccctggtatcctcaggcccgcctggcggc

SEQ ID NO: 50127 - DNA, 201 bp, Homo sapiens
tgtgaatttccaggacctgctcatagagcctcagttctcagttctgtactgagtcttggaagagagagagagagagagagagagagagagagagagagagaaaaggcaaaattcccaacaactaaaatatctctcgggaaatccctttccacaccctcggggacgtcccctggccctggtatcctcaggcccgcctggcgg

SEQ ID NO: 50128 - DNA, 201 bp, Homo sapiens
aaaaaaagagagagagagagagcgagaaagaaaagaagctttattatcattttacattcaagggcaatctcttttttttacgtatgaaagtaagtgagatmcatctactactttgaaaatgaagaaagttgagatcattgacaatgaacatactataattttaaatttaaatgtttaatagtttacttattataatttatt

SEQ ID NO: 50129 - DNA, 201 bp, Homo sapiens
aatccctattttttcatccataaaatgagataaaaatatcttcctcatagtgttgttgtcagagtacccgaagaaattgatatcaaaatacttacctagtwcttgtcgtgtagtaatcattcaacaaagtgaactcgtgtctgtgatgctgcagaatcctaaccatactatgctcgtgtgagtgggaaatgaaaggaaagg

SEQ ID NO: 50130 - DNA, 201 bp, Homo sapiens
ttgtgaatttccaggacctgctcatagagcctcagttctcagttctgtactgagtcttggaagagagagagagagagagagagagagagagagagagagagaaaaggcaaaattcccaacaactaaaatatctctcgggaaatccctttccacaccctcggggacgtcccctggccctggtatcctcaggcccgcctggcg

SEQ ID NO: 50131 - DNA, 201 bp, Homo sapiens
gtttgtgaatttccaggacctgctcatagagcctcagttctcagttctgtactgagtcttggaagagagagagagagagagagagagagagagagagagagagaaaaggcaaaattcccaacaactaaaatatctctcgggaaatccctttccacaccctcggggacgtcccctggccctggtatcctcaggcccgcctgg

SEQ ID NO: 50132 - DNA, 201 bp, Homo sapiens
gtttaagacagagtttcactcttgttgcccaggctggagcgcaatgtcacgatctcagctcactgcaacctccgcctcccaggttcaaatgattttcctgyctcagcctcctgagtagctgggattacaggcatgcgccaccacgcctggctaatttttgtatttttagtagagacggggtttctccatgttggtcaggct

SEQ ID NO: 50133 - DNA, 201 bp, Homo sapiens
aattttcaatagcaaaaatctgaccacttcactgccatccttaaaatgaaccaaaaatccttttgttgactccacattctttacagaataaagtccaaatwgtttaagctattatttaaggctttcaaagtatcaccccattgcttctttcccaggtgcctttccttccatcacctcctacagcccctaaacctcagccac

SEQ ID NO: 50134 - DNA, 201 bp, Homo sapiens
tgcttatttccatctagcagggtatatggatagactataacccaacatatgtcaaataattttggtgggtagctcatttgaactaatatggaaactcctcraagacaaaaatgtaataatacattagcaatgtaatgctatcataaattagaaatgaaaaatgttgttctatttttggggtattaatttttcctactgaac

SEQ ID NO: 50135 - DNA, 201 bp, Homo sapiens
aagagtaaaataaggaaacatgggtaaagcacttaacatagaatatattttctataaattttacttcctcttttttttcatttataaagttgttcttccaragtagtagtattaacattgaatagtgtaaagcattcatgccattttattgtatcttctcttaggacatacagaagataatttggtccctcttgtcaatat

SEQ ID NO: 50136 - DNA, 201 bp, Homo sapiens
gagatgcagtgatctaaaggtaaaagtatcagaaaaaagaattgtccttttgctgattgatttgagggatgtgattatgtagtacattgatgctgactcaycctgagtaaaaaattcgttacattctcatttcctcctactaatatatggctgtggtctttcttacaaaggcctttaaattcaccaagtataagctctaat

SEQ ID NO: 50137 - DNA, 201 bp, Homo sapiens
accagcatcttcccaaccttctctcccaatgactaccccagcctctggtaaccaccattctaccgtctatttctgtaagatcaacttttctagattctacrtatcagtgacattgtgcagtatttgtttttctgtgcctggcttatttcactgaacgcagtgtcttccaggttcatccatgtggctgcaaatgacaggatt

SEQ ID NO: 50138 - DNA, 201 bp, Homo sapiens
gttgctggtataatgtactttgccatttctgttccctttctgaaaaagaattccttactaccaaggctgcgcaggtccatatgcaatgaccaagagtacayaaagataatgtccagttcagttcagttttgtggtgtgtttgtatttaaaatgtgaagtagcgtgtctatatgcattcatgtttatttgaacaaatgctgt

SEQ ID NO: 50139 - DNA, 201 bp, Homo sapiens
ttgttatatgctgcacttcgtccaatgcgttttttttccttcacgaacctaccctataggttggtttgttaccacataaaatttgcagtgtgtaggttggkttgttaccacatagaatttgcagtacatgctcagaggaagcttttgctaacttcttaattttcctagaggaagaacatggctcaaagagaaattttatcc

SEQ ID NO: 50140 - DNA, 201 bp, Homo sapiens
gtccacattcttcccaagtgataaatagtaaactcttcttttaatcatcagactgtatttatagtcttgactagcatccattcaataatattaatttgtcrtaaaagaatatagaatatgcatcattttgttagcctgtcagcactgcaggaaaatcagctcacacatatgtcatgaagaagatggtggtttcatgtccct

SEQ ID NO: 50141 - DNA, 201 bp, Homo sapiens
agaacagaagaagagtgctaaatggaaaggagagacgagtccatttcaagaaaaaaaaattggccaattcatcttgagaaagcttgagaaaaatgcaccthttcaatcagtaacgaggttttagagaatctagctctttaatctttgttttgatctgatttctgccttctgacactgcctacgtttatgccaccattcctc

SEQ ID NO: 50142 - DNA, 201 bp, Homo sapiens
aacaaattttgagtgtagcaataggggagcgtctgattcagactaaacatgtacctgcaaattagtcaagaaataatgagacaatctgttaccaaactctyggctttgccgttctctttctctggcactactacgaaccaagataaataattatacaatatgtaataaagccaccttgttaattgccacttaataaaaata

SEQ ID NO: 50143 - DNA, 201 bp, Homo sapiens
atcaactctcaagaagtttaggcaaggtgtgggatgaaggcaataaaatcataattataatatcatgtgctaatgtggaagaacaaattttgagtgtagcmataggggagcgtctgattcagactaaacatgtacctgcaaattagtcaagaaataatgagacaatctgttaccaaactcttggctttgccgttctctttc

SEQ ID NO: 50144 - DNA, 201 bp, Homo sapiens
actgttctcattgtagcgaccaagtataatcatctgacattttgcctctatcaaaagggacagcccgaaggaataagaagctcaaatacttacacactaayggatgtgaggcgcaatgcaacaggagactacaagtgttccctgatagacaaaaaaagcatgattgcttcaacagccatcacagttcactgtaagtcacct

SEQ ID NO: 50145 - DNA, 201 bp, Homo sapiens
ctttgataaggtggcatgtggatttggagagaatagaaaagagaaaaagaacaaatattttgaggagggtgaaactgatgtgtgccaccccaaatctttgwttatatattttatgtagcatttcattgtataaagaaataatatacatgtataaataattttttaaaaattggatttctagtttcagcaaatgcctttatg

SEQ ID NO: 50146 - DNA, 201 bp, Homo sapiens
cactagatacactttaattattctagaaggcagggaaattatttgagaattttcataatcctggggaaatatagtaaaaaataaaattttgaatatggacrtactatatcaagagcaaatagttgtgccaatatttctagaagcaaatgagtattaaacaatatcttgtttatctaaagctaataaaaatttagaaatggg

SEQ ID NO: 50147 - DNA, 201 bp, Homo sapiens
gtcatctggagctagtaatgcctcagatgacataagtggagcaactcagctctggtccatggttgcctctcatcatgaagcaggacagcctgagcttgttstcatagcgatgagcaaaggcaagtaagcaaaatgtgtaagtgctttctgcttgtatcccatttgctatccttacagtggccaaaggacagcataaggtga

SEQ ID NO: 50148 - DNA, 201 bp, Homo sapiens
agagcaaggaaaactgccttataaaaccaccagatgtcatgacaactctctcattatcacaagaacagcatgggagaaaccacccccatgatacaatcacygcccacttggtccctccctctacacatggggattatggggattacaatttgcaatgagatttggttggggacacagagccaaaccatatcaccaacataa

SEQ ID NO: 50149 - DNA, 201 bp, Homo sapiens
gaagaaggcacacatgactagcaagcccccaaaacagggagatgtcaaatgggctgcagttgtttgtgttcaaaggtgcagaagaatcagaaccatttctsacactgagcaaaacttcccagggtctccacagcttcccacatgttctctgttttacctggaatgtccttccaccactctccacctggctaactctttttg

SEQ ID NO: 50150 - DNA, 201 bp, Homo sapiens
ataaattttagcaagcatgcatccattataattacactggttttttactatgtaatttaccacagaacagaatacatatacagacagttaaattaattcaytagataggggacatataggaaagtcagcttcttatagttaaccaatccaaatatattcataaaaatatagatggaaaacttgattcaagaaatagtttcc

SEQ ID NO: 50151 - DNA, 201 bp, Homo sapiens
tttgctcaggttaatatgctttcaatggaaacatgtggaataaacagctgtcatggacatgtgccaccaaaataaaagctcttctcagccagaaaaacaaytgggaagttagtgaaccagtacatgctcataccttaggaaagcaaatacttttcactgagcccatagacaaaattaaagtctggaagaattctttttttt

SEQ ID NO: 50152 - DNA, 201 bp, Homo sapiens
catttttacactgtgataattatccccatttgctcaggttaatatgctttcaatggaaacatgtggaataaacagctgtcatggacatgtgccaccaaaakaaaagctcttctcagccagaaaaacaattgggaagttagtgaaccagtacatgctcataccttaggaaagcaaatacttttcactgagcccatagacaaa

SEQ ID NO: 50153 - DNA, 201 bp, Homo sapiens
aggcatttttacactgtgataattatccccatttgctcaggttaatatgctttcaatggaaacatgtggaataaacagctgtcatggacatgtgccaccaraataaaagctcttctcagccagaaaaacaattgggaagttagtgaaccagtacatgctcataccttaggaaagcaaatacttttcactgagcccatagac

SEQ ID NO: 50154 - DNA, 201 bp, Homo sapiens
cctcataagtttaaacagactggaaacaataaagcctaaaaagaaaatcatgcacatcaacaattttctttctatctttcaactttaattttcacccttayagccctaaaccactaatttgaaaagatttttctaaaagttcatctttctaatatatcataatatttctttttttctggccctggaagagattgagtactc

SEQ ID NO: 50155 - DNA, 201 bp, Homo sapiens
ctactctcatatcctgtgtaaataccccatgactgagtaaatattatcatgcaattttagaattagaagtttagatgttttgacctaaatgttttccaggkttaaaatatccttcttacagaacagtgatcctcataagtttaaacagactggaaacaataaagcctaaaaagaaaatcatgcacatcaacaattttcttt

SEQ ID NO: 50156 - DNA, 201 bp, Homo sapiens
gtaggaatctaggtgtgaggtcacacagccagactaaaatggtgtcggttaataaaaccatgtccagaaaaccatagatatttataagaaacaaatgataygttgatagactataataggtgaataaggggaaagagtaccttactttctgacttgagagattggcctccttcacctagtaaataaatcaaaatggaatac

SEQ ID NO: 50157 - DNA, 201 bp, Homo sapiens
ttgtttctttaatgaccaagatttcttttagatgagtattaaattctttgagtttgtaacgcaacacttgcaaatatttcgctagaaatttatacacacayatctgtcattttattctacaaattgatgttttctcattctataacataaggaactcagtatttaaagttcaaagcaatcaccactttaacaaactcttga

SEQ ID NO: 50158 - DNA, 201 bp, Homo sapiens
gtagaaaaaaaaagacttctggtcacaaattctgttactttcacaccaaaccccaaaacatttcaccgaatttcttatcttcctactctttcatttctacyattttctttctttcttacaaataaaccttccttatcaaatcccattttctgtgctttatttgagcaattgatacatcctactttctttagatatcatttt

SEQ ID NO: 50159 - DNA, 201 bp, Homo sapiens
tattatatatgatttaaaatgcatgtgataacaccatatagtttaggttatatgtgtatatttgtacagtatttcttctgatgttaaatttctgtatacaktttcttgtaaataagaatagaaaatagtgtctccatcttctctctacacatttgcacatctttccaatcttacagacctgggtgattgtgctgtaggcta

SEQ ID NO: 50160 - DNA, 201 bp, Homo sapiens
tagacccagttctaaacaaaagttctaccaccaactagcatagtgacacgtgaccttgtacaggttagtaacatctctaagttctccatttcttcgactgyaaaatgtgaataatgatattatttatctcagtgcccttgtgaggattaaattaattagtgaattaagtgcttcatacagtgactgatgtttgataggtgt

SEQ ID NO: 50161 - DNA, 201 bp, Homo sapiens
tgattaaatatttatctaaatttaacagttttagatgcttaagttttgcttgggttctattaatttgtgcatgtagttaagaaatatatcttgccattcargtagacccagttctaaacaaaagttctaccaccaactagcatagtgacacgtgaccttgtacaggttagtaacatctctaagttctccatttcttcgact

SEQ ID NO: 50162 - DNA, 201 bp, Homo sapiens
gaaacgggagatattgcaactgacaccacagaaatacaaaaggtcattcaagacgactatgaacacctttacgcacataaactagaaaatgtagaggagaygaataaattcctggaaacatacaaccctcctatattaaaccaggaagatacagaatctctgaacagaccaataacaagcaacaagactgaaatggtaata

SEQ ID NO: 50163 - DNA, 201 bp, Homo sapiens
ttaattaagtgagtgggaaaagggattccaggattctatttctgtgtctctgattcacggttttgaaacgacatctaacctcactacatgtcaattttctstcctgctgaatacagttagaaggaaaaaaaacacttctcaaaggtgtggtgctgtttcgttaaggattgtgattgtcagatgaaagaccctatcatcagt

SEQ ID NO: 50164 - DNA, 201 bp, Homo sapiens
ctctttatcacctttgtactcaagctttggcttttctgaactttccttattttcaaaaatgtcccccagccccacttccacccgagacattcacacacccmatttcctcttccaggaaggctcttatgtcgcctgggtaaacttactcttcaagtctagtgacttttttccagaagctttcctgatatctttccatttcac

SEQ ID NO: 50165 - DNA, 201 bp, Homo sapiens
ggcatagtactcttgaaggagaaactaagaatgttttgaccttttttttctgttcattttgactcttcattggccacgtaaattaactgcatgtattacawctattgagctctcagagagggtgtcactaaataactgatttcagtttccagaaaactttgacttacttacaccccaagaattttctttttgtttaaatat

SEQ ID NO: 50166 - DNA, 201 bp, Homo sapiens
tttgtgtgcatgctagtaactgaggacaacgtgtttgaggcacctacaatagtcaaggtgttcagtaagtagtctgcagcagtgtcactgctaagtgggaytgatggccagtaccagaccatgttctttagaaagaagactgaactctctgtagtgtctctatagcaggtatctatataaggggacttaaagagatcttca

SEQ ID NO: 50167 - DNA, 201 bp, Homo sapiens
tcggaattaatcatcagtattacaagcttgattctggcatttagccttaaaaatgtgttgatgctataggtcttttttatatttaacggtgttgattttttcccatatttcttgcagatagtaaaatcaaattttctcaggtatgaaggtacaagtgggtctgaaaatggagggtagagatcctggtagggagatgtggaa

SEQ ID NO: 50168 - DNA, 201 bp, Homo sapiens
cgtagacaaaaaatatagatattggtagaatatggccaaggaaatgttattttgaatgtaatcctgaaacatctgaatatgcttgtgtttaaatgtattaytattttaatttttaggaaaagcccgatggctccccagtatttattgccttcagatcctctacaaagaaaagtgtgcagtacgacgatgtaccagaataca

SEQ ID NO: 50169 - DNA, 201 bp, Homo sapiens
gcatttaaaattttgttctctctctctttctctcttcttccttttttttttcccccaaaggccttggatggtatactgtaaattcagcatatggagatacmattatcataccttgccgacttgacgtacctcagaatctcatgtttggcaaatggaaatatgtaagtgtgacctacctgggacttggttaattgcccttgt

SEQ ID NO: 50170 - DNA, 201 bp, Homo sapiens
atggtttaagataaaggaattaattcccacagtgaagaacagtgactaaatttataaataattaaattcatatatttattggtggaaagttggtgtttaamtagtcaccaattaattattttgaaacaagtatcatcaggccaaaatgttgactaaacctgagattctatttaaaaagaagagtttaattaacttaattat

SEQ ID NO: 50171 - DNA, 201 bp, Homo sapiens
aggcacctccaatacacggctgaatagaaatgttcagaatggacacctttgcatgtttccagtcttagaggggaaattgctcaatagttaccattatgtaygatgttagctgtatgtccctacccagagttagtcaaactgcagagttaagggtataatcctccagattacctagtctgcccaagaattctgactccacct

SEQ ID NO: 50172 - DNA, 201 bp, Homo sapiens
taccatacttctcctaacccattaatggagttgttaaacatcatataatattgaaagatatttctattagatgagctttcaattattaatggtaatggaaraacattaatgcagctcttacaacatgacagactgtcagaaagatctcaggaatagtgaagggccagagatcctagagtccctgatctgtataaatttgct

SEQ ID NO: 50173 - DNA, 201 bp, Homo sapiens
cagagagaagggtacactttcttcaagtgaagattctgagggcagaggcaaaagaaacacagagaaggaaatgaataccccttctcccatcataactcttytctctgccagtaaatttgacagaacttgggaaatatttgggtacagagatgtagaaaaataagtgaaaatggcttttcaatttttaattacccaacatgc

SEQ ID NO: 50174 - DNA, 201 bp, Homo sapiens
agtatttcttctcctcgctttccaggtgctatggtggttccaaactctatttcttttaaaccagtgacaccatgaacattatttatataaattgaaggcartggagacagaccaaaagtaaacagaaagtagaaaaaaattaaaagtcaaaacctagaaaatgaatggccctaggtgagtttgggtgagtttcttgttttt

SEQ ID NO: 50175 - DNA, 201 bp, Homo sapiens
tcatatcattttgaggagatctttgatctactttgttcttaatttttgtatgcttatttttttttgccacacttcattttgtgactccaattggtgtattkgtttaagaacctacctttacatagggatcccagaaaatcaagacagttagctcaaattgcaaaaactctgaagtctgaattcagtctgtgcgaccaaagg

SEQ ID NO: 50176 - DNA, 201 bp, Homo sapiens
gagaaattggccaaaacagaggggctgtaggccccatgcaagtctacaatccagcagggcagtcaaatcctaaagttccaaaattatctccattgactccrtgtctcacatccaggtcatgctgatgcaagaggtgggttcccatggtcttgggcagctctgcccctgtggctttgcagggtacagccaccctcctggctg

SEQ ID NO: 50177 - DNA, 201 bp, Homo sapiens
tgagcctcagtttcttcatctgttcttcacctgtaaaatagggatagtacatcaaacataagggctccagaaatatcagcagtcccctttcagcgtgcttkgtacttacatttaatgggaacaagtcttttgttcccccagcccccctctttttttcaattcttttaaagctgttgattctgcaggacattgtgtatgttt

SEQ ID NO: 50178 - DNA, 201 bp, Homo sapiens
atagaatagctaactttccttgagtccttattatgccccaggcacttttcttaatattactttcttaaagctcgaacaattctctaaagatggctcttatrtttgaggaaactgagactcaaagaggtttacttgcccaggttggacaaccacaaagtcgtagaaccatgaaaaaatagctggtgaggccagccacggtgg

SEQ ID NO: 50179 - DNA, 201 bp, Homo sapiens
tggaagcccccagccccctccaccatcacagcagtgtgggcagcgctggattgtgacagtggcctgaactgcggcagctggatttagcaaagccagggcayagcccagcgcagaggttcctcgctcctgggtgaagccggaaattcctggcaggttcagtggcgttgcaccaacgtgtcaagctgtgatctgtgctctctt

SEQ ID NO: 50180 - DNA, 201 bp, Homo sapiens
cattcagagctcataagtgtccagccctgaagccaggccttgtgctgctgctatggtggtcagttgattgctaacttcaccatcctcagccaacagtgacygagcagctgctgtcctcagccctgtgctggggatgagacagggattctgagttaaatcggacatgcttcttgttcccagcacagtctagtcccgtgcaac

SEQ ID NO: 50181 - DNA, 201 bp, Homo sapiens
cccacccgtacaacaagctctggagcctgggccaggacgacatggccatccccagcaagcccccagctgcctcccctgagaagccctcggccctgctcggraactccctggccctgcctcgaaggccccagaaccgggacagcatcctgaaccccagtgacaaggaggaggtgcccacccctactctgggcagcatcacca

SEQ ID NO: 50182 - DNA, 201 bp, Homo sapiens
tctagcttggcatttattttctttcaggatctttaaaatatcatctcattgtcttctggcttacattgtttctgctggaaagtcatctgtaagtcttatgsgtgttcctttaatggcaatttttttttcttttttttttttggctacttttaagtttttccttttcatttttaatttttagcagttgcactatgattagtg

SEQ ID NO: 50183 - DNA, 201 bp, Homo sapiens
ttctaattatataggtaagaaaaagagggctccatgagcgcagagattatgtcttgcttgcacttgtatgctttggtagctagaagagtgcctggcatacrttaggccctcaagtatttaatgattaaatcttagagctaggaagcaacttgtccaaagaacagagtgacagagttgggatttgaattctagtgtgactgt

SEQ ID NO: 50184 - DNA, 201 bp, Homo sapiens
agaccagacagtgaaggggggaaatgcctgacaagttcatttttctttcttggactgaatattgaagattcacttcagaacaatagcagaacacattgacrgcttgaaatcggtacccttgttgcctcagtttccttttaagaaaaatctaattccaccctatctgccaagctgatgtgattggaatcctgagacgtggtg

SEQ ID NO: 50185 - DNA, 201 bp, Homo sapiens
ccttttgagcagtgagtttgttgaatttttaaaattccctccacatgccaatctcagagcctcattttctcaactctaaaatggggcactaatagtacctrttttagttgaaagattaaatgggagtgcaccatgcatgggacatggaaagttctttataaatgggagctgttattttaacttacttttgtttaaagcaag

SEQ ID NO: 50186 - DNA, 201 bp, Homo sapiens
tagtaccttagatatagattgggaggtatgctggtgttattaaaaaatcagatgaactctataaacacccatttggaaaaatagctattttgacatctttmttttctttactttttggctttctcagttttgaagctacccaatgtattttgagtttaaattacatatattggtgaaaaaaaaaagttaacagtatgtagt

SEQ ID NO: 50187 - DNA, 201 bp, Homo sapiens
aagtgctgggattacacttgtgagccactgtgcccggccctcttttccctgttttgaagggaaaactttccacatttcacctttcagtaccacggtggctrtaggtttttttaattgagttttttgattgatttataactcacatatagtaaaatgaacaaatcttaagcatacagtttgaattttgaaacatgtatacac

SEQ ID NO: 50188 - DNA, 201 bp, Homo sapiens
ctctcatttgcttactagaaagcttaggtgcagaaaaatatataggctatttctttttcccagttaaataattacatcaaacatggaggcacattcaggamtatttactgctagtgaagctcatgatgacttttttttactaaccatttctgaaattcatgtattatgcctaaaaaagctcagagtaggtcttgggaatta

SEQ ID NO: 50189 - DNA, 201 bp, Homo sapiens
atattcgtcttccaagagatgatgatgcttttctctcatttgcaatgttttttgacagatcttttatttttcacttgctttcttgagtaaggagagctctrtctagatttgctgttttgccacaggtggttgaatgggttaccatgggcactgttctttgtgcttgcgagtgatggtcagatccccttctcagatctgtgg

SEQ ID NO: 50190 - DNA, 201 bp, Homo sapiens
tttccagttgcacaaggtcacagagctatcaagtgtggaatgaataaatttacatcattatgttatttaatcctctccataatcctatgaagtaagtattkttatcactgccctttacaaatgaagtgactgaagtcagagatgttaggccgtttgtgtggtggagctgcaactggagcccagatcgatgtgattctaagt

SEQ ID NO: 50191 - DNA, 201 bp, Homo sapiens
gtatttttatcactgccctttacaaatgaagtgactgaagtcagagatgttaggccgtttgtgtggtggagctgcaactggagcccagatcgatgtgattstaagtgtattttgtcttccatgctagtctgaccgcagcctcattgatagcacccctcacctctcaccttaatcacacgtgtagattcccttgtttaactt

SEQ ID NO: 50192 - DNA, 201 bp, Homo sapiens
gatgttaggccgtttgtgtggtggagctgcaactggagcccagatcgatgtgattctaagtgtattttgtcttccatgctagtctgaccgcagcctcattsatagcacccctcacctctcaccttaatcacacgtgtagattcccttgtttaacttctgctcattctttaggtttcagctcaattagagctctggctgaga

SEQ ID NO: 50193 - DNA, 201 bp, Homo sapiens
tgagagggaattgtcattgataagggcctctttgttccgggtcctatgtagacatcatctcattggaccctcaccacagccctgcaaggaggccaatggarctatcctcatcttgcagatgaagaaaccgagctttccaggagcacccttctgatttgaataggccacagaattccagttaatgtgtctgtctgctgccta

SEQ ID NO: 50194 - DNA, 201 bp, Homo sapiens
tttgacaatgtcattcatatctcatgaaaaactacctcagacaggttaaatgtgttaaaacatggaacgaaaaggatggaaggagacccagtgctgcctaraaaccttgatcttttgccaaagtatttaaacaatttagtgttttggtttcctagctccaagctgcttctcaaatcccttgctaattaatccagttaatgc

SEQ ID NO: 50195 - DNA, 201 bp, Homo sapiens
atacaccagcaagatgaaagaaaattttagaaaaaggagtcagctacagtccccttatatggcagcatgtcattttcattaattgttcattttttttttttacagtgccaatgcacatttcatttattcctgtagtcgcacagtcaattataaatagctttccatttgattgtgtgttatgaacattttgcaggtttctac

SEQ ID NO: 50196 - DNA, 201 bp, Homo sapiens
atggcatctgactgggatcattgatttttttgtttattactgcaagtaggacacggatcctcatgtagccatttcttccttttgttgtgttttttttttttctagtagagacagtgtatttcctaggctatgaaagctccagtagggtgggccttagttagaacctcactaacccattacattatattacagtagtaattt

SEQ ID NO: 50197 - DNA, 201 bp, Homo sapiens
tgattagatactttatcaagaaacttactgcacattcattttcccctttgttctgcctttgctgcagcctcacagttagccaagttggccagaacttcacrttcgtgctcactgacattgacagcaaacagagattcgggttctgccgcttatcttcaggagcgaagagctgcttctgtatcttaaggtaagggagaaggc

SEQ ID NO: 50198 - DNA, 201 bp, Homo sapiens
ctgccttaagctaataaaaagtttaagcctggacgttttcgatggttcatcctttatctctgacaaatatctgactgtatgtttcatgggagaacatgggyagctgaatttaagtaagtttattttgaaacctcacctttcattaaaagtaaaagaggaaacaccctatctcttatttcgttgtttctgacccagaaaact

SEQ ID NO: 50199 - DNA, 201 bp, Homo sapiens
tttacttttttaagtggttttaagtatattcacaagggtgattgattaccactaattccagaactttttcatcaccccagaaagaaaccccatgcctgttrgacactcctcattcccccaaacccttcagtcctaggcaatcactaatctacttgctatagatttgccttttatgggcatttcatatattaataaatagaa

SEQ ID NO: 50200 - DNA, 201 bp, Homo sapiens
aaattgtttcctaaagcagctgtaccactttgtgtaaagtggtattttattgtggttttgatttggcccaaatgagttacatagaaaagatcagtgtagayggagataggtttctaggaagaggttggaacttgaactgaaagaaaggggagatttggagaatggagggggattaccaaaggaagacaagtggaagttata

SEQ ID NO: 50201 - DNA, 201 bp, Homo sapiens
cgcccaccacagtcacaccagtgtggaagcccccagccccctccaccatcacagcagtgtgggcagcgctggattgtgacagtggcctgaactgcggcagytggatttagcaaagccagggcacagcccagcgcagaggttcctcgctcctgggtgaagccggaaattcctggcaggttcagtggcgttgcaccaacgtgt

SEQ ID NO: 50202 - DNA, 201 bp, Homo sapiens
taaatgttttaggaagacattttatatgtaaaacacatataattgccttctgtgtgtgtgtgtgtgtgtgtgtgtgtgtgtgtgtgtgtgtgtgtgtgtakagagagaggggggaagagaaggataaagccaatgtggtaaactgttaacattttgggtaatctgggtgaaaggtcggtggtaattctttctattattctt

SEQ ID NO: 50203 - DNA, 201 bp, Homo sapiens
ttcttataatttgtttttaatgtatctattacttgtctcaaatagttcagtaacattttttaggtcctcataccacccagcttgggcaatatagacaaagrtgagggtgacacatacattactttgtcattcattcatttgtttaaaaaaatattgcattggtcatatgttatttgacaggggaactcacaggcctataag

SEQ ID NO: 50204 - DNA, 201 bp, Homo sapiens
tttgagacgtcaagtggagatgttgagtagacagttagataaatgagtctagaattggaagagataggagctggagaaataaatttaaaattgatagtgcrtatttgaagtgatgggactgaaagaggaccagcaaaggaaagaaagtcaagtccaaggactgagttctggagctcttcaatagggagagatcagcaagga

SEQ ID NO: 50205 - DNA, 201 bp, Homo sapiens
agccagggataggtgagagggaacatcctccaggcagaaggagaagcagacacaagggagggtgtggcaagagatgaacctgaaaggcagtcttggaccakatcagagaggaccttataagctacatcatgaagcttaaaatgaatccttaggtcattggacagctgtggagaaagagtttgtaagggagggaagttatat

SEQ ID NO: 50206 - DNA, 201 bp, Homo sapiens
tcatctctgctcactccttgggtcctgaggtcactagctgttctgcttctctctctgcctttcagaaccatcttatgtttgtcttatatgtaatgtgcagrgttttttgttatttctaatgtagattttcttctgccattacacatatttttaaacttaaattttttgctgttatatcatttacatacagtaaagtacaca

SEQ ID NO: 50207 - DNA, 201 bp, Homo sapiens
tctggaggcacacaggtagaggaaagcttgcaaagtgttcgatggaatatttgagtgttggagaggcactgtgtgtgcactgtagtttggtactggctaargaaggttgagattccaggagagctactttttcagagctatgaaactttgggaagccctccctcctccctgaaccgcaggtttttcatttgttaagtgggg

SEQ ID NO: 50208 - DNA, 201 bp, Homo sapiens
ttaatgtcatgttttcgtagctcattgtggttttaatctgcatttccctgatgactgattactcatgttaagcaccttttcatatgcttcttggccatttrgatatcttcttttgtgaggtacctattcaggtcttttcctgtttttcactatgttctctgttcttttcttactgattggtaggcattctttatattattg

SEQ ID NO: 50209 - DNA, 201 bp, Homo sapiens
gaggaccacttcagcccaggagtttgaggctgcagtaggccaagatggtgccactgcattccagcctgggcaacagggtgagaccctgtcttttaaaaatrttgagcggattagtttaaaataatgactgcaaagtacatatgagcccaagaaatagggaggaggcgttggctgcatcggggggaggatggtgccttgagt

SEQ ID NO: 50210 - DNA, 201 bp, Homo sapiens
tgctgctttgctggttgctagaatctgaccaaagctttcccccaccccacgtctactgatattggacttggggtcaggggacagtgtgctagagagaattyttagtagcacctgtgaccagcatccagtcattcatcccttgtgcttttcaggagttgtttgtccatccctgttctgtcttgggccacttggcgacactgt

SEQ ID NO: 50211 - DNA, 201 bp, Homo sapiens
agggatgcatccagaaggtattttctatccttcttggtggtgggatggtcaggaaggagaagggaaaggtgacagcaatgacagttccagacagaggatcmggtggcttgtaaatgaagttccacccatacacaggggcagtgaagtagagcagttagaatgtgacacctctacttcctgcttacttgatcgtgggcaagg

SEQ ID NO: 50212 - DNA, 201 bp, Homo sapiens
ccagcatttaaggtagtgtagttagagaaccattaaattaattgaatatgggggagagaggagaagctgaaatgaaaggtgatgatatcaaggtttccaayttgggcctcataatacccttcatagacactggcgagtcaggagggagaactggcattgaggtcgagaaggatgaatttggttgattgtaaactaatgata

SEQ ID NO: 50213 - DNA, 201 bp, Homo sapiens
agtcctggctacttgggaggctgaaggggaagaattgcttgagccaggaggttgaggctgcagtaagctgtgttcatgtcattgcactccagtctgggctrcagagtgagaccctgtctcaaaaaataaaataaaaaataaaatgtatcatattatatgtacatatgagaccctcataactcaataagacaatccaataaa

SEQ ID NO: 50214 - DNA, 201 bp, Homo sapiens
atgtgtgagaaatataaataagcctttattctaacatttgtaagtagctttaagaggggatagaatgggaactgaaagtctgagtttgggcccagactacmagactttgattggaatgtggcccatgtcttgagtttgttgctaggtatgtagcctaacctccctgaggctgttttacccttgtaagatgggaacattaat

SEQ ID NO: 50215 - DNA, 201 bp, Homo sapiens
cagtgttgaatagaagtggcagaaatgaatattcttttcttcatccgcatcttaaagagaaacatttagtcttttggcataattatgatattaattatatsatttttttagatgccctttatcagcttgatgaagttctgttttgtttctagtttgtttaattttttttattatgaaaggatattggattttgtcagatgc

SEQ ID NO: 50216 - DNA, 201 bp, Homo sapiens
tagtaatacatgctataaaatgatgtgctggcatccaggctttgttccatttatagagcacaggcaaagtagatttagcgtaatattatacttaagaaccytaggattttcagaatggtcgatgagcattggtttgaatttaaagtcaccagctgcattagctcctaacaaaagattcatcctgtcctttgaagctggttt

SEQ ID NO: 50217 - DNA, 201 bp, Homo sapiens
aagggagatgcattttttataacaatgaatatttaatttccacatcacagatgaaaaagactctctgaagaggcatctgagggaagctccagagagcagcygctaatcagaaaagggccttctcgcgagagctcttccgcacggctcacttttttcttgaacttttttattttttatttcttcctgcttattggaatagat

SEQ ID NO: 50218 - DNA, 201 bp, Homo sapiens
gccaggccaagagcttagaggaccttcgtgcccccaaagacctgagggagcagccagggacctttgactatcaggtatggcatgggcaagggagggtatckgccgggggccggcactgtccgcacacgaggtgggatccccatgtgacagtggaagagactaagggagaaacagtgactttccaagaccctcagccaatgc

SEQ ID NO: 50219 - DNA, 201 bp, Homo sapiens
catgttgactttgtcaggctcatgtagagggaatggacagagctctgctcttagaattgtctggtgagtttctccagcaggtaggcattgcgttctgtctygaagtgtgtcacttactgttggtcccctcatattttgggtccatgtcattctcaccacttggatctttgagcagggaaggtgagaaacttgaggcctagg

SEQ ID NO: 50220 - DNA, 201 bp, Homo sapiens
gacttgagttcagatctctaactctgtaacgtattatctgtgtagcagtaaaagcaagtcaacgatttgagctttggttctgtatcttcttatacacatgraataagagttaccgcctcgcacggttcttgtggggcaggcctccacaagatgaggaatgtggagcgctgagcagagcacatggcatgctgttggggatta

SEQ ID NO: 50221 - DNA, 201 bp, Homo sapiens
caggtgtggtggctcacatctgtaatcaaagcactttgggaggtcaggcaggcaaatcacttaagaccaagagttcaagaccggcctggccaacatgacaraaacctttctctactaaaaatataaaaattagcctgtaatcctagttattcaggaggctgagacgcaaggatcacttgaacctggcaggtggaggttgca

SEQ ID NO: 50222 - DNA, 201 bp, Homo sapiens
ctagtctatatcaagaggtggattttcacagtcatcatcaaatcacccgttaacattgacatcttgctgtctcgtgtgttgttttaagatttttctttttsaaactaggacttaggaaaaataataaagccagtagcttttcaaaagaatgtgcttcctcatatattatctcattttatcctcctatcataagagataaga

SEQ ID NO: 50223 - DNA, 201 bp, Homo sapiens
gcaaaaactctgaagtctgaattcagtctgtgcgaccaaaggtctcggaagagggtgctcttgtaagagagatcagcctgcaaggtcccatgatcagatgrcactggccacacaaaaactctggaatgcatttcaaacacaagtgtctcattacagctggcatcttagcctgcagcgggcactcttcttgggcagatgctt

SEQ ID NO: 50224 - DNA, 201 bp, Homo sapiens
tttttttttttactttataaaactaatgtattaactatattaataaaataacaattattttattttcaaaaaatgtctactctttttcattacagttgaakcattagttttttacattcatttatttgcccatttgattgttgtctcttcagttttctcttaatggaaatttgaactatgaaactgtacatacattacatc

SEQ ID NO: 50225 - DNA, 201 bp, Homo sapiens
gcagtgagccaagattgcaccacttccctccagcatgggcaacacagtgagaccctgttttgttttgtattttacaaaacagaacaaaaaagaataggaamccggagctggagaggtagttcagaagtgaacacttgaatttgagagtcatttaccttgtgctgttaattgaaactaaggtataggtaaactgctaataga

SEQ ID NO: 50226 - DNA, 201 bp, Homo sapiens
agctaggtaggacaaaccaagacatacctttattaaatcccattttacctagagaggcttaaccagatgtgtttatgattctcatatttgagtgtatatcrgacatgatgcctctttgtgtagtatctagttttagcggtataacttgtaaagcgttgagaacattttttatcagagcactcttccaacctgccagatact

SEQ ID NO: 50227 - DNA, 201 bp, Homo sapiens
agtcactgttgattcttgggtttttcaacctcttgcccaaaaggctcactttccgtatttcttagtaacttggcagtctggaaacgtaggtggaaatgtarttttttcatctgcaggtataaactctcaatctctttagactattcggcctaagagctgattgttagcatgatagccacagggtgctctgctgaagcgggt

SEQ ID NO: 50228 - DNA, 201 bp, Homo sapiens
ctaccattgtggcatggttaccatatgcaacacagattcattttatgaggagttaatgttacatttttctcctaatctcatatattctaattgaggaaaaktagatcctaattaaaagctgatgatccagcagagtgatcaatagcatgatgccttgaaaaaaaaaacaaaacaaaaaacgccattaagctttgctgctgc

SEQ ID NO: 50229 - DNA, 201 bp, Homo sapiens
cgtgccactgacccacctctcccctctgcacttcccaggaggagccgatcactttctgtgaggaagccttcgtgtcccactaccgctccggagccatgagrcagttcctgcagaacgccacacagctgcagctcttcaagcaggtgcctccctccctggtctggcctgggtctggctccctggcggggatttctgcagctg

SEQ ID NO: 50230 - DNA, 201 bp, Homo sapiens
tcatggcttcaagctgagtgtacttaatctttttgagaacatggtcctggctgggtgtggtggctcacgcctgtaatcccagaactttgggaggctgagaygggcagataagttgaggtcaagagttcaggaccagcctgggcaacatggtgaaaccccatctctcctaaaattacaaaaatcccggacatggtggcaggt

SEQ ID NO: 50231 - DNA, 201 bp, Homo sapiens
ttgagcaaagaagtgacataacctgaacttcagaataaaaggattactgtctgttaatgttgtgatctgactctatagaggggcaaggaagaaagcagggrgacccatcaggagggtgctgcagtaatcgaggtgatatgatagtgatctatcaaggatggttgtatttgggggtgctgagaaacgttgagattctggatg

SEQ ID NO: 50232 - DNA, 201 bp, Homo sapiens
ctttctgtgaggaagccttcgtgtcccactaccgctccggagccatgaggcagttcctgcagaacgccacacagctgcagctcttcaagcaggtgcctccmtccctggtctggcctgggtctggctccctggcggggatttctgcagctgtctccactctaagtactgaggccgcaggcatggatgggactcaggccccag

SEQ ID NO: 50233 - DNA, 201 bp, Homo sapiens
gccagggaaaccacagacccctttcttttaactctttccagctttgcccttatggtaggttgtccttgagtcttttcccgggtccctggtttgatgggctsttgaccgtaagaagtacggtttctagagcacctactaccggcaggcatgagttttaaggacttgatattcttcccaaagaacagtctcttgagtttcatt

SEQ ID NO: 50234 - DNA, 201 bp, Homo sapiens
attgtttgagatagctatgcacgtgagataatatgtgaatatgagtaaattgttatttgtctttaagtatgtttaagtgcctttttccttttattcatgcycacattatcctaggaagaatggagaatgaaaacacagtgaatagtctgaattaagagttcaagcataataggcttgaagtatggctttattcattgtaat

SEQ ID NO: 50235 - DNA, 201 bp, Homo sapiens
tataatgttatccagttcttcagaaatactggtcctggcaagagggacccctgccttggcctgatgctttagaaggatctgctttgtccctcctctaccartgccctttccacagggcaaggagtctctggggcctacggaacatggtcacttggagactaaacccttccatcctagaccatgctttgagcacccagcatc

SEQ ID NO: 50236 - DNA, 201 bp, Homo sapiens
tataattgaattgtgccgccttctgaattttatagaaatggaattattctgtatgtagctctgctgcttttttgctcaattatgtttgaaagggtcttccrtgttgtgtgtaactgcagtcatagattttcattgctgtgtagtgtactatagaattatttcagaatttagttatccattctactgttgacctttgaagtt

SEQ ID NO: 50237 - DNA, 201 bp, Homo sapiens
cattctactgttgacctttgaagttgttcgcagtttttggctactataagccatgctactgtgacctttcctacgtatgaatcctggcacatgtaaacatmcatttccatatagaacatacttgattactgaatcatgccatacttttacaaaatggattgtgccagtctgtactcccacctgcagtgtttggtagtctac

SEQ ID NO: 50238 - DNA, 201 bp, Homo sapiens
ttaaatgttttaggaagacattttatatgtaaaacacatataattgccttctgtgtgtgtgtgtgtgtgtgtgtgtgtgtgtgtgtgtgtgtgtgtgtgtrgagagagaggggggaagagaaggataaagccaatgtggtaaactgttaacattttgggtaatctgggtgaaaggtcggtggtaattctttctattattct

SEQ ID NO: 50239 - DNA, 201 bp, Homo sapiens
gccccttgaagatttgtcttctctcatctgtttctattggcaaacagtctgttatcaatccagtcatcattcttttatgaaaaatccatcttttctctccrggaactctgaagatgttctctttcgccttatattctgtgattttaccctgctgcatctaagtagatttatttatcatacttgatacctagggctcatgtc

SEQ ID NO: 50240 - DNA, 201 bp, Homo sapiens
atcatctttcttgcttaatgtacttgggctcaaatcgaggatcacacattgcctatggttgttatgtctctttagtaccgtttcatgtaggatagtctctsttgctttttgttatgttttggtcttccaaggcatttacatttttgaagagtccagaccagttgtcttgtagcctaccccacaatgtgattatgtgactgt

SEQ ID NO: 50241 - DNA, 201 bp, Homo sapiens
tgggtcctggttcccatgcagcctttccatagaaatagaaggtgtgcttagaaggacagcttgcctggtttcagatcttggctctgctgctcacttgcagygtgacctcgaacacgtctcctcctttttcggagcctcagcattcttatctatcaagtagagtgactatgcctgtttcccaaggtagtcagagaagctagt

SEQ ID NO: 50242 - DNA, 201 bp, Homo sapiens
agcattaaggtcagaattgtaatgcaaaatgtctagctccaaagtccttgctcttaatcaccatactgtgtgggctctcggaggtgtttggtgaatgcttrtcatttctggaaactttcggctcaggcgcatgaagggggcacactcactcacgttgaggagcagcggcacagaggatggcattgctagcctgctcctctt

SEQ ID NO: 50243 - DNA, 201 bp, Homo sapiens
tcctaccttggatacagtaaggtgcccagctgaatggtttttcccccttttctttgtacgagctgttgtgcttttgttccttctttctatagtttattgayggtcgattagatcttctcaattccggcgaaggtttcagtgatgtttttgaagaggaaatcaacatgggcgagtacgctggtgagaagcaactcattttcc

SEQ ID NO: 50244 - DNA, 201 bp, Homo sapiens
ttccctccagccagggaacaggtgccaagcagagcactgagtctagagtctccttccatcaattcacactcctcatccccagtccatacacacccacccasagctcccaccgagagtccttctgtcatgaccataactgactggcagggaccagttatcatccaggcctatttctcgatgtgcatttacatacctttgaaa

SEQ ID NO: 50245 - DNA, 201 bp, Homo sapiens
cagcctgtgatgcagttccctccagccagggaacaggtgccaagcagagcactgagtctagagtctccttccatcaattcacactcctcatccccagtccrtacacacccacccacagctcccaccgagagtccttctgtcatgaccataactgactggcagggaccagttatcatccaggcctatttctcgatgtgcatt

SEQ ID NO: 50246 - DNA, 201 bp, Homo sapiens
atttttgtagagatagggtcttgccatgttgcccaggctggtcacgaactcctgggctcaagagatcctcccacctcagcctcccaaagtgttgggattayaggcatgagccaccgcacctggcctggaccctgattcttgatactatagttgggacaaattgccactcactcaaaagacatggattgttaaaaacatttt

SEQ ID NO: 50247 - DNA, 201 bp, Homo sapiens
gctcaagagatcctcccacctcagcctcccaaagtgttgggattataggcatgagccaccgcacctggcctggaccctgattcttgatactatagttgggrcaaattgccactcactcaaaagacatggattgttaaaaacatttttgtaaattttcctggctctgagtacttgacatgctagttagaaaaagtcttgttt

SEQ ID NO: 50248 - DNA, 201 bp, Homo sapiens
gtgcaatcacagctcactgaggccttgacctccagggctcaagcaatcctcccacctcagcctccccagtagctaggactacaggtgtgcaccaccacgcstggcttttttttttttttttggagagacaggtctcagtatgttacccaggctggtcttgaactcctgggctcaagcaatcctcctgcctcggcctcccaa

SEQ ID NO: 50249 - DNA, 201 bp, Homo sapiens
acattgtggagaaaattaaattctatatattgtagtatgcagtggaaattaagtaggtttttattttctactcatggacttgaatctaccagtgatcttaygcaaaaccaagggcaattgttgtgctttagctcaatccacaagtcttaaactaccacatagagattttaaatcccttatctataatacaaagcaatattt

SEQ ID NO: 50250 - DNA, 201 bp, Homo sapiens
ctgtgccatcaaaatgcagaaaataaaatctctgcagcctctttaagggtttttttttaaccttttaccgttgtatttgttttcatagccattatgttttygacttgatgatcccatttttccttcctttttctagtaatcagagaaggtgattctcgatggactgaaatcaagcatagtccctgctggaaacagaaaggg

SEQ ID NO: 50251 - DNA, 201 bp, Homo sapiens
tttaacttacttttgtttaaagcaagagtttatatctgtgtggaactctgctactcagcaactgttatcaaattgacataactgaaaaacagaaagtaaargtaactagacaaagtagatttctcagagtctatccattaaaacttaagttctttaatcacagaaaagccctcagcttatgccctgagtgcttcagtatgc

SEQ ID NO: 50252 - DNA, 201 bp, Homo sapiens
tattttgtatatttacatcttcagagtaagtaattttattagcatgagttgtaaaatgcaaattgtaacattaagggaactcttttgaagttagatagcartataattttgaaattagaatatattgcattctaagtgaaagcaaattacatgtatcttaaaactttacgtaaacttatggaatttttaaacattgtggag

SEQ ID NO: 50253 - DNA, 201 bp, Homo sapiens
aaaatgcagaaaataaaatctctgcagcctctttaagggtttttttttaaccttttaccgttgtatttgttttcatagccattatgttttcgacttgatgwtcccatttttccttcctttttctagtaatcagagaaggtgattctcgatggactgaaatcaagcatagtccctgctggaaacagaaagggaatcttaact

SEQ ID NO: 50254 - DNA, 201 bp, Homo sapiens
ctcagagtctatccattaaaacttaagttctttaatcacagaaaagccctcagcttatgccctgagtgcttcagtatgccgggaagatttctctgtgcaayattgctcagcagttactgatcgtgtcaatgacatcaatcattgcatcagtcaggatccttttcactggaagtgacagaaacccagtgaaatccgacttga

SEQ ID NO: 50255 - DNA, 201 bp, Homo sapiens
taggtacttctttacagaaaaatcgtagtaccatgattgaagtttgaagaagtttgaagactctacaattctagcaatcaattatgagccacttatttttrggatgttattttttaagattataaagatacactttctcattagagaaatttagaaaactgcagaaaagaaaagaaatctctcatcccaccatgctgataa

SEQ ID NO: 50256 - DNA, 201 bp, Homo sapiens
acttgcttttggcatgacctttatctgtggtctcaaacatagtcccctccattcgagctaggtctgtggttttggttctcgcctgcagctgtatgtgtgcrtgtctgaggtgtgtggatgtgtgtgtgtgtgtgtgtgtaacagagggaagaggaagatattctctcagctggcatagggcagaggggaaatctttattcg

SEQ ID NO: 50257 - DNA, 201 bp, Homo sapiens
gattcaaaatattctttccaaaaaagcagtgagataataatgaagcttggaaacatttataactaaaatgatttaaatcaagttttaatgcttaaaaatascgatcttcaggtttcttgaaaactgccatgtaagactgatttccccaggagtctacatgcccgaggtcttattatcacacttctaaatcattaatcacct

SEQ ID NO: 50258 - DNA, 201 bp, Homo sapiens
gactagttcctgccactgaagaattttactcctccttgagatttgccacattatttaatgagttcctggatgggagttgatactaaattaaaaacaccagmtaggagaacagtagttacggattagttagtctccatcataaacacagggatgtgagagcattttagcattttcatattgtaccatctgagtctgatgcaa

SEQ ID NO: 50259 - DNA, 201 bp, Homo sapiens
agttgaggctgcaacgagctgtgatcacgccattgcactccaacctggtcaaggagagtgagactctgtctcaatcaatcaatcaatcaatcagtcaatcratgtatgtatacagatcagtggtttgtagtctattccaactatctaatccactatccatctaatagatatatcaccaccactaattccagacacattaga

SEQ ID NO: 50260 - DNA, 201 bp, Homo sapiens
ttcaccctataaaacaggaactagacctcatgttttaaatgcttagaagactttttttaaaaaaacctttaggaagttacattctagcttttgaacttctkttggtattatttcacaacacattttgcatttccttctttatgttacattgaaaacatgcagtccgctcaaaggctttctttagaaaaagaaagctttact

SEQ ID NO: 50261 - DNA, 201 bp, Homo sapiens
agaaactttggtatgaactcttattaccagctaaccttggcagaaacctagtcgtaccaaacaagtcctattaacacaaatgccactataaatcaaatgcrttatttcctcccatggttgactagttcctgccactgaagaattttactcctccttgagatttgccacattatttaatgagttcctggatgggagttgata

SEQ ID NO: 50262 - DNA, 201 bp, Homo sapiens
aaagaaagctttactgaagatatcactgtgagcttgctttgcccagcagaagactttaataagttgctcaatttaaagacagttttcttacctttaatatrttcttagacattagaattttctgctatcacgaagccttatttgaggagaagatagatgcagataaattgctgtctagattataacaatgtccttaattat

SEQ ID NO: 50263 - DNA, 201 bp, Homo sapiens
tttacaataagaacctgtactccagcagctcagtcctgtcatacatggtagaaccgtgtttgaaatttcttctttctccctcttttcttcctttttatttkaatgtagtttgtacagtaaaaaggtgagagggaaaagaaacaaaaaccagacactgttctcatagaagtgaacctacactaacagcaaggtttttctctt

SEQ ID NO: 50264 - DNA, 201 bp, Homo sapiens
agacaccactttaggtagtgggaacagagtcaggtaccaggaagcattcagttgtgggtaacagaaatctggctgaaatgattatgaacttgattatcgakcattggaaggtcagaggcaggcagttcagtgattggctgattgagaaactcactgattatatcgcaatatcagagccaggattcacatccaaatctgact

SEQ ID NO: 50265 - DNA, 201 bp, Homo sapiens
gactctgcctcaaaaaaaaaaaaatttaaaaagatatgaggacccagcccagctctggggatggaatctgaaagagtcagcctcatggaggaggagggagkcatgaacaaattgggggttctgttaggctagagagaggagggaatgagggctgggtgggcagccaacaatagtgactggagacagatgatcccctccttc

SEQ ID NO: 50266 - DNA, 201 bp, Homo sapiens
agctgggacaacaggtgtgcaccaccatgcctggctgatttttgggtttttattttttattttttgtaaagacagggtttccccgtgttgcccagactggyctcaaactcctgggctcaagggatctacccacctccttcctgggctcaagggatccgcccacctcagcctcccaaagtgctgttactataggtgtgagcc

SEQ ID NO: 50267 - DNA, 201 bp, Homo sapiens
tttgacattttctttttccttcaacttttcatttaaaaaaattcaaacctatggaaaagttgaaagaatagtacagtgaatacccatttacccttcacctrtgttcactgataattaatgttttacaaatgtgcgttgtatttctaaatatatgcacactgtgccttttgttttgtttttgttttcattttgtttgcttta

SEQ ID NO: 50268 - DNA, 201 bp, Homo sapiens
gggttaccatgggcactgttctttgtgcttgcgagtgatggtcagatccccttctcagatctgtggctgaagaactggtttatgttcattgttcctagttraattcctagtaactagcaggcatttgcaccacgaaggtagaactttattgccttacagaataagctgaaatttctagagtgcattctgttagaattattc

SEQ ID NO: 50269 - DNA, 201 bp, Homo sapiens
tgttttatttgatggatccaaatctgttaatatccttactgatttggatgctcagactgccccagatttggccagtggaagccctttcaggcttgctcccrtgtcccttcaatgtatccccatcattctttgagcacttctttgcttcctggcacaaaaaatgttccaagttcatctagcacgttccctgtcttagtgcta

SEQ ID NO: 50270 - DNA, 201 bp, Homo sapiens
ccatgtggctcggtgttattcactctgatccatatggtcaggctggagatgttccctggaggggtgttaacactcagcaacccaaccgcctccctcccttsagagctttcctgcatggctcctgctgcttgcccatgtgtgattcttgattaatttttcatttttaatgaagtttgatcatgtttattatttctcatgatt

SEQ ID NO: 50271 - DNA, 201 bp, Homo sapiens
accaagttttgtttccccttctatgtggacaggtagtgtcagattttcaaactttactagaaaaaaagtatcaataaacctgctatagaaaataaaaaccrtaccattcttaacattctgtctgtttaaccatgatttaagatacctgtgttccaaggagagttgcaatattctcccttcctggggtttttattgacactg

SEQ ID NO: 50272 - DNA, 201 bp, Homo sapiens
tacatttgaatcaactctgagtgtagcttgtgccctaatctcattccttctagaagttggtgaggagtttaagtacttcctactttgtgttctggtcctcrtagtgccatcctaattttcctggggatcatacatttcgtaattcaaagtaagcaaactggacacggtgccttggttatgcatggaaatattttctgtagt

SEQ ID NO: 50273 - DNA, 201 bp, Homo sapiens
tctttatgtttgaggcatacgtggtgtcttttgtcaaaccctacatgaatatcaaacctatttctgtactggggccagcatctccccagccccctcagtcrtgtgtgcccagacctccctgcaggtatcttactaagggctcagccttgcttttgttacttaggccttttatttctttcaggaaaatcagtggaatgagct

SEQ ID NO: 50274 - DNA, 201 bp, Homo sapiens
gctcctttaaaataagaccagttaatactactctcttatttgtggacttctgtggccaaatctttggtactgccttttttcgggggtgaggggtggtggaygggaaggaaggtagaggaacagagagaggctgactgtgccaaagataaactatgttacagatggaaatgtttttttctaagtccaaaatctataagaaac

SEQ ID NO: 50275 - DNA, 201 bp, Homo sapiens
aggagtgtctgtccatctcagcgtggtaagtggggcggagtattagccatcactgaaaacgcatttcattattgacagtaagagggagctagctgaacagkattgtattttgtcagccatacctcccctaaccctacccccaaatactctgagacctctgagttcaagataggccagagagtagaatttcttcctttctct

SEQ ID NO: 50276 - DNA, 201 bp, Homo sapiens
aatggaatgtatataatatactttatgggtgtcagatgaagaactcttgttggagctagtgtttaattaaacccaatggcctttaagaattaaaaaaaaawttttttttattaggaattagtacgttagagcttggaagtagcttatgttcattccttagcggttgggacaagaattttgcttttgctgaaagagcctgtg

SEQ ID NO: 50277 - DNA, 201 bp, Homo sapiens
cttttatggcccagtgcattatgagaaactctattgtgtggtgccgagcactgtaaagcggaggacataggctttctttcatgtactgctgttttgttccrcatgcttaggcattattagcagatacaactgagtaagctaaagcagcagagatgaagtataggtgtttattaggcaatgcactggggaaatgggaagctg

SEQ ID NO: 50278 - DNA, 201 bp, Homo sapiens
gttttagtttttcagttgtccatggtatatttgtctaggttgtctaaaatttgttctaagggcttattgacctacctcagtttccctaaagtatttagagrccagagacaacgtaacgttgcagattaaaatgagcataaagttaagtggccaccctcacttagctcaggcgtgcaccttctctttcctagctgattacca

SEQ ID NO: 50279 - DNA, 201 bp, Homo sapiens
attccattttaaagataaggcaactgaggctgtgcagttgcagagccgctctttaggggctaatatcaaggttgatgctcttcctgctacccatgctgttyccaatgctgcccacgttttgaaattcttctgaagtttctaggcttgggaacaaaatgtcatattaggatttttgttgtgaaaggaaatgtaactatgcat

SEQ ID NO: 50280 - DNA, 201 bp, Homo sapiens
cagttgtccatggtatatttgtctaggttgtctaaaatttgttctaagggcttattgacctacctcagtttccctaaagtatttagagaccagagacaacrtaacgttgcagattaaaatgagcataaagttaagtggccaccctcacttagctcaggcgtgcaccttctctttcctagctgattaccatggcctcctaac

SEQ ID NO: 50281 - DNA, 201 bp, Homo sapiens
cgtaacgttgcagattaaaatgagcataaagttaagtggccaccctcacttagctcaggcgtgcaccttctctttcctagctgattaccatggcctcctarctggcctttatgctttccttcacatccatatttaatgctgtcatctcagcaatcttttaaaaacacagctgagaccacaatattccctttgtaacacctt

SEQ ID NO: 50282 - DNA, 201 bp, Homo sapiens
aatattccctttgtaacacctttctgtggtcctctgtcaccccaagctaaagtcaagctcattagcagggcaaatgaggtcttccatgctccatcctttcyctatccagcttcatcttagtccactcctctcctctccttttaaatatgcatttcccaatatgtctcaaccaaatttcatacattttttaaaatttccata

SEQ ID NO: 50283 - DNA, 201 bp, Homo sapiens
tggatgataaattctccaagtaagatctcagtcacacttggtttctcctattgcctacagactgatcatttctcagcttgtgtctttggccctgacttccragtgccagacctgggtcctcagctctctgtccgtagctgtttctccatcctacatgggcatctcaaattgaatttaacctcctcccctcgaccaaccttt

SEQ ID NO: 50284 - DNA, 201 bp, Homo sapiens
aaagttacagaaaagttgtaattgcactgcaaataattttttcttctgcacaatttgggaataagttactgatctcaacctcgactacgtcagtcgactaygtcgactactgcaaacaaggtgattctcctgcacaaccacaatgtggtatcaaagtgaggaaattaacattgataccgtactaccatctaattctcagtt

SEQ ID NO: 50285 - DNA, 201 bp, Homo sapiens
ttcactctcctctgtgggcacccttgtcacaattgggttctgacaccctatgttagattactctagacagtgtgggcgctcttctcgcactggttgcactytgagtccccatattgtgcaagccctcctatgtggatgccatccttacctactctggactactgtggctacttctcaccaagtatggacgtgtacctcgac

SEQ ID NO: 50286 - DNA, 201 bp, Homo sapiens
agagtcgttgacaggactggcgagcccctgaatcctgagcgcgctctctccggagatcatctctgtgagaccccgcggcaggtgctgcggcttttcttccmggacccccttcgatcctgagcaccccctcatccccctcgcaggtggcgcctctggagggcaagttgtggggcacccagaaacctcactgtggagtctgcc

SEQ ID NO: 50287 - DNA, 201 bp, Homo sapiens
tgtgcctttaactgatacactgaaaataatggtggctatgacttagtagtgcttattttataccagtcattgttttatatgctttacctatattaactctyttaatcatcacaaaaaccctatgggatagatactgttactgtctcaattttacagatggggaaaccatggcatggcgagcttatgtaatctgtccaaggc

SEQ ID NO: 50288 - DNA, 201 bp, Homo sapiens
tatacacagatgaacaagtatgtgtgtattttttcttattcttcctggagcccataagagattaattattgtcctcattttataagtgttacaaaccaacrcacagaaagatgaagtaacttgccttaaggtaatacagctagtaagtagtggattgttgattcgattctaggtctgtactgtgctgcctgtgtctataat

SEQ ID NO: 50289 - DNA, 201 bp, Homo sapiens
  misc_feature (1)...(201): n = A,T,C or G, or insertion/deletion polymorphism (see Tables 1-2)
acaaggttttgcatcagtatgggttggttaaaagcgtaaattctggttctggtacagccagtttataagctgtgtgacgataggatgtacaagttgtttcntatttttaatttataaaatgggattattaatgggtcccatcatagaggtttcataggaggaatgaaagaaatagtacagtctttttgccacaacatgtgc

SEQ ID NO: 50290 - DNA, 201 bp, Homo sapiens
acaacttttatttgtaagataacattaaaaattatttataaaaatgtatacctgtatacatttttctgtatagaaatttgttatatgcagtaacattttaktatttcctcaaatttgaaatgaatatcatgtgatattaagtcacttaaaaattctctaatatgagatatgaaaaacttagactcaaactataatatattt

SEQ ID NO: 50291 - DNA, 201 bp, Homo sapiens
  misc_feature (1)...(201): n = A,T,C or G, or insertion/deletion polymorphism (see Tables 1-2)
tttgtccatttcatatatctaattcattggcacacatttgttcatagcattctctctctctcttttttttttctgctaaaccagaaaacctagacaaattntgaaagagctgtaacattaatattttcttgctcctctgtatttctgcaaatatggtcctcatggttttttcttttacttctcacctctcatacattgtac

SEQ ID NO: 50292 - DNA, 201 bp, Homo sapiens
tctcacctctcatacattgtacttgcagccactgcaaagtaattgtcattttcagatgctgtttctttgtctgaaatgtcttttctcttgcctcattggargaattggcatttatcttcaagataattttcttcatgctgccttccctgattgtccagacagactcagtctttccttcctttgaattctggtgtacttcta

SEQ ID NO: 50293 - DNA, 201 bp, Homo sapiens
agtcactcccctcccagtgtcctcacttagaaagtagtggccttgccaagcgcagtggctcacacctgtaatcccagcactttgggaggccaaagcgggcrgatcacttgaagccaggagttcgagaccagcctggccaacatggtgaaaccccatcattacttaaaaactacaaaaattagctgggcatggtggctcaca

SEQ ID NO: 50294 - DNA, 201 bp, Homo sapiens
tatcaacagcaaaggattgttttcctgtacacagttcacatttatgaatggcttcctaggcactgagcactgtgcttggtgacttcatgtatccttccagyttgtcttcattgcataaggtctggcagaggatttttgcttttcagattgtcacctcaaaatttccattgtctccacacaaaagcttgcacatgaatcttc

SEQ ID NO: 50295 - DNA, 201 bp, Homo sapiens
ttaggctcagtatcaacagaatgtaatctaatttctccagattggagtaaattcgggccttctgaccggatgagaattagaattggatgaagtgaatccaragtagactgaaatgaatcttgagttcatttctgaatttcatttgcaagtgtatccagcgttaggtgtgttaatttcatattttggttcatactctgaggc

SEQ ID NO: 50296 - DNA, 201 bp, Homo sapiens
attcctcctcatagtattgttgtgaggatgaagtgagtttcttatatacttagcaagtgtccagaacacagtaaagctcagtaaatgatgactgcttttaygattctgttgtgacccttatgtgttgaataaattaacttcttttggtgcttgctgaattgtggaggaggtagattccttttatctattttcttttggcaa

SEQ ID NO: 50297 - DNA, 201 bp, Homo sapiens
aggtctcactttgtcacccaggctggtttcaaactccagggctcaagtaatccacacacctcagcctcccaaagtgctgagatgacaggtgtgagccaccrcgcccagcctgggtatttcttaagattcagaagggctttcccagatgctctcctggtgacttctcctccagtgccattgaccagaattgagtcacatgcc

SEQ ID NO: 50298 - DNA, 201 bp, Homo sapiens
tctaactcatgatctgctcattaaactgaatgaagctctggtccccttccactgagcagcacatttaaaaaatcaggtatgcaaactaaaaacctactgcyttcatcctggtcacctgccttcctgctcaccctctatattcaatatatcagaaaaatttgattgatttacctaaatatctttaaaaactaggtatttctt

SEQ ID NO: 50299 - DNA, 201 bp, Homo sapiens
ctgaactcaggtgatccacccacctcagcctctgaaaatgctgggattacaggcataagccaccacaggtggccttttttttttttttttttttttttttkgagacaggatcttgctctgtttcccaggctagagtacggtggtagtcaaaactgcagcctcatgagctcaggcagtcctcctgcctctgcctcccatgta

SEQ ID NO: 50300 - DNA, 201 bp, Homo sapiens
tggtatgaattttgggtatttcttaacattacttattatttcttgtaagccaattctctttctatcttttttctgggactcccaatgacatacaagttagrcctagtcacagtagttcatatataacttactctcccttctctttttcagtgttatccatttgggcttaatctggatatttttttctgacctatctgttca

SEQ ID NO: 50301 - DNA, 201 bp, Homo sapiens
gaacaccactgtcccgccttcagagaactttcaatctattgttggcaagtgattgcgagttaaaggtcttgttaccccactctggatttgagtggtactgkggtttagagtgtaagagcttaagttttggggtgtttctagatctgagattaagtcctggttctgctcctttgtcagattctccctactttacctctctga

SEQ ID NO: 50302 - DNA, 201 bp, Homo sapiens
gaacttctggttttaacctgaatgtaattggggagaactgatattagaagaaatggaagggagccggcatgggtggtgtccctcctgtgtgccaggcagcrtactagacacttcccatgcgttgtcatttcttacacagattcactgggcagtgggtcgggataggtcgggggatggtagcatccctgttacagatgaggg

SEQ ID NO: 50303 - DNA, 201 bp, Homo sapiens
acgtctttctttctttctcatattgagcaaagttatttcagtctgtgaaataactgtgtctgaggccagtattatttgaatcccttctgggtctgtttctrttgctttgaatctctgttgtcacctttcttttgtccctgtttacttcgtaattttttattgagtgccaattgttgtatattcaaaaccaggtatatttta

SEQ ID NO: 50304 - DNA, 201 bp, Homo sapiens
ctcttattaaattttattgctttagtgactttataggctttagtattatcagtttgatagaaagccagtgctatacagatatataaaaactcagattatayatggggacatagaaagccagacccagacaaaaggaagccaaagcgtctaaggattaagacaataatagttatgattgtggtagcttggtaagtgatttca

SEQ ID NO: 50305 - DNA, 201 bp, Homo sapiens
tttaaggcccaacagtaagcaaaactaaacattatttgagctacatacatgtgtggtaaaactttgaaattctcagaaacagaattgagaaaaagtcttaktagggtcagcaggaagaggcaagaggaggcagtggaaaaactcttaagacaatgtgaggaagacgaaaatgtctgtttctttaggagggtaggttcgcag

SEQ ID NO: 50306 - DNA, 201 bp, Homo sapiens
aaataactgtgtctgaggccagtattatttgaatcccttctgggtctgtttctattgctttgaatctctgttgtcacctttcttttgtccctgtttacttsgtaattttttattgagtgccaattgttgtatattcaaaaccaggtatattttaaggtctagggtaatattatcctcctccagagaggatttatattaatt

SEQ ID NO: 50307 - DNA, 201 bp, Homo sapiens
atcacataaatgcatcataattcgtttaatcagtcccttataagacacttagtagtctaaatagttttgttattacaggttgaacatccctaatctaaaartttgaaatccaaaatgctccaaaatgctgcagaatctgaagccttgtggtgctgacatgatgccacaaatggacgattccacacatgagtacttaacaca

SEQ ID NO: 50308 - DNA, 201 bp, Homo sapiens
cagaggtggtgttcgtgaggccagaggccagggtcacttgaccacagctggtccctgcgggtctgtgcagtgggtgcttgagtcagggaggaggtgaaccrttgctagacagcccacccaagcagagagagcgtgaagagatactcaaacttttcccttccactttcctcctcctaatctctcgctggtgccttgcatggg

SEQ ID NO: 50309 - DNA, 201 bp, Homo sapiens
gcccaccgcaggtccttggtatatgttaggttaaagagcaaaacccatgggtattggtgtttgaagacgcgtcctcttctgtgccagtgtctgtggaaagrccagtgtagatggagcactatgggagctgtttattcagctagcttgtgtggccctctctgggccaacctgctagctgggcttccctaagataaagggaac

SEQ ID NO: 50310 - DNA, 201 bp, Homo sapiens
gtgacccttgtggttcccaaccctggccgcggatcagaatcacggagggatgaggagcggggggggggcggcttttaaaaaggcaaatgtccaggcccccytcagagatttctgtcaagttcctgtgatctgaaatcagagccaaggcccaccatcttttcctagtgctggtctttaaaaaaaaattattttactattgta

SEQ ID NO: 50311 - DNA, 201 bp, Homo sapiens
atcattgacagtggctgagcagagcctatcaggtgacccttgtggttcccaaccctggccgcggatcagaatcacggagggatgaggagcggggggggggsggcttttaaaaaggcaaatgtccaggcccccctcagagatttctgtcaagttcctgtgatctgaaatcagagccaaggcccaccatcttttcctagtgct

SEQ ID NO: 50312 - DNA, 201 bp, Homo sapiens
ttctatagtatatttctaaaagttgagttacctggtcaaagggttagtacacatttttaagatgtttataatgtaatacctaatcatattccagagagctrtatcctttatattccaactaggaaaacatgagaaatttaagttaacgttctgaggtctctgagggaagttttcaaaaggggactcccaaaataatttaac

SEQ ID NO: 50313 - DNA, 201 bp, Homo sapiens
atggtatctttgaatttcatactctaaatatttgtggatgtgttgaaatacagttaaattttgaaacctgacgtagtatccagcacatttgctaagctgtyttattgattccaataatttatctgtagatattgtatttttttaaacacaatcatgttgcctgcaaataatagttttatttcctcttctaatccttatgcc

SEQ ID NO: 50314 - DNA, 201 bp, Homo sapiens
gcagccttccgcttccctgtgcttccccttccatcctggagcactccattctctctgctggagatgcctttgtttgtaaagccaggctcttctcatgccasatggagactagaagggtgggattgtccaaagccatcacttggtgggggctgaaaaaggcatgagaggcttcctcctctgcaggaaaccagccaaggagag

SEQ ID NO: 50315 - DNA, 201 bp, Homo sapiens
acatcaaagatcattgatcactgatcatcataacagatataataataatttaaagagtttgaaatattgcaaaaaattcccaaaatgtgacacagagacakgaaatgacttgctctatccagggttgtcatatactttcaatttgtttttttttttttttttttttttttttttaaagcagtatctttgaagtgcaataaa

SEQ ID NO: 50316 - DNA, 201 bp, Homo sapiens
ccaccttcttggcctcccctcaccagccaccccaatctttgcatgcacagtcctcagcctttagtgaacctggttggtccctgtggcctccagcatctgtrctattctattttctcacctataccgctcctcggttggggtctggcctgtctcctgccaactttgacatttcaccttctgtgtggccctgctgtcccagca

SEQ ID NO: 50317 - DNA, 201 bp, Homo sapiens
ggatcaattgagccataacacatttcatcaggaaggtgaaacttgaactgggtctgatgagtaaggtttgggaaaagaaagaagggagcatcccttcctasagtgagggtggaggtaactgaggaagcaaaggcttggagacagggcccctcatagccagtgagtgcgccattttctttggagcaattgggtggggagatg

SEQ ID NO: 50318 - DNA, 201 bp, Homo sapiens
caagtcctctcgccgagtctgtgtagaggcagccagtcatcaggggaaggagtgagctcaccaggctgctaggaaggaccggagctggagaaccagaggtrgtcaggtgagctgggggggttcagggcaggagaagggttgctctgtcatcctcatcccagaaggacacccagacggtccttcccatcagacggcagttga

SEQ ID NO: 50319 - DNA, 201 bp, Homo sapiens
attagaagaaccgtgtcagaaaggattccaggtgactttggaaattttagttgacaaggatagcacaatgggctaagaatacctgcttgttttagttttcrctactagctgtgtgacctcatactagtcccttaacctctctgggcctcctgtttcctgtctctgtaacagggaaataatccttctctaacttgcctcacc

SEQ ID NO: 50320 - DNA, 201 bp, Homo sapiens
gccaaagtcactcagcaaaccagctaggcctggagaccctgcggtgggagcaggagggccctgcacacaatcagatgttctagtgtccgaaatctgagacygcttcccacgggattactgtctaatccgctggtgacaatccagctgctcacctgtccccagcctcagctctggtccccagggcctgcacactcctggcag

SEQ ID NO: 50321 - DNA, 201 bp, Homo sapiens
gacaagaggtcttcagaagtcctggcctaagtggtcacaggggcatcaggagcccaggaccacttggctagtttcagaccagctggggcaggcaggaaggracacactcgtatttgctcagttacaatcaacgactccttctttgtgtaaaatggtaatgaggccattaggagaggctcacctgaagtgcagcgttgtgaa

SEQ ID NO: 50322 - DNA, 201 bp, Homo sapiens
atctggagaattgacatttggtgtgtttttacatgtgccaggaagtttaagccaaaagtaatttgctgagcacctattaggtatcaagtactctactagamcctatggtaaacagagaagtgagtgagctgataacgacagccggtgtgctgtggatgtgaggcggggttttaccagagatgagattgcggaggtggatgg

SEQ ID NO: 50323 - DNA, 201 bp, Homo sapiens
atcaaagtgattggatttggatttttccaagattactaggacagatatgggtgaatggcattgaggagaaactgaaggcagaagaaggcccactgaggaamccgctccactagtctgggccagagagggtgatggagctgaatttgcagggccaatgtcatgggcactgagaggagaggatggattcagggcatatctggg

SEQ ID NO: 50324 - DNA, 201 bp, Homo sapiens
tgtaggcgatggactgggagggggagaggctggaggcagggaaacctgctgatggtaatggttgctaatgtctgttggtggcactgtgcaaagaacctgaygtccatcatctcgttgaatcttcctaacaggacactcgggtaggcagtgctgttacctgtacttcacagatgaggacagtaaggcttggaatggtcaaat

SEQ ID NO: 50325 - DNA, 201 bp, Homo sapiens
cacaccagccacatttcaagtgctcagtagtagctagcatattggatggcattggatagaagacagattatttccatcactgcagaaagttctgttggacratgcagaattctaggcaggggggcaatggtgggtgagagcactccacaccggaaataacctatgcaaaggtcctggggtaagggggaggccagtgggact

SEQ ID NO: 50326 - DNA, 201 bp, Homo sapiens
atggttcccccgaagtagaaaggccaagcataagagaagcagtattgtggggagtggtgtaggagagctgggtgtctagacagggtagcagcctgtgcacyggtggagggggtgggctcccctctccctgatcacctcttcctcttgatgaatggtgtgaattgaggggtgggggggctgttcccctttaccccacacact

SEQ ID NO: 50327 - DNA, 201 bp, Homo sapiens
aaggagctttgtagcctggcacctgtggctggagttcagatgttacccgaagatttgggttttctttttaaaaagaagaaaaaagaaagagcagaagaaamccatgccagtgtctcctggacgaaggggcatgggttggggcctgccagggaaaggcaggctgccgtcggcctgcgtgtgaagcactttataagctctgta

SEQ ID NO: 50328 - DNA, 201 bp, Homo sapiens
gaaaataataacaagatatatgaaaaaaaaaatttaggaaaaattcggcaatattcatgataagaactcctagaaaatgaagtattctcactgtgatagasagcatctagaaaagacctacagctcacatcatacttaatggtgaaagactgatttctttcccccgagaatgaaagaaaggtatctgctcttcttatttct

SEQ ID NO: 50329 - DNA, 201 bp, Homo sapiens
atttaaaacaccttttgggaaaaggcaccctgctcccagccaggagtccaccaggtcatgtccaaggcccagctccatcatatcgtctctgaactaactgrcgccttaattatttaaataacggcgagggctcgcttccttagcccatgaccttagaagtcagtacaggcctttgtgtgtgtgtttgaaaagaaactagcc

SEQ ID NO: 50330 - DNA, 201 bp, Homo sapiens
cacaggcttggagtcccagcacacgtgggtcctctgctggtaacctgggggagccctcagctgttccaagtccgaggagctgatcagccacacaactaggmccagcacacattcagcacacagaagtggtgtgggaatgggcacacatatgtcccaactcagcccgtggtcactgccgccctccttccctcccaacagagg

SEQ ID NO: 50331 - DNA, 201 bp, Homo sapiens
caattttgacaaattaggtaaaatgaacaaattccttgaattacagaaagtgactcaagaagaaatagaaaaatggcactatttctattaaagaattttawatctgtaaaactttcccacaaagaaaaccctaggcccagagagcctccctggtgaattctatcatatatttaagaagaactaacacaatcttatcaccaa

SEQ ID NO: 50332 - DNA, 201 bp, Homo sapiens
tcacttctgtggtattctttccaaaaatccactctaatcatgcagagacttctgagaaattcaaatttgggaacattctgcaacaggggtctccaaccccygggctgtggattggtgccagttcatggcctgttcggaacccagccatacagtaggaggtgagcagcgagtgagcatgaccacctgagcactctacctcct

SEQ ID NO: 50333 - DNA, 201 bp, Homo sapiens
gaggcggaggttgcagtgagccgagatctcgccactgcactccagcctgggtgacagaactagactccatctcaaaaaaaaaaaaaaaaaaaaaaaaaaamaaaaacaggcacccgaacccacaggagccaggaagaggacaggggacagccagctttcatctgcatgttaggttccacataaaatatcctaggagttaca

SEQ ID NO: 50334 - DNA, 201 bp, Homo sapiens
acctgggaggcagaggttgcagtgagccgagactgcgccattgcactccagcctgggagacaagagtgaaactccgtctgaaaaataaaaatataaaaaasgctagatgcacttcccactggggctccactagaggtaagggttgacccaggcgctgcctctccatctacccagtggtgccctgggactcaggtccatggg

SEQ ID NO: 50335 - DNA, 201 bp, Homo sapiens
tgtgtgtaataaaatccaggcaagtggtgggtggcagaccgcaggggagtagctgaattgggttaatgagggaaaaggtgctttttttttttttttttttytcatattctgccttaagctaataaaaagtttaagcctggacgttttcgatggttcatcctttatctctgacaaatatctgactgtatgtttcatgggaga

SEQ ID NO: 50336 - DNA, 201 bp, Homo sapiens
ttcacagacagctctttgtgtgtaataaaatccaggcaagtggtgggtggcagaccgcaggggagtagctgaattgggttaatgagggaaaaggtgctttttttttttttttttttttcatattctgccttaagctaataaaaagtttaagcctggacgttttcgatggttcatcctttatctctgacaaatatctgactg

SEQ ID NO: 50337 - DNA, 201 bp, Homo sapiens
ctagtaagttatgctatgattaaaactaaatggaccaagtctgcttttgagagaggcagtctctgttttctcttagcctcatagaatcagtcccggttgckccttggacacacctacaagtcctgttcattatttttcctaaactgctctctagtctgtcctattcttctgtttccctctgcattcacactcaaagcttct

SEQ ID NO: 50338 - DNA, 201 bp, Homo sapiens
attgctttgtatgtcatcatgttgctcaatttcacaaattagaatgcatagccaccatcctatattgcatgctgttgtacttagttcatttctaactttcyataattggaggctgccatgtgtatccggtgaacactcaataaaattaattgagggtaatgatgatgaagacaagatctatagtgtcatcgttatttctcc

SEQ ID NO: 50339 - DNA, 201 bp, Homo sapiens
ccgcctaaccacatcgctttcttttctagtgagattttgtctttgtaggctgaattgtttttagttttatattttaatgaagaagattgtcagcattaggrattcctttaatttcatttgctttcagcaaacattggaattattgttaaactctcaaaactatcattcaatgaataatatctaattatcagttgtaaaaac

SEQ ID NO: 50340 - DNA, 201 bp, Homo sapiens
tactttgtgtaccctaatcctgaataatgtgcttggctttatgtacctatatatgtatttttttagaaagacatttaaactggtagtttgctttagatttyaatacattaaaattaggtgagtatgttcaaatatggtgatatttcaataagaatagtatatacttaaaactgttacagtttggttccaaaataaatatat

SEQ ID NO: 50341 - DNA, 201 bp, Homo sapiens
gatcacagatgctgggctgaaataggacagctggctccgcctgcttcttcagtccctgtcccagcctgcctgtatcaccctcgtcccccagcactgctgtrcatgtccctttgctgaagcccatcctgtaccctcagctttcaacattgcctctcccctgtttgccagggtaacacatattcatccttcagaactcaactc

SEQ ID NO: 50342 - DNA, 201 bp, Homo sapiens
aataggcattccatgaagtctgttgaaggagagttggctggagtgcccctgaattaatctatcccaggaaatttaataagggcaattcagatagaattcarttcagcaaacatgtatggaaggcagcctactctgtgctgtgcactgtgcttgaagtctgtggtgcctttatctgtggcaagagcacagatggtaaggaga

SEQ ID NO: 50343 - DNA, 201 bp, Homo sapiens
tgcagtgagccgagatctcgccactgcactccagcctgggtgacagaactagactccatctcaaaaaaaaaaaaaaaaaaaaaaaaaaaaaaaaacaggcmcccgaacccacaggagccaggaagaggacaggggacagccagctttcatctgcatgttaggttccacataaaatatcctaggagttacagctgacacagg

SEQ ID NO: 50344 - DNA, 201 bp, Homo sapiens
tgaacaaaataagcgaagatccttgcctttataaagtgtataatttaggaggggaaaacagataataagtacaggttaagcattcctaatctgaaaatccraaatgctccaaaatccaaaacttcctgagtgctgatgtgatgtcacaagttactctgaacatgttattttttcactctattaacagtatgtcagggctgg

SEQ ID NO: 50345 - DNA, 201 bp, Homo sapiens
attgagtatttcaagtaaaaataataccagtggaggtattctgctggtaataataccagtagggggtggagaatagaagtattctgtttaaaggttgttaygttacctgtatacaaaaactggcataatattatttgaaggtagactgtattaagttagagatttatgttgtaaaccttacaagggccactaagggaggaa

SEQ ID NO: 50346 - DNA, 201 bp, Homo sapiens
tataggccatggagtcagatctgactttgccagttgctgacctctcccagactttatattggaaagaataacgcctcactggatttttgtgaagactgcamaattacacatccacagtgtctggtacagtggctggcacttgataggtagttagtatatagagctgttaattcacttgctctgtatttataaaggttgatg

SEQ ID NO: 50347 - DNA, 201 bp, Homo sapiens
gaagcaggaaaacctgttaggaagctattggtagttaatccaggtggaaaatgatggtggcttaaatcagggtgttagtggtggagatagagtgaaatggkcagaatttgaatatattttgaagatttagttggcaggagtggctgatacattggctctgggatgtgagagaaagatcaggagttccattttggatatgtt

SEQ ID NO: 50348 - DNA, 201 bp, Homo sapiens
ctgtctaccacgttttctaggaactttaagcctaaggcagaactcagggtttttggagcctgtgtaaaataatttatagcacctttccagtaagtcttgcmcacactcttattctattaattaaacattctgtagcaatctggtatatcttaaagatttaaaagtatgtatagtagaagactggaaaacatagactgttga

SEQ ID NO: 50349 - DNA, 201 bp, Homo sapiens
cattattaccagcagactcaagactggctcatctgactccagcctcatccctccaatctttccgcctcatgccccagagtgacctttctaaaaacataaastccatttcccacctaactaaaactattccatcagtgaatgtaatttttcaaaaaaacatttaaggacaaaaaaattctcctataacttcccattacctag

SEQ ID NO: 50350 - DNA, 201 bp, Homo sapiens
gcacagcacatcgggaaggttctaggatctggggcccaaagatttgagcagcagtcctgtcttcattgcttattagactgttccatcttggagaatctctytgagtcttggtttcctcatttgtaagatatgtagaattcctgttctgctcacctttaggaactgacctaagtgctggatgcgacctcatgttgtaatcac

SEQ ID NO: 50351 - DNA, 201 bp, Homo sapiens
caacctaaatcccagaacaccaacatggccctgagtcctggttggattggcagagaccatctgtcctcactgccactgccctgggcactctgaggaagccsctgacccagctaggagctttgtgctcttgtcaatagacggtgacagcccccaaagctctccctgcagtggaaatacctcttgtgtggggggtgtggaagg

SEQ ID NO: 50352 - DNA, 201 bp, Homo sapiens
aaggcagaactcagggtttttggagcctgtgtaaaataatttatagcacctttccagtaagtcttgcacacactcttattctattaattaaacattctgtrgcaatctggtatatcttaaagatttaaaagtatgtatagtagaagactggaaaacatagactgttgagatggaagaagattagcctttcttaaaagaaaa

SEQ ID NO: 50353 - DNA, 201 bp, Homo sapiens
gtatctaagattgtgacaatctgggctttatctctgagaaatgactgaaaaaaaaaatgtgtccttgtgatttttcccactccgtcattgatcactctccrttcatgtcctactcccactgccttctcctcgtctccctttgcctcagagaaaactaatggagccatagagaaagctctgagatataaatgaccttgtgca

SEQ ID NO: 50354 - DNA, 201 bp, Homo sapiens
gttctgtgcctgagtgagattgtgcttttgggagtcctatactgtgaaatgtgtgtgttcaaatatggaaatgcttcttgtggccttcagtgaaagtgatrcacacttttctgtggggacagcctctttgatggccatggtgctgtgacatcacaatgacatgatacgaaaccttgtctgagagctacctgcctctttggt

SEQ ID NO: 50355 - DNA, 201 bp, Homo sapiens
tttcacagacagctctttgtgtgtaataaaatccaggcaagtggtgggtggcagaccgcaggggagtagctgaattgggttaatgagggaaaaggtgctttttttttttttttttttttcatattctgccttaagctaataaaaagtttaagcctggacgttttcgatggttcatcctttatctctgacaaatatctgact

SEQ ID NO: 50356 - DNA, 201 bp, Homo sapiens
cacagagcttaaccggcaagtcctccagccaggagtgggaagaaatcaaaagcctattccagcccagccgtggagagcctacaagggctggtctgtgccaytggggcccaatgggagcacagaaacaaggcctgattctggtccagaatcaacatcccattcatggggccattcagccctggaggcttctctccaatggcc

SEQ ID NO: 50357 - DNA, 201 bp, Homo sapiens
ctttatagaacagagtgcattatttctgattgagtatagatatatagtaagtcttgtaatcaactgactgtccttaagtaatgatgcacatagtttatgtyatttagtattttggaaaagagccaaataattccgttttgtttgtttgttttcttaatcaaatgagtaatgcattttaccccgattgcagaaatttggccc

SEQ ID NO: 50358 - DNA, 201 bp, Homo sapiens
tgcctatcagggaagccctgagttggtactgcaggggcattactccagagttctctagtcggtctaggcacatcattgattccttcccagtagttgaagaygagggtgaagaaagaaattgattcccagcttttaagtcaagcaaaatacacgtcaagagttgaaatcacttgcagatagtttcaacttttttgcaccact

SEQ ID NO: 50359 - DNA, 201 bp, Homo sapiens
attccacttctaggaatgcatcctaaagcacaaagctttatgcctacagatttcatgacgatattatatacagtaatttcttcaaaactggaaataacatsccacaaaaggggcttggttgagtttgtttccatgtagtagggcactctgtcgcagttagtaatgatccacgcaaagttcttaattaagtggatcactgct

SEQ ID NO: 50360 - DNA, 201 bp, Homo sapiens
ttgattcccagcttttaagtcaagcaaaatacacgtcaagagttgaaatcacttgcagatagtttcaacttttttgcaccactcatttcgagaggctctayttttggcataaccttttgaatattcctgcttttattattagtcttgtgttttaaaaaataatacacattggttttaatgacttgaaaactggtatttcta

SEQ ID NO: 50361 - DNA, 201 bp, Homo sapiens
ttttcacagacagctctttgtgtgtaataaaatccaggcaagtggtgggtggcagaccgcaggggagtagctgaattgggttaatgagggaaaaggtgctttttttttttttttttttttcatattctgccttaagctaataaaaagtttaagcctggacgttttcgatggttcatcctttatctctgacaaatatctgac

SEQ ID NO: 50362 - DNA, 201 bp, Homo sapiens
tgctgcctctcattcattcattcacgaattgtctgctcttgggcaaatattggagtaggagctgagagtagagaaatctgattcccaacccccaaaagccygtagactagggaaggaatcagatacctacctaagtaagtcacagtcaacgtgttattctaattgtgcagataaaccttaggggagcacaggtcatgggag

SEQ ID NO: 50363 - DNA, 201 bp, Homo sapiens
tgattcccagcttttaagtcaagcaaaatacacgtcaagagttgaaatcacttgcagatagtttcaacttttttgcaccactcatttcgagaggctctacktttggcataaccttttgaatattcctgcttttattattagtcttgtgttttaaaaaataatacacattggttttaatgacttgaaaactggtatttctag

SEQ ID NO: 50364 - DNA, 201 bp, Homo sapiens
cttttcacagacagctctttgtgtgtaataaaatccaggcaagtggtgggtggcagaccgcaggggagtagctgaattgggttaatgagggaaaaggtgctttttttttttttttttttttcatattctgccttaagctaataaaaagtttaagcctggacgttttcgatggttcatcctttatctctgacaaatatctga

SEQ ID NO: 50365 - DNA, 201 bp, Homo sapiens
ttgcttatgatttaagaataaagtgatccctttagtaactccattttaaataggtgatcatgaaaggtattttctgccatgtatttgtatagtttctgagmaagtttaattatgtcagctggaacataattttttcatattttgtttacactgacaagccaaaagcgttggtcctcttttgaagaaaacttccatccagtt

SEQ ID NO: 50366 - DNA, 201 bp, Homo sapiens
aagcaagtccccagtggggcgggaaggacctggtatctcacactcacccatctctcccacctcccctaaaccagttcactggacaggcagaacaggcagascatgctggtgatcgtgacttgtggcaacaagaattcttatcgtcgttgcttttaagtagatattcacctgcaactgagtttacaggttcctatgtacagt

SEQ ID NO: 50367 - DNA, 201 bp, Homo sapiens
aatattaaaatcttctgactctgtctcttgcttcatcttctactaggagagttaaatttttattttatcttaaatttctatgagattgggctctttagatycaaactacgcaatccaaggattataggaccttttcattaatgaatttcctttctttagacaatatataaaggctggaaaatcttaacgtattatttagaa

SEQ ID NO: 50368 - DNA, 201 bp, Homo sapiens
aaagaaaaaggtaattgaacggtggcttggtcctggaatttccttagcatgctatgtgttctcatgcacagtcatcacttatgagtctcgtaccatccagwagcttcctactgcaaacgcagcaggctctgctcaccttaggcctcgaggaaggccctggattgagtggatagatttcccttagaagctgtctcctcttca

SEQ ID NO: 50369 - DNA, 201 bp, Homo sapiens
taaaatgtctttttagggttaagattactaaattacagtgtaagttttcagttactttggatttgcatagcttggactagattcttttcagtctcttactrtaactttaggtaatgtggctcttaataaaagccaattggaaaattttgttaaaggactgaagcacaataataatgtatttctttcatttctagaaattgg

SEQ ID NO: 50370 - DNA, 201 bp, Homo sapiens
gtgcttagaaagagccaatggtggccgggcgcggtggctcacgcctgttatcccagcactttgggaggccgaggcgggcggatcacgaggtcaggagatcragaccatcctggctaacacagtgaaaccccgtctctactaaaaaaaatacaaaaaattagccgggcatggtggtggatccctgtagtcccagctactcag

SEQ ID NO: 50371 - DNA, 201 bp, Homo sapiens
gtgtagggcagccgtgaactactgaatcttagaattcagtctcctgacctcctccctggaatttcagctcagattccgagtgctctagttgtgctttctgwtggggcttatctagttcgattgtacccttcaggtgaaagggatactccttctgcggtttcttgcaggaacctgtagctcagacctggggccaaaggaaag

SEQ ID NO: 50372 - DNA, 201 bp, Homo sapiens
gttagcaaattatggtcaccactctcatcaaaatcccatctttggtctcaaaacattatatgattttttcagattaaaaaacatgagcctttattaattayaatatttagtatgggatggtttgaaattaagagataataacctatcggagagatttccataaatagtcttgtaatgtgtcaagtataataggtattacac

SEQ ID NO: 50373 - DNA, 201 bp, Homo sapiens
tccaactccaccatactttccctgttttaccatactgcctccataagatccatcacagcataagtagcctaacaaacggttttatttcaaaagcaataaascaatatatatttattgtagagaagtaggaaactgagagaaagaaaaaaatgaaacccacacagacataggaccagtgtattaacatcttatcttcccaga

SEQ ID NO: 50374 - DNA, 201 bp, Homo sapiens
catccaactgggtgcttagaaagagccaatggtggccgggcgcggtggctcacgcctgttatcccagcactttgggaggccgaggcgggcggatcacgagrtcaggagatcaagaccatcctggctaacacagtgaaaccccgtctctactaaaaaaaatacaaaaaattagccgggcatggtggtggatccctgtagtcc

SEQ ID NO: 50375 - DNA, 201 bp, Homo sapiens
ggcagtgagcacagtgaggttcacagctcccctcctattaaaagcaggccacggccgggcgcggtggctcacacctgtaatcccagcaccttgggaggccsaggcgggcgggtcacttgaggtcaggagttcaagaccagcctggctaacatggcgaaaccccgtctctactaaaaacacaaaaaattagctgggtgtggt

SEQ ID NO: 50376 - DNA, 201 bp, Homo sapiens
tccctgtcttgtcctggaaactcaaagggtgggcaggaagtggagtgtgtgcctgcttcccttccctgtcttgtcctggaaactcaaagggtgggcaggargtggagtgtgtgcctgcttcccttccctgtcttgtcctggaaactcaaagggtgggcaggaggtggagtgtgtgcctgcttcccttccctgtcttgtcct

SEQ ID NO: 50377 - DNA, 201 bp, Homo sapiens
ggtgggcaggaagtggagtgtgtgcctgcttcccttccctgtcttgtcctggaaactcaaagggtgggcaggaagtggagtgtgtgcctgcttcccttccytgtcttgtcctggaaactcaaagggtaggcaggaagtggagtgtgtgcctgcttcccttccctgtcttgtcctggaaactcaaagggtgggcaggaagtg

SEQ ID NO: 50378 - DNA, 201 bp, Homo sapiens
agaggagttttttttttttactttataaaactaatgtattaactatattaataaaataacaattattttattttcaaaaaatgtctactctttttcattamagttgaatcattagttttttacattcatttatttgcccatttgattgttgtctcttcagttttctcttaatggaaatttgaactatgaaactgtacatac

SEQ ID NO: 50379 - DNA, 201 bp, Homo sapiens
tagaggagttttttttttttactttataaaactaatgtattaactatattaataaaataacaattattttattttcaaaaaatgtctactctttttcattmcagttgaatcattagttttttacattcatttatttgcccatttgattgttgtctcttcagttttctcttaatggaaatttgaactatgaaactgtacata

SEQ ID NO: 50380 - DNA, 201 bp, Homo sapiens
ttaacgagccactggttaatgataagaattttagaggagttttttttttttactttataaaactaatgtattaactatattaataaaataacaattatttyattttcaaaaaatgtctactctttttcattacagttgaatcattagttttttacattcatttatttgcccatttgattgttgtctcttcagttttctctt

SEQ ID NO: 50381 - DNA, 201 bp, Homo sapiens
tgggccacctgagcttgtgttctcatgtatggaactcagggccttcctctattgggcatgggattgaggtccctgatgggagggaagggacacagggttgtcactcgctttccagagtctcagaggactcaggacaacaaagtgtaaggactctgaacaaaagcaggtcctaaacacaacgcctggacattccttgagggg

SEQ ID NO: 50382 - DNA, 201 bp, Homo sapiens
ataaaacctttcacatgtgaaataccatatacagtaaaagcatcttccttaagcacatctatttaatttttttattaaaagtctttgaatgaggataagtmcaatagaatagaaatacccagtacagtgatagtaacacctttgcagtgtgtcttgttgtatagagagcaaggtatctgatacatctttatgaataaaggg

SEQ ID NO: 50383 - DNA, 201 bp, Homo sapiens
ttttttttttttttttttcatttttgagatgaaatttcactcttgtcacccaggctggagtgcagtgggatgatctcggctcgctgcaacctctgcctccygggttcaagtgattctcctgtctcagcctcccgagtagctgggattacaggcgtctgccaccacacccaactaattgttttgtatttttagtagagatgg

SEQ ID NO: 50384 - DNA, 201 bp, Homo sapiens
gaggtcgaggttacagtgagccaggattgtgccaccgcactccagcctgggtgacacagtgagacactgtctcaaaaaaaaaaaaaaaaaaaaaaaaagtmcagtcactttgagggcccagtgccaaataggttcttgataattgttgtttctttttctgcttactctctttgaacatgtagctgtaagttttctgttctt

SEQ ID NO: 50385 - DNA, 201 bp, Homo sapiens
aagaagattgtcagcattaggaattcctttaatttcatttgctttcagcaaacattggaattattgttaaactctcaaaactatcattcaatgaataatayctaattatcagttgtaaaaacattttattaatattgatgctattccaatgattgcatctttagctttccttgtttaagtattttttaggtagcgtcactt

SEQ ID NO: 50386 - DNA, 201 bp, Homo sapiens
ccaagtatacatgaaacagctatgaaaatggaccccctgttagctatatgggtgcaggcgggtagttggatttaacaatgactggagtttgccaagagagratgacaaagaggcacaaggcagatgagaatgtgtataaaggaacagttataacaatagaatttaagctatgtaaggagaatcatgtagacctgaggtgga

SEQ ID NO: 50387 - DNA, 201 bp, Homo sapiens
ttgtaatcaactgactgtccttaagtaatgatgcacatagtttatgtcatttagtattttggaaaagagccaaataattccgttttgtttgtttgttttcktaatcaaatgagtaatgcattttaccccgattgcagaaatttggcccttagaaaacccactaatgaaatgagcaaacaccttaaaagcttgattttttgt

SEQ ID NO: 50388 - DNA, 201 bp, Homo sapiens
caggcttgggagtgacacttctgtagaatttgacaaatgtacttccaaacccctgcttgaccacttccctgctgtgctaactccagccatgatactacatstttctgtatcttgctttcttcctaagagctgagtcctgtatatggacagcatatcccagtgtctggcatgtggtggggacacaatatacattcctttctg

SEQ ID NO: 50389 - DNA, 201 bp, Homo sapiens
agtttattacggctagaacatagggtgtgtggttgggagggacaaaagatgagacccaaatagacaggagggaccagattgggaatggtcacaaaaacaartttggacttcaagtttggggcagtggggcatctactaaggtgattaagccagggaatgatgtgataaaattcatgctaccaggagtcccagactaagggt

SEQ ID NO: 50390 - DNA, 201 bp, Homo sapiens
agacattgtacaagtacacagacaccagacaccaacctccaaaatccaagaggtctgtctttctgcagtccatggatgtgcagcaaatggcaggtgagctytgggctctgagaaagccaggcttgagtgcagtaccatttcttcctctcctgttctaaaactcagaatgcccaaagatattggaatagtcccatggattcc

SEQ ID NO: 50391 - DNA, 201 bp, Homo sapiens
tttagcacttccttcaggagctcttttagggcaggcctggtggtgacaaaatctctcagcatttgcttgtctgtaaagtattttatttctccttcacttaygaagcttagtttggctggatatgaaattctgggttgaaaattcttttctttaagaatgttgaatattggtccccactctcttctggcttgtagggtttct

SEQ ID NO: 50392 - DNA, 201 bp, Homo sapiens
ttctggatttaaaaagatttctttggtccctaaatgtttcccaagtcatagagtcctgagtcagacttcaatctttttattttctgccagaaagatgaggkgtaagaaggggtaggaacaaacacatcttattcacaaacaacaacatcatcagtaaacaaatgtggaaaaactgtccatactcataattaaagtaatgca

SEQ ID NO: 50393 - DNA, 201 bp, Homo sapiens
ccagctactcaggaggctgagttggtaggatcatttgagccagagaggttgaggctatagtgagctataattgtgccactgcactccatcccgggcaacaragtgagactctgtctcaataataataataatagaaatactaacttctaagtggcatggatttaagaccacctgattgcacggccctttcatttccagttt

SEQ ID NO: 50394 - DNA, 201 bp, Homo sapiens
cgttagtttcttcattggtaaactggatgataatcatatctatcttaaatgtttatcttgttttgtttgtacaatgctctttgaatcactttttttttttwaaaaacatataatcctgtacgtatagtgggccagtgggccatgagccaccatgcccagaccattctttattcttattctttattcttttttattcttatt

SEQ ID NO: 50395 - DNA, 201 bp, Homo sapiens
caaaacatttcttaagcttatagttattcacaatataaccaatgtaaatcagctggaagattctgattagagagacggtagagataatatttaaacaagayttgcaacttgtatgttgaagattgccttgttcttttggtgagagctcctgtgtatgaaaactttcatgttactttcttcaaaattttgataagccagaga

SEQ ID NO: 50396 - DNA, 201 bp, Homo sapiens
caaaaaaaaaaaaaaaaaaaaaagccagtcatggtggcacatatctgtagtcccagctactcaggaggctgagttggtaggatcatttgagccagagaggwtgaggctatagtgagctataattgtgccactgcactccatcccgggcaacagagtgagactctgtctcaataataataataatagaaatactaacttcta

SEQ ID NO: 50397 - DNA, 201 bp, Homo sapiens
ccaacattgtatgacacaaatgtataatatttacaggaagtataaaacaaatgataaattttgattttttttgcatcattattaggcagagaaacataagmagcagtgtggtgtataaaatgtgactttgattccacaaaggttctgccagtctttcgacagtggcttgtttaaaccatgggtcttcacattggaattgag

SEQ ID NO: 50398 - DNA, 201 bp, Homo sapiens
ttctttgcatttcatcagtgattgcttataaaccagtaaaaattactaatactcatttttaaagtgggctaagaatatgaatagaccatttgtctattatrtaaatatagtgaagaaacatatgacaaaatgttcaaccttagtcctgatcagaataaaaataaaagtaaaataggtacaattttaaagctactaacttga

SEQ ID NO: 50399 - DNA, 201 bp, Homo sapiens
tgttaatgtttcagtatatttacttccttattgtcttcttttgtgtgtgtgaatgtgtgtgtaaataaaatataaaaactttttttctgaactctcagctrtatgtgttttcctcactctctccaattattcattaagctttccctaaaattattaatgttgatttgcagaaatcattttagttgctatgaattattacat

SEQ ID NO: 50400 - DNA, 201 bp, Homo sapiens
attttcaactgtgtaacttcagtcagtttcagatttcagaagtggtataacatgaagcccagactgtgggcctgaatatatgtatgtatgtgtatgtgagsggggggagctgggggttggtaggtagaaatgaaaaggtgtttgtaaaatgagaatctcttaaaattgatttatcaaagattatttacataaattgtgtga

SEQ ID NO: 50401 - DNA, 201 bp, Homo sapiens
gcttcctatgaggattaaacaaggaggcatgtagactttagcacagtgcatggcaatagtaagtgctcagtcaatgctatttcttcccttcttaatccgawctatcatccaatcatttttttcagcaccatcattcactggatgtttcctctgtgccagatactctggggaacactggtaatgagtgtaacccccatcatt

SEQ ID NO: 50402 - DNA, 201 bp, Homo sapiens
tccctgtcttgtcctggaaactcaaagggtgggcaggaagtggagtgtgtgcctgcttcccttccctgtcttgtcctggaaactcaaagggtgggcaggargtggagtgtgtgcctgcttcccttccctgtcttgtcctggaaactcaaagggtaggcaggaagtggagtgtgtgcctgcttcccttccctgtcttgtcct

SEQ ID NO: 50403 - DNA, 201 bp, Homo sapiens
accccaacatggtacctacacatattgtggttttgtctttggagggggcattcttatttttatttcacgtcaagttgcagagctgctattaggattcagcrgaggcattggtatctaagattgtgacaatctgggctttatctctgagaaatgactgaaaaaaaaaatgtgtccttgtgatttttcccactccgtcattga

SEQ ID NO: 50404 - DNA, 201 bp, Homo sapiens
cagaacaaaaaagaataggaacccggagctggagaggtagttcagaagtgaacacttgaatttgagagtcatttaccttgtgctgttaattgaaactaagktataggtaaactgctaatagaggaggacgcagagagagaaggagaaagataaagtcctggaaaggagttgagaaggggcccagaaatagagcagtgagag

SEQ ID NO: 50405 - DNA, 201 bp, Homo sapiens
tggccattatattctgacagacctggatgtgagtcccagttctgtcacttactgtcgatgtggccttgggcaagttatttcacctctgaaactgtttcctwatctgtgaaatgtggtgatgagtgtatatgtgtatcaacacacacgcactctttcctttaaaacaatactttgcaagggtctaaaccccaacatggtacc

SEQ ID NO: 50406 - DNA, 201 bp, Homo sapiens
cttgtatgatttgacagtacagtcagatggtaaaagaacttctgtactgtatgatgtttcagaatagttctgtaaagtgtctgaatgtactctggtaccaytgttgtgtttaatttgtccgaggcagcctcaggtaaacactagaatctgttgcagcaagatatgcaaagtaaaatgaaatatgtatgtgagattgtatta

SEQ ID NO: 50407 - DNA, 201 bp, Homo sapiens
tctgttcacctggggagatgcacccagcatccactgggtagctgctctctgggtgggtgttggccattctgtggcacagttttccttcccttcccttcccygctgtgggtgggaattagagggctagatgggaggctgggaggacttagatgccttcccctgtgaccgtcgcgagtccacactcccagccacacgtgaccg

SEQ ID NO: 50408 - DNA, 201 bp, Homo sapiens
tgtttattccttccctttcccaaaagataatggagaaggaaaaaagtaagatgagttccacccagctgaaaatgaaactactggaagaacgattgttgccrttaccccctgaaaagcagccctgcatttcagctgctaagaaaagcaagacactgtttgctctttccttctactcacatgtccggcatctgtctagagtag

SEQ ID NO: 50409 - DNA, 201 bp, Homo sapiens
gatttgaaggactggtggcaggaaagctttggccttggggtgtgaattctaagaaatagaggcacaattaagtttaaaaaattcaaggactttgagcttgrtaatgaaagatttttctctagactaatgtgagcagaaaagttgcccatctgtgcacatttttgtgtgcatttaaaatatttaaaagctgacagcttttaa

SEQ ID NO: 50410 - DNA, 201 bp, Homo sapiens
gcttataggaccagcatgtgtgttgtgaagggccatggcccgtgagggggctggctggaaagaaggggcttcttgtggtggggtttatcgggggcagggccaggtcttgaatggcatgctggggacagggatgtgagcaactctcctgggctgccagtggcagggaaagcagttggaggctcgtggtggcctggccaagga

SEQ ID NO: 50411 - DNA, 201 bp, Homo sapiens
ttttgtatgtttggattttgtgtgtgttctgtttttaactttcaacttgagttttaagatcgtcaatcaggcttttctttcaagtcagtggcactgcttgyaattgcaggacttagagggtcagcatttcccttatggtattaaaaaaaattaaacatagggagtattttaggaatttgagctccactgatcttttcatca

SEQ ID NO: 50412 - DNA, 201 bp, Homo sapiens
tcggttcagcagagcaagagaaatccagcaaaaggcagtgacttgttctgcggcgcctgcacgcgctttagaatccccgcacgcggcgccaggttgtgagrgacaggatcctgagtcccccaaggctccaccttcagcggtgtgacagcggggcttctctgccaaaggactggccagagcctacaaacggcatttctttaa

SEQ ID NO: 50413 - DNA, 201 bp, Homo sapiens
tcaaaatatatttaaatcaggattttaaagcccccactcttggagagtggtacttttcatattcgaataattttatttttctttgggaaaagatgataagrcatgaatgtttatgtgtaaggaaaacatcagtattaagaaaatgggtttatttaattgatttattaaattggtttattgcagtttttatttacagagaac

SEQ ID NO: 50414 - DNA, 201 bp, Homo sapiens
ttgtagagacagggtttcatcatgttgcccaggctggtctcgaactcctgagctcaagcgatctacctgcctcagcctcccaaagtgttgggattacaggygtgagccactgcgcccaacctagaccccatttttttattttgcctcatttattggccttgcctcttctgctacggccattctcaggcaggctttcccctc

SEQ ID NO: 50415 - DNA, 201 bp, Homo sapiens
gaatatgcaaaagatctagaatagccaaaacaatgttgaaagagaagaacaaagttgtaggacttatattacctgtttgcaagactcactataaagttacrgtaatcaagacagtgtagaaacacatataaatcaatagaacaaaattaagagtccagaattagacctacacataagtggtcaattgatttttcaacaaat

SEQ ID NO: 50416 - DNA, 201 bp, Homo sapiens
tttctctccacaggaagttctacagactttgaccaagttttgtttccccttctatgtggacaggtagtgtcagattttcaaactttactagaaaaaaagtrtcaataaacctgctatagaaaataaaaaccataccattcttaacattctgtctgtttaaccatgatttaagatacctgtgttccaaggagagttgcaata

SEQ ID NO: 50417 - DNA, 201 bp, Homo sapiens
caacttccttgacttgaataaaacacgggacccttattgcatgagtggccccatccatgttccaaatgacccacgtgtatagtcagctgccagcttcagcyaccggagccatggcctgccttttgcacattgtggtttttcttttcctgataatttgacttcagtcatcagaagcacaaattaaatgtaaatttctggatt

SEQ ID NO: 50418 - DNA, 201 bp, Homo sapiens
aattgtgtgtatagttctttctttagctattatcaaatacaaaagtcttctagaatagttagcaaactgagctgctaatattcaagtctgttttacatgtkcccaagacatattatattactgctgagatctgtagtaaggaggacattttatattctggggaaagaaaggatttttgcttgaattttatttgttgaatgg

SEQ ID NO: 50419 - DNA, 201 bp, Homo sapiens
caattaaaatagtctgaggttttttttttttctttttaacgagccactggttaatgataagaattttagaggagttttttttttttactttataaaactartgtattaactatattaataaaataacaattattttattttcaaaaaatgtctactctttttcattacagttgaatcattagttttttacattcatttatt

SEQ ID NO: 50420 - DNA, 201 bp, Homo sapiens
tctttaatcatgggtatcaaaagttgctgttattagctccctactacgtataagatctctaccaggagatagaacagagaatttgaatgccccccaccttwtttttttcttgagacagggtctcactctgttgcccaggctggagtgcagtggcctgatcacggctcactacagcctcaacctccccaagctctggtgatc

SEQ ID NO: 50421 - DNA, 201 bp, Homo sapiens
cgggacttggggctccagcactctccagcgccctttcttgagctaatttaggatttggctgcacctgacctctcacatagcagtagaaaatatttccttgktttttttttttttgtccttctcccctttccctcctcccctttatctggcaacgaatgtacctcgtgactccccagatgcctctaatatagacatctcaag

SEQ ID NO: 50422 - DNA, 201 bp, Homo sapiens
tagacttcaacttataatttaaatcagcctagccctatcttgtttaaaagtattcagcagggaatattgctaaatagtattttatattttgtttaagtggytaagaatggtatctctgggaaaaagagaattttctatagattttgagattaaaagtacaaaaccacctaaacatttccttagtatttacattgtgataaa

SEQ ID NO: 50423 - DNA, 201 bp, Homo sapiens
acagttgtctgaacaacctggagttaaaaaacaagttaaaaaacagcaagtatgttcctttttatagtattacagttttttttggttttgtttttaaaaascaaagtatttgcttcctttcagtaagaatgttaggatgacgtgtagtgtatttcactgaatttgtttgaaagattgagatgctgatatatacaaagcact

SEQ ID NO: 50424 - DNA, 201 bp, Homo sapiens
gggaaatatgtgtgcatgtgaaaagtcaggttacatttatgctttatttttctatcaagttatatatatacatataaaccttgagcacattctaatatctkcatttcaaatccaactttgtataagtcatgttggttttctgttaacttcaactgtaagaaaccagccttccccatgtcttccaagtagccttgggttcag

SEQ ID NO: 50425 - DNA, 201 bp, Homo sapiens
actatatgaaagatatgacaacttgataaaaagaacactgcctgaactgactaattttctttttcagaaaatgtagaattaattctgagttgttcccagamaaacacactttgggcacatgaataattcaacctatatatttttttcttccacttatgtgtcacagtttaacaagaacccagtgatcaatcctcagctacc

SEQ ID NO: 50426 - DNA, 201 bp, Homo sapiens
tccttccttgttttagttccctatgctgtaaaatggggataaatggggatgatgataatatctcatattatcatcacatttgaggattcagaaacacagtwtttaaagaattaagcacagggcatggcacagagtttctctcagtttgaactatcatgaagaaaaacatgaaatttgttttgatccttcaaactggaaatt

SEQ ID NO: 50427 - DNA, 201 bp, Homo sapiens
taaagtcaagctcattagcagggcaaatgaggtcttccatgctccatcctttccctatccagcttcatcttagtccactcctctcctctccttttaaataygcatttcccaatatgtctcaaccaaatttcatacattttttaaaatttccatattatatttggcttcccccaaatgtaagaaggtctaatatctttaaaa

SEQ ID NO: 50428 - DNA, 201 bp, Homo sapiens
ccttagtatttacattgtgataaactgtttcttagataggtacaaatatgagaactctaagacaattaaaatagtctgaggttttttttttttctttttarcgagccactggttaatgataagaattttagaggagttttttttttttactttataaaactaatgtattaactatattaataaaataacaattattttatt

SEQ ID NO: 50429 - DNA, 201 bp, Homo sapiens
taggtacaaatatgagaactctaagacaattaaaatagtctgaggttttttttttttctttttaacgagccactggttaatgataagaattttagaggagytttttttttttactttataaaactaatgtattaactatattaataaaataacaattattttattttcaaaaaatgtctactctttttcattacagttgaa

SEQ ID NO: 50430 - DNA, 201 bp, Homo sapiens
cataatagagactgatcaagttcatttagaagatgtttatgcgtaccgactggcacttaaaaagctctttgtttccatattctctttgggagagctttgaytggggccttggctagtctagaaaaggaccatagctgagtataatctgttcaggctctcagtaattttacggaataccagtgcagtccaccggtgtaattt

SEQ ID NO: 50431 - DNA, 201 bp, Homo sapiens
tcgcttgaactcgggaggcagaggttgcactgagccaagatggcaccactgtactccagcctgggtgacagagtgagactccatctcaaaaaaaaaaaaaaggaaaagaaaaaaaatagcagatggagaaactctgcaaataggaatttcaaaactgatggctcttgctccgtgccactgacccacctctcccctctgcac

SEQ ID NO: 50432 - DNA, 201 bp, Homo sapiens
ttagctctatacggataggatttttttttttttaactcagggtatcgtcttcttgactcataaaacatggtttggtaaaagcaaacttgcttatcaaacarcataagcataaaatcgattggatagtatattttatttttgatcatccccgttctttaattattttaaaatttcagtttgctattgtttaaggtcactgtg

SEQ ID NO: 50433 - DNA, 201 bp, Homo sapiens
agcttctgagttaatattggctagatttaagcaggaagaactcttagaacttacggaagctcgacagtaaatttaacactcatgcaactcattaaaatagkataaaagtggagcttcaaacatctctgtgtttgctaccagggctggggggtggggtgttacccttaattcagctcaagatctgaaagtctgatctttcag

SEQ ID NO: 50434 - DNA, 201 bp, Homo sapiens
tctcgtacacaaaataaagtttgcattgttttccttcttgctccagcagccaggaagctcagagctaattttgtaacttaacttagatgccacataggacmtacatacccagctacttttttcccaaacaaatactttttatatatctatgtatttggcagccctgatgtttttctttgttgttttagatgctcatataag

SEQ ID NO: 50435 - DNA, 201 bp, Homo sapiens
tgcatatttattttatatttggtcttgcatattatgttgccagccctggtaagacccaatctccaccctcaggggaaacagttatttgttgaaagtctatkgtgaaagaatctatttgtttatcatctgttttactcttcaaagcaaccctgtgaggtaggttggcattgtataattgtcacagacgaggagggacaagtt

SEQ ID NO: 50436 - DNA, 201 bp, Homo sapiens
gtgcagatagcaagaagtgaaataggccaggtgcagtggctcacgcctgtcatcccagcactttgggaggccgaggcaggtggatcacttgaggtcagttygagaccagcctgaccaacatggtgaaaacctatctctatgaaaaatgcaaaaattagctgggtgtggtggcaggtgcctgtaatcccagctactcaggag

SEQ ID NO: 50437 - DNA, 201 bp, Homo sapiens
ctgcaacctctgccttctgatttcaagcgattctcctgcctcagcctcctgagtagctgggattacaggcgcccgccaatatgcctggctaattttttgtrtttttagtagagatggggcttcaccatgttggccaggatggtctccatctcttgacctcgtgagccacccacctcagcctcccaaagtgctgggattaca

SEQ ID NO: 50438 - DNA, 201 bp, Homo sapiens
tggccctgtcattgcccagttcttcaccctcaggcaagtgacgtcccctttcagagccttgatttccttatctgtaaaatggagatcatcatcctacctacctcacgcgatgctgtgaggagtaagtgagctaatgcatgtaaaaccacccagtgctggtttagggctcagcaagcggtagctgtttttaatcactgcacc

SEQ ID NO: 50439 - DNA, 201 bp, Homo sapiens
ctggccctgtcattgcccagttcttcaccctcaggcaagtgacgtcccctttcagagccttgatttccttatctgtaaaatggagatcatcatcctacctacctcacgcgatgctgtgaggagtaagtgagctaatgcatgtaaaaccacccagtgctggtttagggctcagcaagcggtagctgtttttaatcactgcac

SEQ ID NO: 50440 - DNA, 201 bp, Homo sapiens
tctggccctgtcattgcccagttcttcaccctcaggcaagtgacgtcccctttcagagccttgatttccttatctgtaaaatggagatcatcatcctacctacctcacgcgatgctgtgaggagtaagtgagctaatgcatgtaaaaccacccagtgctggtttagggctcagcaagcggtagctgtttttaatcactgca

SEQ ID NO: 50441 - DNA, 201 bp, Homo sapiens
gtaaagactggtttactcttctaattccattttgcctaaactagccttgagttgtttgtgttccccaagtgtttactcccagcaagatggaggcagcccaygcatgctggatggcagcaggaagtcaatcttggatttcagaaattgccatagataagaatcagctgcaaataatcatggcccaacccataagagacagtg

SEQ ID NO: 50442 - DNA, 201 bp, Homo sapiens
cagtccttcaggccaaagacaggtcaagtgaagaaactgctgcctatcagggaagccctgagttggtactgcaggggcattactccagagttctctagtcrgtctaggcacatcattgattccttcccagtagttgaagacgagggtgaagaaagaaattgattcccagcttttaagtcaagcaaaatacacgtcaagagt

SEQ ID NO: 50443 - DNA, 201 bp, Homo sapiens
cacttcttacatggcggcaggcaagagagagaatgagaaccaagcaaaaggggtttccccttataaaactgtcagatctcgtgagacttattcactaccaygagaacagtatgggggaaactgcccctgtgattcagttatctcccaccgggtccatcccacaacatgtgggaattatgggagctacatttcaaaatgaga

SEQ ID NO: 50444 - DNA, 201 bp, Homo sapiens
gacagacagacataacatacacccagcaagatgaaaagacagctagtttcccagaaaacaggagctgactgtgacttctgtgggcttatggaggaaggagstggtgtgaaaaccagatgggagagttgttaagagttgtatgtttccaaaattgcctttgtagctcctttgcaaaaatttggaccatgcatgctggaggga

SEQ ID NO: 50445 - DNA, 201 bp, Homo sapiens
ggactgcagtggtgatcaagaacctctccactctcatgattttacagtcaagcttagtgtcagatcctctttgtccctcagtttactaatgacgcccagaraggctgtcacttgccaactatctgaccagatctgatagtagtatctgggttgcctggccaccgggtctctcaaataaattttatatgtaatactgctaag

SEQ ID NO: 50446 - DNA, 201 bp, Homo sapiens
actcaggaggctgaggcaggagaattacttgaacccaggaggcagaggttgcggtcagccaagattacaccattgcactccagcctgggagacagagcgasactccatctcaaaaaaaaaaaaaaaaaaaaaaaggaaagaaagtaaacgttaccccattttacagagcggaaccctgagcttggagaggctgagtgcaaa

SEQ ID NO: 50447 - DNA, 201 bp, Homo sapiens
gaagttaacaaccttgggagaaactgaggcagtccccgagcaggatttggaaagcaatttcatttaaaaggggctggagggaggggggaggcactcgtgtkcatttaatctttttttttttaattatttttttttaagttccacggtacatgtacaggatgtgtttgttacataggtaaacgtgtgccatggtggtttgct

SEQ ID NO: 50448 - DNA, 201 bp, Homo sapiens
ccaagatcgcgccactgcgctccagcctgggcaacagagcgagactctgtctgaaaaagaataaaggccgagcactgccactcatgcctgtaatcccagcyctttgagaggccgaggcaggtggatcacttggtgccaggagttcgagaccagcctgaccaacatggccaaatcccatctctactaaaaatacaaaagaaa

SEQ ID NO: 50449 - DNA, 201 bp, Homo sapiens
tgttctctgcacagcaggaacctctgcttcaaggccattgtcccagggggtaattgttcctttatggggctgcttgactatcctcaggtagctgactgtgwtagctccaggggctgatacccagtaggctctcaacaactactcactgaatcagtgaatgaaaggcaaaaacagccacccttcctcacaaatttgggaaag

SEQ ID NO: 50450 - DNA, 201 bp, Homo sapiens
tgaggtcaggagttcaagaccagcctgggcaacatggcaaaaccccgtctctactaaaaatacaaaaattatcctggcgtggtggcacacacctgtaattycagctactcaggaggctgaggcatgagaatcgcttcaacccgggaggcagaggttgcagtgagctgagattgcaccactgcactccaacctgggcaacag

SEQ ID NO: 50451 - DNA, 201 bp, Homo sapiens
gtatgggaactaacatatgaggtgggggtgaggagttggatatcagggatggtttcaccaaggtgcttgcaccagcactgggctctaaggacaaggaagaygatgccagcacactcatgctcaaggcttgctggctggacacatgccgtttagttggtgccaactttccaagaggctcctgttggccatggctacaggtta

SEQ ID NO: 50452 - DNA, 201 bp, Homo sapiens
tctgttgactagtcagctgagacccagcaagctaacattatactagagcgttcatggcagaccctcacttataagctccttgaaggcagcagctgtgcaargtaaggccccacaatgcgggtatccagccactggaattacctgtgaggctggccagaacaagccttgacctcccagaagactacctgaaggaggaaatgt

SEQ ID NO: 50453 - DNA, 201 bp, Homo sapiens
aaggactcagaaattagaacctgtattagggttctctagagggacagaactaacaggacatacatatgtagatatagatgtagatatagatatagatatatggagcctgtattatagtcagggttctctagagggacagaactaacaggagatagagatatggagcctgtattagtcagggttctctagagggacagaact

SEQ ID NO: 50454 - DNA, 201 bp, Homo sapiens
gcacagagcctaactcacagttaaccctgtgaacatctggggagggcaaggaagccatctctgagaggccttctcaggctttctatgtagaattcatctcygtcttcctctcttgctctgaaggagtccctcggaaatcttctcttccagctgtttctttagagttacgtgtccctctcccgtaaggtagtaagatccagc

SEQ ID NO: 50455 - DNA, 201 bp, Homo sapiens
aaaggactcagaaattagaacctgtattagggttctctagagggacagaactaacaggacatacatatgtagatatagatgtagatatagatatagatatatggagcctgtattatagtcagggttctctagagggacagaactaacaggagatagagatatggagcctgtattagtcagggttctctagagggacagaac

SEQ ID NO: 50456 - DNA, 201 bp, Homo sapiens
gaccccaaagccctggcccccatctttactgtgccccttcttccaagctcccagatattttgaatagtgtttggctttaatggtagttgaaactcttttcrtaagaaaaaaattgttgacctttggtaagacatggtacagagtaaaagaatgggcttagagataagagagacctggattgaaatcccagctctgatcttg

SEQ ID NO: 50457 - DNA, 201 bp, Homo sapiens
aaaaggactcagaaattagaacctgtattagggttctctagagggacagaactaacaggacatacatatgtagatatagatgtagatatagatatagatatatggagcctgtattatagtcagggttctctagagggacagaactaacaggagatagagatatggagcctgtattagtcagggttctctagagggacagaa

SEQ ID NO: 50458 - DNA, 201 bp, Homo sapiens
cactgtactccagcttgggagacagagcgagactttgtctcaagaaaaaaaaaaaagagagagagagactggttaagtgatttgcccaaaattgcatctartaagggactacacttgcccattggaccccaaagccctggcccccatctttactgtgccccttcttccaagctcccagatattttgaatagtgtttggctt

SEQ ID NO: 50459 - DNA, 201 bp, Homo sapiens
aaaaaggactcagaaattagaacctgtattagggttctctagagggacagaactaacaggacatacatatgtagatatagatgtagatatagatatagatatatggagcctgtattatagtcagggttctctagagggacagaactaacaggagatagagatatggagcctgtattagtcagggttctctagagggacaga

SEQ ID NO: 50460 - DNA, 201 bp, Homo sapiens
ttaaaaaggactcagaaattagaacctgtattagggttctctagagggacagaactaacaggacatacatatgtagatatagatgtagatatagatatagatatatggagcctgtattatagtcagggttctctagagggacagaactaacaggagatagagatatggagcctgtattagtcagggttctctagagggaca

SEQ ID NO: 50461 - DNA, 201 bp, Homo sapiens
cacatccaggctcttgggtagacacttgcccaagatcagtcagcccagcctgctgggccttaaaccaaatctgggttctccacaccatcgtgacccctttwtcagctggaggagatcatctctcatatacggaaatccctgtatctcaatattaagacacttaccaaatattgtaaccaggaatctcccgaacattttttt

SEQ ID NO: 50462 - DNA, 201 bp, Homo sapiens
aggctggagactcccacatccaggctcttgggtagacacttgcccaagatcagtcagcccagcctgctgggccttaaaccaaatctgggttctccacaccrtcgtgacccctttatcagctggaggagatcatctctcatatacggaaatccctgtatctcaatattaagacacttaccaaatattgtaaccaggaatctc

SEQ ID NO: 50463 - DNA, 201 bp, Homo sapiens
gttaaaaaggactcagaaattagaacctgtattagggttctctagagggacagaactaacaggacatacatatgtagatatagatgtagatatagatatagatatatggagcctgtattatagtcagggttctctagagggacagaactaacaggagatagagatatggagcctgtattagtcagggttctctagagggac

SEQ ID NO: 50464 - DNA, 201 bp, Homo sapiens
cttttctccctgccccctgtatcgtaagcgttaagaaaggcccacaagtagttgccaaacaatagattgtgacctgctggtgggtaataaaaccagtttartgggtcttgaagtgaatttttaaaaatgaaatggaataaaatagcaattatcagagaaaataacatatagtaaggacaggtatagttttctgaaactttc

SEQ ID NO: 50465 - DNA, 201 bp, Homo sapiens
aaagcttcacagtagcaatggaaactgtcttttaactctctgaacactagtaattttaagacaaaaaatatttatttatttatttatttatttatttattwtgagataggttctcactcccattgcccaggctgcagtgcagtggcctgatcatggctcactacagcctcagccccccaagtagctgagggctgcaggagt

SEQ ID NO: 50466 - DNA, 201 bp, Homo sapiens
ttggttccttgatcataactagttctttccagtccccagaatctctgcctagttcttttctctgcctgaaacaacccagtgccctgtttcttgagtggctkctccatttcatcctttggtcaatattgttgccatccctgagaagctacctctgaccacattatctcagtagggcctttccttcccttccattttcctcta

SEQ ID NO: 50467 - DNA, 201 bp, Homo sapiens
tggcttgagtccaggaagttgagaccagcatgggcaacatgatgaaactctgtctttacaaaaaaatacaacaattagccaggtgtggtggcatgtatctstggtcccagctacttgggaggctgaggtgggaggatcacttgagctcccacagagctcaggagacggaggttgcagtgagtcaagatcacgccactgcat

SEQ ID NO: 50468 - DNA, 201 bp, Homo sapiens
ggctggagtacagtggcgcgatctcagctcactgcaagctccacctcccgggttcacgccattctcctgcctcagcctcccaagtagctaggactacaggygcccgccaccacgaccggctaattttttgtgtttttagtagagacggggtttcaccgtgttagccaggatggtcttgatctcctgacctggtgatccgcc

SEQ ID NO: 50469 - DNA, 201 bp, Homo sapiens
actggttatatgtttgcttttctgaggaaaagtgaaaagttataattgggataaggcattttagtctgcattgagaatggaaggaatctttgagggatccrtagtgaatgtgtgtgctttattgaatgagtaagacttgaagtgggctggactaaattgctgaaggcaaatctgttcatggtagatttagagagggggaaa

SEQ ID NO: 50470 - DNA, 201 bp, Homo sapiens
agcactattgctcttgctggttgggaagaaaggaagcctatagtctactaagacaggtaagatgagcgtgcaaacaattagaattataacatttaagaacrcttatgtccccagccaggcccggtagctcacacctgtaatctcatcactttgggaggctgaagcaggcagatcatttgaagtcaggagttcgagatcagt

SEQ ID NO: 50471 - DNA, 201 bp, Homo sapiens
atcatgaggtcaggagatcaagaccatcctggctaacacagtgaaaccccgtctctactaaaaatacaaaaaaattagccaggtgtggtggcgggcgcctrtagtcccagctactcaggaggctgaggcaggagaatggtgtgaacccgggaggcggagcttgcagtgagctgagatcgtgccactgcactccagcctggg

SEQ ID NO: 50472 - DNA, 201 bp, Homo sapiens
gggatgcgtttggagcatgaggtatgtggaagagcagaggcaaagtgacacagaaggactctaggaaaggaagccagggtcagctttgggagggtgcgttwgctggttaaggagctctccctttcctcacccctattgggcccttgtgtgtgccacatatgttgccaggtgcacaatgttgaacaaaacagacaccattcc

SEQ ID NO: 50473 - DNA, 201 bp, Homo sapiens
tacagtcaggttttgtttttgttttgagacagagcttcactcttgttgcccaggctggagtgcaatggcgacatctcagctcaccacaacctccgcctccyaagttcaagtgattctcctgcctcagcctcctgagtagctgagattacaggcatgcgccaccatgcccagctaattttgtatttttagtagaaacagggt

SEQ ID NO: 50474 - DNA, 201 bp, Homo sapiens
gcatccctgagcttctgattaggggctgggctcttcctggggcgtacagagatgagttcagcctctggccccttgagctcctggtgagaggggataccagygaagactatcccagcacccaggagtgcacacggcactgggatgagtgactgccactcagaggcctgcatgtgtcaggaggacagtccaggcagaaggaat

SEQ ID NO: 50475 - DNA, 201 bp, Homo sapiens
ttcccctcttctaaaatatgatgtaacaacattccccatgtaagattgcttggggcagccaggcatggtggcacatttaagaccagcctgggcaacatagygagaccccatctctacaaaaaataaattagctggatgtagtatcacatgcctgtggtcccagctacttgggaggctgacaggaggaccacttcagcccag

SEQ ID NO: 50476 - DNA, 201 bp, Homo sapiens
tgcctggcatcgagctctgagacctctttaccatcaggccaaacagtgtcagagacacactgagaccacacaaggctcctgtggctggaagcagggttcarctcatttcgtggttctttaaccagcatccctgagcttctgattaggggctgggctcttcctggggcgtacagagatgagttcagcctctggccccttgag

SEQ ID NO: 50477 - DNA, 201 bp, Homo sapiens
cagcccaaatgtccatctgcagatgaacagatcgataaaatgtggtctatccatacagtggaatattatttagccataaaaagtatgaagtcttgacacaatgctacaacatggacgaaccttgttcataaaagcactgtgctaagggaaataatctgatggcaaaagactacctattgttaattccatttatatgaaatg

SEQ ID NO: 50478 - DNA, 201 bp, Homo sapiens
ttcattgtgtgttactgagctcctaccctcatcctggcactgagctagaaacatgagtgaacagaacactgtctttgcccttcatgctaagagggagaggygtgcggagaactctcagtgcaggtgttaagtgcaaatagaagcctgttcaagtgacccagaagggggagagattaactccatttgagagagcaggatagg

SEQ ID NO: 50479 - DNA, 201 bp, Homo sapiens
ctgccttggtagtccacagagctgtagggaactgctggcctgggcatcaggagtgccggccctgcctgagcgcctctcttctctgggcttcagtttcttcrtctttaaaatgacagcacggggtcagcaggtctccaaagacccatggctctgcctccctcagattctgtattcagtagagcagaaagtacatgatgttct

SEQ ID NO: 50480 - DNA, 201 bp, Homo sapiens
attgattttcctgcctcagcctcccaagtagctgggactacaggtgcacgccaccatgcccagctaatgtttgtatttttagtagagacaaggtttcaccrtgttgcccaggatggtctcgatctcttgacctagtgatccgcccacttcggccacccaaagttctgggattacaggcgtgagccactgcctggccaataa

SEQ ID NO: 50481 - DNA, 201 bp, Homo sapiens
gtgagaacgtcttctgcgaagtcttgtttgcctcgcttcttttccctcagagccaaaatttgtccacagtacattcagtatccatgagccatcttaatttkgcagctgctctgtgtgtacgggcttgtgtttgagtgtgaggatgatcatgtgagccatcccctactcacctttaagacagtgcccctagtatatcagatc

SEQ ID NO: 50482 - DNA, 201 bp, Homo sapiens
tttttctccagagcagtggagaagagctgagaaatcttaaggtgccagcattgatggaaagagatagataggattgtcttagaggtgaacactcaatagtmtgccatccactcccaggccccagaagttgcaaccaagtgataaaggaaaaacactctacttgttgagcactaatgtgtattaaaagggtattttcattct

SEQ ID NO: 50483 - DNA, 201 bp, Homo sapiens
tcagacaggcttagtcagctagcaagtggcaatttagaagacagacctgtctgactctccaactccatgtactgtccaggaaagccaggtgtcccatctcrtgctttctgttggtgagaacgtcttctgcgaagtcttgtttgcctcgcttcttttccctcagagccaaaatttgtccacagtacattcagtatccatgag

SEQ ID NO: 50484 - DNA, 201 bp, Homo sapiens
taacatgtataaagatgtaatcaacaggttcaacccacttgcctagacacccactctgggtccagctctggggtaatacaaggagcacaaggatcaataaraggtcatctctgcctttgaggaactccacggtggtgagagatgaggaggaggttgtgtagcgactgtgttttcctgggctacagcagagaagtgggaagg

SEQ ID NO: 50485 - DNA, 201 bp, Homo sapiens
cagaaccaactcgtgaacccatgggtttctaacccgaagtctatttcttggggtttaccccaccaatatttctttcactttaagaagttattttcccatgrtgtaggtcaaatcccaccagactctgcagtcctcaaggacaaggactgtgtcttattctctgaatccccctggtcctggcccccaaatacttagttgttc

SEQ ID NO: 50486 - DNA, 201 bp, Homo sapiens
ccttggtgtgtcctcttagcaaccagggaaagatgtgccgatctcaactgagaaaattaaaggatagcactcaagtctgtagagaaaattccagtgcctcrgttctgtaggatctcacctgtcctctgggacccaccctaaaaagtgtttcttacttgaaagtttgagtaacatgcatccgacgtataaagaggacttaga

SEQ ID NO: 50487 - DNA, 201 bp, Homo sapiens
ccattaccagctgggggtgttgagcagctcgctttacctccctccaatctgttcccttttccatggccactaggacacttagcaagggcaggagcaccagmgtgaaagaggagcaggctcaggggcccagccctgggctgtgggctggggatgcagacaaccagagctgagtcagatgggagaggaaccactccaggttca

SEQ ID NO: 50488 - DNA, 201 bp, Homo sapiens
gataattaatgttttacaaatgtgcgttgtatttctaaatatatgcacactgtgccttttgttttgtttttgttttcattttgtttgctttatttttgcgsaaccattttaaagtaagttattatgacgcttcactcctaagtatttcagcctgtattttctaagaagataggacattctctatcctaatcataaagccat

SEQ ID NO: 50489 - DNA, 201 bp, Homo sapiens
tgggcaggaagtggagtgtgtgcctgcttcccttccctgtcttgtcctggaaactcaaagggtgggcaggaagtggagtgtgtgcctgcttcccttccctrtcttgtcctggaaactcaaagggtaggcaggaagtggagtgtgtgcctgcttcccttccctgtcttgtcctggaaactcaaagggtgggcaggaagtgga

SEQ ID NO: 50490 - DNA, 201 bp, Homo sapiens
gagggctgtgatgagtgtgcttgaccattataaaactaccttcattactagagggacacagattccccccacctctaccatgattgtattgttgaaagcckccttttatcattttgctgccatatgtgtttgtgaaaatcagctgcgttgtaaaaattcttacttcctggaaaccagaaacccattcagctagtgtcccta

SEQ ID NO: 50491 - DNA, 201 bp, Homo sapiens
gtctttcatcttcattagaaccaggtacagtgttggtattcagtggtagaaaggtatctcccctcctaaagaaaattgatattccttgtaggttttttcaraatgatgataaaattgaaagcagtgttactaccagtaattaataatagatctactattttaataaattcctaatttatactaaatatgtatctctaatat

SEQ ID NO: 50492 - DNA, 201 bp, Homo sapiens
atctccactaaaaatacaaaaattagctgggcgtggtggcacatgcctgtaatcccagctactcaggaggctgaggcaggagaattgcttgaacccaggargcggaggttgcagtgagccaagatggtgccactgcactccagcctgggcaacagagtaagtgagactccatctgaaaaaaaaaaaaaaaaaaaaaaaaag

SEQ ID NO: 50493 - DNA, 201 bp, Homo sapiens
ctcccccagtcttccccaaacaatttattgtctgcacacacacacacacacacacacacacacacactctctctctctctctctctctctctctgtgtgtrtgtgtgtgtgtgtgtgtgtgtgtgtctctctctctgtgtctctctctctctctctaagccactccactccccttccactgttcctggtccctgtgaatgg

SEQ ID NO: 50494 - DNA, 201 bp, Homo sapiens
gtcttactctctcacccaggctggagtgcagtggtgcgatctcagctcactgcaaccttcgcctcctgggttcaagcaattcttctgcctcagcctcccargtagctgagattacagatatgcgccaccacacccagctaattttttgtatttttagtagagaaggggtttcactatgttggtcaggctggtctcaaactc

SEQ ID NO: 50495 - DNA, 201 bp, Homo sapiens
atcccagcgactcgggaggctgaggcaggagagttgaacctggcaggcagaggttgtggtgagctgagattgcgccattgcactccagcctgggcaacaakagtgaaactctgtctcaaaaaaaaaaaaaaaaaaaagtctggtaatcttgcctattcttcctcatggtgtgaatctggaggcattctccattccccaaac

SEQ ID NO: 50496 - DNA, 201 bp, Homo sapiens
aagacgctttccttcactccttgttgggtggtttttttggtgtgtgtgtgtgtgtgtgcgcgtgtgtgtgtgtgtgtgcgtgtgtgtgtgtgtgtgtgtgtttattccttccctttcccaaaagataatggagaaggaaaaaagtaagatgagttccacccagctgaaaatgaaactactggaagaacgattgttgccatt

SEQ ID NO: 50497 - DNA, 201 bp, Homo sapiens
gaagacgctttccttcactccttgttgggtggtttttttggtgtgtgtgtgtgtgtgtgcgcgtgtgtgtgtgtgtgtgcgtgtgtgtgtgtgtgtgtgtgtttattccttccctttcccaaaagataatggagaaggaaaaaagtaagatgagttccacccagctgaaaatgaaactactggaagaacgattgttgccat

SEQ ID NO: 50498 - DNA, 201 bp, Homo sapiens
gttgggggaagacgctttccttcactccttgttgggtggtttttttggtgtgtgtgtgtgtgtgtgcgcgtgtgtgtgtgtgtgtgcgtgtgtgtgtgtgygtgtgtgtttattccttccctttcccaaaagataatggagaaggaaaaaagtaagatgagttccacccagctgaaaatgaaactactggaagaacgattg

SEQ ID NO: 50499 - DNA, 201 bp, Homo sapiens
ctcctccctggctccattctgcctctaactctactcccttagcagccacgaggagctctacctgtggtttctagcaccacctttgttctgggagctccagktttctgtttctagctcattcctgtttcacaagcttcagctactagaatgtcttagtcagacttcccaaaccagctgtaccccagttccaccaaggtgtca

SEQ ID NO: 50500 - DNA, 201 bp, Homo sapiens
ggatgctgtaggctctgggaggagagatgctgaccctagccttgagaataatgcttctcagaggaagagaatgcccacactgaaacctagtagataaatakaagaattagataaaccagggagcagagagcagcatctgcaaagacttaggtgtaggcaaagggggctttccaggagatatgagtagttcagcctccgata

SEQ ID NO: 50501 - DNA, 201 bp, Homo sapiens
tgttgggggaagacgctttccttcactccttgttgggtggtttttttggtgtgtgtgtgtgtgtgtgcgcgtgtgtgtgtgtgtgtgcgtgtgtgtgtgtgtgtgtgtgtttattccttccctttcccaaaagataatggagaaggaaaaaagtaagatgagttccacccagctgaaaatgaaactactggaagaacgatt

SEQ ID NO: 50502 - DNA, 201 bp, Homo sapiens
ggccatttttcacttagatagcagggctgtacaaaacaccctgtggtacaggataatgtgttggtgtccccgtgttttaaagtttggatataacacctttkcatgctcattttatttcaatttttaaaatgcataaaaataaattaaaaatggaaacttgagtaaaaatgtgggaagctctaaagaacctccatgaagtcc

SEQ ID NO: 50503 - DNA, 201 bp, Homo sapiens
ctgttgggggaagacgctttccttcactccttgttgggtggtttttttggtgtgtgtgtgtgtgtgtgcgcgtgtgtgtgtgtgtgtgcgtgtgtgtgtgtgtgtgtgtgtttattccttccctttcccaaaagataatggagaaggaaaaaagtaagatgagttccacccagctgaaaatgaaactactggaagaacgat

SEQ ID NO: 50504 - DNA, 201 bp, Homo sapiens
gtgtaagcttcctcctgactaggtgatattgctgttgggggaagacgctttccttcactccttgttgggtggtttttttggtgtgtgtgtgtgtgtgtgcrcgtgtgtgtgtgtgtgtgcgtgtgtgtgtgtgtgtgtgtgtttattccttccctttcccaaaagataatggagaaggaaaaaagtaagatgagttccacc

SEQ ID NO: 50505 - DNA, 201 bp, Homo sapiens
ccgtggggcagggatcggggtaggagggatcctgcatgagaggctgtgggtcagacaccagtcagcagggggcgcggtggagcacccattgatttctaggycctcttgggctagcatcgtttcttcccgagtgggagctcaggcccagaatgtggatttgaccagtcttcccaaggtcacccagttgaaaagtggccaggc

SEQ ID NO: 50506 - DNA, 201 bp, Homo sapiens
ctgtgtggtggtttccatggggtgcgcacagctgcgaggccccaagttatcttccttttggtctgccaggtataggtaaattgcccatccaactgggtgcwtagaaagagccaatggtggccgggcgcggtggctcacgcctgttatcccagcactttgggaggccgaggcgggcggatcacgaggtcaggagatcaagac

SEQ ID NO: 50507 - DNA, 201 bp, Homo sapiens
tatctcttatttcgttgtttctgacccagaaaactgaagaggcaagatcccgtagtggttgaaagttggcaaatccacattcagttcctagctctaccttkagctgctgtgtgaccctgggcaagtgactccccctctctgagccttggctactttgtctgcaaaatggggttgcagtaaagaattcatgagaaattgtat

SEQ ID NO: 50508 - DNA, 201 bp, Homo sapiens
gccactgctgcacatgctcagtgaggcttggcggccatcctggcacatggctcttcctgggtcaaccgtgacctgtctggctcaggaatgggctctggctkctgggggagccgtgtcactcctgggccatgggggcacctcctgggcacttaggtgtttcagcatagattccagtttcgcaccctgggcagacccccaggc

SEQ ID NO: 50509 - DNA, 201 bp, Homo sapiens
agtagaacagaatagagaatcaactgatatctagatatattttttagaaaggtgccaaggtaattcaaagggtagtctgttaaaaaatgaaagggtagggmaggcatagtggctcacacctgtaatcccagcactttgggaggctgaggtgggtggatcacctgaggttgggagtttgagaccagcctggccaacatggcg

SEQ ID NO: 50510 - DNA, 201 bp, Homo sapiens
atatgtgaagcactgttctcagtgattggcagatagtaatgtgaattcagtggtcatggtggtggctgttttttgtttttgttttttttttttttttttttgagatggagtttcgttcttgttgcccaggctagagtgcagtggcgagatcttggctcaccacaacctctacctcccgggttcaagtgattcttctgcctc

SEQ ID NO: 50511 - DNA, 201 bp, Homo sapiens
tatatgtgaagcactgttctcagtgattggcagatagtaatgtgaattcagtggtcatggtggtggctgttttttgtttttgttttttttttttttttttttgagatggagtttcgttcttgttgcccaggctagagtgcagtggcgagatcttggctcaccacaacctctacctcccgggttcaagtgattcttctgcct

SEQ ID NO: 50512 - DNA, 201 bp, Homo sapiens
atatatgtgaagcactgttctcagtgattggcagatagtaatgtgaattcagtggtcatggtggtggctgttttttgtttttgttttttttttttttttttttgagatggagtttcgttcttgttgcccaggctagagtgcagtggcgagatcttggctcaccacaacctctacctcccgggttcaagtgattcttctgcc

SEQ ID NO: 50513 - DNA, 201 bp, Homo sapiens
aatatatgtgaagcactgttctcagtgattggcagatagtaatgtgaattcagtggtcatggtggtggctgttttttgtttttgttttttttttttttttttttgagatggagtttcgttcttgttgcccaggctagagtgcagtggcgagatcttggctcaccacaacctctacctcccgggttcaagtgattcttctgc

SEQ ID NO: 50514 - DNA, 201 bp, Homo sapiens
taagtgagttaaatatatgtgaagcactgttctcagtgattggcagatagtaatgtgaattcagtggtcatggtggtggctgttttttgtttttgtttttkttttttttttttttgagatggagtttcgttcttgttgcccaggctagagtgcagtggcgagatcttggctcaccacaacctctacctcccgggttcaagt

SEQ ID NO: 50515 - DNA, 201 bp, Homo sapiens
attgtatcagttgctttatcatgtatttattcaactatttatcatccatagcatccattaatccatctttttttttttttttttttttttttgagacagastcttactctgtcacccaggctggagttcagtggcactatctcggctcactgcaacctccacctcccaggtacaagtaattctcttgcttcagtcacccaa

SEQ ID NO: 50516 - DNA, 201 bp, Homo sapiens
ggggatatacttgaatacttgataagaaaagtactggaatatgtggtataccttttcataactattgtagattcacagaaaggaaatttttccaagtgtcrtctatagaacaggttacaaatgtcaggtgatcaaatgtaatgaatgaagttaggctgtagtattgtgattagataacagtcttgataagttgggattatc

SEQ ID NO: 50517 - DNA, 201 bp, Homo sapiens
cctcctgccccagggctgaaaccttctctcatccaaaagtcattgggaaggttgggaagcaagataggcttctattgtgtgtgtgtgtgtgtgtgtgtgtrtgtgtgtgtgtgtgtgtgtgtgtgagagagagacagagacagagacagagagattgtgatggctaagcatggggtgtgggagaccaaggtgtgagtaact

SEQ ID NO: 50518 - DNA, 201 bp, Homo sapiens
agtaagttgtaggctgggaggctaggccagtctctctctccttttcatgtttttctgcctgctttatattcactggcagcttattagatggtgcccaccasattaagggtggatctgccttccccagcccactgattcaaatgttaatctcttttggcaataccctcacagacacacccaggatcaatactttgtatcctt

SEQ ID NO: 50519 - DNA, 201 bp, Homo sapiens
atgtaaatgtcaggtccatgttaaaaactcagtaattgttaggtttttttcttttttttcaccttctgtatcaaaagactaagaacattactgtatattasaaatgtcagagaaaggtatgtttaaggtaatggagaagaaaattttaatgaccaaggaattaggctgttaacatgcagagtagggcttaacattgtctca

SEQ ID NO: 50520 - DNA, 201 bp, Homo sapiens
ttcaggagcgaagagctgcttctgtatcttaaggtaagggagaaggcttgggctgttggcttgttctctgaagcaatgtcagcttctgcattgctcttccrtaattaaatcttccagctgttcatttcattttcctatctgtttcccacaagtcactgcatttggggagaaggacttcacagtgttgttcttgcactgtaa

SEQ ID NO: 50521 - DNA, 201 bp, Homo sapiens
tggagccgaggggcttttggaggcaagctttcctttatcttatcaagcactacagtgagaaccacaaggtaaggattttatatcctaatctcaggatttaycattgtacgtgatcatactactattgtactgtttagagcaggtcagactgagaaatcatgctggactggttttgtgtctgatctgtggttttagtagctg

SEQ ID NO: 50522 - DNA, 201 bp, Homo sapiens
tctaactaaaaaatacaaaaattagctgggtgtgatggcacatgcctgtaatcccagctacttgggaggctgaggcaggagaattgcttgaatccgagacrtggaggttgcagtgagccaagatcgtgccactgtactccagcttgagtgacaagagcgaaactccatctcaaaaacaaaacaacacaaaacccacaaaaa

SEQ ID NO: 50523 - DNA, 201 bp, Homo sapiens
agagcacccagcctgccccatatcacttcaccaaatatttctaaaatgattcagtttttctcttgtttacttgaagtcacagttttcttgcaagattctayttccccttcttgccttttcccccctgcctcctgactttcagtggctggatttaactagtggtattttgctttcaggaaaaaaaaaatttgtaatccttgg

SEQ ID NO: 50524 - DNA, 201 bp, Homo sapiens
agcccctctgtacccatacattcctcatatccctggggtcctgtgtctctctcctcgactggtctgtgaggcacaatgggtatcagaaagcatcagcacaygttgagataggcagggcctgcagcctcccgaatgtggcacctctccaggattctctccctgaccactggtttgcctgcatggtcaagaggacgtacccag

SEQ ID NO: 50525 - DNA, 201 bp, Homo sapiens
gagggttgtattcagagaaatagcagctgggaatatgtatgctgggccactgtggaaggggatggaagtagttgaggcagagagaccactgatgatcccayggacattgctcaggccagggctggtgggagcctaatctaggacactgcttctgggggtaaagatgagaaaatcatcctagagacatttaggagacccaaa

SEQ ID NO: 50526 - DNA, 201 bp, Homo sapiens
accgtgttagccaggatggtctcgatctcctgacctcatgatctgcccgccttggcctcccaaagtgctggaattacaggcatgagccaccacgcccggcytgtccagtgggaatttcaagtgaactctgaagtccttttaacaggatcccagtagtttcttttcttttatttatttatttatttattttttttgagacag

SEQ ID NO: 50527 - DNA, 201 bp, Homo sapiens
ttcaccgtgttagccaggatggtctcgatctcctgacctcatgatctgcccgccttggcctcccaaagtgctggaattacaggcatgagccaccacgcccrgcctgtccagtgggaatttcaagtgaactctgaagtccttttaacaggatcccagtagtttcttttcttttatttatttatttatttattttttttgaga

SEQ ID NO: 50528 - DNA, 201 bp, Homo sapiens
aaaagttaaccaaaaaatttaatttttaattttttttttttagttgaagttgtactttgtcacccaagctggagtgcagtggtgtgatctcggctcactgyaacctctgcctcctgggttcaagcgattctcctgcctcaacctccccagtagctgggattacaggtgtgcgccaccatgcccagctaatttttgtgtttt

SEQ ID NO: 50529 - DNA, 201 bp, Homo sapiens
ctgggaggcaaaggttgcagtaagctgagatcacgccactgcactccagcctgggtgacagagcgagactctgtctccaataaaaaaaaaaaaaaaaaaamaaagaaagaaagaatgaaagggtagtctattaaaaaatgtcgatggagcagttgggtatccgcagggaaaaaaaaggaactgagttttggatgaaatcac

SEQ ID NO: 50530 - DNA, 201 bp, Homo sapiens
tgcccattagcctttcctcatagttattttatgaaagtgcacaattaatgtgagagtgtcgtgaaacctttggagacagtgccctggacatactgaggtarattttgttcaaaatcaacagatagcaccctactgtaatctgctaacagcttgtttatctaattgtcaataaaatttctggttcaggaaagaatttatgtt

SEQ ID NO: 50531 - DNA, 201 bp, Homo sapiens
attttggccaggctgatctcaaacacctgacctcaagtgatctgcctgcctccacctcccaaagtgctgggattacaggtgtgagccaccattccaggccscagatgtcatatcattcttaaatacttccatatgtgcctctaaaaggtagatttttctttttaaaaaacataacattttcacacctaaaaagttaaccaa

SEQ ID NO: 50532 - DNA, 201 bp, Homo sapiens
tgttatgatggttaatcttgtgtgtcagcttgtctaggctatggtacctaattatttggtcaaacactagtatagatggtactgtgaaggtattttaaatstaactaacatttataatcattgacttttagtaaaggagatcaccctccataatgttggtggtcctcatccaatcagtttaaagccttcagagcagaaact

SEQ ID NO: 50533 - DNA, 201 bp, Homo sapiens
tttactacataaagttcttaaaacattaaaaatggtaaaggtcctcaaaaaattaatgtagaattattatatgatccagtaatttgacttgtggatatatrtgcaaaagaagtgaaagcagggacctgaatagacatttgcacatgcatgttcatagcagcattattcacaatagccaaaaggtggaaataacccatatgt

SEQ ID NO: 50534 - DNA, 201 bp, Homo sapiens
tgaagcaaatcccagatgttgtcatatcatccttttttttttttttttttttctgagacagagtctcactctgtcacccaggctggagtgcagtgatgcartctcggcacgctgcaacctccacctcccaggttcaagtgattctcgtgcctcagccaccccagtagctgggattacaggtgtgcaccaccatgcctggct

SEQ ID NO: 50535 - DNA, 201 bp, Homo sapiens
ctacttccttggcttttctttctgtctcctttgccagttattccatacctccccaaagtgttaaatggtgctcccttccagggctcagtccttgggcttcttttttttttttttcctttttgagatggagttaacgctcttgttccccaggctggagtgcaatggcgggatcttggctcactgcaacctccgcctcccagg

SEQ ID NO: 50536 - DNA, 201 bp, Homo sapiens
aaattcagtgtacttttgatggaagacatagttctttgtcttttgaatttttaaaaagtgttggtatgattgactgttaattcatgtaagaatatacaatkggtcacatttatgagtgatgcctaagtgcatcttttgaaagatttggatagtgggaagatgagaaaggtgaatagagcatgtcaagttttgtgggaaagt

SEQ ID NO: 50537 - DNA, 201 bp, Homo sapiens
tattggaaatctattcagttttataaaagatttatacaaataatttatatttatctctgtttaactggtactacttttcagtctttttaaagtgttttttktgtgtgtgtgtgacagagccttgctcttgtcgcccaggctggagtgcagtggcacgatcttggttcactgcaattactacctcctggattcaagcttcct

SEQ ID NO: 50538 - DNA, 201 bp, Homo sapiens
tctgcctcctgggttcaagcaattctccttcttcagcctccctggtagctgggattacaggcatgcaccaccacacccggctaatttttgtatttttagtrgagatggggtttcaccatgttggccaggccggtctcgaactcctgaccttaagtgatccacccaactcagcctctcaaagtgctgggattacaggtgtga

SEQ ID NO: 50539 - DNA, 201 bp, Homo sapiens
ggagacggaggttgcagtgagtcaagatcacgccactgcattccagcctgggtgacagagtgagaccctgtctcaaaaagaaaaaagaaaaaaaaaaaaaaggatggctttgagagattttaagtagaaatgacaagacttggtgacaaattacacgtaagaggcaaaagaagaatcaaagatgacttgccaaggttagca

SEQ ID NO: 50540 - DNA, 201 bp, Homo sapiens
gcaatggcacgatctcggctcactgtaacctctgcctcctgggttcaagcagttctcctgcctcagcctcctgagtagctgggattacaggcatgtgccamcacgcctggctaattttgtatttttagtagagacagggtttctccatgttggtcagactagtctctcactcctgacctcaggttgtctgcccgccttggc

SEQ ID NO: 50541 - DNA, 201 bp, Homo sapiens
gtgtgtgccaacatactctgctaatttttgtgtttttagtagagatggggtttcatcatgttgaccaggctggtctccatctcctgacctcaggtgatccwcacaccttggcctcctgaagtgctaagatttcaggtgtaagccgcagtgcctggccagatgtgtgcttttctaagagtcactgttgattcttgggttttt

SEQ ID NO: 50542 - DNA, 201 bp, Homo sapiens
ccctccctcttggcaccctgcatatcgtattataattgtcttttctgtttttcttgagggcaggaaccttcttgcttgaattctcccttgaagaataatcstattcagtaggtagctagctaaatgaagagatatttaaaaatatctcattcagtggaatttgttatgtccaaataagcaaggcaatgttagtatcagttg

SEQ ID NO: 50543 - DNA, 201 bp, Homo sapiens
taaaagcgttcctacttctacacatcctctcctgcatctgttgtttcctgactttttaatgattgccattctaactggggtgagatggtatctcattgtcsttttgatttgcatttctctgatggccagtgatgttgagctttttttcatatgtttgttggctgtataaatgtcttcttttgaaaagtgtctgttcatatc

SEQ ID NO: 50544 - DNA, 201 bp, Homo sapiens
ggtcagggtcagagagtacatctatatgtatttctgcatctatctgtgtatattgaaaagtgtgagtccacaccagtacttccgatttcaaccaataccaycgattcattcaagttttctccctttccatatttgtaacttctctcttcaactgtgagaagcctggttcccattatccttaatatatttacttattaatcc

SEQ ID NO: 50545 - DNA, 201 bp, Homo sapiens
tctctcctccactcttcacagcagtcccgcagaggaagaattatcctcgtcttacagaagaggaaaaggaaccttagagaatcattattagctgatattgwcagtatttgaacctagctctgtttgactctgaagtccatgttcctcccattcttttgtcttgcccccatcccaaacttggtgccttatttgacttaggct

SEQ ID NO: 50546 - DNA, 201 bp, Homo sapiens
ttggtttgttaggttgtgcttaccatgaaaggaaaagtgacaaaagtatttgggaaagattttatacacagaccaaaatgaaaaatattttcatcatggcygtccaggaagtagaaaatcagctaagtgctaagtggaacattcatttcctctttctagtattttggttaacggaaatacatccccccaaaatgcccccaa

SEQ ID NO: 50547 - DNA, 201 bp, Homo sapiens
actttcctatcctttcattcttgagtctgcaggcatcagcctacatgccatcaggcaggctttgctcatgagctcagggtggctgctatttcacctgtggrccttacaccctcaccacaatttccaaaggcagcaaaaatttttgttgttgttgagatggagtctcgctgttgttggccaggctgtagtgcaatgacacga

SEQ ID NO: 50548 - DNA, 201 bp, Homo sapiens
aggcagaaacttgctgtaatacacacccatcatatgtctagaaccaagtgccctgaacattcacgtgcattctctcctccactcttcacagcagtcccgcrgaggaagaattatcctcgtcttacagaagaggaaaaggaaccttagagaatcattattagctgatattgtcagtatttgaacctagctctgtttgactct

SEQ ID NO: 50549 - DNA, 201 bp, Homo sapiens
ctgggactacaggtgtacaccatcatgcccggctaatttttgtatttttggaagagacagggtttcaccatgttggccaggctggtcttgaactcctgacytcaagtgatccacccatcttggcctcccaaagtgctgggattataggtgtgagccaccacgcccagccaagcttcagtatttttttctaaaaggtgactg

SEQ ID NO: 50550 - DNA, 201 bp, Homo sapiens
gtgattgaggcctgatggtaagattaacatgactaaaatgtgggggcatgtgggttggtagggggtggtgggcagatgaagctgataagtctggtctcacygaggctaaattgcaaatagtcttgcatcgcatgtcctgctaatgacggtcttttaactcctgaatgcatttgggagcctttgaggtttacattgtgtttt

SEQ ID NO: 50551 - DNA, 201 bp, Homo sapiens
cctcccgagtagctgggactacaggtgtacaccatcatgcccggctaatttttgtatttttggaagagacagggtttcaccatgttggccaggctggtctygaactcctgacttcaagtgatccacccatcttggcctcccaaagtgctgggattataggtgtgagccaccacgcccagccaagcttcagtatttttttct

SEQ ID NO: 50552 - DNA, 201 bp, Homo sapiens
attttaaagtacagacttaaaaacaaattttgtggagttacatcaaaatgatcatctcctgtcaccattatttttgaaaagaaattacattttcatatctraaaggcaggaggaatatgatgtccaattaaggatagtttttataattgaattaaatatctttatatggaaagtacactgtattgtccccgtttttctcat

SEQ ID NO: 50553 - DNA, 201 bp, Homo sapiens
cccccaaacccttcagtcctaggcaatcactaatctacttgctatagatttgccttttatgggcatttcatatattaataaatagaatcatatataacccktcctgcgtggcttctttcacttaatgatttcaagatttatccatgttggagcatgcatgagtgtttcattactttttactgctgaataatattccattgt

SEQ ID NO: 50554 - DNA, 201 bp, Homo sapiens
attcagaacccttttaagttaacctctttgacttcccttgccagacctttagtttattggaaattgtccaaggaaacaatcttttagagcctactggtttkgggcttttgtcgacttctacttcaccctaccaggaattaaaaaagggaatcaattgagaataagtacctcctggtaagctgtggcaccccaaaaagaatc

SEQ ID NO: 50555 - DNA, 201 bp, Homo sapiens
gagcttgctttatctagcagcttaatgtgatgccactttcccctttatctcctgtgcattagcaggactcctgtccttttggttccttgatcataactagytctttccagtccccagaatctctgcctagttcttttctctgcctgaaacaacccagtgccctgtttcttgagtggctgctccatttcatcctttggtcaa

SEQ ID NO: 50556 - DNA, 201 bp, Homo sapiens
ttgttactatgaaaagaagccacattataccaacattgtatgacacaaatgtataatatttacaggaagtataaaacaaatgataaattttgattttttttgcatcattattaggcagagaaacataagaagcagtgtggtgtataaaatgtgactttgattccacaaaggttctgccagtctttcgacagtggcttgttt

SEQ ID NO: 50557 - DNA, 201 bp, Homo sapiens
ctttattttttcattatgcaaagggtttacataggtacaagcaaatctcagttaaaagttagttccccgcccccatttaacaagatttcatatgcattttkacataactgcagaatattccatcaagtataactaccataatttccataaccaccctcccttgttggacatttaggttatttccagtcttttgatattata

SEQ ID NO: 50558 - DNA, 201 bp, Homo sapiens
taggatgtatgtatgtagaagaagaggacctgtggacctttttttttttttttttccgcttgagacagggtcctactctgttgcccggagtggagtggcaraaccatggctcactgcagccttgaactcctgggctcaagcagtcctcttaagtagctgtgcacactgccacatctgcctaatttttaaatttttggtgga

SEQ ID NO: 50559 - DNA, 201 bp, Homo sapiens
ccaccgcagagcctgaagcccacatcctgtgctggggccactgcctatgtgagtgtccagccagtggtcgtggaagggcttctcgggcatgctggggcacrggtatggatgtgtgaaattggcattcatgatttttgttgaaagaaggaaggagtgaacctacagactgagaagtaatcaaataaatgcccgaataaaggc

SEQ ID NO: 50560 - DNA, 201 bp, Homo sapiens
tttattttttattttttttttgagatgcagtttcacttttgttgcccaggttgaagtgcaattgcgtggtctcagctcactgcaacctctgccttccaggktcaagtgattctcctgcctcagcctcccaagtagctgagcttacaggcacccacgaccatgctcagctaagttttgtagttttagtagagacagggtttc

SEQ ID NO: 50561 - DNA, 201 bp, Homo sapiens
aggcccaagaattacctgcccagagcattagaatttgatgtaaatgattatttacatttggattgaacagtgcagtctttttctttttaaagaaaaatttstctttcagttttgtctgttatatttcagccctggccaggccactgcatatttatacagttgacccttgaacaatatgggtttaagggtactggtaccctc

SEQ ID NO: 50562 - DNA, 201 bp, Homo sapiens
tgaaatatttgaagctataaaccagactgtgtttttctcttgatcaaaatcattcagtggcattctattgcctccccccaccgccaaaaaaaaaaaaaaaatctgaattctttaccatgacctgtgggactctctgtgtgatctggagcttgctttatctagcagcttaatgtgatgccactttcccctttatctcctgtg

SEQ ID NO: 50563 - DNA, 201 bp, Homo sapiens
ttatctttagatagtaattaaacccctatgtagactggcccaaaggggtatagggctttcctttgcccagtgtgaagggagcccatgcttccttgctcatygattcattcggcagtggcaggatgctcgctctgtgctgggtgccaagcgtacagagaggagaggaccagatcctgcttgccaggtgcgcatagacaggta

SEQ ID NO: 50564 - DNA, 201 bp, Homo sapiens
aagtgaatccaaagtagactgaaatgaatcttgagttcatttctgaatttcatttgcaagtgtatccagcgttaggtgtgttaatttcatattttggttcrtactctgaggcttggtgtctcttgtgggcagagctttgtagatgttacttttctattacactatgcaatctgctgcttcatgtatgcataactgaaagat

SEQ ID NO: 50565 - DNA, 201 bp, Homo sapiens
tgcactgtgcctggccctgtgttgggcagtcatccctaagttctaaatgtgcacacttgagtaaaggaagtcggctgtagatgcaaacacttccaacaccrcgtggtccgtgctgccctgatggggactgtggagccccacagaagacatcaaactcagcctggaacagggatgcctgggttcatgttaaaagttgtcact

SEQ ID NO: 50566 - DNA, 201 bp, Homo sapiens
tgccactggataaataaagcctattatttccttttcaacattttaggctattattctcatacaagagctaataagcagaaggttaggtatattaccaaacyatgatcctgtctatcagaagaaaccaggaaccttgattaatatgccttgttaactgatgatttcagttccatattggtagtgctagaataatttgtataa

SEQ ID NO: 50567 - DNA, 201 bp, Homo sapiens
gggcgcctgtaatcccagctactcaggaggctgagcaggaaaatcggttgaaccctgggttgcagtgagccgagatctcgccactgcactccagcctgggygacagagcgagactccgtctcaaaaaaaagtctcatgcaagtggaatgtgaaaggatctaatccatgatctggcccctgccaccctgtctagtctcctct

SEQ ID NO: 50568 - DNA, 201 bp, Homo sapiens
agcaatggagggggcggtccaagcaatggtcgcctggtgcttcagcgtgcatgccttcccctccgccctggcagcctccactcgtagtccctgagtgacarttcatcacccgcagctgggcttctcgggctattcttcggtaccactaggggcaaagtgtctaaatttgacccccagaaatcagatccctgatccaagcca

SEQ ID NO: 50569 - DNA, 201 bp, Homo sapiens
ctgccaacctccacctcctaggttcaagcaattcttatgtctcagcctcccgagtagctggaattacaagtgtgtgccaacatactctgctaatttttgtrtttttagtagagatggggtttcatcatgttgaccaggctggtctccatctcctgacctcaggtgatcctcacaccttggcctcctgaagtgctaagattt

SEQ ID NO: 50570 - DNA, 201 bp, Homo sapiens
ggaccagaggtagacttataagagtgcacacaactcagcctcacttagcagagatttatttatctcttccaacttgacacatacgatttccttttttttttcgcctcctataacccaagaaatgattaatgaaggatctactttgttttgtagacattatcttcaaattcccagaaatatgtttgagagttgtatctactg

SEQ ID NO: 50571 - DNA, 201 bp, Homo sapiens
ggcagaaacttgctgtaatacacacccatcatatgtctagaaccaagtgccctgaacattcacgtgcattctctcctccactcttcacagcagtcccgcaraggaagaattatcctcgtcttacagaagaggaaaaggaaccttagagaatcattattagctgatattgtcagtatttgaacctagctctgtttgactctg

SEQ ID NO: 50572 - DNA, 201 bp, Homo sapiens
taaactcagaaggttcaaatcccatctcctcttttcccagcaacatctccatgagcatctccaacttttctggcttctccttctccatctacgtaatgagrgcaatcataagtccttggaggattgtagcgaggatcaaatcataacgtatgatgctgcctggtagtagtaactggttcctacacaagttttacctagtga

SEQ ID NO: 50573 - DNA, 201 bp, Homo sapiens
attctttgatttctttctttggtgttttgtggtttttggcatacagttcctacacctgtattgttagatttatacctaaatatttattcccttttttttttctttcccttattggtgctaatatgaatggtacagctaataattaaatactaagtttttattactttcattcttggctttctgaaggtgttttcctatcat

SEQ ID NO: 50574 - DNA, 201 bp, Homo sapiens
tcctctgaataggtgacttctgttggtttcagggtatcacataatcttaaagtagttctccttttggggtgaatgtaacatcctgtatttccataacttaycttgctaaaatatgaataaaaacttaataatgactctgcctctacataaaaaaataaaaatgttacctgggcttggtggcagacatctgtagtctcagct

SEQ ID NO: 50575 - DNA, 201 bp, Homo sapiens
tagtcctggtacttgcctgtccatactctctctctctctctctctctctctctctctctctctctctctcactttcccttcctcagcatctttctttaccytagaacatttatttcttccgcagaaagtaggtgatgccatcatgtttaattacctaacattctaaagcacagcttgtagattgagacctagattcaaatt

SEQ ID NO: 50576 - DNA, 201 bp, Homo sapiens
tctcagcatcattacatgtaccaaattagcagtgagtgttaataggacagaaataggattttcagttcctttagccaaaaagttaaaaatattaaacatcytgaagagtaatggagggataagcaatctcaaggtggtcgcagagagcctctggaaattgttatagtcttaattgtttacaggcttaatgaaaataccaac

SEQ ID NO: 50577 - DNA, 201 bp, Homo sapiens
cccaaattccagatggctttctttttggtaaacttcacaagctgattctaaaatgtatatgaatatgcaaaagatctagaatagccaaaacaatgttgaargagaagaacaaagttgtaggacttatattacctgtttgcaagactcactataaagttacagtaatcaagacagtgtagaaacacatataaatcaatagaa

SEQ ID NO: 50578 - DNA, 201 bp, Homo sapiens
caaaattaagagtccagaattagacctacacataagtggtcaattgatttttcaacaaatatgccaaagtaattcaaaagggaaagaagagggatcttttwttccaacaaacgtgctggaacaactggatatctatatggaaaaaaaagaagccttgacttttacctcatgcaaatattagctcaaaatagactatagacc

SEQ ID NO: 50579 - DNA, 201 bp, Homo sapiens
atgtaggatcctggattggatcttgggatagaaaaatggcatgaatggaaaactgatgaaatcacaataaagtctggagtttagttaatactaatgtgctrttgttagtttcttagttttgacaaatgtgtggtggtaatctaagatatgcaagcttgtccaacccaccccactttgttgttgtggctgttctgttttgtt

SEQ ID NO: 50580 - DNA, 201 bp, Homo sapiens
attaggagccaacttgaagggctcttgtgttcttttgactggtcctcatcattctctgggttctcctttgctttctggtgcaagatgttctgtgctcatcwtttagtttcttttccttagccatgaaatctgccattttcccaaggttccttttggtggagaatgctatttaaaagccaaaattttgattctatgtgtgtt

SEQ ID NO: 50581 - DNA, 201 bp, Homo sapiens
tttttgtatgtttagtagagacggggtttcaccatgttagccacaatggtcttgatctcctgaccttgtgatctgcccgcctcagcctcccaaagtgctgsgattacaggcatgagccaccatgcccagccgtggatgctttcttgtaagtgaaattggtggattataaggcatggaaatttaaaattcattctatttgtg

SEQ ID NO: 50582 - DNA, 201 bp, Homo sapiens
ggaagattgcttgagttcaggagttcgagaccagcctggacaacatagtgagatccctgtctctacagaaaaccaaaaaattagctgagaccacaggtgcmtgtggtggtgtgcgcctgtggtcccagctactggagaggctgaggtgggaggatcccttgagtctggaggtcaaggctgcagtgagccatgatcatgcca

SEQ ID NO: 50583 - DNA, 201 bp, Homo sapiens
atggtggctcacacctgtaagcctagcactctaggatccgaggctggctgatcacctgaggccaggagtttgagaccagcgtggacaacatggtgaaaccstgtctctactaaaaatacaaaacttagccagtcatggtggcatgcacctgtagtcctagctacttgcgaggccgaggcaggagaattgcttgaacccagg

SEQ ID NO: 50584 - DNA, 201 bp, Homo sapiens
aacctctgagcctcagtttcttcatctgttcttcacctgtaaaatagggatagtacatcaaacataagggctccagaaatatcagcagtcccctttcagcrtgctttgtacttacatttaatgggaacaagtcttttgttcccccagcccccctctttttttcaattcttttaaagctgttgattctgcaggacattgtgt

SEQ ID NO: 50585 - DNA, 201 bp, Homo sapiens
gaccctgctctagttaccagcaataatattggtgtggagggggcaggtaaacaaacctgccagctgacttgggccctagacttggttaaaccctggcttgscttcccttgattgtagatggtagaagcccaacttaaacgaacttgagcaaagaggataggagggagaatttcttggcttatataactgagacatcccgga

SEQ ID NO: 50586 - DNA, 201 bp, Homo sapiens
actcttgtcacccaggctggagtgcagtgggatgatctcggctcgctgcaacctctgcctcccgggttcaagtgattctcctgtctcagcctcccgagtakctgggattacaggcgtctgccaccacacccaactaattgttttgtatttttagtagagatggggtttcaccatgttggccaggctggtctcaaaccctga

SEQ ID NO: 50587 - DNA, 201 bp, Homo sapiens
aagggatgcttaaaggggacttaaaaaaattttttttgagtggtggatgtatttactccaggaatataaattgatccagaattcttgaaaaaaaaaaaaaatagacaaaaacacttgaaacatggggtcgatgttccatttctaactattataacaatttaattcaaaagaaattattttcaccttaaagtaaattaatca

SEQ ID NO: 50588 - DNA, 201 bp, Homo sapiens
agtgttgaatagaagtggcagaaatgaatattcttttcttcatccgcatcttaaagagaaacatttagtcttttggcataattatgatattaattatatcrtttttttagatgccctttatcagcttgatgaagttctgttttgtttctagtttgtttaattttttttattatgaaaggatattggattttgtcagatgct

SEQ ID NO: 50589 - DNA, 201 bp, Homo sapiens
ttatcaatttctgcaaaaagcccagctgggattttggtagggatttaattgaatctgtagattcatttggggaggattgtcagcttaacaatattgtgttscaatccatgaatataggatatctttccatttattaaggtaatgtttagggtttttttccccataatgttttgtagttttcagagtataagttttgcaatt

SEQ ID NO: 50590 - DNA, 201 bp, Homo sapiens
tttttaaagcagtatctttgaagtgcaataaaacaaactatgcccatacaaatcaacagtttctgagaaatttttgcatgtttatttaactttaattggcrtctttaccctcctcctggacaatacaagattgtatattgttttgactttaatcattcccctccttgtttatatggtttttattgttgtgtattttacttt

SEQ ID NO: 50591 - DNA, 201 bp, Homo sapiens
gatggtttcaccaaggtgcttgcaccagcactgggctctaaggacaaggaagatgatgccagcacactcatgctcaaggcttgctggctggacacatgccrtttagttggtgccaactttccaagaggctcctgttggccatggctacaggttagaagatcaaaggggtgctttagggagtgggactcatgggggatgcag

SEQ ID NO: 50592 - DNA, 201 bp, Homo sapiens
gacagagtcacctcagtcacccatatttgtggaatgacaggtacagaaggccccatccaagacatgatgcccagctcacaaagggcatctcaaaagagccrcaaaggacgttgatctcccctgagcacctgctgtgtgctccaaagtacgggcagcttgacacacaccatatcaccttaaacctcacaataggaagtaggt

SEQ ID NO: 50593 - DNA, 201 bp, Homo sapiens
gctgattgcgtttcagatagattctgttgctctaggggcctatcaggtccctgacacgtgtcctctctccagtgcacttcctcaaaccgtgttctcctcaytagggaaacagaaatctctaatcagcttggcgcttcctttcttgggactttggatgcaagtgtcattgtgttgaaaccgggaatctggcccctggtgaga

SEQ ID NO: 50594 - DNA, 201 bp, Homo sapiens
acatttaaatgtcaattaaatttgaaatatctacatttgtcagcatttcattttgggccagcgtgacgtgctgctgatttgtccacgcgatgtgacacatraaaaaaactcccgagatgcagatcttcctcattaaaaaataagccggtgcgatcccggcgcggcagagagcatggagcacgtccctgcttcctgacgccg

SEQ ID NO: 50595 - DNA, 201 bp, Homo sapiens
ccctctctgagccttggctactttgtctgcaaaatggggttgcagtaaagaattcatgagaaattgtatggacagcatttcgcccaaggcttgtaagtatygccatccatgtggcctggactcgacaaagctctgatctgaccacatcagatgacaaacttctcacctggatgtaccctgccactttcaagagacaggtgg

SEQ ID NO: 50596 - DNA, 201 bp, Homo sapiens
agcaactcccagtcctggaggaaataaagaatattggtttcccccaagaacagtatactggagaagctgcccaagaagaaaatggcttcactttctcagtrgcttgctaggaaagtaatgagaataaggtttcaaaacttagttcctctaatttaatgtctttggaggaatcggctcctttgcagagaatagctttgatat

SEQ ID NO: 50597 - DNA, 201 bp, Homo sapiens
ccatccgggctgcagtccctgttctccacttcttggccacgtggtcacctcttcaccagtgatgccccagtgcacagctagcctgggtctgctcacaccargtaggctcaaagcgcctcttggttgggtgcacagatggacagatggatgggtggactcatgaagccctcaccctctagaaaatcagtattgcgacacctt

SEQ ID NO: 50598 - DNA, 201 bp, Homo sapiens
gaggtcaagcaggctgagaaccagcactgccagatcccagagaataaggctatttggtgatcgctccccctcatcccttccccaggcaaatgaatagcatmatgaagtgaaagaccccttgacttgaagttagacttgatgctaacctggactctgccttttctaagctgtgtgactctacacaagttactatacctttct

SEQ ID NO: 50599 - DNA, 201 bp, Homo sapiens
aagcggtagctgtttttaatcactgcacctgctttcctcttagagccgattcccatctgcatttcttatgggaagaaaatcttacgctagtatgcatgaakaccaccttcattgtgtctccttagcttccacaggcctcccagctcatctgccgttcctgcactaatcagaatttcctgacttctccctgtttgtctcggt

SEQ ID NO: 50600 - DNA, 201 bp, Homo sapiens
gaagtcccgctgagctgagtcttcaagacggcagagcagtcagtgctccaagcaaaggtgacagggagggggaatatccagggcccagtgtggtcaaagayggtaagcatggccgcaggggaggccaggagagggccacagaggtaggtagagccaacacacagcatggagactgccctgctcggagctcggcacggccgc

SEQ ID NO: 50601 - DNA, 201 bp, Homo sapiens
gataaggaccaagcaagcccctgagcctggtgttcagggccctctctatcccagcgtctgctgacttcccagtcccatgtcccagtcccccacgttgtcaygtggctccccacattggactggacacccatgcctctgggacccgccaaaaccaaaaggaaaagctgactgtcgacccaaaagtgtaaacggatctactgg

SEQ ID NO: 50602 - DNA, 201 bp, Homo sapiens
gaggagtcaacctatacttgccttattgataactgatcactggttatttataataaaatttaaaggctgggcgtggtggctcatgcctgtaatcccagcaytttgggaggctgagaccggcggatcatgaggtcagaagttcgagaccagcctggccaacatggtgaaacctcgtgtctactaaaaataataaaattagct

SEQ ID NO: 50603 - DNA, 201 bp, Homo sapiens
gagaccctcacagaaagatttgtttcctaaaacctgagtgctagctagagctcataatttttgtgtttttttgagacagagtctcactctgtcacccaggytggagtacagtggtgtgatctcggctcactgcaacctctgtctcccaggttcaagtgattctcatgcctcagcctcccatgtagctgggattacaggcgc

SEQ ID NO: 50604 - DNA, 201 bp, Homo sapiens
tctcccttgttatccaattcattgccattgacttagttctggccttccttattctttcttggattactgccacttaattggttttctttatttttgagacrgagttttgctcttgttgcccaggctggagtgcaatggcgcgatctcggctcaatgcaacctccgcctcccgggttcaagcgattttcctgcctcagcctc

SEQ ID NO: 50605 - DNA, 201 bp, Homo sapiens
ccagctaattttttgtatttttagtagagatggggtttcactgtgttagccaggatggtctcgatctcctgacctcgtgatccacccgcctcggcctcccraagtgctgggattacaggtgtgagccactgcccctggccagtttaatgtttctttagtctcccttaggaaaggttctcagtctttccttgactttgatga

SEQ ID NO: 50606 - DNA, 201 bp, Homo sapiens
gacggagtctcgctctgtcgcccaggctggagtgcagtggcaagatctctgctcactgcaagctccgcctcccgggttcacgccattctcctgcctcagcytcctgagtagctgggactacaggcgtccgccaccacgcccagctaattttttgtatttttagtagagatggggtttcactgtgttagccaggatggtctc

SEQ ID NO: 50607 - DNA, 201 bp, Homo sapiens
tagcagtagaaaatatttccttgttttttttttttttgtccttctcccctttccctcctcccctttatctggcaacgaatgtacctcgtgactccccagawgcctctaatatagacatctcaagtttggtttctgccatgaaatcgaggcagtttccaacaaagatccaattttcaaatgtgctgggttgccacctggcct

SEQ ID NO: 50608 - DNA, 201 bp, Homo sapiens
atgttctttaaagcaaaaggattctgttcagaatcacaaattgcgtttagtttatttaatgtttctttctttcttttcttttttttttttttttttgagayggagtctcgctctgtcgcccaggctggagtgcagtggcaagatctctgctcactgcaagctccgcctcccgggttcacgccattctcctgcctcagcttc

SEQ ID NO: 50609 - DNA, 201 bp, Homo sapiens
tctctccaaagggatgttaaattttggtttaagattttctcttgctttagctttttctctcccactcttcctctttccccagttgtaatgctttattctaytcagtgttcataggatttgaacaacctactgtacccactctccacctttaaaaatgactttccttaagattacaaatgctaacaaaactcttccgataat

SEQ ID NO: 50610 - DNA, 201 bp, Homo sapiens
gaggatcatcaggagtctgccctggggggacatcccctgatcctgtcctcctcattctgagccttctcattctgcacacatggtggaggggccctgggaccagtcctaaggcagttccaggcccagggccttgggaatgctgctttaggtttctttcttacctctaacagccccagcaagtccagtttaggctttaaaaaa

SEQ ID NO: 50611 - DNA, 201 bp, Homo sapiens
aagcacagggcatggcacagagtttctctcagtttgaactatcatgaagaaaaacatgaaatttgttttgatccttcaaactggaaattgaggatcatcargagtctgccctggggggacatcccctgatcctgtcctcctcattctgagccttctcattctgcacacatggtggaggggccctgggaccagtcctaaggc

SEQ ID NO: 50612 - DNA, 201 bp, Homo sapiens
ataagggatgtgactaatttgtctgtgcccccatcttgtgctgaaaataggtttgaggaaccttaagacactatgtacagtacagcaagatgagagataargaagcaaggaaaccgggagaaagaggaaactgcatgacgcctggaagggactgatgtgtgtgtgcagctgtgtgtctgtgtgaggctctgtgaccctcca

SEQ ID NO: 50613 - DNA, 201 bp, Homo sapiens
ggcctttgcaggtaaagcttgggaccaccattctatgtttgtttagaaacaaaggcattgactgggggcttttctgaagtatgatgaacagtggcactgargttttgttttgtggttggaagttatcaacatccctgagagtggtttatgtgtcttgcctaaaatccttccctccataaacccaaatattgacaaaagcta

SEQ ID NO: 50614 - DNA, 201 bp, Homo sapiens
aggtggttgccaggtgctgggaggagagggaaatggggagttattatttcaggcctacagaatttcagttttacaagatgaaaagagttctggagatagayggtgataatggttacacaatagtatgaatgcatgtaatatcactgaactaaccgtacacttaaaaataatcggcagtaaattttatgctatatgtatctt

SEQ ID NO: 50615 - DNA, 201 bp, Homo sapiens
aggaaagcattgcatggggagtgagcttggggatttcaggttctatattacaaagtcagtgtggcacaaaggaagaaatgcatacttgggaatcaaatccsaggtctaccactgactttgttttgtggtattaggtaagtgatttaactaacctctttaggcctagtcccttctctgtaaaatgggtattgtatctatggg

SEQ ID NO: 50616 - DNA, 201 bp, Homo sapiens
acagctctcactggcctcagcagtgtcactcccagcgttactgagactttcagggttaaagaagacaaggtgtccctttaacacaggagtgaccttcccasataggggaatggtgcttgttggctcagccacccaccctttggggagctgtctggaccacagcctaaccacctcctggctactgtatctgcctctgagcct

SEQ ID NO: 50617 - DNA, 201 bp, Homo sapiens
gttatgaaaagtagttgtgatttatagtgactgttgattatgcaacttctgcctgtagctaggaatggggatggacaggaaattacccacttaagtgctcytctagttgttggagaagacagagctttggttactactggctggctttccctcctggcagggcattcaagatgttctcctggctgtggtgaaatctaagtg

SEQ ID NO: 50618 - DNA, 201 bp, Homo sapiens
cagttagggaaggagtcaactccccgcaccctcccaagccggtgcccactcagggctctaagccagctcatgctctgcccctcacagaccaggcacggggytgggctggcaacaggcctgctcagccctgcgggggccatggggcagactgcaggcctccaacgacgttgagggcacccaggagccaggaaagagttcaag

SEQ ID NO: 50619 - DNA, 201 bp, Homo sapiens
agtccacgccagcccttttggaagaggccttgccaccaggagggcagcattgtccttcaagaggaaactgtgccgtcccagctcctgcctggagcctggtrctcggggcattttggttactaaggggaccctggcctgctaagttagaaaaaggggccaggttttttcctattcttcagcctgctgccattgttgaaaaag

SEQ ID NO: 50620 - DNA, 201 bp, Homo sapiens
gggtgtggtggcatgcacctgtaattcaagctactcaggaggctgaggcaggagaatcgcttgaacctgggaggcagagattgcagtgaacccagatcacrccactgcactccagcctggcaacaaagcaagactccgtctcaaaaaaaaaaaaaaaaaaattagccgggcatggtggcgggcacttgtaatctcagctac

SEQ ID NO: 50621 - DNA, 201 bp, Homo sapiens
ctagacccttcccctttgcttggaggtcccattactgctctcagaggtgctgccttgggtgctgtcttggccatgagagtagatgatgcttactggctttrggcgtcacccagaagagaattttttacttaatcctctcacaaccctatgtaacaagttgttatagacccattttatggataaagaaattgaggttcagct

SEQ ID NO: 50622 - DNA, 201 bp, Homo sapiens
aatcagctgggtgtggtggcatgcacctgtaattcaagctactcaggaggctgaggcaggagaatcgcttgaacctgggaggcagagattgcagtgaaccyagatcacgccactgcactccagcctggcaacaaagcaagactccgtctcaaaaaaaaaaaaaaaaaaattagccgggcatggtggcgggcacttgtaatc

SEQ ID NO: 50623 - DNA, 201 bp, Homo sapiens
tgtaatgtgagggcttgacaaaggaggctgggctggagttgtgttctaacggttgcatgtgagttccaggaagaaaggctttaggtgttgttaaactgagytcacttattcagtaggttaagacccaccatttaaaatgaacagagtttaccaacagcacatccattttctttctgtctcactctccgagggttcaatgtg

SEQ ID NO: 50624 - DNA, 201 bp, Homo sapiens
gcccaggttggacaaccacaaagtcgtagaaccatgaaaaaatagctggtgaggccagccacggtggttcacacctataatcccagcactttgggaggctraggtgggcggatcacgaggtcaggagatcgagaccatcctggtcaacatggtgaaaccccgtctctactaaaaatacaaaaatcagctgggtgtggtggc

SEQ ID NO: 50625 - DNA, 201 bp, Homo sapiens
agttctgccctcaaggagtgttaggtaggagagagaaatgcatgactaaagacaatcagaaattaaaccaattcaggaaaaggagtagaaacgcatttcgstgcggttagactagggctgtgttaatcctcgctgtgtaatgtgagggcttgacaaaggaggctgggctggagttgtgttctaacggttgcatgtgagttc

SEQ ID NO: 50626 - DNA, 201 bp, Homo sapiens
gcgatcctcccacttcagactccaaagtgttgggattatggatgtgagccacctctccaggcccaatattttcttttaagggatagatagggccgggtgcagtggcttacgcctgtaatcccagcactttgagaggtcaaggtgggcggatcacaaggtcaagagttcgagaccagcctagtcaacatggtaaaaccccgt

SEQ ID NO: 50627 - DNA, 201 bp, Homo sapiens
ggaggaggcgttggctgcatcggggggaggatggtgccttgagtgagcctgccagggtgtgctgaggccctccccaaggccacttgtctttttgttgtttytctggttataaaaatagcacctgctcttcattggctcacgcctataatcccagcactttgggaagccgagagaggtggatcacaaggtcaagagattgag

SEQ ID NO: 50628 - DNA, 201 bp, Homo sapiens
ggcgttagttttgtgcagtgtttccactgtctgatgagaacaaaatacaaatgtataaatgcatgtacaagctataaaatacaattgtacatatgagttakcatttaaaactggcattgcacaaggccaagctaaatgacaaagttcatgccaatataatttacatttttattttttcttataatgacattaaatagtaca

SEQ ID NO: 50629 - DNA, 201 bp, Homo sapiens
ccaaaacttcttggttttaatatggtataatttatcaatattttcctactctacaaagatattttccaatatttcctttttttcgttttttttttttttttactttttaaattttatgtagagatgggctcttactttgttgcccaggctgatatcaaactcctggatcaagcgatcctcccacttcagactccaaagtgt

SEQ ID NO: 50630 - DNA, 201 bp, Homo sapiens
catgatctcggctcactgcaacctccgcctcctggattcaagcaattcttctgcctcagccttccaagtagctgggattacaggtgcccaccaccacgtcyggctaattttttgtatttttagtagagacggggtttcactatgttggccaggctgtctcgaactcttgacctcgttatccgcctgcctcagcctcccaaa

SEQ ID NO: 50631 - DNA, 201 bp, Homo sapiens
tttattttattattattatttttgagacggcatcttgcactgtcgcccaggctggagtgcaatggcatgatctcggctcactgcaacctccgcctcctggrttcaagcaattcttctgcctcagccttccaagtagctgggattacaggtgcccaccaccacgtccggctaattttttgtatttttagtagagacggggtt

SEQ ID NO: 50632 - DNA, 201 bp, Homo sapiens
acaggtatgagccaccatgcccggcctgtttttttaactttttgttttgcaagtattttattttattattattatttttgagacggcatcttgcactgtcrcccaggctggagtgcaatggcatgatctcggctcactgcaacctccgcctcctggattcaagcaattcttctgcctcagccttccaagtagctgggatta

SEQ ID NO: 50633 - DNA, 201 bp, Homo sapiens
ggaactagaatcttatagaaaagttggcagtacagtgtaaagaacttaaaatacacacacacacacacacacacacacacacacacacacacacacacacagtttaaagcacggtattgacctgatgcatcatcacccttgaatgtttcagtgtgcttctcctacaaacaaggttattctcccctctaacgcaatgcaaac

SEQ ID NO: 50634 - DNA, 201 bp, Homo sapiens
agtcagtgattgagttgggatttgaaccaggtaaatgagtaatgattctttctctgagcctgtagggtagctaaacacatttccagcatttttaataggartaaaaagagagtaggaaattaatgacacacaattcacaagtcaggtgcattcattctctgtctttttcctggagaatcctgggtgttttcttttcatcga

SEQ ID NO: 50635 - DNA, 201 bp, Homo sapiens
ggccccagactcggtggagcagctcaggaagcagtgggagaccttcgagtgagccgggccctgagggtgggggatgcaccgaggcccgagggtccgtccaytgctgcggttccgaggctcccccgccactctctctctgcccaggttctgctggtgggaagggatgggacccctctctgctgccccctcctcccctccaca

SEQ ID NO: 50636 - DNA, 201 bp, Homo sapiens
tcagtgcacgctgagctcacctctgctgtggcagggccccgtgctcttgctgtcgaaaccacaaatggaaactaggccatctctgccttctcccctaatcyagaattattcctggtctcctcatggatcgtcatcctctgttgttgctcataaatcggagagggctgggttggaaaccaggaaagacattaaatacttttt

SEQ ID NO: 50637 - DNA, 201 bp, Homo sapiens
cattaactcccaaatacacaccaagtttgggtcactaagtaaatccactaggctcagcataatgagtgacatttcagtaattgatgccctagaatatgttmattgtgaacccatgattcttttcgatgctaaaataaaggcttgggtagttttggctttggagttgagctagcgcagaagaatagtcaccatcgattaggc

SEQ ID NO: 50638 - DNA, 201 bp, Homo sapiens
aggaactagaatcttatagaaaagttggcagtacagtgtaaagaacttaaaatacacacacacacacacacacacacacacacacacacacacacacacacagtttaaagcacggtattgacctgatgcatcatcacccttgaatgtttcagtgtgcttctcctacaaacaaggttattctcccctctaacgcaatgcaaa

SEQ ID NO: 50639 - DNA, 201 bp, Homo sapiens
cagctaattttttttgtatttttagcagagatgaagtttcactgtgttagccaggatggtctcgatcttctgacctcgtgatccacccgcctcagcctccyacagtgctgggattacaggcagacatcacctttattttaagagtccaggtgtcagtgagaattatcaagatgtagcatcagaagattagaaggtcttcac

SEQ ID NO: 50640 - DNA, 201 bp, Homo sapiens
tcccgggttcacgccattctcctgcctcagcctcccaagtagctgggactacaggcgcccgccactatgcccggctaattttttgtatttttagtagagayggggtttcaccgttttagccgggatggtctcgatctcctgacctcgtgatccgcctgcctcggcctcccaaagtgctgggattacaggtgtgagccaccg

SEQ ID NO: 50641 - DNA, 201 bp, Homo sapiens
gggtaaaagcttgacatacgctgattattcttactgccaatcgcctaagcaaattatgttactttcttccatggtagtactcttccctgcagatttttgtrttgaaagttagctgtttgataacactgcatttgatgatgaacttatgaatgtgagaaggtgttttggaacgttagcaattatagcattgagtggtggata

SEQ ID NO: 50642 - DNA, 201 bp, Homo sapiens
tgcgcttcccaagtgaggcaatgcctcaccctgcttcagctcgtgcacggtgcccgcacccactgacctgcgcccactgtctggcactccctagtgagatsaacccggtacctcagatggaaatgcagaaatcacccatcttctgtgttgctcacgctgggagctgtataccggggctgttcctgttcggccatcttcttt

SEQ ID NO: 50643 - DNA, 201 bp, Homo sapiens
tgagctatggtgggctccacccagttcgagcttcctggctgctttgtttacctaagcaagcctgggcaatggcgggcgcccctcccccagcctcgctgccrccttgctgtttgatctcagactgctgtgctagcaatcagcgagacaccgtgggtgtaggaccctctgagccaggtgcgggatataatatcgtggtgcgcc

SEQ ID NO: 50644 - DNA, 201 bp, Homo sapiens
agggacatttaagtctgcagaggttactgctgtctttttgtttgtctgtgcccttcccccagaggtggagcctacagaggcaggcaggcctccttgagctrtggtgggctccacccagttcgagcttcctggctgctttgtttacctaagcaagcctgggcaatggcgggcgcccctcccccagcctcgctgccgccttgc

SEQ ID NO: 50645 - DNA, 201 bp, Homo sapiens
gtgcccctgctggggggtgcctcccagttaggctgctcgggggtcaggggtcagggaaccacttgaggaggcagtctgcccgttctcagatctccagctgygtgctgggaaaaccactgctctcttcaaagctgtcagacagggacatttaagtctgcagaggttactgctgtctttttgtttgtctgtgcccttccccca

SEQ ID NO: 50646 - DNA, 201 bp, Homo sapiens
tcttggaggctttgctcatttctttttattcttttttctctaaacttcccttctcgcttcatttcatcttccattgctgataccctttcttccagttgatygcatcggctcctgaggcttctgcattcttcacgtagttctcgagccttggttttcagctccatcagctcctttaagcacttctctgtattggttattcta

SEQ ID NO: 50647 - DNA, 201 bp, Homo sapiens
ggcctgccttgctagattggggaagttctcctggatcatatcctgcagtgttttccaacttggttccattctccccatcactttcaggtacaccaatcagrcgtagatttggtcttttcacatagtcccatatttcttggaggctttgctcatttctttttattcttttttctctaaacttcccttctcgcttcatttcat

SEQ ID NO: 50648 - DNA, 201 bp, Homo sapiens
cccctgcgtgcacccctcaagccctcaatgtgcttgggctggagtccgcttgctcctcccctgaaggcctgggtgggagagtgcagcctgctctgtccccsacaggccgcagccgtatcggacactcagggagtcagacagcgcggaaggcgacgaggcagagagtccagagcagcaagtgcggaagtccacaggccctgt

SEQ ID NO: 50649 - DNA, 201 bp, Homo sapiens
cctgaaggcctgggtgggagagtgcagcctgctctgtcccccacaggccgcagccgtatcggacactcagggagtcagacagcgcggaaggcgacgaggcrgagagtccagagcagcaagtgcggaagtccacaggccctgtcccagctccccctgaccgggctgccagcatcgaccttctggaagacgtcttcagcaacc

SEQ ID NO: 50650 - DNA, 201 bp, Homo sapiens
tgaaagatatgacaacttgataaaaagaacactgcctgaactgactaattttctttttcagaaaatgtagaattaattctgagttgttcccagaaaaacayactttgggcacatgaataattcaacctatatatttttttcttccacttatgtgtcacagtttaacaagaacccagtgatcaatcctcagctaccagagtt

SEQ ID NO: 50651 - DNA, 201 bp, Homo sapiens
gagaattcaacagcagagatagagaaagccagaatgagatctttctttctcattttgatatacattaagctgtaaccctgcatttcctacataaaatgtcmtatgtgtacttgtgtgcatgattgttgtttgtgagtgccaactcctggtgaagctaccatctgcattatttatccaggtttaagatgcagcttctttgat

SEQ ID NO: 50652 - DNA, 201 bp, Homo sapiens
gggtggcagaccgcaggggagtagctgaattgggttaatgagggaaaaggtgctttttttttttttttttttttcatattctgccttaagctaataaaaartttaagcctggacgttttcgatggttcatcctttatctctgacaaatatctgactgtatgtttcatgggagaacatgggtagctgaatttaagtaagttt

SEQ ID NO: 50653 - DNA, 201 bp, Homo sapiens
gtgtgtaataaaatccaggcaagtggtgggtggcagaccgcaggggagtagctgaattgggttaatgagggaaaaggtgcttttttttttttttttttttycatattctgccttaagctaataaaaagtttaagcctggacgttttcgatggttcatcctttatctctgacaaatatctgactgtatgtttcatgggagaa

SEQ ID NO: 50654 - DNA, 201 bp, Homo sapiens
ttcgcaaacttccacagcattcatgctgtaccccagctggggagaaagagaagaacaaggcaggccctgcccttgaggaacttgactcagaaacagagtgrcaagaggttaaatggtatctatgaagtgcgaagaggcacagccagggagctctcctagcctccagtgggcttcgtagaagtcccgctgagctgagtcttc

SEQ ID NO: 50655 - DNA, 201 bp, Homo sapiens
aagcggaggttgcagtgagccaagatggtgccactgcactccagcctgggcaacagagtaagtgagactccatctgaaaaaaaaaaaaaaaaaaaaaaaargaagggacagacattaattggattcttgcagaatgcatcattatacattgttgtgtgtccctaaatgaaagacacagtgagaatgtataataggggaacc

SEQ ID NO: 50656 - DNA, 201 bp, Homo sapiens
ttacatttaaagttaatattgttatatgtgaatttgatcctgtcattatgatgttagctggttattttgctcattagttgatgcagtttcttcctagtctygatggtctttacattttggcatgattttgcagcggctggtaccattgttcctttccatgtttagcacttccttcaggagctcttttagggcaggcctggt

SEQ ID NO: 50657 - DNA, 201 bp, Homo sapiens
gttttccatttgcttggtagatcttcctccatccttttattttgagcctatgtgtgtctctgcatgtgagatgggtttcctgaatacagcacactgatggktcttgactctttatccaatttgccagtctgtgtcttttaattggagcatttagtccatttacatttaaagttaatattgttatatgtgaatttgatcctg

SEQ ID NO: 50658 - DNA, 201 bp, Homo sapiens
tttcaaaaaaccagctcctggattcattaattttttgaagggttttttgtgtctctatttccttcagttctgctctgattttagttatttcttgccttctkctatcttttgaatgtgtttgctcttgcttttctagttcttttaattgtgatgttagggtgtcaattttggatctttcctgctttctcttgtgggcattta

SEQ ID NO: 50659 - DNA, 201 bp, Homo sapiens
ccttgaagcttacccacccgtacaacaagctctggagcctgggccaggacgacatggccatccccagcaagcccccagctgcctcccctgagaagccctcrgccctgctcgggaactccctggccctgcctcgaaggccccagaaccgggacagcatcctgaaccccagtgacaaggaggaggtgcccacccctactctgg

SEQ ID NO: 50660 - DNA, 201 bp, Homo sapiens
tgccccttccagtcaatacctatttaaaaataatcacggcagggcacggtggctcaagcctgtaatcccagcactttgggaggccgaggtgggcggatcaygaggtcaggagattgagaccatactggctaacatggtgaaaccctgttctctactaaaaatacaaaaaaaaattagccgggcatggtggcgggcacctgt

SEQ ID NO: 50661 - DNA, 201 bp, Homo sapiens
attgttataaccctggaatgtcctctcatcacttttcaaggttgatttgactatttcctggccctgtgtgatcattttgctttaatttgttcgctggagtrcatattcaggttcttataggagatagccccagtagcacccctgcagaaagagtacataaaaagtaaactgtgggttctcgcatgtctgaaaaatgtctgc

SEQ ID NO: 50662 - DNA, 201 bp, Homo sapiens
aagacatgactgatttcagtcacccctgaaaggctttgccttcccacctagccctctgcctcttccagatgccacatcgccatttctcaactgcctgtttkgtgcccagcaatttcacacgtgttgtcttggctaagctccctgctccccaaaaaatcttcgcagcctgggcattcagccatgagggagccacggctgtag

SEQ ID NO: 50663 - DNA, 201 bp, Homo sapiens
aggcttccaagtagctgggactacaggtgcccgccaccacgcccggctaattttttttttgtatttttagtagagatggggtttcaccgtgttagccaggwtggtctcgatctcctgaccttgtgatctgcctgcctcggcctcccaaagcgctgagattacaggcgtgagccactgttcccggccaggatcccagtagtt

SEQ ID NO: 50664 - DNA, 201 bp, Homo sapiens
ctcgactggtctgtgaggcacaatgggtatcagaaagcatcagcacacgttgagataggcagggcctgcagcctcccgaatgtggcacctctccaggattstctccctgaccactggtttgcctgcatggtcaagaggacgtacccagcctccaggaccctccctgccagaaatcaccaccacccctaccaagcccaccct

SEQ ID NO: 50665 - DNA, 201 bp, Homo sapiens
gccaccacgcccggcctgtccagtgggaatttcaagtgaactctgaagtccttttaacaggatcccagtagtttcttttcttttatttatttatttatttwttttttttgagacagagtctcatcctgttgaccaggctggagtgcagtgacgcgatcttggctcactgcaagctctgccttccgggctcacgctattctc

SEQ ID NO: 50666 - DNA, 201 bp, Homo sapiens
gagtttcttctatggggcgtgtgccactgtgtacccccagagaccctgcagtcttggttcagagccaccttcttttttttttttttatttttttaagatgmggtctagctgtgttgcccaggctggcctggaactcctgggctgaagcaatcctcccacctcagcctcttgagtagctggaacttcagagattcctttgct

SEQ ID NO: 50667 - DNA, 201 bp, Homo sapiens
tacctacacgagtatacaggtgattgaggctaactcaaacagtgtcttctctcttggagttttgatggttagcatgtttttcagagatgccctcgaaaaargaggctgggattcttgctgtgttccttccttgtagtcatcttcccacttacccccaacaagagtaaatttaaccgagcaggccagaatctacctaatagc

SEQ ID NO: 50668 - DNA, 201 bp, Homo sapiens
tgtgctgacatacattcagctgaggaccactaaccatgcctggaaagttctgggaaggcagggactgccttactcatccttgaacacctaggaaagacccygcacaggagacagatgcccagaatctacttgttggcaggtgaatgtggcatgtggacagtagtggattagtcactgtgtgctcagcaccatgcaaagccc

SEQ ID NO: 50669 - DNA, 201 bp, Homo sapiens
gtcatcacgctgtttcagcaggcacaaaagggcctgctctcttgtttccttaattgttagagagattctagttgttgagggagtttcaggtcctctgcccrtgatcacctcatagaaactcaagcttctggactagaagagttttcatgcttatcaactataatattgattcaaagagcagaccgaggtgctttctgcata

SEQ ID NO: 50670 - DNA, 201 bp, Homo sapiens
atacattcagctgaggaccactaaccatgcctggaaagttctgggaaggcagggactgccttactcatccttgaacacctaggaaagaccctgcacaggakacagatgcccagaatctacttgttggcaggtgaatgtggcatgtggacagtagtggattagtcactgtgtgctcagcaccatgcaaagccctttacgaat

SEQ ID NO: 50671 - DNA, 201 bp, Homo sapiens
agagttaccgcctcgcacggttcttgtggggcaggcctccacaagatgaggaatgtggagcgctgagcagagcacatggcatgctgttggggattagcctragtggcctccatcctgttgctgtcacacgtaagggggttagagtattgttcatccacaacacagctaacagacctagcccatggactgatcggaggcaac

SEQ ID NO: 50672 - DNA, 201 bp, Homo sapiens
caggctggagtgcagtgacgcgatcttggctcactgcaagctctgccttccgggctcacgctattctcctgcctcaggcttccaagtagctgggactacargtgcccgccaccacgcccggctaattttttttttgtatttttagtagagatggggtttcaccgtgttagccaggatggtctcgatctcctgaccttgtga

SEQ ID NO: 50673 - DNA, 201 bp, Homo sapiens
gccaccacgcccggctaattttttttttgtatttttagtagagatggggtttcaccgtgttagccaggatggtctcgatctcctgaccttgtgatctgccygcctcggcctcccaaagcgctgagattacaggcgtgagccactgttcccggccaggatcccagtagtttctaatagctcccttgccttttggtatgacag

SEQ ID NO: 50674 - DNA, 201 bp, Homo sapiens
cccaaagcgctgagattacaggcgtgagccactgttcccggccaggatcccagtagtttctaatagctcccttgccttttggtatgacagagtgtcccagrctcatcatctgtgtttcctcctccagacccagtgtttctctaaggagtcctggttccttttggtgggaaatagtattagaaatcacagcctgggatttag

SEQ ID NO: 50675 - DNA, 201 bp, Homo sapiens
cagaagtaaaaggaagatgtctcatcttattttatgaggtcagctttaccccaacttgaaaaccagataaataatttacaaacaaaaaaaaaaaaaaaaaaggcaactacagaccaatatagatgcaaaaatctttaacaatatattatcaaattgaatccagcaatatataaaaaaggataataaccttttttaaaagat

SEQ ID NO: 50676 - DNA, 201 bp, Homo sapiens
ggatccaaaagagagatgggcaagtagcctttgttaaattagggggctggattgaatggggatatcataagaacacagccgtatatcagcattcctggggmcagagcttttgacctcagcgtctgttaaatatataggggaaaaatgatgatggggtgtaatgattcctcttactttctggctatgtgacctggggcatgt

SEQ ID NO: 50677 - DNA, 201 bp, Homo sapiens
tggagaagttagtggatagcagaaggagttggaggctctgatggtgttaagtggaaaggttccgggattctgctgcctgggagtgttttttcaatcctagygaggcttgtgaccagtgtggctccaccctcctgctgggaagaatcttgaaatatttacttaggtaccatgttctgccctagaggctgtggtttaagagag

SEQ ID NO: 50678 - DNA, 201 bp, Homo sapiens
gtggagaagttagtggatagcagaaggagttggaggctctgatggtgttaagtggaaaggttccgggattctgctgcctgggagtgttttttcaatcctastgaggcttgtgaccagtgtggctccaccctcctgctgggaagaatcttgaaatatttacttaggtaccatgttctgccctagaggctgtggtttaagaga

SEQ ID NO: 50679 - DNA, 201 bp, Homo sapiens
gtgctttctgggcccctaaggaccatttattctaaatgcatttatgcaagcatttccagtggacactgctacagactaggtgggaaccggggagactcggsatatggaacccacaagggcctcgaagagaacagcctaccaagctcccatgtcaggagccatcagcctccagtgtggctttgctgggtcacgtagccacaa

SEQ ID NO: 50680 - DNA, 201 bp, Homo sapiens
agcatggagcacgtccctgcttcctgacgccgtgtctctgacatggtatttaaaaaggaacagcctcgcctgtcaccactgtcacacgcgcgcgctaaccrgcgacacgttaaaccaaacattagaaggggttcgggaagtcatctgcatgggaactccacgcggagacaaggtgggcagaggcgggagcagccgtggggg

SEQ ID NO: 50681 - DNA, 201 bp, Homo sapiens
ccactttggacaggtgtgtaccctggccctcctacctgtctgttttgttttttttttatttttgtttttagcagcagtagcacatgcagcagacggttttkcatttcagttctctttggcagtgcagctccatggaggttttcacatctttaaatgtttatttggtgcaaacatgttttgcaggcaaattttcaaaaattt

SEQ ID NO: 50682 - DNA, 201 bp, Homo sapiens
ccaaagatctcatgttaccaacacttcaccggtgataacagaaaagtgcctctgtgctttcctcctgagcaatctccttcaatcaaagtaatactctcatrgaaataagatgacaaagccactctctaaaagcaacaattattgaatgcccatcaagaaagaaaagagccttgtttccaaaatcaaatccaagtgtatgtt

SEQ ID NO: 50683 - DNA, 201 bp, Homo sapiens
aaggcctatgtgctcaccctgcctgggctcaatggaaaatattgagaattacactgaattgtcagtgcaggtgccattattccaaagatctcatgttaccracacttcaccggtgataacagaaaagtgcctctgtgctttcctcctgagcaatctccttcaatcaaagtaatactctcatagaaataagatgacaaagcc

SEQ ID NO: 50684 - DNA, 201 bp, Homo sapiens
cctaggcgagagcaagactccgcctcaaaaaaaaaaagaaaaaaaaaatcactattctgatttctgtcactgtagcaattttgcccattcttgaacttcayataaatggaatcttgcagtatatgctcatgggtgtggcttcttctgctctacattgtgttggtagaattcatctgtgttgttgtatgtaattgtagttca

SEQ ID NO: 50685 - DNA, 201 bp, Homo sapiens
attttgctttgcgttcattggtccttttaaatgtgtgaatgtgtatctgttgttagttctgggaagttctctgtattttcagaccaagaatgaagttaagstagaaatcttaagagatagctagagtattaaaaacagctgttggctatgtctcatcctcttctcttccagagtattgatttgtcttaatgttttacttct

SEQ ID NO: 50686 - DNA, 201 bp, Homo sapiens
ggatttttccagagaaggtttacatattttgttagtgtcctgaagccactcttagtttgggaccacttcggtttaaattctggggttgagggttttttttktttgtttgtttgtttgtttgttttcagagagtctcactctgttgcctagggtggagtgcagtggcagtatcctggctgactgcagccttgaactcctggg

SEQ ID NO: 50687 - DNA, 201 bp, Homo sapiens
atgaatttttaaacggtacacctcagccccttcagcatgtaagtttgtaactaaggaaacactgcgctgaagctggtttgaagttttgaagaccgtgaaawgagtaaggggtcctaataactatttcgtttcaggtctgtagctctaaattacccttaaaaggactagggcctaccattgtggcatggttaccatatgcaa

SEQ ID NO: 50688 - DNA, 201 bp, Homo sapiens
taatgtgagagtgtcgtgaaacctttggagacagtgccctggacatactgaggtaaattttgttcaaaatcaacagatagcaccctactgtaatctgctarcagcttgtttatctaattgtcaataaaatttctggttcaggaaagaatttatgttatcctgaaacttaacataccatgtccccggaaccaaggagaaata

SEQ ID NO: 50689 - DNA, 201 bp, Homo sapiens
cctactgtaatctgctaacagcttgtttatctaattgtcaataaaatttctggttcaggaaagaatttatgttatcctgaaacttaacataccatgtcccyggaaccaaggagaaataataatagtaactgccaaacacctactgtgtgtcagacaccctgctggatactttacacacagatctctcattctcaaattctg

SEQ ID NO: 50690 - DNA, 201 bp, Homo sapiens
ggtggggattaaataaatgtgcatgtgtgcataattttttcccttttctcctgttaaaatggcaagcaaaatatctggggaacagatatattctgcaagcrgatcttcaccatgttagaatttggggattactcttaatgcaaaagaaatgccccttttatggtttgtatagctccaaattgccggttaaatttaaccggc

SEQ ID NO: 50691 - DNA, 201 bp, Homo sapiens
gacacacagcagccagaccctaaaaggatgaaagcagaagttgccaagtctctaaaggcctatacccaataatgactcggcataattcctgctgtattccrtggttcaaagcaagtcacgaagtcagcccccttgaaggatcctggaaacagactccatggcttgatgggagaattggcatgtgccatagggatgggacta

SEQ ID NO: 50692 - DNA, 201 bp, Homo sapiens
tgactaaaatgtgggggcatgtgggttggtagggggtggtgggcagatgaagctgataagtctggtctcactgaggctaaattgcaaatagtcttgcatcrcatgtcctgctaatgacggtcttttaactcctgaatgcatttgggagcctttgaggtttacattgtgtttttgtcttttcttttttaaactatgcagtgg

SEQ ID NO: 50693 - DNA, 201 bp, Homo sapiens
gctatttggaaggctgaggcaggagactagcttgaaccagggaggtggaggttgcagtgagccgagattgcgccactgcagtccgcagtccggcctgggckacagagcaagactccgtctcaaaaaaaaaaaaaaaagaaaaaatatctagtatctgttgatgtagctccacctccaccactaccaccctggtccaagcca

SEQ ID NO: 50694 - DNA, 201 bp, Homo sapiens
ccatatcatcgcatgtttgtgctttgcagctgtggggaaaggtgttgacacctttcttgtcctctttttacacatgaggaaactgagtctgcagcagtggsaagcctgcttcagtttgagacaaaacaccagcagagtcagagtgtgagtaggctccccactccgttctggatggcagagtggaggccaggctggatggag

SEQ ID NO: 50695 - DNA, 201 bp, Homo sapiens
tgttcaccagctcttcatgggcatctgcactgggggacccagggatgaatcagcccctaccatctctgctgccaggaatgattttcctcttctgttccacytgaacagaaaatcctcccaacccttcaaggccctgctcaggcatcgccttcccttgacaagcccccacctccaccgacttctccaagcccagtcattccc

SEQ ID NO: 50696 - DNA, 201 bp, Homo sapiens
agagatgggcacagctgtctgccgttgcctgcgatagcttctggagactcaagtgtgacaaagtccactgcagtcccggggctaggagaggagaagggtasaagctaagaacctaggtcattcgttcagcaaatcatcactgatgcctactctgtgccacatctgtgaaaacagagatggcaatgacacggttcctgactt

SEQ ID NO: 50697 - DNA, 201 bp, Homo sapiens
ctctaactctactcccttagcagccacgaggagctctacctgtggtttctagcaccacctttgttctgggagctccaggtttctgtttctagctcattcckgtttcacaagcttcagctactagaatgtcttagtcagacttcccaaaccagctgtaccccagttccaccaaggtgtcagcccctctgtacccatacattc

SEQ ID NO: 50698 - DNA, 201 bp, Homo sapiens
atttctcaaattatttttttttgtgtcccttcctatttttggagtggacaatagtgtggaaagtgcctaggttttggattcaggcagacctggattcaaaycttagtcttatctcttattaactatgtaaccattaaaaatctgttttaactctgtgatctgcaatatctttctgtaaaatgggtataacttacctacttt

SEQ ID NO: 50699 - DNA, 201 bp, Homo sapiens
tccaccagtctgtgacaggaagactcttcaggatgtagagcaaaactgaaatgtatcagtcttgaattagatcctggttaaagtttttgacctgcatactmatatttcatgtgtttcctcttcttcctccagctatctcccctggttcgaggtattttataagctgcttaacatcctggcagattacacgacaaaaagaca

SEQ ID NO: 50700 - DNA, 201 bp, Homo sapiens
atttgcattgagttaatctctatcagggactgttgtgttaacaggaggcttcgatgttggagttcccaaaacggctgataaagggaggcagaggtcctcakcgggagggcagagctgagccaccacgtgggtccacgaagcccccaggtggctttcctgtaggtatgtggggtctccttcaagctctaaggggaaaggaag

SEQ ID NO: 50701 - DNA, 201 bp, Homo sapiens
gtgtgatggagaagaggttctgcacggaacttactggaaggtgcgggatgttaaagggaaaacgtgttttcatggaggcctgggcgggggattagctctcygttagagaggctgggtgggaggcctccaatgggaggattggtggcggtttcatcgggagggcttggggtctccatgagaggattagggtctcttcagggc

SEQ ID NO: 50702 - DNA, 201 bp, Homo sapiens
caaacatttaccaagaccctactaaaccaggggactattctagatgcttggaattgcagcagtgaacaaaatgaagtcctagtcctcaaatctcttctacyttaggaagacacagagagtaaacaaagatgaaaatcaacatataatatgtctgatggtaataagtgttatgcagaaaaagaaagctaaggaagaagatag

SEQ ID NO: 50703 - DNA, 201 bp, Homo sapiens
acgtcaagttgcagagctgctattaggattcagcggaggcattggtatctaagattgtgacaatctgggctttatctctgagaaatgactgaaaaaaaaaatgtgtccttgtgatttttcccactccgtcattgatcactctccgttcatgtcctactcccactgccttctcctcgtctccctttgcctcagagaaaacta

SEQ ID NO: 50704 - DNA, 201 bp, Homo sapiens
ggtagtggatggttagacagactggcacccaccggacaggcaggacctagcctcaccctgggggctgtccctgctcgtcagcacctgcccactggagccaygtgacagagggacacagcgtagccaagacatttacaaagcgaggatcctttgtgcctgagtgaagtgatcctttcaaaaatgatcaccagctccccttca

SEQ ID NO: 50705 - DNA, 201 bp, Homo sapiens
cttagatggagctcctccctggctccattctgcctctaactctactcccttagcagccacgaggagctctacctgtggtttctagcaccacctttgttctkggagctccaggtttctgtttctagctcattcctgtttcacaagcttcagctactagaatgtcttagtcagacttcccaaaccagctgtaccccagttcca

SEQ ID NO: 50706 - DNA, 201 bp, Homo sapiens
ggaggaaaaacttgccaatcaaaaaagagaaatcagattctggacattcataacgattgagttgaacattcgggagctatgtgattaggcattcagcgtgkcctcctcgggtggtattcctctcgttatagagagctggagaaggccagagagctccacggtgaggccagggctcctgatgtaccatggaagaactgagaa

SEQ ID NO: 50707 - DNA, 201 bp, Homo sapiens
ctttcctccatgtcccaccattctctcttagctgagaagttaggagcaaccaagtatcaagtttctcatgtgcagaatttaatgagtactaaggggatatrttttgttgatcaaagtgtatatttgttttgcaatgaaaataattggaacttgtgttcattatataattctggctgagttatttttatttggtaagaaaca

SEQ ID NO: 50708 - DNA, 201 bp, Homo sapiens
ttccctgatcttccaagtctccacgctccctgtgcacacagccattacagccgtcatcacacgctgttgtaattatttactgtgctgtcctgcctctccarctggaggttttggaaggcagagatcaggcctcccttggcctggtgtcttcagaaccctcacgacgtgtctgcagggatgagactgagaaatggattcacg

SEQ ID NO: 50709 - DNA, 201 bp, Homo sapiens
ttctcagagtgaccatgaatcagagcctgccttctaggaacttgcagtgtgctggggacagtccacctgggtacaggtggtggttggtggagacatttagkgggaaatgaggtcctcttcatctgaatgattcaagtaaggtttccccaaggaagtaccatgaagaaggcagccaggagtgagagtgcacaaaatgctcag

SEQ ID NO: 50710 - DNA, 201 bp, Homo sapiens
gctattcttcggtaccactaggggcaaagtgtctaaatttgacccccagaaatcagatccctgatccaagccaaattcctctggggactagagattcttcrccacactggatggaagagcatagggcagggactccctgtaacggacactctgtggatgtcttctggatgaaggagtgtctgacatctgagagaagtggca

SEQ ID NO: 50711 - DNA, 201 bp, Homo sapiens
taaaccacgcaacaggccagatgcggtggttcatgcctgtaaccccagcactttgggaggccgaggtgggcggatcacttgaggccaggagttggaggccrgcttggccaacatgacaaaaccctgtctctactaaaaatacaaaaattagccgggcgtgttggcgggcgcctgtaattccagctactcaggagactgagg

SEQ ID NO: 50712 - DNA, 201 bp, Homo sapiens
tttcttttaaaccacgcaacaggccagatgcggtggttcatgcctgtaaccccagcactttgggaggccgaggtgggcggatcacttgaggccaggagttsgaggccggcttggccaacatgacaaaaccctgtctctactaaaaatacaaaaattagccgggcgtgttggcgggcgcctgtaattccagctactcaggag

SEQ ID NO: 50713 - DNA, 201 bp, Homo sapiens
tcattaccattctggtgcttaagcagtgcctagcctgtaataggtgtacaataaatagtttggttttcatttatcactcacttttaatacctccctgtcastgcatcagcagtaaactggattaacacgaagtctcatttggtgtcagttgtggaataacacagtcagctaccactcgcatcccttgaggttctggctctt

SEQ ID NO: 50714 - DNA, 201 bp, Homo sapiens
gcttaaaaggtcattatctgttctctgaagggaaacttttatcccgggttgattagttttatcctgggttgataagtgtttatgcaaaagaagtaggggtrggaaaaacctggtactcactgaactcctacttcttgccctttatgtatattttcttggttaaatgtacacagtattatccccaacttgctaaataagaaa

SEQ ID NO: 50715 - DNA, 201 bp, Homo sapiens
accccccaaacttcagtgaatttgctgacgttttattagctaccaattactatctaacagatgtctaatttcttaatgtattctctttctggaggcacacrggtagaggaaagcttgcaaagtgttcgatggaatatttgagtgttggagaggcactgtgtgtgcactgtagtttggtactggctaaggaaggttgagatt

SEQ ID NO: 50716 - DNA, 201 bp, Homo sapiens
ccagggaactcagtgtgcaaaggtcaccctcctgtctgtagagagcagagcagaaaagtggggtgagtctgaggtcaagcaggctgagaaccagcactgcsagatcccagagaataaggctatttggtgatcgctccccctcatcccttccccaggcaaatgaatagcataatgaagtgaaagaccccttgacttgaagtt

SEQ ID NO: 50717 - DNA, 201 bp, Homo sapiens
aaataagacctggtcactgttaaagacagtgagaggcagagaaggaaaggaagcagagagttgcagtaaggggtgggaactgctatagtagaatgtgcaasctgggagacatttcagcacagggctaatcactgcagattgggtgctgcggggaagcttcccagggacggatgtgtctggaataaggccttaccggaggaa

SEQ ID NO: 50718 - DNA, 201 bp, Homo sapiens
aaaccagaaggcctggaattttccaaccaagcttcaagtcgtggtcatcaccatgtcacctagatggtttttaaactatagatttaattttggcaaattcycctcttctaaaatatgatgtaacaacattccccatgtaagattgcttggggcagccaggcatggtggcacatttaagaccagcctgggcaacatagagag

SEQ ID NO: 50719 - DNA, 201 bp, Homo sapiens
agtgtcagaagagagggaagatgcccaggagggggctccaggccacctgccgagtgaagatcaaagggttgaaaggtcagagggctcagctcccttaactrtatctgtctgtgcaatagctatttcagattgtaaatcttggcgatttcattaagtcctcctggctgctactggggcattgaaataataaaattttatatc

SEQ ID NO: 50720 - DNA, 201 bp, Homo sapiens
cagtgtcagaagagagggaagatgcccaggagggggctccaggccacctgccgagtgaagatcaaagggttgaaaggtcagagggctcagctcccttaacygtatctgtctgtgcaatagctatttcagattgtaaatcttggcgatttcattaagtcctcctggctgctactggggcattgaaataataaaattttatat

SEQ ID NO: 50721 - DNA, 201 bp, Homo sapiens
caggctctcagtaattttacggaataccagtgcagtccaccggtgtaatttggggtgcatgtgtgtaaacaggtgatgtttctttttttttttttttttttgccatttcattaaattcatccgatttctgccatggcagaaaattttattattttagtaatgcggtcaagtcatgaaataaattgtgtcttccttagattg

SEQ ID NO: 50722 - DNA, 201 bp, Homo sapiens
agggccccaggcttggcttaatgctctgctgtcaccgtcctgaaattcctaacatttttacctttgaactggtgtggggatgttttgtttgttttgtttcragacggagtttctctcttgttgcccacgctggagtgcagtggcgcgatctcggctcactgcaacctctgccttctgatttcaagcgattctcctgcctca

SEQ ID NO: 50723 - DNA, 201 bp, Homo sapiens
cagggcacaaacacccagactgagtttcagaatgagaatattgtcaaccacatctatcatcacctctttgaaagagtctagtccataaccagttactgttkctttagattattaaatttcagtcaacaaaaacatgacatcgtctcagtggaaatgaattccttatcatttaatcatgatgtttttgatcccttactgtgt

SEQ ID NO: 50724 - DNA, 201 bp, Homo sapiens
gagaatcccaagactggaaggattgtgtggccttattgcctattccatgctcgagtctcccctacaacatcctcccatgaggctttccagcttctcttgcmtacctctggtgccagggaacttacttccttctgaagcaacctttccatctttgaaatgctcctgtttttaggaatgttttcttattttagtgtaaagcat

SEQ ID NO: 50725 - DNA, 201 bp, Homo sapiens
tataattttgctgaggcacatatctgaattgctcatgtcatgctgcagatctggggtttgcaagtaaaacacttaaccagcaagtgacctacccagctgtmctgagttcccatttcaataaagctttgtggtgcttttacagtaacttttgtaggggtctgaaaatgacgttaaaaattcatctgtaccttgctgtacttt

SEQ ID NO: 50726 - DNA, 201 bp, Homo sapiens
agttttcttcttcccattctgaattatttccccctctctacttgatcttccccttattgtggaagcatgtagctatttctcctatcttagtggatgggagyaggaaaacatcctcttgaactaatactgttctcccattaggtctctatttcctcttccctttacagcaaaattcctttaaaaagttgctgaatttgttgt

SEQ ID NO: 50727 - DNA, 201 bp, Homo sapiens
ctcttctaattccattttgcctaaactagccttgagttgtttgtgttccccaagtgtttactcccagcaagatggaggcagcccacgcatgctggatggcmgcaggaagtcaatcttggatttcagaaattgccatagataagaatcagctgcaaataatcatggcccaacccataagagacagtgttggcaatgataaag

SEQ ID NO: 50728 - DNA, 201 bp, Homo sapiens
cagcctctagttgtgatctattaggcaattgcaatttgttaaatgtctggggccgggcgcggtggctcacgcctataatccaggcacttttggaggcgggyggatcacatgaggtcaggagttcgagaccagcctgaccaacatggagaaaccccatctctattaaaaatacaaaattagctgggcatggtggcgcatgcc

SEQ ID NO: 50729 - DNA, 201 bp, Homo sapiens; identical to SEQ ID NO: 14587

SEQ ID NO: 50730 - DNA, 201 bp, Homo sapiens
ctgcagatacatgactaacaaggatagctggccatgcccagggctggtgttggttgaggaggtggtgatggtgcggggcatgtgtgtgtgtgtgtgtgtgygcgcttgaggagttgtggaagtgttcatatctgtaaagtattatttcatggatgcagaccttaatgctaggttgaataactttgttgccatagaagaaga

SEQ ID NO: 50731 - DNA, 201 bp, Homo sapiens; identical to SEQ ID NO: 14590

SEQ ID NO: 50732 - DNA, 201 bp, Homo sapiens
cgctaatgaggaggagcgtctctaccctgcagctgtctgtactcctgtgtcttccgtaatgtgccaagctctctgaatatatgcaaaactagtctgcaaaragccatatgtctcagcatctggctttatttctaagtgttcaggtggaatttaagccgcgatcaaatttacaatgtcactgccagctctggacacttactt

SEQ ID NO: 50733 - DNA, 201 bp, Homo sapiens
atactcatcttccagaaggcgtcttattcctcctcgacaaaaaaaaaatgtgttggtattaaaatgctttgaggtaggctggatgaacccagcttagtgargatgacatgaaaacccttagctaatggggtctttattgagtagaactcaggtaagttcagatgtaagcagtgtctctcagtaaacatgaaaagactgaag

SEQ ID NO: 50734 - DNA, 201 bp, Homo sapiens
tgccttaagattttccttaagcttttggaaatgtataatgtttgagaaaaaagaaaaagaatagactgagtggaatcgtatctagtttcagttaataacaygtttcagttgatgttactgttatagctactgggcataaagtctccttcccttttttgaatcctatttttgaggcattgaagctgtgtctgtaagagacaa

SEQ ID NO: 50735 - DNA, 201 bp, Homo sapiens; identical to SEQ ID NO: 14588

SEQ ID NO: 50736 - DNA, 201 bp, Homo sapiens; identical to SEQ ID NO: 14589

SEQ ID NO: 50737 - DNA, 201 bp, Homo sapiens
cagaccttaatgctaggttgaataactttgttgccatagaagaagaaccgcacgtcaggcttttttcattagcaaaccagtaagcactcactttgggcctytgaaatcacttccatcacctaacaccagagatacaaactgaagctagcccttaagagcctccccctaagatttagagagaatgatttctcaaccagtttt

SEQ ID NO: 50738 - DNA, 201 bp, Homo sapiens
ttcccatggtgtcccccaatcacttaggaatttagcctgtgtctaaagaccctctctgcagcctgacgtggctagccatcccagtacttccacgtttttcrtgcctttctccaacagcgttgccgtggccccttaggcggcgatcgttttatcaatggtcgctccctctttttatctgttggcaggagccctttttcaacg

SEQ ID NO: 50739 - DNA, 201 bp, Homo sapiens
tcccggcaactccagacaccaaatcgcttcccatggtgtcccccaatcacttaggaatttagcctgtgtctaaagaccctctctgcagcctgacgtggctmgccatcccagtacttccacgtttttcatgcctttctccaacagcgttgccgtggccccttaggcggcgatcgttttatcaatggtcgctccctcttttta

SEQ ID NO: 50740 - DNA, 201 bp, Homo sapiens
gctcatgagtgatgggagagatctgggcaggcaacctcctctcatcctgcatcatcagcctggacttggaacttggctgctttttctttctgcagttagcrgagggccttggccaacacataagcctttctgccagcacttggcattccagctgacctcgacccaaggcctctgtgacttcaggaggcggcagctgggaag

SEQ ID NO: 50741 - DNA, 201 bp, Homo sapiens
ggacttgggcgcgccacggcggccggagcgctccacatcagcacccctcccccagagccgctgcaggaacagggaggaggccttttccaccgcacccggarcgtttacaacgggctggagctgaatacctggatgaaagtggagaggctgttcgtggagaagttccatcagtcgttttccttggacaattaacaagttagg

SEQ ID NO: 50742 - DNA, 201 bp, Homo sapiens
tggaggccggcctgggaacaggggccgaagggcgagccggaccctaggggattggtagggtcggggagaaggggtccaggctaggggcgggcggggcgcasggagaccaggcggcttgagcgggaggtggggagctggaggagtgccgggttcgcgggcgggggacggggagaggggggcggggagaggggcgggagtcgg

SEQ ID NO: 50743 - DNA, 201 bp, Homo sapiens
tcagaagcaggctaaactcacctaggggagagtcctatcccaggtagtggtcatgcttggggacaggtggtgactaggaggggcacaaggaaggctgcagsgtccggcccatcttgttgctggcctgggtgctggtctcactgatctctgtgtggtggggcaggtcagcctcccaggcctgctggtgcctgcagtgcccag

SEQ ID NO: 50744 - DNA, 201 bp, Homo sapiens
gatttctcaaccagttttcatctttgaaagtgccatttctccctttatcattgtgatttttattcaaatgcatgagtctctgattttctaccatatacaaagggtagagactacagtttcctatagaagaaacttcacatagtggccgaaggatcttatttctcaaaattcaggaactggtttcctctttctggaaattat

SEQ ID NO: 50745 - DNA, 201 bp, Homo sapiens
gaggatgctggcacagggcactgttcacagactgcctttgctccatgccttttccatgagcatgagtggctgttcgtgtgggaaacggcagagccctcgcrgtccccatcagcactgtgcagtggtaccggaggtggcaggagacagcctgatggcccaggttgtcttcatacccggcttcatgccagggtgcatgccggg

SEQ ID NO: 50746 - DNA, 201 bp, Homo sapiens
tttgattttttttactttatctttttctctctgttctctagttcattggtttccactctaatatttattaatttcccttcttctcactttgggtttaattygttctgtcttttcttattgtagttacttacaatggaagcttacacacttgatttaagattttttttctaatgtagacatttacagctataaatttccctt

SEQ ID NO: 50747 - DNA, 201 bp, Homo sapiens; identical to SEQ ID NO: 14598

SEQ ID NO: 50748 - DNA, 201 bp, Homo sapiens
agaacgtgacttcggctcttgccaggtggagtgttctagagatgtcagttggtgtccagtgatgtcaagtcatttgtatctactgattttctttctaattwttctatccattactgagagtggggtaggattttggtgtccaattattgtttttttgtttttttttttttgtttgtttgtttttttttttgaggtggagtc

SEQ ID NO: 50749 - DNA, 201 bp, Homo sapiens
gactgccccattttacattcccatcagcagtgtataacggttctaattttcttttcctttttcttttcttgagacaaggttttgctctgtcacccaggctrgagtgcagtggcatgatcttggctcactgcagcctcaatctcttgggctcaattggtcctcccacctcagcctcctgagtagctgggactacaggtgagt

SEQ ID NO: 50750 - DNA, 201 bp, Homo sapiens; identical to SEQ ID NO: 14602

SEQ ID NO: 50751 - DNA, 201 bp, Homo sapiens
gacatgttctgaaactccactctgcccggccttggcttcgacgtgtctggtgaatgtgtgggctgtgaggctccccgaacgtagacctcagactgcaacgytggccgttacagggtctggcacacgggcccacgtcaggcccatcgccacagtgatggttgttctgtgactgtttctggtggcctctgctccacactccag

SEQ ID NO: 50752 - DNA, 201 bp, Homo sapiens
ggtctggcacacgggcccacgtcaggcccatcgccacagtgatggttgttctgtgactgtttctggtggcctctgctccacactccaggctgacgctgtgycccttccactgggaccctcgggtggcttccatgcacttgtgccctaaatcctgctcctagactaaacttcatctcctgtgttctcattctgcagcatggc

SEQ ID NO: 50753 - DNA, 201 bp, Homo sapiens
tttataagggcactggcttttaatatttaatttaaccactcagtcagtactgaaacagttgttagggaggcctgcgttagtgagacctgacctgccacaamacatcttactcggaatgctgcccataacttcaaaaaatcagctttgacggagccctactgaacacacctagcatctctcttccttcagcttagggtcaag

SEQ ID NO: 50754 - DNA, 201 bp, Homo sapiens
cgccactgcctgggtctctaccctcggccacctcactgacttacttcttgatggcaaacacagttaacccaatggtggtgttctggagcctgaactgctcyttgaggatgtcgatgttgaatgtgccctcccagacaatgggagccagccaaggggtcaccacgaggacatccttcctactgcacatggagagaggcgtgc

SEQ ID NO: 50755 - DNA, 201 bp, Homo sapiens
ggaagggtggtcagaggaggcagaagctgagtggagtttccaggtgggggcggccgtgtgccagaggcgcatgtgggtggcaccctgccagctccatgtgrccgcacgcctctctccatgtgcagtaggaaggatgtcctcgtggtgaccccttggctggctcccattgtctgggagggcacattcaacatcgacatcctc

SEQ ID NO: 50756 - DNA, 201 bp, Homo sapiens
ctgaattacaaggcgggacaggtaaagtggggcaggtgagagaaggagggtgagtgatgtgatttttctactcctgttttccaggaaaaccaaaatgccaygcacttcgacctatgatccttttcctaataatgcttgtcttggtcttgtttgggtaagacacatttgaccatcgaggctggcctggtttggggagaagtg

SEQ ID NO: 50757 - DNA, 201 bp, Homo sapiens
tctggaagggtggtcagaggaggcagaagctgagtggagtttccaggtgggggcggccgtgtgccagaggcgcatgtgggtggcaccctgccagctccatrtgaccgcacgcctctctccatgtgcagtaggaaggatgtcctcgtggtgaccccttggctggctcccattgtctgggagggcacattcaacatcgacatc

SEQ ID NO: 50758 - DNA, 201 bp, Homo sapiens
ggttggtttcccggggaagggcggctgcctctggaagggtggtcagaggaggcagaagctgagtggagtttccaggtgggggcggccgtgtgccagaggcrcatgtgggtggcaccctgccagctccatgtgaccgcacgcctctctccatgtgcagtaggaaggatgtcctcgtggtgaccccttggctggctcccattg

SEQ ID NO: 50759 - DNA, 201 bp, Homo sapiens
gatgtaaatctcagttggggctgcttcgttctctcctctcagattctcctgacatctgaattcagaggcccacatggctgtcctctttccctttgctttcwctgacttgcgtctcttgtttcctgtccctttgttctccaaagcccctgcaaaggcctgataggtacctcctacctggggaggggcagcgggggttgggtg

SEQ ID NO: 50760 - DNA, 201 bp, Homo sapiens
ccagcgccttccgggttcttccctgtccctcctttgtggtctttgttttcccttttttgtcttaatatgtttcaacggatgtatacaataaaccgcacatraaaggtacagctggatacatcttgacccagtcaagatgatgaacacagctgccaccccaggagtctgtcctgccccacgggttatgctgtcttagttggt

SEQ ID NO: 50761 - DNA, 201 bp, Homo sapiens
atggtggtgttctggagcctgaactgctcgttgaggatgtcgatgttgaatgtgccctcccagacaatgggagccagccaaggggtcaccacgaggacatkcttcctactgcacatggagagaggcgtgcggtcacatggagctggcagggtgccacccacatgcgcctctggcacacggccgcccccacctggaaactcc

SEQ ID NO: 50762 - DNA, 201 bp, Homo sapiens; identical to SEQ ID NO: 14596

SEQ ID NO: 50763 - DNA, 201 bp, Homo sapiens; identical to SEQ ID NO: 14597

SEQ ID NO: 50764 - DNA, 201 bp, Homo sapiens
gagggagggctgggaatgatttgcccggttggagtcgcatttgcctctggttggtttcccggggaagggcggctgcctctggaagggtggtcagaggaggmagaagctgagtggagtttccaggtgggggcggccgtgtgccagaggcgcatgtgggtggcaccctgccagctccatgtgaccgcacgcctctctccatgt

SEQ ID NO: 50765 - DNA, 201 bp, Homo sapiens
gtggggtggcggccagccttgtcctcccagagggtagatgggaaaggtcattcatgcagcatcttactgagctcatgtgggctcgtgggctcgtgggctcrccaggtcggtaaaacccagctccttctccagaggctgcgtctcacccagggatggtggcttctgctgccccctcctctctgtaactgtggccggccgtca

SEQ ID NO: 50766 - DNA, 201 bp, Homo sapiens; identical to SEQ ID NO: 14601

SEQ ID NO: 50767 - DNA, 201 bp, Homo sapiens; identical to SEQ ID NO: 14604

SEQ ID NO: 50768 - DNA, 201 bp, Homo sapiens
cctttgctttctctgacttgcgtctcttgtttcctgtccctttgttctccaaagcccctgcaaaggcctgataggtacctcctacctggggaggggcagcrggggttgggtgctggggagggtttgttcctatctctttgccagcaaagctcagcttgctgtgtgttcccgcaggtccaatgttgagggagggctgggaat

SEQ ID NO: 50769 - DNA, 201 bp, Homo sapiens
tggcgggagggtcaatgcccagtcatggttcagcggctgtgcacacccctgcttacctgcatcccacgctttccatgcaaactcacgtggcggcgctttgygcttgcaggatggtctacccccagccaaaggtgctgacaccgtggtgagtaaagttactgacactgaaactgaacgcagctcaaggggctgttctgaagg

SEQ ID NO: 50770 - DNA, 201 bp, Homo sapiens
gatgtatacaataaaccgcacataaaaggtacagctggatacatcttgacccagtcaagatgatgaacacagctgccaccccaggagtctgtcctgccccrcgggttatgctgtcttagttggtctcatgtcagggagccttggaggaccagggtcgggcagttggtctctatactcctggggttctggcactggctctgg

SEQ ID NO: 50771 - DNA, 201 bp, Homo sapiens
tggagcagcatttgcgctccgatccaattggccatccctttcaccttggcatttcaacaaccagacaggaagcaggtaacccaaaggaaaagagaaacccytcacgggtcctttgacctctcatatttacatagacagtatcggggttgcgctggggggtacaaaatgaattcaaagctcgaaaccaaatagccaccaggt

SEQ ID NO: 50772 - DNA, 201 bp, Homo sapiens
tcaggcttgttggggcgggcaggagagcagggtagtggagtcagagggagtgatcccccgaaaggcaggaagaggacatgagagagccttggagatgacgrtgaggatgtggttggtgggcggtgagctgggtgtcatgtgctggctccttagagaatgctcagctccttcacacccatcataatccctggaggactgaga

SEQ ID NO: 50773 - DNA, 201 bp, Homo sapiens
gtcaggcttgttggggcgggcaggagagcagggtagtggagtcagagggagtgatcccccgaaaggcaggaagaggacatgagagagccttggagatgacsgtgaggatgtggttggtgggcggtgagctgggtgtcatgtgctggctccttagagaatgctcagctccttcacacccatcataatccctggaggactgag

SEQ ID NO: 50774 - DNA, 201 bp, Homo sapiens
tatcgctgagttctcaggaaggaacggtaaatacttcccgggtcattctttcacccacgggaaaacaggtttggagagatctgggacagtgctctggtccyaggcaggaagggctgagtggggcctgggactcaggtctgactgcaaacacctgcctcctccctgtgctgccagcgccttccgggttcttccctgtccctc

SEQ ID NO: 50775 - DNA, 201 bp, Homo sapiens
tggttcagcggctgtgcacacccctgcttacctgcatcccacgctttccatgcaaactcacgtggcggcgctttgtgcttgcaggatggtctacccccagycaaaggtgctgacaccgtggtgagtaaagttactgacactgaaactgaacgcagctcaaggggctgttctgaaggtattagagggcggtttccttgatgt

SEQ ID NO: 50776 - DNA, 201 bp, Homo sapiens
  misc_feature (1)...(201): n = A,T,C or G, or insertion/deletion polymorphism (see Tables 1-2)
gataaggcatactgaggcctgacttggtgagggctcctgccccggaggtgcagccctggaggagcgggaggcagaggagtggaaaattcatgaagaaaacngggtatggtgtaggtcgaggccctgccctcagtaatgctcaccatttgtcagtgtttactgtgaggcagcactgtgttcaatatcgctgagttctcagga

SEQ ID NO: 50777 - DNA, 201 bp, Homo sapiens
gcaggccagtgaaccccaacgccaaaggccagggagagccgggtggggtacccagagccagcacacagccctttaatttagaggagtgctgtgtacacatytggggagagatgttttactttgatttggaatcaggtggcggataaggcatactgaggcctgacttggtgagggctcctgccccggaggtgcagccctgga

SEQ ID NO: 50778 - DNA, 201 bp, Homo sapiens
ttaagtcaagtggaaagcaatggcccctgaggtcacttagtccctcttgccagtttgtaagtgctgaatcagagactctgagctttggccctttcccgagktcccgggattatgagctgacacagcccccaagcaaccacagtgattccagcctgggagtgtggccttggcgggagggtcaatgcccagtcatggttcagc

SEQ ID NO: 50779 - DNA, 201 bp, Homo sapiens
acctgtccttaattttcttggcgccagaagatgaattgagtatttacccagacaacaacgtcgcttcagagggagggatgcagaacgcagggccacggggygcaggctgcaggccagtgaaccccaacgccaaaggccagggagagccgggtggggtacccagagccagcacacagccctttaatttagaggagtgctgtg

SEQ ID NO: 50780 - DNA, 201 bp, Homo sapiens
acgtccctcccagccttaagtcaagtggaaagcaatggcccctgaggtcacttagtccctcttgccagtttgtaagtgctgaatcagagactctgagcttyggccctttcccgagttcccgggattatgagctgacacagcccccaagcaaccacagtgattccagcctgggagtgtggccttggcgggagggtcaatgcc

SEQ ID NO: 50781 - DNA, 201 bp, Homo sapiens
gcccacagtgaattgagacacaaccccttacgtccctcccagccttaagtcaagtggaaagcaatggcccctgaggtcacttagtccctcttgccagtttrtaagtgctgaatcagagactctgagctttggccctttcccgagttcccgggattatgagctgacacagcccccaagcaaccacagtgattccagcctggg

SEQ ID NO: 50782 - DNA, 201 bp, Homo sapiens; identical to SEQ ID NO: 14611

SEQ ID NO: 50783 - DNA, 201 bp, Homo sapiens
acagttaaaatggccccggctcatgtctcctgagcctctacaatcctttaggtggggacagtactgcggcccacacgtccccacaggctgcgtgtgacacytgacagtgctttgtgccactgtggagcaggtgtcactctcccacttctcagagaggaagccgggctctggaagccagcagcccacaaggaggcccagcag

SEQ ID NO: 50784 - DNA, 201 bp, Homo sapiens
ctctcagattctcctgacatctgaattcagaggcccacatggctgtcctctttccctttgctttctctgacttgcgtctcttgtttcctgtccctttgttstccaaagcccctgcaaaggcctgataggtacctcctacctggggaggggcagcgggggttgggtgctggggagggtttgttcctatctctttgccagcaa

SEQ ID NO: 50785 - DNA, 201 bp, Homo sapiens
ataggtacctcctacctggggaggggcagcgggggttgggtgctggggagggtttgttcctatctctttgccagcaaagctcagcttgctgtgtgttcccrcaggtccaatgttgagggagggctgggaatgatttgcccggttggagtcgcatttgcctctggttggtttcccggggaagggcggctgcctctggaaggg

SEQ ID NO: 50786 - DNA, 201 bp, Homo sapiens
aggccaagctggccacactgcttttgattttttttaaattgtgatgaaatacgcttaacataaaatttgccatcttagtcattttggagtgttcagtagckttaagtccattcacattgctgtgcagccatcaccaccatccatctccagaactcttttcatcttgccaacctgaagctctgtccccataaaatagcaact

SEQ ID NO: 50787 - DNA, 201 bp, Homo sapiens
cccataacttcaaaaaatcagctttgacggagccctactgaacacacctagcatctctcttccttcagcttagggtcaaggggctggggttgatggcaccrttgaaagaaacagctttattgccgtgtcattgatatgccataaaattcacctgtttcaaatgaattattttcagttagtttacagagttgtgaaataaat

SEQ ID NO: 50788 - DNA, 201 bp, Homo sapiens; identical to SEQ ID NO: 14613

SEQ ID NO: 50789 - DNA, 201 bp, Homo sapiens; identical to SEQ ID NO: 14614

SEQ ID NO: 50790 - DNA, 201 bp, Homo sapiens
ggaaattatctccagaccaactcaaaattacaaagttttccagagcttatataccttctaagctatatgtctatgtgtaagtgtgcattcatctcaagacrtaagtaattgacttatgttaatctataactaaggtctgagtcctgaagaccttcctctggatcctcagtaaatttacttaatctaaaacccttatcttgt

SEQ ID NO: 50791 - DNA, 201 bp, Homo sapiens; identical to SEQ ID NO: 14615

SEQ ID NO: 50792 - DNA, 201 bp, Homo sapiens
gtcccggctctcctccattctggtgggtctcaccagagattggccaagaagagatcaaactgttcctggaccaaactgagggtggggctgctatctctcgyggcccaataacgagatgcagatgaactggggagaaagagactttttatttctgtaaccagttacaaggagaagacctggaaattatctccagaccaactc

SEQ ID NO: 50793 - DNA, 201 bp, Homo sapiens; identical to SEQ ID NO: 14616

SEQ ID NO: 50794 - DNA, 201 bp, Homo sapiens
gaaaattcatgaagaaaaccgggtatggtgtaggtcgaggccctgccctcagtaatgctcaccatttgtcagtgtttactgtgaggcagcactgtgttcartatcgctgagttctcaggaaggaacggtaaatacttcccgggtcattctttcacccacgggaaaacaggtttggagagatctgggacagtgctctggtcc

SEQ ID NO: 50795 - DNA, 201 bp, Homo sapiens; identical to SEQ ID NO: 14618

SEQ ID NO: 50796 - DNA, 201 bp, Homo sapiens; identical to SEQ ID NO: 14617

SEQ ID NO: 50797 - DNA, 201 bp, Homo sapiens; identical to SEQ ID NO: 14619

SEQ ID NO: 50798 - DNA, 201 bp, Homo sapiens
ttcccgggtcattctttcacccacgggaaaacaggtttggagagatctgggacagtgctctggtcccaggcaggaagggctgagtggggcctgggactcargtctgactgcaaacacctgcctcctccctgtgctgccagcgccttccgggttcttccctgtccctcctttgtggtctttgttttcccttttttgtcttaa

SEQ ID NO: 50799 - DNA, 201 bp, Homo sapiens
tagcaggagggggacacctgtttgctgtccttggaccctagaaagaggatgctggcagagccgtggtcacttctctgtcagatgtaggtggggcaggcaargcagttggccccagacaccaaaggaagtggctgacccacaaggccctgggactctgggccaggccagagagggagctagccaggcaaccgcagacacata

SEQ ID NO: 50800 - DNA, 201 bp, Homo sapiens; identical to SEQ ID NO: 14621

SEQ ID NO: 50801 - DNA, 201 bp, Homo sapiens
tttgttctccaaagcccctgcaaaggcctgataggtacctcctacctggggaggggcagcgggggttgggtgctggggagggtttgttcctatctctttgycagcaaagctcagcttgctgtgtgttcccgcaggtccaatgttgagggagggctgggaatgatttgcccggttggagtcgcatttgcctctggttggttt

SEQ ID NO: 50802 - DNA, 201 bp, Homo sapiens
gtgggctcgccaggtcggtaaaacccagctccttctccagaggctgcgtctcacccagggatggtggcttctgctgccccctcctctctgtaactgtggcyggccgtcatgctgagccaccccctcaatacaaggctccagatgtttcctgctcactgaccagagatagcaggagggggacacctgtttgctgtccttgga

SEQ ID NO: 50803 - DNA, 201 bp, Homo sapiens; identical to SEQ ID NO: 14622

SEQ ID NO: 50804 - DNA, 201 bp, Homo sapiens
cgtgggctcgtgggctcgccaggtcggtaaaacccagctccttctccagaggctgcgtctcacccagggatggtggcttctgctgccccctcctctctgtractgtggccggccgtcatgctgagccaccccctcaatacaaggctccagatgtttcctgctcactgaccagagatagcaggagggggacacctgtttgct

SEQ ID NO: 50805 - DNA, 201 bp, Homo sapiens
cgctgctggccgcaccatgcactttttggaggaagggaccaacaggcagtcttcgttctgtgtcctgagtcttggcacacttcctttctgcagttacgggktcctaagccccagaagtctaatgccaggaagcctggaacgggggttctggtgagtgcagggaagagcaggtggagcatccatgctggccggggtgctggc

SEQ ID NO: 50806 - DNA, 201 bp, Homo sapiens
tcacgctgctggccgcaccatgcactttttggaggaagggaccaacaggcagtcttcgttctgtgtcctgagtcttggcacacttcctttctgcagttacrgggtcctaagccccagaagtctaatgccaggaagcctggaacgggggttctggtgagtgcagggaagagcaggtggagcatccatgctggccggggtgct

SEQ ID NO: 50807 - DNA, 201 bp, Homo sapiens
gtgggacgtggcgaggcgcctgagctttgctgagaacttgccctacctgcctcgaggccttgcagcttcaccgggaactcttgtgctcacgctgctggccrcaccatgcactttttggaggaagggaccaacaggcagtcttcgttctgtgtcctgagtcttggcacacttcctttctgcagttacggggtcctaagcccc

SEQ ID NO: 50808 - DNA, 201 bp, Homo sapiens
tctatgctctgcccagtgtagacatgctcaactctgtggccttgaagggtcacctggatacctctggagtcagccttgacctcccttctgacctccagtcyccaactccaggcttacccagagttcccatgcatggtctctgctcccccatccccacccctcctccaccagccatcctcaactctccctttgctctcaccc

SEQ ID NO: 50809 - DNA, 201 bp, Homo sapiens
caagacagagtggggtggcggccagccttgtcctcccagagggtagatgggaaaggtcattcatgcagcatcttactgagctcatgtgggctcgtgggctygtgggctcgccaggtcggtaaaacccagctccttctccagaggctgcgtctcacccagggatggtggcttctgctgccccctcctctctgtaactgtggc

SEQ ID NO: 50810 - DNA, 201 bp, Homo sapiens
ggtctctccttgtgttcaagacagagtggggtggcggccagccttgtcctcccagagggtagatgggaaaggtcattcatgcagcatcttactgagctcaygtgggctcgtgggctcgtgggctcgccaggtcggtaaaacccagctccttctccagaggctgcgtctcacccagggatggtggcttctgctgccccctcc

SEQ ID NO: 50811 - DNA, 201 bp, Homo sapiens
ccttgcagatacgtggctttcctgaagctgttcctggagacggcggagaagcacttcatggtgggccaccgtgtccactactatgtcttcaccgaccagcyggccgcggtgccccgcgtgacgctggggaccggtcggcagctgtcagtgctggaggtgcgcgcctacaagcgctggcaggacgtgtccatgcgccgcatg

SEQ ID NO: 50812 - DNA, 201 bp, Homo sapiens
aacgagcagttcaggctccagaacaccaccattgggttaactgtgtttgccatcaagaagtaagtcagtgaggtggccgagggtagagacccaggcagtgkcgagtgactgtggacattgaggtctctccttgtgttcaagacagagtggggtggcggccagccttgtcctcccagagggtagatgggaaaggtcattcat

SEQ ID NO: 50813 - DNA, 201 bp, Homo sapiens
aattctgggtcccaagctgttagtcgcttccagacacagaaggtcccagaaccaagagtgaagtcacctgtcacctctactggggcatctctggacacggyctggaaacactccctgacgtggcctcagggactgcactgatcaaggcactggtggcggggggtgagggagctggggctctggagctccagcaggtgccca

SEQ ID NO: 50814 - DNA, 201 bp, Homo sapiens
ggtcccagaaccaagagtgaagtcacctgtcacctctactggggcatctctggacacggtctggaaacactccctgacgtggcctcagggactgcactgaycaaggcactggtggcggggggtgagggagctggggctctggagctccagcaggtgcccatacgtgagcaatatcccagggaccaccctcctgcccacctc

SEQ ID NO: 50815 - DNA, 201 bp, Homo sapiens
ttgatcttttcagagaactgacatttgattttttttactttatctttttctctctgttctctagttcattggtttccactctaatatttattaatttcccytcttctcactttgggtttaatttgttctgtcttttcttattgtagttacttacaatggaagcttacacacttgatttaagattttttttctaatgtagac

SEQ ID NO: 50816 - DNA, 201 bp, Homo sapiens
cgggccggggtgggggcgcccagggctgcgaggcttcaggccggccgccgccccagcctccgagaccctgcgtcctggggagccggcgggcaggtgggctyggccgcgctgtgggtgcctgggacccgcagggaggatgggcgcggtggcgcggcctggcggggggctcgtctccggggtccccgggtcctggtgagagcg

SEQ ID NO: 50817 - DNA, 201 bp, Homo sapiens
atggtttcatttttataaggataaattagagtttataaaaattaacacttcccttcaaaagaaaaattaaggaaaaatgaataaataagccaccgactgaragaaaatatttgttttctaagaagtattttgtttttcattttatgggttcatagtaggtgtatatatttatggggtccctgagatattgtggttcagtca

SEQ ID NO: 50818 - DNA, 201 bp, Homo sapiens
cctcggccccgggtgcccgcgagggagccgctaccgcagggaatgcggggtgcacccgacagccgggccggggtgggggcgcccagggctgcgaggcttcrggccggccgccgccccagcctccgagaccctgcgtcctggggagccggcgggcaggtgggctcggccgcgctgtgggtgcctgggacccgcagggaggat

SEQ ID NO: 50819 - DNA, 201 bp, Homo sapiens
ctggccggtgagtgcaggcctcggccccgggtgcccgcgagggagccgctaccgcagggaatgcggggtgcacccgacagccgggccggggtgggggcgcycagggctgcgaggcttcaggccggccgccgccccagcctccgagaccctgcgtcctggggagccggcgggcaggtgggctcggccgcgctgtgggtgcct

SEQ ID NO: 50820 - DNA, 201 bp, Homo sapiens
aagggagagataaggctcactagccacagaaaaacagccagttaatttttaaaggactccagccctttctcttcctcaaggggaattggttttttacatayaactgagtttttgcttacacagtttttaatttcttttaattcctgttctagtattttggggctaggttgtcaggtatgtatatatttctgtttgttatat

SEQ ID NO: 50821 - DNA, 201 bp, Homo sapiens
gagggagggggccgctccttccccagtctctaccctgacttggccctcgtcctgcagccactcagagagcacgatggagctggagcttcagttttgaccaratgcgtgtcgccggcttttgtgtgtgtgtgtgtgtgatggagtctcgctctgtcgcccaggctggagtgcattggcaccatctctgcccactgcaacctc

SEQ ID NO: 50822 - DNA, 201 bp, Homo sapiens
acatgtgtgccatgtgggagctggggcaggtcctctttcctcctgtggctccgagggagggggccgctccttccccagtctctaccctgacttggccctcrtcctgcagccactcagagagcacgatggagctggagcttcagttttgaccaaatgcgtgtcgccggcttttgtgtgtgtgtgtgtgtgatggagtctcgc

SEQ ID NO: 50823 - DNA, 201 bp, Homo sapiens
gcctcccttcagtggctcccatgtcacagaattgtcctgcagccctggcacatgtgtgccatgtgggagctggggcaggtcctctttcctcctgtggctcygagggagggggccgctccttccccagtctctaccctgacttggccctcgtcctgcagccactcagagagcacgatggagctggagcttcagttttgacca

SEQ ID NO: 50824 - DNA, 201 bp, Homo sapiens
catctcctgtgttctcattctgcagcatggctgttagggaacctgaccatctgcagcgcgtctcgttgccaaggtataatgtcagtgcctcccttcagtgsctcccatgtcacagaattgtcctgcagccctggcacatgtgtgccatgtgggagctggggcaggtcctctttcctcctgtggctccgagggagggggccg

SEQ ID NO: 50825 - DNA, 201 bp, Homo sapiens
tccatgcacttgtgccctaaatcctgctcctagactaaacttcatctcctgtgttctcattctgcagcatggctgttagggaacctgaccatctgcagcgygtctcgttgccaaggtataatgtcagtgcctcccttcagtggctcccatgtcacagaattgtcctgcagccctggcacatgtgtgccatgtgggagctgg

SEQ ID NO: 50826 - DNA, 201 bp, Homo sapiens
ttccatgcacttgtgccctaaatcctgctcctagactaaacttcatctcctgtgttctcattctgcagcatggctgttagggaacctgaccatctgcagcrcgtctcgttgccaaggtataatgtcagtgcctcccttcagtggctcccatgtcacagaattgtcctgcagccctggcacatgtgtgccatgtgggagctg

SEQ ID NO: 50827 - DNA, 201 bp, Homo sapiens
gcttcgacgtgtctggtgaatgtgtgggctgtgaggctccccgaacgtagacctcagactgcaacgctggccgttacagggtctggcacacgggcccacgycaggcccatcgccacagtgatggttgttctgtgactgtttctggtggcctctgctccacactccaggctgacgctgtgccccttccactgggaccctcgg

SEQ ID NO: 50828 - DNA, 201 bp, Homo sapiens; identical to SEQ ID NO: 14603

SEQ ID NO: 50829 - DNA, 201 bp, Homo sapiens; identical to SEQ ID NO: 14605

SEQ ID NO: 50830 - DNA, 201 bp, Homo sapiens
gtgggaggagggccagatctggactgggtttggagatgctcaggtggggctcagagcatcacctgtggggcagagggaccatcttggcagatgaaggcccrtcgcagggtgtgatgcctgaattacaaggcgggacaggtaaagtggggcaggtgagagaaggagggtgagtgatgtgatttttctactcctgttttccag

SEQ ID NO: 50831 - DNA, 201 bp, Homo sapiens; identical to SEQ ID NO: 14606

SEQ ID NO: 50832 - DNA, 201 bp, Homo sapiens
tttaccttatttgggaaggtttaagcattagcctgtcggggtcagcttagattatgcggcccaaccccagccaataggggaaggacacagaaacagaaacwgccttaccccagccaataggggaaggacacagaaacagaaactgcgttaccccagccaataggggaaggacacagaaacagaaactgcgttaccccagcc

SEQ ID NO: 50833 - DNA, 201 bp, Homo sapiens
gatctggactgggtttggagatgctcaggtggggctcagagcatcacctgtggggcagagggaccatcttggcagatgaaggcccgtcgcagggtgtgatrcctgaattacaaggcgggacaggtaaagtggggcaggtgagagaaggagggtgagtgatgtgatttttctactcctgttttccaggaaaaccaaaatgcc

SEQ ID NO: 50834 - DNA, 201 bp, Homo sapiens
ggtttggagatgctcaggtggggctcagagcatcacctgtggggcagagggaccatcttggcagatgaaggcccgtcgcagggtgtgatgcctgaattacraggcgggacaggtaaagtggggcaggtgagagaaggagggtgagtgatgtgatttttctactcctgttttccaggaaaaccaaaatgccacgcacttcga

SEQ ID NO: 50835 - DNA, 201 bp, Homo sapiens
cgccatctcaactcactgcaacctccgcctcccaggtttaagtgattctcctgcctcagtttcctgagtagctgggactacaggcacccaccaccacgccyggctagtttttgtatttttaaactttttttttcttttttctttttcttcttttttttttttttgagatggagtctcgctctgtcgcccgggctggagtgc

SEQ ID NO: 50836 - DNA, 201 bp, Homo sapiens
gactttagcctttcacacaatacacaaaaattatggaattctgaagaaaataagagaaaatgttcatgaacttggggtaggcaaaaatttaatagatgagscaaaaaaaaaaaaaggcccaaaccataaaaatggtttcatttttataaggataaattagagtttataaaaattaacacttcccttcaaaagaaaaattaa

SEQ ID NO: 50837 - DNA, 201 bp, Homo sapiens
cctcggccacctcactgacttacttcttgatggcaaacacagttaacccaatggtggtgttctggagcctgaactgctcgttgaggatgtcgatgttgaargtgccctcccagacaatgggagccagccaaggggtcaccacgaggacatccttcctactgcacatggagagaggcgtgcggtcacatggagctggcaggg

SEQ ID NO: 50838 - DNA, 201 bp, Homo sapiens
acagcagctggagtgatctttccagaacataaggtaggaggctctccatgatctgatcctgccttcctgacctccccagcctcatctctccctcctctgcyctcgccctctgtgctccagccaacgtggcctgtcactcgtccacctgccatactgtcctgactccaggcctttgcctgtgctatggcctctgttgggacc

SEQ ID NO: 50839 - DNA, 201 bp, Homo sapiens
ggcctccctcggtgggttcgacagtgacctcgacgtgctcatttcagtgtggttcattccggtctcccaggggaagggggtgctgagtggaaggaggtcamtgggaagccggggtggctctcagagtctgcaggagcagtcgggctgatgagctgggaggagcagaccgcctccctcttctctgagtgggaggagggccag

SEQ ID NO: 50840 - DNA, 201 bp, Homo sapiens
aaccatttttgccacattgaaggaaaattatttccaccaagatttccctacagccaaacgatctaccaactacaaaaatggaaaaaataatttaggacatrtaaagttcaaatgttttgcctcccacgtttcggtttcaagaagctattcgagataaatcgctccgtggtcacaggacttagaaaggtggaggtaaacaca

SEQ ID NO: 50841 - DNA, 201 bp, Homo sapiens
gcggattaacaatggcgtgcttctcagaaatgaaaaagaacgaacgattgatacacgtgacaatataggtgaatcttcaaaacagcatgcggtgtgatgcrgccagacataaaagagcatgtatcagaggattccgtgtatgggaaacgccagggaatcagatccatggttgtcagggtcaggagggaccttactggggtg

SEQ ID NO: 50842 - DNA, 201 bp, Homo sapiens; identical to SEQ ID NO: 14620

SEQ ID NO: 50843 - DNA, 201 bp, Homo sapiens; identical to SEQ ID NO: 14625

SEQ ID NO: 50844 - DNA, 201 bp, Homo sapiens; identical to SEQ ID NO: 14626

SEQ ID NO: 50845 - DNA, 201 bp, Homo sapiens
ccctagcaaatgaattagccgagaactctggaatagatgacccctttgcaggtgtcatggagaaatggtttggaaaatggaagggactcatgacctaaatmtttacctcccttgcaacagttacaggtgtactcatccttgtgggctgctgtatcataccttgtattcgtgggttaacccaaaggctcatagaagcagctc

SEQ ID NO: 50846 - DNA, 201 bp, Homo sapiens
atgggagggggcctcatggtttgtagacatgttctgaaactccactctgcccggccttggcttcgacgtgtctggtgaatgtgtgggctgtgaggctcccygaacgtagacctcagactgcaacgctggccgttacagggtctggcacacgggcccacgtcaggcccatcgccacagtgatggttgttctgtgactgtttc

SEQ ID NO: 50847 - DNA, 201 bp, Homo sapiens
tggagatgctcaggtggggctcagagcatcacctgtggggcagagggaccatcttggcagatgaaggcccgtcgcagggtgtgatgcctgaattacaaggygggacaggtaaagtggggcaggtgagagaaggagggtgagtgatgtgatttttctactcctgttttccaggaaaaccaaaatgccacgcacttcgaccta

SEQ ID NO: 50848 - DNA, 201 bp, Homo sapiens
cctgcttagcttggttgggaggctccaagaccaacatcccaagaaagatgagacagaagccagatcacctttttgggcctggcttcagaagtcacccagcrtcacttctgctgcatttatttcttagaaacacagaatatcagaccccatctcttgatgggagggggcctcatggtttgtagacatgttctgaaactccac

SEQ ID NO: 50849 - DNA, 201 bp, Homo sapiens
tgaattacaaggcgggacaggtaaagtggggcaggtgagagaaggagggtgagtgatgtgatttttctactcctgttttccaggaaaaccaaaatgccacrcacttcgacctatgatccttttcctaataatgcttgtcttggtcttgtttgggtaagacacatttgaccatcgaggctggcctggtttggggagaagtga

SEQ ID NO: 50850 - DNA, 201 bp, Homo sapiens
tggggtcactgcaaagacttccctgcatctctggcagttgatgctggctgtcatctgagacacctacccagggcctctccctggggcctgggctcctgctyagcttggttgggaggctccaagaccaacatcccaagaaagatgagacagaagccagatcacctttttgggcctggcttcagaagtcacccagcatcactt

SEQ ID NO: 50851 - DNA, 201 bp, Homo sapiens
gcactttgggaggtcaaggtggccagatcacttgagcccagaagtttgagaccagcctgggtgacatagtgagaccctgtctctacaaaaaaaaaaaaaaattagctgggcatggtggcatgcacctgtagcccctgctactcaggaggctgaggtgagaggatgacttgagcccagtaggcagagattgcagtgcattcc

SEQ ID NO: 50852 - DNA, 201 bp, Homo sapiens
agcctcagacttgtctccccatccccatcagccctgtcccccttcttctcacagcagctggagtgatctttccagaacataaggtaggaggctctccatgwtctgatcctgccttcctgacctccccagcctcatctctccctcctctgccctcgccctctgtgctccagccaacgtggcctgtcactcgtccacctgcca

SEQ ID NO: 50853 - DNA, 201 bp, Homo sapiens
tgatccttccacctcagcctcctgggaccagaggcatgcaccactatgcccagctaattgttttttttttttttttcttgatagaaatgagttctcactaygttgcccaggctggtctagaactcctggcttccagcaattctgctggctcagcctcccaaagtcctgggattataggcacgagccacgatgcctgtcctc

SEQ ID NO: 50854 - DNA, 201 bp, Homo sapiens
ggaggccaagataggtagatcacttgaggccaggagtttgagagcagcctggcccacatggcaagactccatctttacaaaaatacaaaaaaaaaaaaaaagttgagtgtggtggtgcgcctgtaatcccacctacttgggaggctgaggcatgagaattgcttgaacccaggagggagaggttgcagtgactggagatca

SEQ ID NO: 50855 - DNA, 201 bp, Homo sapiens
acgtcctgctccagggctccggtggggctgccctcatctctgtgacagcctcagacttgtctccccatccccatcagccctgtcccccttcttctcacagyagctggagtgatctttccagaacataaggtaggaggctctccatgatctgatcctgccttcctgacctccccagcctcatctctccctcctctgccctcg

SEQ ID NO: 50856 - DNA, 201 bp, Homo sapiens
tggcttactgcagccttcacctcctaggctcaagtgatccttccacctcagcctcctgggaccagaggcatgcaccactatgcccagctaattgttttttktttttttttcttgatagaaatgagttctcactatgttgcccaggctggtctagaactcctggcttccagcaattctgctggctcagcctcccaaagtcct

SEQ ID NO: 50857 - DNA, 201 bp, Homo sapiens
cctgtcctcaaaatattttactgtactgtactcacctattattggcctttggttgaccatgggtaactgaaactccagcaagcgaaggtgtggataagggmactactgtacgtgactttaatatacataaaatcaccttaaagacaatgattgtttccagaacatgagcctctgagacagcagggagatactaggggaagt

SEQ ID NO: 50858 - DNA, 201 bp, Homo sapiens
ctccgatccaattggccatccctttcaccttggcatttcaacaaccagacaggaagcaggtaacccaaaggaaaagagaaacccctcacgggtcctttgayctctcatatttacatagacagtatcggggttgcgctggggggtacaaaatgaattcaaagctcgaaaccaaatagccaccaggtttgagtctgtattatt

SEQ ID NO: 50859 - DNA, 201 bp, Homo sapiens; identical to SEQ ID NO: 14629

SEQ ID NO: 50860 - DNA, 201 bp, Homo sapiens
tggatcacctgaggtcaggagttcaagactagcctggcgaacatggtgaaaccccgtctctactgaaaatacaaaaaaattagccagccatgatggtgtgygcctgtaatcccagctacttgggaggctgaggcacgagaattgcttgaacccgggaggctgaggttacagtcagccaagatcgtgccactgcactccaac

SEQ ID NO: 50861 - DNA, 201 bp, Homo sapiens
tccaccaagatttccctacagccaaacgatctaccaactacaaaaatggaaaaaataatttaggacatgtaaagttcaaatgttttgcctcccacgtttckgtttcaagaagctattcgagataaatcgctccgtggtcacaggacttagaaaggtggaggtaaacacacacaagcattataagataagaagtaacagatg

SEQ ID NO: 50862 - DNA, 201 bp, Homo sapiens
aatcagaataggttgatattaggatagacagatagttcaatggaatagaatgcagagtttagaaatagacctacacagaaatagtccattgattttttaakagttgctttttgataagggtgctaaggtaatgtgatagagaaaggaaagtattttcaattcaaatggctgaaatgactggatatccattgagggaagaaa

SEQ ID NO: 50863 - DNA, 201 bp, Homo sapiens
gctgcgggataattaaggaatcagagagaccgatggggttgaggaggaattatttaattatttaggcgcaccgacccaatcagattaacatccaaaggacygggccccaaacaaagagtcaagctaccttttaagcattttgtggggtggggggagatttgtgcagggggaagagtattacagaagcgagaaacaaagaca

SEQ ID NO: 50864 - DNA, 201 bp, Homo sapiens
gaagccctacgggacagcccccaagggccattcgacttccagctcttgatgccaattttacctcatgtctctcatggcaaggggaaaatctgacgttcctsggaaacctgatgggatgtactgggcctaaacctttccaagagctaaccagtcagtcagccctaatccatccccaagcagatgtacagtggtattgtgggg

SEQ ID NO: 50865 - DNA, 201 bp, Homo sapiens
aaattttacatagtaatcagaataggttgatattaggatagacagatagttcaatggaatagaatgcagagtttagaaatagacctacacagaaatagtcmattgattttttaagagttgctttttgataagggtgctaaggtaatgtgatagagaaaggaaagtattttcaattcaaatggctgaaatgactggatatcc

SEQ ID NO: 50866 - DNA, 201 bp, Homo sapiens
aaggcactggtggcggggggtgagggagctggggctctggagctccagcaggtgcccatacgtgagcaatatcccagggaccaccctcctgcccacctccmggtgtgggacgtggcgaggcgcctgagctttgctgagaacttgccctacctgcctcgaggccttgcagcttcaccgggaactcttgtgctcacgctgctg

SEQ ID NO: 50867 - DNA, 201 bp, Homo sapiens
ctaaactgtcacttctccccagatggatctacagagtccacataatctcacttaaaactccagaagaaatttttgtaaagttgacagctgattctaaaatkttacatagtaatcagaataggttgatattaggatagacagatagttcaatggaatagaatgcagagtttagaaatagacctacacagaaatagtccattg

SEQ ID NO: 50868 - DNA, 201 bp, Homo sapiens
actgcagcccccacctcccaaggcttaggtcacctcagcctcctgagtagctgcaactacaggcaagtaccatcatgcctagctgatttttgcattttttrtagacagggttttgccatgttacttaggctggtcacgaactcctgggctcaagtgacccacccacctcggcctcccaaagtgctgggattacaagcgtga

SEQ ID NO: 50869 - DNA, 201 bp, Homo sapiens
tggagaaatataccatgctcatggattggaagacttacattgctaaactgtcacttctccccagatggatctacagagtccacataatctcacttaaaacyccagaagaaatttttgtaaagttgacagctgattctaaaattttacatagtaatcagaataggttgatattaggatagacagatagttcaatggaataga

SEQ ID NO: 50870 - DNA, 201 bp, Homo sapiens
tgggaggctgaggcatgagaattgcttgaacccaggagggagaggttgcagtgactggagatcacaccactgcactccagactgggcaacagggcaagacwcagtctaaaaaaaaaaaaaaaagaaaaaagaaaaacaagaataaatcaattatttttctataatacttgccacaatcaattgaaccatgaaaaattttaa

SEQ ID NO: 50871 - DNA, 201 bp, Homo sapiens
tgcccacaattgcgtggctgggggtggggaaggcaattctgggtcccaagctgttagtcgcttccagacacagaaggtcccagaaccaagagtgaagtcayctgtcacctctactggggcatctctggacacggtctggaaacactccctgacgtggcctcagggactgcactgatcaaggcactggtggcggggggtgag

SEQ ID NO: 50872 - DNA, 201 bp, Homo sapiens
tggggtaagctgaagcttccagtatcccacgtgggcattctgttgctgagggcaaccgcccctccctgcaagggaggggaaggagcaggcaggcacacccktcctccctccacatttcactggagttgacctgtgtcctactgtggttgcacctggaccagcccagagggactggagtgactcttcccgcaggtagggcac

SEQ ID NO: 50873 - DNA, 201 bp, Homo sapiens
gatcacttgaggccaggagtttgagagcagcctggcccacatggcaagactccatctttacaaaaatacaaaaaaaaaaaaaaagttgagtgtggtggtgygcctgtaatcccacctacttgggaggctgaggcatgagaattgcttgaacccaggagggagaggttgcagtgactggagatcacaccactgcactccaga

SEQ ID NO: 50874 - DNA, 201 bp, Homo sapiens
aattgcgtggctgggggtggggaaggcaattctgggtcccaagctgttagtcgcttccagacacagaaggtcccagaaccaagagtgaagtcacctgtcasctctactggggcatctctggacacggtctggaaacactccctgacgtggcctcagggactgcactgatcaaggcactggtggcggggggtgagggagctg

SEQ ID NO: 50875 - DNA, 201 bp, Homo sapiens
agatcacttgaggccaggagtttgagagcagcctggcccacatggcaagactccatctttacaaaaatacaaaaaaaaaaaaaaagttgagtgtggtggtrcgcctgtaatcccacctacttgggaggctgaggcatgagaattgcttgaacccaggagggagaggttgcagtgactggagatcacaccactgcactccag

SEQ ID NO: 50876 - DNA, 201 bp, Homo sapiens
caaggtctcaagatacaaagtcaatgaataaatcaggctgggtgtggtggctcacacctgcaatcccagcactttgggaggccaagataggtagatcactygaggccaggagtttgagagcagcctggcccacatggcaagactccatctttacaaaaatacaaaaaaaaaaaaaaagttgagtgtggtggtgcgcctgta

SEQ ID NO: 50877 - DNA, 201 bp, Homo sapiens
ttactcttgatttcttcctgtatattcaagttattgtctggtgacctttccttgctccagtatatataataacttcattgcctccttgctcctttatgctrttattgtcatatatattatatatgtttatgctgtgagcccatcagctaagtcagcttagcaaggtctcaagatacaaagtcaatgaataaatcaggctgg

SEQ ID NO: 50878 - DNA, 201 bp, Homo sapiens
tcagtaagacaagtaaggagaaaaacacttttcaagtcttttatattacactgtatatttatcactgactttactcttgatttcttcctgtatattcaagytattgtctggtgacctttccttgctccagtatatataataacttcattgcctccttgctcctttatgctattattgtcatatatattatatatgtttatg

SEQ ID NO: 50879 - DNA, 201 bp, Homo sapiens
aaaaattatttagtctgacgttagcatttctcctcaagctcccttacggttgtttgcatagcaaatctactatccttttgctttgacctatttgtatcttwgtttctaaagtatgtatgtctctcacaggcagcatatagtcaaagcttaaaaaaaaaatccagtctaacgatctctgccttttgattggcatgttcattc

SEQ ID NO: 50880 - DNA, 201 bp, Homo sapiens
tttacatacaactgagtttttgcttacacagtttttaatttcttttaattcctgttctagtattttggggctaggttgtcaggtatgtatatatttctgtytgttatattttcgtgatgtattcactttatatcatggcagaatgtttctctttagtaagatttttgatcttaaaaaagttggccagatggggtggctcat

SEQ ID NO: 50881 - DNA, 201 bp, Homo sapiens
ggctcttgccaggtggagtgttctagagatgtcagttggtgtccagtgatgtcaagtcatttgtatctactgattttctttctaattattctatccattaytgagagtggggtaggattttggtgtccaattattgtttttttgtttttttttttttgtttgtttgtttttttttttgaggtggagtctcactttgtcacc

SEQ ID NO: 50882 - DNA, 201 bp, Homo sapiens
tgtgttctctctctctctggtcaatgtagctaaagctttgtcaattctcttgatcttttcagagaactgacatttgattttttttactttatctttttctytctgttctctagttcattggtttccactctaatatttattaatttcccttcttctcactttgggtttaatttgttctgtcttttcttattgtagttactt

SEQ ID NO: 50883 - DNA, 201 bp, Homo sapiens
gtctcctcttttagtcctgattttagttatttgtgttctctctctctctggtcaatgtagctaaagctttgtcaattctcttgatcttttcagagaactgmcatttgattttttttactttatctttttctctctgttctctagttcattggtttccactctaatatttattaatttcccttcttctcactttgggtttaa

SEQ ID NO: 50884 - DNA, 201 bp, Homo sapiens
caaagatttaatcttatattttcttctaaccgctttctagtttatgtgtaagaatctgtccattttacctaagttgcataatttgttggcaaacagttgtwcatagtatttccttgaaatccttttaatctctgtaagattggaattgctgtctcctcttttagtcctgattttagttatttgtgttctctctctctctgg

SEQ ID NO: 50885 - DNA, 201 bp, Homo sapiens
ctcctttgttcagttttgagagttctttacatacacagtatcatatatatatatatatatatatatatataccagatatatgatttgcaaatattttcaaycatcaatagtttgtcttaacacttttttattggtgttttgaagtagaaaagttttacattttgatccattccaatttattaactttttcttttattgtgt

SEQ ID NO: 50886 - DNA, 201 bp, Homo sapiens
ctctccctccaggccctttcctgtgtcctcgggcccctcgggtccctgcaccaggccagcagcaatcgggtgtcagaggttcaagtccaggctgactcctsggacgcaccgactttgcccaggagggctggggagagggcagccccaaagtgtcatctttgattattctttgtccccaaagccagccttgggcatgtgccc

SEQ ID NO: 50887 - DNA, 201 bp, Homo sapiens
ggctgagggttccactgtctgtacgtctgcagcaatacataccattcttgtgggtaaaaggtggtatctcattatagttttgatttgcatttccccaaggwcaaatgatggcaagtggcttttcttgtgctttttagccatttgtatatgtttttggtgaaatgcctgttgaaatgttttgcctttttaaaaattgagttg

SEQ ID NO: 50888 - DNA, 201 bp, Homo sapiens
aaactcctgggctcaagtgatctgcccacctcggcctccccaagtcctgggattataggtgtgagccgctgcgcctggctgagggttccactgtctgtacrtctgcagcaatacataccattcttgtgggtaaaaggtggtatctcattatagttttgatttgcatttccccaaggacaaatgatggcaagtggcttttct

SEQ ID NO: 50889 - DNA, 201 bp, Homo sapiens
cactgcactccaacctgggtgatagagtgagactctgtctcaaaaaaacaaaaaaattatttagtctgacgttagcatttctcctcaagctcccttacggytgtttgcatagcaaatctactatccttttgctttgacctatttgtatcttagtttctaaagtatgtatgtctctcacaggcagcatatagtcaaagctta

SEQ ID NO: 50890 - DNA, 201 bp, Homo sapiens
aggacagggcaggagaacgtggtgcatctgctgctctaagccttccaatggccgctggcgggcgggtgcaggacgggcctcctgcagcccaggggtgcacrgccggcggctcccccagcccccgtccgcctgccttgcagatacgtggctttcctgaagctgttcctggagacggcggagaagcacttcatggtgggccac

SEQ ID NO: 50891 - DNA, 201 bp, Homo sapiens
tgccatcaagaagtaagtcagtgaggtggccgagggtagagacccaggcagtggcgagtgactgtggacattgaggtctctccttgtgttcaagacagagwggggtggcggccagccttgtcctcccagagggtagatgggaaaggtcattcatgcagcatcttactgagctcatgtgggctcgtgggctcgtgggctcgc

SEQ ID NO: 50892 - DNA, 201 bp, Homo sapiens
gtcaggagttcaagactagcctggcgaacatggtgaaaccccgtctctactgaaaatacaaaaaaattagccagccatgatggtgtgtgcctgtaatcccwgctacttgggaggctgaggcacgagaattgcttgaacccgggaggctgaggttacagtcagccaagatcgtgccactgcactccaacctgggtgatagag

SEQ ID NO: 50893 - DNA, 201 bp, Homo sapiens
tcaggacagggcaggagaacgtggtgcatctgctgctctaagccttccaatggccgctggcgggcgggtgcaggacgggcctcctgcagcccaggggtgcrcggccggcggctcccccagcccccgtccgcctgccttgcagatacgtggctttcctgaagctgttcctggagacggcggagaagcacttcatggtgggcc

SEQ ID NO: 50894 - DNA, 201 bp, Homo sapiens
gccaaggcaggtggatcacctgaggtcaggagttcaagactagcctggcgaacatggtgaaaccccgtctctactgaaaatacaaaaaaattagccagccrtgatggtgtgtgcctgtaatcccagctacttgggaggctgaggcacgagaattgcttgaacccgggaggctgaggttacagtcagccaagatcgtgccac

SEQ ID NO: 50895 - DNA, 201 bp, Homo sapiens
ggccaaggcaggtggatcacctgaggtcaggagttcaagactagcctggcgaacatggtgaaaccccgtctctactgaaaatacaaaaaaattagccagcyatgatggtgtgtgcctgtaatcccagctacttgggaggctgaggcacgagaattgcttgaacccgggaggctgaggttacagtcagccaagatcgtgcca

SEQ ID NO: 50896 - DNA, 201 bp, Homo sapiens
ttggaattcagcaaagctgaccagcatgaacattaacacagaccttaagtctgattagtggcatttacaatctatactctctgaagcgtgctacctggagkcttcctttgcatgataaaactttggtctccacaaccccttatcataacctagacactcctttctagtgataataactctttcaaccaattgccaataaaa

SEQ ID NO: 50897 - DNA, 201 bp, Homo sapiens
attttcgtgatgtattcactttatatcatggcagaatgtttctctttagtaagatttttgatcttaaaaaagttggccagatggggtggctcatgcctgtratcccagcactttgggaggccaaggcaggtggatcacctgaggtcaggagttcaagactagcctggcgaacatggtgaaaccccgtctctactgaaaata

SEQ ID NO: 50898 - DNA, 201 bp, Homo sapiens
acatccaaaggaccgggccccaaacaaagagtcaagctaccttttaagcattttgtggggtggggggagatttgtgcagggggaagagtattacagaagcragaaacaaagacagttattcagttaagacatgcattacattatttcttacttttcaaggaacaacacgttttatgactcaagattatctgtttagtgacc

SEQ ID NO: 50899 - DNA, 201 bp, Homo sapiens; identical to SEQ ID NO: 14612

SEQ ID NO: 50900 - DNA, 201 bp, Homo sapiens
acttaggctggtcacgaactcctgggctcaagtgacccacccacctcggcctcccaaagtgctgggattacaagcgtgagtcaccatgcctggcccaaccrttactggtgaattgactgtttcacccttcaattctgtgagtttttgcttcatgtattgctgcgggataattaaggaatcagagagaccgatggggttgag

SEQ ID NO: 50901 - DNA, 201 bp, Homo sapiens
ggtgctggtggtcccccatcgctgggaagaggatgaagtgagtcgcagcccgaggactcgctcaggacagggcaggagaacgtggtgcatctgctgctctragccttccaatggccgctggcgggcgggtgcaggacgggcctcctgcagcccaggggtgcacggccggcggctcccccagcccccgtccgcctgccttgc

SEQ ID NO: 50902 - DNA, 201 bp, Homo sapiens
tatttactcaagggaaatgaaaacacaggtccacaaatacctgcacatgagtgtttacagaagctttgttgctagtggccccgaacagtgaaaaaaccacrgtgtctgtcaataggagacagaataaatgaattgtggcggattaacaatggcgtgcttctcagaaatgaaaaagaacgaacgattgatacacgtgacaat

SEQ ID NO: 50903 - DNA, 201 bp, Homo sapiens
tccgaggcgggtggatcacttgaagtcaggagatcgagaccagcctggccaacatggtgaaacctgtctctactaaaaatacaaaaaattagccaggcgtrgtggtgggcgcctgtaaacccagctactcgggaggctgaggcaggagaattgcttgaacccgggaggcggaggctgtagtgagccgaaggtgcccctttg

SEQ ID NO: 50904 - DNA, 201 bp, Homo sapiens
aggcaaccgcagacacatacttgacttctcggcagctgtgggcagctgggccagcgacagtggcggaggccaggaatgacttactcttaggaataggtgcrgttcaagcctggagggaggaagctctagggtgcagaggcgggtgtgtggaggcctcgcgtgcagcttataatgagggagcacgtggccggcctggccata

SEQ ID NO: 50905 - DNA, 201 bp, Homo sapiens
acgcagcactgctatgaacatttgtgtacaagactttgtgtgaacatgttttcatttctcttgggttgatacccagcagaggaattgctgggtcatacagraagtctgatttaacattttaagaaactagcaaactgttttccaaagtgactgccccattttacattcccatcagcagtgtataacggttctaattttctt

SEQ ID NO: 50906 - DNA, 201 bp, Homo sapiens
acctgtttcaaatgaattattttcagttagtttacagagttgtgaaataaattttataacttttccatccccagcccaccaaaactccctggaactcctcygcagtcattccccattcccacctggcctcagacaatcactttctgtctctccagtcttgccttttctggacagttcctatgaatggagtcctgtgttaca

SEQ ID NO: 50907 - DNA, 201 bp, Homo sapiens
tagaactgggttatggagcaacttcaacaaagaataatcaacgtgtggggaaatgacaggacccaggagagcggttttaggcttccaagtttgggaaaccrgcaaggtgagtattgggaggaaactaaggcggaagtttcattcacagagccctagggtgccttctttcctctggctgatgcgtctctctcctataatttc

SEQ ID NO: 50908 - DNA, 201 bp, Homo sapiens
atttgttcactcatcaatatcttatttaaaaattatttgaacatgtttctctttatttttttgagcatattgatacacaacatgtggacctactcagagtsacctacatttttgaagcccatattttttaagatgtagaattccagttttgcaattattttccactcacacattaaatatattataggtgtatctcagaga

SEQ ID NO: 50909 - DNA, 201 bp, Homo sapiens
tgctctcaggatattttctttatcattggcttttaacaatttgcttatgatgtgctttctttgtgattattctttgttgggttgtattgagcttgttgaayatgtaaattaatatttttcactgtttgaaaagttgtcagtcattattactttaaatattttctacgcctttctccccctctttttttttggggattttaa

SEQ ID NO: 50910 - DNA, 201 bp, Homo sapiens
atattttcgtattccccagaatgttcttgagctttgttctgccacatgattgttacttggaaatggtttaatcctttcgggtcttgcttttaagcttaatkaggatcaggaaaaagtttattcttggcctaattttccctaatgactgagtcagaacccttctgggtactctgcctgatgccttatcattaatgaggcttt

SEQ ID NO: 50911 - DNA, 201 bp, Homo sapiens
ttccaaatacctgcttcaactctgtggattgcatttcatttccctaatggtgtctttggatgaacacaccttgatttatcaatagtctttctttgattatwagaatattttgtgtctgttttacaactatttgcctactccaaagtcataaaaattttctcctgtgcatttctttaaaggctttattgttttacttttcac

SEQ ID NO: 50912 - DNA, 201 bp, Homo sapiens
tcctcagcagtagttactgctgccacacagcatggttctgctaatatgtacttccagtgggaatgtttgacagttccagctgatggaaatctttaccagcrtttaatattttctcttattcattttcaccattctggtaagagtgtcccgcaatttcattctggctttaattgaatttccccaatggctaatgcagttgaa

SEQ ID NO: 50913 - DNA, 201 bp, Homo sapiens
gtgtttatgttaggcaccacatagttgggcctttctttagccaatctgatcatttccgcctttcaatgagagtgtttagactatttgaaattttagtgtgwttattcatatattagggtttaattctgggatcttgctatttgtttttctatttgtcccatcaattctgttatttttttctctttttttgctgccttttag

SEQ ID NO: 50914 - DNA, 201 bp, Homo sapiens
cgtacagccctgtaataatagaggttgctcggaatcaactcacagtagtaaaaatcctggttgagaaattatccccaaagatgatatgattttatcgcccygtacaaagttaaccagtcttatacataatatggatcttttcaaacttttaaatgaagtataatgcatacacagaacagtgaactcatcatgggcaactaa

SEQ ID NO: 50915 - DNA, 201 bp, Homo sapiens
ctatttttacctttatttataaaatgtctgtatgtaggtgtatgtgtttatgttaggcaccacatagttgggcctttctttagccaatctgatcatttccrcctttcaatgagagtgtttagactatttgaaattttagtgtgtttattcatatattagggtttaattctgggatcttgctatttgtttttctatttgtcc

SEQ ID NO: 50916 - DNA, 201 bp, Homo sapiens
attcttgtgcctcagcctcccaagtagctaggattatgggtgcccaccaccacacctggctgattttttttgtattttagtagaggtggagtttcaccatsttggccaggctggtctcaaactcctgacctcaggtgactcacccgcctcagccttgcaaagtgctgggattacaggcatgagccaccacgcctggccgac

SEQ ID NO: 50917 - DNA, 201 bp, Homo sapiens
gactccgcctcaaaaaaaaaaaagtggaaatagcaatatgtgctttagctaaatattaattttgtttttgccctgccttttagctctgtggtcttgaccarggcctcatagcgactctgaatctcttgcgactctgaatctcttgcgactctgaatctctcgcaatctcaattttcttgtttgcaaaactaagatgtagca

SEQ ID NO: 50918 - DNA, 201 bp, Homo sapiens
tcttctggttactgcaagcctttgatttttgaaattttttgccagtctttttgttgcctttatggaggaatgatttatgagacccccactccaccatattrgaaatcttgcaaattcaatttctttgaatagaaaatagtattaatagatatagggcaatccaggctatctacttcttctcaagggagctttaatagtctg

SEQ ID NO: 50919 - DNA, 201 bp, Homo sapiens
gatagtgcttttgctgtggagctcttggtgaggtcaataacaccaccaccctatgaatgtgactttgaggacctgccagtcaagtcaaagagtggcagtgytctggaaatgggacttttcgaggagctccaaaccctctctcttcttgcaagcctgctggttttcaaagcctttgtgtctgcaaagctcttgatattcatg

SEQ ID NO: 50920 - DNA, 201 bp, Homo sapiens
catgataattccatgcacttaacatgaggtaggtgataacggaagtagtggttttcttgatttttcttattcaaactgcttcatcaaacaaaacaaaacaraacaaacgccctggagacagagagtcttattgtgccatagtatttctctttctctctcttttttaaatatttcaagcgagcatgccatcagcagggctgt

SEQ ID NO: 50921 - DNA, 201 bp, Homo sapiens
agtcccagctactagggaggctgaggcaagagaatggcatgaacccaggaggcggagcttgcagtgagcccatatcgtgccactgcactccagcctgggcracagagcaagactctgtctcaaaaaaaaaaaaaaaaaaaatcttcccacaaggcaaattccaggcccagataacacgtcttgtgaattctaccaaacatt

SEQ ID NO: 50922 - DNA, 201 bp, Homo sapiens
agtcagttgatgtgggcaaataacctaacaccttggcattcacttccaggttttcttcatttcctcgtcctccctttccttcttcaaatgttctcctgttycttcttggctttataactatctttgtctctgcttcccttcctatacattgccttaattaatcctttaatttagattaaattaaaggataaatataaatta

SEQ ID NO: 50923 - DNA, 201 bp, Homo sapiens
ttttcaaagcacagaattacatggtctactctagacattgctcctaaggttgagcagaggggataagagctttttctcttttttcctttcctctttttttyatacaaagttcgttgtagatattttagaaagtatagaaagccccgacaaggggaaacccactcaacccaattttaatgttgttgtcatttcttttagttt

SEQ ID NO: 50924 - DNA, 201 bp, Homo sapiens
tttttttgagatggagtctcactctgtcactcaggctggagtgcagtggcaccatcttggctcactgcaacccccgcctcctgggttcaagcaattctccyacctcagcctccccagtggctgggattacaggcatgcaccaccacacccagctaatttttgtactttttggtagagatggagtttcatcatgttggccag

SEQ ID NO: 50925 - DNA, 201 bp, Homo sapiens
attgcttgtcaaaagggggaactgaggcacggaggctgagcttttactcaacatgccatctatgttgagggacttctgacttggatagccattcaactgcsagcactatggaggccagtcaggcctggccctgccttggaatttctgtgttattcagggacataatggggtttgtgttgatttttgttgggagtgtgtggg

SEQ ID NO: 50926 - DNA, 201 bp, Homo sapiens
aaatcttcccacaaggcaaattccaggcccagataacacgtcttgtgaattctaccaaacatttaaagaaaatataatagtaattctactcaaactcttcsagaaaattgaataggagtaaatgcttctcaactcatgagttctccccaactctgtgaggctaatattacccagatatcaaaaccaaacaggacattacat

SEQ ID NO: 50927 - DNA, 201 bp, Homo sapiens
tatttaacagtgtattaagggatctagctggtgcaaaaaaaaaaaaatcaagatatgaaataaaaggtatccagattggaaaagaaaagaaattctatttktagacaacatagtggtctatgtaggaaacactatggaatctattaaaaatctactagaactaataaatgagttttggaggttataagatcaatatacaaa

SEQ ID NO: 50928 - DNA, 201 bp, Homo sapiens
tactccatctgctccccagcttcctctttaattattggataactaagtagagaaggaggccaggagaatgtggaaatgtgaaacttccctaagcctccacyttattcgctttccaccagtctttaactttacccaatggactctctgacctcagggaacttttgtaggcttttgagtgattttaacttttccctgttttac

SEQ ID NO: 50929 - DNA, 201 bp, Homo sapiens
atcccacgtgatattttatataaccttgtcggttcagtttaaaagcaagtgttagttgctcctaacctttgctgcctttttttttttttttttttttttttgctaagctaagtagaatttataagatcttgtacatttaaggtaaaaaatacttgtcattgtggtgcaaattacagaccacttagaagcctttctcttacg

SEQ ID NO: 50930 - DNA, 201 bp, Homo sapiens
agtggcttcctctcttgattacgttggtggctgtgagatgaactacccagtcatcagtcatcattatcaatggcccatttgcctgggatgctttggaagartgaaagagagtaaaggcagttctacttttaaagaagttaaaacatgggctacagagcattttcgtttattgtttatcaaatgttagcctgcctcagaata

SEQ ID NO: 50931 - DNA, 201 bp, Homo sapiens
tggggactatttaagctaggttaagtgttttttttttttttttttttttgagatggagtctcgctctgtcacccaggctggagtgcagtggtgcgatctcygctcactgcaagctctgcctcccgggttcatgccattcttctgcctcagcctcccgagtagctggaactacaggcgcccgccaccacgcccggctaattt

SEQ ID NO: 50932 - DNA, 201 bp, Homo sapiens
attacaaaacatactatgtgtgttttattgaagatatggtcttcaaataacctgctagtttccataactgtctgaaaagtgggttgactagctttccatgraacaccccatgttttggtaactttaatctacctagtctgatggaacttaaatggggaatcatcttgtagagcttaagacgtactaaatacgtaatatcaa

SEQ ID NO: 50933 - DNA, 201 bp, Homo sapiens
ctacatagaagattttatctttgtcactggttttaaacaattttattattatgtgtttgtagtttgctttatgtttcttttgcttggggttcattgtgatwtgggggcctatgtatacatcatttttgtcacatcttgaaaaacttcaaatatgttttctgttttccacatttttcttcttcagtgattcatattacatgt

SEQ ID NO: 50934 - DNA, 201 bp, Homo sapiens
ttaattatgttttttattttctgtatcttaccatattttgacattctggaagatgtttcatatctagggagagactgctccaccaggggctaagcagttcytaggtgtgttgtggacagcttacagcttgcccttcatgtgagactgcttgacccaagatggtaccccactcacctccttatccaactctcacacacccaa

SEQ ID NO: 50935 - DNA, 201 bp, Homo sapiens
tcagcatgtctggagcatagtgagagatgagggaagtcataagggaccaggctgtctgggtaatggggggatggcagagggttgattatatagaatgttgygcccttttttagggtcttggcttgtagtctggctgggatgggaagacttcagggttctttgtttaagaccagagaggtgatctgacttacgttttgattc

SEQ ID NO: 50936 - DNA, 201 bp, Homo sapiens
ataaaaatatcagcatgtctggagcatagtgagagatgagggaagtcataagggaccaggctgtctgggtaatggggggatggcagagggttgattatatrgaatgttgcgcccttttttagggtcttggcttgtagtctggctgggatgggaagacttcagggttctttgtttaagaccagagaggtgatctgacttacg

SEQ ID NO: 50937 - DNA, 201 bp, Homo sapiens
tgtaaattctcacctgaataacaccagggaggcatggttctatacacaagcacctgtcagactgtgttgtatttgccacaagagatcacagtggggccgcygctgcacatagggctggcgaccagaacactgtatctcttggccaaccttgtcctccgtgtgagacaagtggagacattttacaaaaatacgttctacgtc

SEQ ID NO: 50938 - DNA, 201 bp, Homo sapiens
agtacaactcagtttacaaagggctttctcattcattatctcatgcattaataaactgactgataattttgacagattattattgcatgtccaacctgtgytaagccctgtgctaggtgctggggatgatgagaggaagaaggagtggaaggggaaatagaaagatgaagaaaattcagagcagcttacagtccatctgcg

SEQ ID NO: 50939 - DNA, 201 bp, Homo sapiens
ttatatggaatgcttagaataagcaaatttatagaatcagaaagtagtatatagattgccaggggctagaagaaaggggaacgaagagtgattgctaatgrgtatgaagtttcttttgggggtgatgaaaatgctctgaaattggatagtggtgatgggtgcgcaactctatgaatatactgaaaccctttgaattgtaca

SEQ ID NO: 50940 - DNA, 201 bp, Homo sapiens
aatagtttgtggttctttgaaatgttcaacatagagttgccatatgactcagcaattccactcctaggtatctatgtgacataattaacaacacaaaaatytgtacaccaattttcatagcaacattattcaaaatagccaaaacatagaaacaacccaaatgtccattaatggatgaatggattaacaatatgcagtata

SEQ ID NO: 50941 - DNA, 201 bp, Homo sapiens
atttgttgtgctgtgctgttctaggtgttgcaaaatgtctagtagccccaacttctgcctggtagatgcacacccaaccaaaaatactcccgcttgtattkaaaactcacttaggttatagctaattcccaggcactgtctgtagagattctgctcaggtagggctctagaatgtccaagaggctgcacagctaggcatgg

SEQ ID NO: 50942 - DNA, 201 bp, Homo sapiens
cattagcaaacgcaaagcaaaacatactaagatgccatccactagaatgacgggatgaaagaggccagaaataataaatgttagtgaggacatagagaaaytggtacactcatttattactggaaggaatgtaagatggtacagctacttttaaaatagtttgtggttctttgaaatgttcaacatagagttgccatatga

SEQ ID NO: 50943 - DNA, 201 bp, Homo sapiens
attagaaatcaataaaagaagaaaatttaggaaagtcacaaatatgtgaaaattaaacaatatactcttaaatatcaaatgggtcaaagaagaaattaaargagaaattaaaaatactgtaagattaaagaaaatgaaagcacaatacaccaagcttatgggatgcagctaaagctatacatagagaaaaaattaaagaaa

SEQ ID NO: 50944 - DNA, 201 bp, Homo sapiens
ggctggaatgcagtggtgtgatctcggctcactgcaagctccgcctcccaggttcacaccattctcctgcctcagcctcccaagtagctgggactacaggygcctgccaccatgcctggttaatattttgtatttttagtagagacggggtttcaccgtgttagccaggatggtctcaatctcctgacctcgtgatccacc

SEQ ID NO: 50945 - DNA, 201 bp, Homo sapiens
atttcaagtgatattgtactgcttcaggtatgatataagaactttataacgctttcatttctcccttcctggtctttgtgttattattgctgcacattttycttctacatatgttatgagacccacaatacatttttaattttgcttcagttatgttttgaaatgttttaattaataaaaatatcttacttatgtacccat

SEQ ID NO: 50946 - DNA, 201 bp, Homo sapiens
tttttcaaaattgcaaataatgtgtaaaatcattgtacttggccgggtgtggtagcttatgcctgtaatcccagcactttgggaggccgaagtggggggartcagctgaggtcaggagttcgagaccaccctggctgacacggcaaaaccccgtctctagtaaaaatacaaaaaaattagctgggcatggtggcctgtgcc

SEQ ID NO: 50947 - DNA, 201 bp, Homo sapiens
tggcaaaatggtttttgtagtggcaccaggctttacaacctcttgtgagggaagagggagaaatgccatgccttaatgtgccaagaaggaggtgtgagatycaccctggttgaaccccatggtgccggtgtcctctcctagaccagtggctgccaagggccatcttccgaggaagcacctggactatacatcctccacaat

SEQ ID NO: 50948 - DNA, 201 bp, Homo sapiens
tggtccccagcacgctctgtggttatttccacactttcctgctctagcttgggtagggaagttcctgggtgggctctgtgatcattaggggtaggtcactscctctaatttgccccacaggtatgagtgtgtggggctctgatgcttccatttctcatcagaattgcatagagattattatggacatttacttaggacagt

SEQ ID NO: 50949 - DNA, 201 bp, Homo sapiens
gctagctactggggatacagcagggaacagtgcacacagaaatacctgcctgcatagggtttatattcttgtagaagagagagataacagataagtagacrtatattgtgtcatatgatggcaagtatagggaggaaaaaagagtataaggttttggcattacagtgggcagaaggttaattttttgaatgtggccagaaa

SEQ ID NO: 50950 - DNA, 201 bp, Homo sapiens
ttgttctcaattttgtgaaaactctttatccctttttgttccccaccccattttctaaccagaagtcaaatatgacaacattcatgatgtagaaaaaccarttcatcagtgtgacttgtgggtgagggtggggacagggccggtgttggtatatttagttttagagatttgctggaaaagtaacatttttgcttttgtctt

SEQ ID NO: 50951 - DNA, 201 bp, Homo sapiens
ggaaatgtgtaatgggacagaaggtagaaatgtttaaaatcttaagttgttgagtttgttctcaattttgtgaaaactctttatccctttttgttccccaycccattttctaaccagaagtcaaatatgacaacattcatgatgtagaaaaaccaattcatcagtgtgacttgtgggtgagggtggggacagggccggtgt

SEQ ID NO: 50952 - DNA, 201 bp, Homo sapiens
ctgcctttactctgtagagtgtcttgctaggaaaaccacaggagagaacacatgcttgcaactcccttcatcatctttgcatcaagaataattcttgtctsaacaacaaacaaacaaacgaaaccaataacgaaaattcttcatcatatttgcatcaagagtaattctagcttggatttagactggcacaaacaatgtctc

SEQ ID NO: 50953 - DNA, 201 bp, Homo sapiens
acctgcaaatgacagtcccatttcctcagcaaacctctgcatgttgtgggaacttatggcttctcagcctcccactcggaacccacctctggtttatgctycagaacatgatgttgttggaccctcccctccacctcctccaggctgagttagcctctgtctcccctcctgccctgggcatggctcttccagtagacaccc

SEQ ID NO: 50954 - DNA, 201 bp, Homo sapiens
tgacttccagacccaggaggtgccatagaggtgcatggaggtggaatggcacggtgcttataaacggcaaggtagggagccagcgctggacacagagccarctgaacagtgaaggcagaagagtagggggcgctgaccctcatcccaggggtcaggcagaaggggccgatgggatgggtcaggtgctgcagagatgttcag

SEQ ID NO: 50955 - DNA, 201 bp, Homo sapiens
aaaatggagatttaacatacactagcccttggcttaaaacctgtacatgcttctctgccacctgcaaatgacagtcccatttcctcagcaaacctctgcawgttgtgggaacttatggcttctcagcctcccactcggaacccacctctggtttatgctccagaacatgatgttgttggaccctcccctccacctcctcca

SEQ ID NO: 50956 - DNA, 201 bp, Homo sapiens
ggcgctgtgggaagcttctgatcagaatcagctctgagatggtcagaaatctcagaagcttccaggctaggattggaagaattgacttccagacccaggargtgccatagaggtgcatggaggtggaatggcacggtgcttataaacggcaaggtagggagccagcgctggacacagagccagctgaacagtgaaggcaga

SEQ ID NO: 50957 - DNA, 201 bp, Homo sapiens
ggatgtgggggtctcccctttgagtttctgctatgatgtgattccaattgatgggccaacacacctctgataccttgtgttatgctgtgtactgcctcaargtgaataatagcttgggatttagtttgtgtagtctaaggaaaatactttgtgttgaactagtcaggctgttttattgatggccattaaaaggccttgtgc

SEQ ID NO: 50958 - DNA, 201 bp, Homo sapiens
ctgggttctggttctgttgtccaggagccctagaaggtttgtaggggtgagatggaaaagtcagacttcaacctagaacctagtggtcaagaggcttggggtaggtccatccccatctgtggcatctggtgacggtgatcctgtctttctgtgtctcattgccacttttgcccttaaaatccacatgccttagttgaaacc

SEQ ID NO: 50959 - DNA, 201 bp, Homo sapiens
atggatgagtggtggagacagtaagtatataaattcttaagtgaagtttctggggcagaaaaggagggaaaatgaggccattagaagagtgtgggggccargtgcagtggctcatgcctgtaatcccagcactttgggaggctgaggtgggtggatcacgaggtcaggagatcgagaccatcctggctaacacggtgaaac

SEQ ID NO: 50960 - DNA, 201 bp, Homo sapiens
aaaattatagaagtgaaaacaatgtaacgattcttgtagagaaggcttagtcctctgaaactgtctgtggatcccaatctgagaaacagctgttcttgccygactgggaggcagtgctccagggagaaaggtctctggttctcagtcaactttttgacaagtccagtgcaatagtggccttggcatcgtagaccctggtgg

SEQ ID NO: 50961 - DNA, 201 bp, Homo sapiens
gcttagagggcacatggtggtcgcttcagcaatggatgagtggtggagacagtaagtatataaattcttaagtgaagtttctggggcagaaaaggagggaraatgaggccattagaagagtgtgggggccaggtgcagtggctcatgcctgtaatcccagcactttgggaggctgaggtgggtggatcacgaggtcaggag

SEQ ID NO: 50962 - DNA, 201 bp, Homo sapiens
tatgcttctcagactccccagataatgatcttatcacaaggctgtaaagcttttatatgtaatgtgaattgatgtatttaataatcaatgtgtttcttcgwagatattaaatcaagacacactggcagatttttatgtaaattgcttccacccttcttccttttaaagataaatgcaaggaacgtgaagaaaaaataattt

SEQ ID NO: 50963 - DNA, 201 bp, Homo sapiens
caattgcaagcttttggatgtgattgtcacataaagccgtggtgtgctgcagtgaatggacaaggcctccggaagtggggatgaccagcctaggccttggrtcaccctaggatctggctgactccctgggtctggacatcagcatctcagcactgcccgctgtctttcctggaagctgctatggagaggatgttagccagt

SEQ ID NO: 50964 - DNA, 201 bp, Homo sapiens
ctctgcagtctgttcagggtctttccaaattaccagctttttctgggtacttcagatacctgcatcactactttctttcttttctttctttttttttttttgagacagaatttcgctcttgttgaccaggctggagcgcaatggcacagatttcggctcactgcaacctccgcctcctgggttcaagtgattcttctgcct

SEQ ID NO: 50965 - DNA, 201 bp, Homo sapiens
gaaaggcatgtctctcctcctacattgtccccactttttagatgagtgaaaagggggtgaaggatgttaaataacttgccaggggtacagcacacaggcaktaagtgatgcagctggacttgaatatgcttctcagactccccagataatgatcttatcacaaggctgtaaagcttttatatgtaatgtgaattgatgtat

SEQ ID NO: 50966 - DNA, 201 bp, Homo sapiens
aaatttagtgtgtataaacttgtgccaacaatatatgtatttcatatgaatgtagaagggagttggggggctaggcttcaaacattgtaaatatgtttccrtcagtatgaacgtctgtgagacctctggaggtcatgcaggacaagtcttttctgagcagaactgcctgtgttgttccggatgtcaagcatcgatggcctc

SEQ ID NO: 50967 - DNA, 201 bp, Homo sapiens
tgattgcattcctgaaaaatttagtgtgtataaacttgtgccaacaatatatgtatttcatatgaatgtagaagggagttggggggctaggcttcaaacaytgtaaatatgtttccatcagtatgaacgtctgtgagacctctggaggtcatgcaggacaagtcttttctgagcagaactgcctgtgttgttccggatgtc

SEQ ID NO: 50968 - DNA, 201 bp, Homo sapiens
caggatgctacccatctgttgccgtgaatgggtgcttggtttgcattttcttcttcttgaggttgtgaggtgggctggtggcacaagacaaggatctgcamtgtcagcagcctttttctcctctggttgtctgctgtgggtccaggaaatgctgctggagcctcccggccatgcctagtgcagggagcatgtgggaagccc

SEQ ID NO: 50969 - DNA, 201 bp, Homo sapiens
ttgcttactggaagtggaatgggtcagtaattgatgaagatgacccagtgctaggggaagactattacaggtatgtatgctaagagttattcacattttgrtgttaaatcccacgtgatattttatataaccttgtcggttcagtttaaaagcaagtgttagttgctcctaacctttgctgcctttttttttttttttttt

SEQ ID NO: 50970 - DNA, 201 bp, Homo sapiens
aactgtcaaaaaggattaaaagttaaataaggataaggttatgtaaattgatcttatgtaaaaaaaaacactaagatatttgaagactaggcatcattatrtgttatatcatgatttttaaaatgatgctaccaagagtacttcagaggtccaaagctgaaatatatttgtatacttatatatataaagtaagggatactt

SEQ ID NO: 50971 - DNA, 201 bp, Homo sapiens
ccaacgtctcagtgctgttgcgtctgccttctgaagcgtgttaaatgtgcatttccctccgtgtccactgccttagcctggagccccttcatcaagccccrgggactgttgttccagctactaactggtctccctgcctctactttcccctgctccaaccctctcccagcttcctagacagggcatctttctgaagcacag

SEQ ID NO: 50972 - DNA, 201 bp, Homo sapiens
ttgttgagtttgttctcaattttgtgaaaactctttatccctttttgttccccaccccattttctaaccagaagtcaaatatgacaacattcatgatgtaraaaaaccaattcatcagtgtgacttgtgggtgagggtggggacagggccggtgttggtatatttagttttagagatttgctggaaaagtaacatttttgc

SEQ ID NO: 50973 - DNA, 201 bp, Homo sapiens
aaatacttttaataatgcttaacttacctattttattttattttagaaattcatcttactgcctcagaattaaaataagtgcaaaatttgtggagaatgarcctaacttatgttataatgcacaagccatatttaagcagaaactacccgttgcaggagacggaggacttgtgtgcccttatatggagttttttaaaaatg

SEQ ID NO: 50974 - DNA, 201 bp, Homo sapiens
tctccaagctgaactgaaaattacaaacccacatacccaagaagttcagtgaaccttaagaaacttgaggacaaacacatcatttcatcataattaaatttcttaaaatcagcgataaagaaaaaatcttagaagcctgagggaaaaaatacgcctaccaagaaacagcagtgacacagatggtagcagattcctcataga

SEQ ID NO: 50975 - DNA, 201 bp, Homo sapiens
aaaaatataacatttgctaaggtgaaaaaaatggagctcctttggcggtagattggggaaagttattggttattggttttcaatgcttctctctccctttrtctaggattgcaaacctctacttcttgacaatatacactttagtggagtcaaagataggctcatcgtgatgaatgtggctgaaaagcatagagggaacta

SEQ ID NO: 50976 - DNA, 201 bp, Homo sapiens
catgcggtctctggaaaagtccactgtacgtgtgtatgaaaaagacacataccatgtttgaattattatgaaagtagttttgaccttgaagactctgaaargatctcaggaacctttgagaactgataatataacgtatctttttcttggtaataatgtttttgaacattctcagtattccctctcagcttcctcctggtg

SEQ ID NO: 50977 - DNA, 201 bp, Homo sapiens
cctactaggcttcattcaagacaatgataatacggcagtgtataaaacagaccaaaacctaccctcatgaagcttacattctagagggggtagacagttawttaacaagaacaagaagtaatatatatagtaagtcagatggtgacacatgctaggaaaccccagtagggacttcaggtaagacagagatgtgtgtgtgtg

SEQ ID NO: 50978 - DNA, 201 bp, Homo sapiens
acttgaacctgggaggcgggggttgcagtgagctgagattgtgccattgcactctagcctgggtaacagagcaagactctgtctcaaaaaataaaaaaaaataagacctcctgagactcacccactatcacgagaacagcatgggggaaccaccgccataatccaatcacctcccatcaggttcctcccttgacacatgga

SEQ ID NO: 50979 - DNA, 201 bp, Homo sapiens
aatacgacaagtgaaaacctctgtccccttatggacatgagtcttcttggtaagacataggatgtcagcagtctctcttcaaaaggggggtctttgaaatscgcccctttgtacaagggtgtggatgcactggctacctagaggacaccactcagcagctccaatggagaggacgaggagatgatgggcacagatgtagct

SEQ ID NO: 50980 - DNA, 201 bp, Homo sapiens
tgtgggagctggcagggtggacacctgtattagtctgtttctgcactgctgtaaagaaatacccgagactgggcacagtggctcatacctgtggtctcagmattttgggaggctgaggtgggcagattgcccaaggtcaggagttcaagaccagcctgggcaacatggtgaaactccatctctactaaaaatagaaaaatt

SEQ ID NO: 50981 - DNA, 201 bp, Homo sapiens
tcttgacaatatacactttagtggagtcaaagataggctcatcgtgatgaatgtggctgaaaagcatagagggaactatacttgtcatgcatcctacacayacttgggcaagcaatatcctattacccgggtaatagaatttattactctaggtgagtcatagctccagccctaaaaggtttagatctgggaaggtccaga

SEQ ID NO: 50982 - DNA, 201 bp, Homo sapiens
gtcgccaagtctattggcctctggaacttgctgtgctatatctattaacatgggaaaaaccaggtgcaagaagcctctttcactcatttgccttcactgascaagattcaagctgcaattagcacaaacagttggctggtttgcctgtcacttatgtcttatcttcctcctcttattaaggaggttaagaaatggtttatt

SEQ ID NO: 50983 - DNA, 201 bp, Homo sapiens
aggagaatctcttgagccctagaggtggagtttgcagttagccgagatcacgccattgcactccagcctgggtgacagagtgagactgtgtcttaataaaataaaataaaataaaataaaataaaataaaataatgtaacatgaattcaatgtaaaaaaatttagaaatatgcctacagtgcctcatatgggtctttcttg

SEQ ID NO: 50984 - DNA, 201 bp, Homo sapiens
gaatttcgctcttgttgaccaggctggagcgcaatggcacagatttcggctcactgcaacctccgcctcctgggttcaagtgattcttctgcctcagcctyccgagtagctgggattacaggcatgtgccaccacgcccagctaattttgtatttttagtagagacgggttttctccatgttggtcaggctggtctcgagc

SEQ ID NO: 50985 - DNA, 201 bp, Homo sapiens
caggagaatctcttgagccctagaggtggagtttgcagttagccgagatcacgccattgcactccagcctgggtgacagagtgagactgtgtcttaataaaataaaataaaataaaataaaataaaataaaataatgtaacatgaattcaatgtaaaaaaatttagaaatatgcctacagtgcctcatatgggtctttctt

SEQ ID NO: 50986 - DNA, 201 bp, Homo sapiens
gagtcatagctccagccctaaaaggtttagatctgggaaggtccagagactgtgattctaatactactttcattatccatgaagaaaccaaatccaagacracctcaatgataccacaaaagtcacatggctttagttttgtttttttgttactaaatactatgtaatgtttttccattcctgcttcagatgtagttctaa

SEQ ID NO: 50987 - DNA, 201 bp, Homo sapiens
aaaattttaattcaatagccatttattaatctagatagatcagaaaaaatcaattaatgttaagattaaaaatacattctttgcaggatcccagatacaaytgatctgtaatgtcaccggccagttgagtgacattgcttactggaagtggaatgggtcagtaattgatgaagatgacccagtgctaggggaagactatta

SEQ ID NO: 50988 - DNA, 201 bp, Homo sapiens
gcatcactactttctttcttttctttctttttttttttttgagacagaatttcgctcttgttgaccaggctggagcgcaatggcacagatttcggctcacygcaacctccgcctcctgggttcaagtgattcttctgcctcagcctcccgagtagctgggattacaggcatgtgccaccacgcccagctaattttgtattt

SEQ ID NO: 50989 - DNA, 201 bp, Homo sapiens
gcaggagaatctcttgagccctagaggtggagtttgcagttagccgagatcacgccattgcactccagcctgggtgacagagtgagactgtgtcttaataaaataaaataaaataaaataaaataaaataaaataatgtaacatgaattcaatgtaaaaaaatttagaaatatgcctacagtgcctcatatgggtctttct

SEQ ID NO: 50990 - DNA, 201 bp, Homo sapiens
ggcaggagaatctcttgagccctagaggtggagtttgcagttagccgagatcacgccattgcactccagcctgggtgacagagtgagactgtgtcttaataaaataaaataaaataaaataaaataaaataaaataatgtaacatgaattcaatgtaaaaaaatttagaaatatgcctacagtgcctcatatgggtctttc

SEQ ID NO: 50991 - DNA, 201 bp, Homo sapiens
tcccacaaggcgcagtggctcacacctgtaatcctagcactttgggaggctgaagcaggaagatcacgaggtcaggagatcaagaccatcctggctaacayggtgaaaccccatcgctactaaaaatacaaaaaattagctggacatggtggcgggcacctgtagtcccagctactagggaggctgaggcaagagaatggc

SEQ ID NO: 50992 - DNA, 201 bp, Homo sapiens
aggcaggagaatctcttgagccctagaggtggagtttgcagttagccgagatcacgccattgcactccagcctgggtgacagagtgagactgtgtcttaataaaataaaataaaataaaataaaataaaataaaataatgtaacatgaattcaatgtaaaaaaatttagaaatatgcctacagtgcctcatatgggtcttt

SEQ ID NO: 50993 - DNA, 201 bp, Homo sapiens
aagaagtggggtatctaaaagggagaaagaaacacagaaagttgggccttgttaggcccttccagccccactgtggcactcactgctggggtatcagctgrcatggttaggtgaagtcctcctggtggtcttgggtgtaatatttcaaagcagcgctcacattaataaaaacaaggtctaattagttgtctgtgcttctaa

SEQ ID NO: 50994 - DNA, 201 bp, Homo sapiens
ctagagtccattgattgtttagcacatgctgcctttactctgtagagtgtcttgctaggaaaaccacaggagagaacacatgcttgcaactcccttcatcrtctttgcatcaagaataattcttgtctcaacaacaaacaaacaaacgaaaccaataacgaaaattcttcatcatatttgcatcaagagtaattctagctt

SEQ ID NO: 50995 - DNA, 201 bp, Homo sapiens
ggcttttagaaaagtaaaacaatacaggaagggattttgctgtcatttaaaacatggtctgctccagatggaggatttggtgatttttattttcttctttrctaaacatttctgcatttcatgaagtttttcagtgcatcatttttattatcagaaaaacaatgacattttattaaatatatatatatttaactcattaat

SEQ ID NO: 50996 - DNA, 201 bp, Homo sapiens
agtgggacctccgcgtgaccctggtccccacctcctctgagtgtccgaggagacacgcgcggggcagcaggctcccggcagctgcagtggggcatccccgygggaccagtcctcctgcagcagtgtggggtccagccacgcccggttccagaacctgcctccgtcctgagcttcacctgcagcagaaatacaccatgatct

SEQ ID NO: 50997 - DNA, 201 bp, Homo sapiens
acaaaatagtaggcaaaaagaccccatttcaaaaactgcacatgttcacagagaagataaggaatgagacgcataaggttactaatggtggttttctctgkgtggtgggtttagggtaattttcctttttctttgtgcatttctatatctaaaattttaattcaatagccatttattaatctagatagatcagaaaaaatc

SEQ ID NO: 50998 - DNA, 201 bp, Homo sapiens
gtgggcccaaattcccaatccacagtaattacaaaatagtaggcaaaaagaccccatttcaaaaactgcacatgttcacagagaagataaggaatgagacscataaggttactaatggtggttttctctgggtggtgggtttagggtaattttcctttttctttgtgcatttctatatctaaaattttaattcaatagcca

SEQ ID NO: 50999 - DNA, 201 bp, Homo sapiens
caaagttttaattctttttggttctaatattttttctcctttttttttctttttgctatagtcactaatttccagaagcacatgattggtatatgtgtcaygttgacagtcataattgtgtgttctgttttcatctataaaatcttcaagattgacattgtgctttggtacagggattcctgctatgattttctcccaata

SEQ ID NO: 51000 - DNA, 201 bp, Homo sapiens
tatttttgccttgtggttctaaatacattatgtttttcctttagcttcagatggaaagacctatgacgcatatatactgtatccaaagactgttggggaarggtctacctctgactgtgatatttttgtgtttaaagtcttgcctgaggtcttggaaaaacagtgtggatataagctgttcatttatggaagggatgacta

SEQ ID NO: 51001 - DNA, 201 bp, Homo sapiens
tttgggaccagcctggccaacatggtaaaaccctgtctctattaaatacaaaaattagctgggtgtggtggctggcacttgtaatcccagctactcgggargctgaggcaggagaatcacttgaacctgggaggcgggggttgcagtgagctgagattgtgccattgcactctagcctgggtaacagagcaagactctgtc

SEQ ID NO: 51002 - DNA, 201 bp, Homo sapiens
ttgtggaaggggaagcaagtgcatctgacatggtggcaggcgggagaagtgaagtgagagcacaggaaaaactgccacttttaaaaccatcagatctggcyggatgtggtggctcatgcctgtaatcccagcactttgagaggccgaggcaggtgaatcacttaaggtcaggagtttgggaccagcctggccaacatggta

SEQ ID NO: 51003 - DNA, 201 bp, Homo sapiens
gggaggctgaggcaggagaatctcttgagccctagaggtggagtttgcagttagccgagatcacgccattgcactccagcctgggtgacagagtgagactstgtcttaataaaataaaataaaataaaataaaataaaataaaataatgtaacatgaattcaatgtaaaaaaatttagaaatatgcctacagtgcctcata

SEQ ID NO: 51004 - DNA, 201 bp, Homo sapiens
actctttatccctttttgttccccaccccattttctaaccagaagtcaaatatgacaacattcatgatgtagaaaaaccaattcatcagtgtgacttgtgsgtgagggtggggacagggccggtgttggtatatttagttttagagatttgctggaaaagtaacatttttgcttttgtctttctttcgttcctccatttct

SEQ ID NO: 51005 - DNA, 201 bp, Homo sapiens
tcaagaaaagggcagccctggaagatatacgtttgtttcatacattcaaaaataggattcccagtacctaagatcaccctttgaatcaatacacatggggytggaccaccttaaggccatggactggtttccatgctatacttttaaataaggtcaaagaaaaaatgtgtccatctcacaggggcctggccttcctggaag

SEQ ID NO: 51006 - DNA, 201 bp, Homo sapiens
gtggccccttccaaacctccccctgagctatcaaagctttcatttactgcctcggtataattaattttcagtgcttatttggccagatcggacctacagcyctcagtggtctttaaagtgaaaaaagtgaaaagtctttagcatgaaacctttgatgtgcatgttgtgtgagcgtatgtgtttgagtgtgtgggtgttcat

SEQ ID NO: 51007 - DNA, 201 bp, Homo sapiens
atagttgttttttatctatctcacgtttattttagattactcaaaataagcatatctgagcttatatctgctgtgcagagcaacgaaaacatttatgggarggtaatggcggtaaacactgtaacttcatgctgacgttaggtggtaacttctcttcgataattcaagctacctagtgataatgtaagttctttattgcac

SEQ ID NO: 51008 - DNA, 201 bp, Homo sapiens
ggctctaagcccagaggtgcttccattgtgtgaagaaacacaggagaccgagacaaaatattgttgatcagacactcaggcctatttcggcggcaaaactstcctaagtggtcatttatggccagcacagagtggggattaacgtgtgtgtgtgtgtgtgtgtgtgtgtgtgagtgtgagtgtgtgtgttgtgggaggtgt

SEQ ID NO: 51009 - DNA, 201 bp, Homo sapiens
tggcttactctagggtttatgggtccagtcttcctccatgactcttgagatgtcaagcccagtttggggagttcaaaaataccattttctctctctcaacraagcctagcacattttttaaaaccacattttaacatttctgaaattaggatgcatcttgcaatggatagtaggtcctagttatttggcagcatttttttt

SEQ ID NO: 51010 - DNA, 201 bp, Homo sapiens
actccttcttccggagttgaccatcagagctgagctcttgccttccttctttctccttctgcagatcttccctctagctctacaggaagggcctccctggytgtgtggtcagaaggtctccactgtccaagtccagcctggcttactctagggtttatgggtccagtcttcctccatgactcttgagatgtcaagcccagt

SEQ ID NO: 51011 - DNA, 201 bp, Homo sapiens
tgtggagccacgtgtcactgagcactgccttctggaaagagactgccatttccaggctgctcctccaccagcccggtgactcagtttctactccttcttcyggagttgaccatcagagctgagctcttgccttccttctttctccttctgcagatcttccctctagctctacaggaagggcctccctggctgtgtggtcag

SEQ ID NO: 51012 - DNA, 201 bp, Homo sapiens
accttggaagagtaccaaagctgtgagttcctgggagttttccgtcaaaatcagtcctctggcatggtaaagaatatgtttgtaaaggaacaagaaaaaaatatataatttttctaaatatatatataggaaatgtatatatatatacacatataatatatatatagacaaaataaaaatatatatttgatctctggccct

SEQ ID NO: 51013 - DNA, 201 bp, Homo sapiens
tcaaatatgttcctacatgagatacaagctattcttgctaacagtacaaattctgtcctgtaagtattagtattttcaggttttttcttttctatgaaacrgttgaaaggaaaactttagtatgctataactcataggctactttgtgtatttatcattttataaacaaatgtcttgacaattaagttgtgtatgaaggcc

SEQ ID NO: 51014 - DNA, 201 bp, Homo sapiens
aaacaaatgtcttgacaattaagttgtgtatgaaggccatcatcaagtcattaactcttatatcaaaacctattattattcactgatttagataattcaayttatgtgtgcgttaccaggttgcagtcagccaacagacacagaacaggttaatagaaatatatatatttttcttatcaggttttcttttattggaacagg

SEQ ID NO: 51015 - DNA, 201 bp, Homo sapiens
acactcaggcctatttcggcggcaaaactctcctaagtggtcatttatggccagcacagagtggggattaacgtgtgtgtgtgtgtgtgtgtgtgtgtgtkagtgtgagtgtgtgtgttgtgggaggtgtttgggggaggtctcaggaattgctggccctgaggtgatactaatggatcaggtttccatggacacaggaac

SEQ ID NO: 51016 - DNA, 201 bp, Homo sapiens
tcccagctccctccccaacccctggcttggcctcgaggcattctcctttcctgcattcaaggcctccaggaatattaccacacaccatctgcacatcgtckggttcttttggccaatgccaatttgataaatttttttggcttcagtgtccagttctgctttctaaacttgtatttgcttcctttggaaaatgtattcctt

SEQ ID NO: 51017 - DNA, 201 bp, Homo sapiens
gaggaagaaggagtggaaggggaaatagaaagatgaagaaaattcagagcagcttacagtccatctgcgagatagaatcaaatgtcaacaatgagaaggaragcaggaaggggacagtgaagaggacccggccacctctaggttctggaccagaacacgggtaactctgccccaggggcctgcttggtgccagggagtcct

SEQ ID NO: 51018 - DNA, 201 bp, Homo sapiens
ctgggctgcaaaaatcaggaccaaactgacatttagtaatggtttgaacttggtactgaataataataataataataataataataataataataataaaagctaatatgtaatacagcacttgctaggtaggagacctggttttaggtaccgctcatataaaataatcagtactattattttattttgcagattaagaaa

SEQ ID NO: 51019 - DNA, 201 bp, Homo sapiens
ggtgagaaattattagcggtgaatgtacttgtaagttatccatcttttctccgaaagtgctgaacgtcttaaccatgagtctcttcttgtctgagggaggyggtgttgcttttggtgaccagagctgctcagtcatgtataccaataacatattccaacatgggtcacaaaaccaaagcattccaaagccatgattgtgcc

SEQ ID NO: 51020 - DNA, 201 bp, Homo sapiens
gctgggctgcaaaaatcaggaccaaactgacatttagtaatggtttgaacttggtactgaataataataataataataataataataataataataataaaagctaatatgtaatacagcacttgctaggtaggagacctggttttaggtaccgctcatataaaataatcagtactattattttattttgcagattaagaa

SEQ ID NO: 51021 - DNA, 201 bp, Homo sapiens
attctagaaccggccaggatcagcagccatccatctcctccccatgatgtctgggagcttttcacattgcctctgttccttacacaggctttatgattttygatttgtctctaaggaaactgaggcttaaaaatagcaggtgagtttcttcaagtcgcggcagatcgataacagagtcagaatttgaacatgggtctgttg

SEQ ID NO: 51022 - DNA, 201 bp, Homo sapiens
agtgctgggctgcaaaaatcaggaccaaactgacatttagtaatggtttgaacttggtactgaataataataataataataataataataataataataataaaagctaatatgtaatacagcacttgctaggtaggagacctggttttaggtaccgctcatataaaataatcagtactattattttattttgcagattaa

SEQ ID NO: 51023 - DNA, 201 bp, Homo sapiens
tacatttttgctattgtgataatgtgggaaattacactcggtatcactcactgtgcttgaatctttatcatcaacctcaaactctgggatttatgtaaccrcaagatcagaactctaagcttctttttttctccagttgaaatttattttaagttggtaaggaaatatgacatatatctatagaacctaggctcataggaa

SEQ ID NO: 51024 - DNA, 201 bp, Homo sapiens
tgggaatgcatgcagcctggctttttaaagtcctcaggtgatcatactgtgcagttagtgtaatgtgggttgagaaccactgacccgagaagtagacagtygccgagtcagtaaattacccaagtaaacaagaagctggttagaccaagcctgtccatagtgattgccaaatcctgcctggtggggaaatttaggaccatt

SEQ ID NO: 51025 - DNA, 201 bp, Homo sapiens
aagaagacttgagctggaggagaaagaagggttgtattctgggtagaggaaactgcacgagcaagaaaagaggtagacattagggaaacttgcaaggaaaygggcacatagtaaacatgggtacatcaagggcgaggagaggaacacattccaaaaggtaggatcaagggagactgaggagcatctggaatgctatactga

SEQ ID NO: 51026 - DNA, 201 bp, Homo sapiens
aatctgagacacatgactaagtaagaaaataaaatattgacgtcttggttttaaatattgggcaacaccatctcatgtttatcctttttctcatcaaaccrcatgtccaattttggattaggaagacattcttactgtacttatggtacgcctgcaatcatggtgcctcctctgtctatttttgggttgaccaaataacaa

SEQ ID NO: 51027 - DNA, 201 bp, Homo sapiens
ggaaacgggcacatagtaaacatgggtacatcaagggcgaggagaggaacacattccaaaaggtaggatcaagggagactgaggagcatctggaatgctakactgagtggtctgggctttgtttgggaggcagtggagccttgcatggcaggttttgacatccaaccttgcagcaaacggcaaataggagcttgctcagca

SEQ ID NO: 51028 - DNA, 201 bp, Homo sapiens; identical to SEQ ID NO: 14695

SEQ ID NO: 51029 - DNA, 201 bp, Homo sapiens
ggccagtagttgtcaaccctggctgcatattggaatcacctgggagccttttaaacactgatgcctggatcctaactccagaagttctgatgtgatgggamtgcatgcagcctggctttttaaagtcctcaggtgatcatactgtgcagttagtgtaatgtgggttgagaaccactgacccgagaagtagacagtcgccga

SEQ ID NO: 51030 - DNA, 201 bp, Homo sapiens
tagcaggtgagtttcttcaagtcgcggcagatcgataacagagtcagaatttgaacatgggtctgttggattctctcagctctgtacacatcattatgccraaatagtaaggaacatgaggaagggaaacactagtttatggaagagctctttctcacatgtccttcaggcagtcatatttgggcactggtttttgagtcc

SEQ ID NO: 51031 - DNA, 201 bp, Homo sapiens
tatggccagcacagagtggggattaacgtgtgtgtgtgtgtgtgtgtgtgtgtgtgagtgtgagtgtgtgtgttgtgggaggtgtttgggggaggtctcargaattgctggccctgaggtgatactaatggatcaggtttccatggacacaggaacatctgggcaggaagtaggaagactgcaaagtcagctcaccccctt

SEQ ID NO: 51032 - DNA, 201 bp, Homo sapiens
ttagggtcttggtggctctaagcccagaggtgcttccattgtgtgaagaaacacaggagaccgagacaaaatattgttgatcagacactcaggcctatttyggcggcaaaactctcctaagtggtcatttatggccagcacagagtggggattaacgtgtgtgtgtgtgtgtgtgtgtgtgtgtgagtgtgagtgtgtgtg

SEQ ID NO: 51033 - DNA, 201 bp, Homo sapiens
ggagacagaggcagaggccagagcatggtgggtgtttagggctgtggcaaggagtttggcttttattgtgagtttcaggttgactgtagtcatgggctggrgaagatggtgccaaggtctgtaaactcttaccttgtagatgtaaattctcacctgaataacaccagggaggcatggttctatacacaagcacctgtcaga

SEQ ID NO: 51034 - DNA, 201 bp, Homo sapiens
gaggtgttgaacctggaaaactcagccacaacaacccctcaacttggggatcaggcagggctcagcctcagcttctctgaacccacatgggccaatgtgaratggatttgatttttcagaccagatcctccctggcaggaccatccaatttatcacaccaacctagactcgatgggcgtttaaaatattgagagatatttc

SEQ ID NO: 51035 - DNA, 201 bp, Homo sapiens
ctggcctggacaactgagtgctgatgtacttggttcttccatccaaaggtgccaagagtccagttctactgcatttggaggtgttgaacctggaaaactcrgccacaacaacccctcaacttggggatcaggcagggctcagcctcagcttctctgaacccacatgggccaatgtgaaatggatttgatttttcagaccag

SEQ ID NO: 51036 - DNA, 201 bp, Homo sapiens
tcccagctcagtgctgggctgcaaaaatcaggaccaaactgacatttagtaatggtttgaacttggtactgaataataataataataataataataataataataataataaaagctaatatgtaatacagcacttgctaggtaggagacctggttttaggtaccgctcatataaaataatcagtactattattttatttt

SEQ ID NO: 51037 - DNA, 201 bp, Homo sapiens
agccatgaaaaaggatgagttcatgtcctttgtagggacatggatgaagctggaaaccatcatcctgagcaaactatcacaaggacagaaaaccaaacgcygcatattctcactcgtaggtgggaattgaacaatgagaacacttggacacagggtggggaacatcacacaccggggcctgttgtggggtgggaggagggg

SEQ ID NO: 51038 - DNA, 201 bp, Homo sapiens
caaaccccgttgagcacaagactgttagtttacttaggaggaaaacttggcaggaacggtcaaagaatagcgagggtatacttctaaaatacgtccttggmacatttacacaaacagcacaagctcattgtcaagaataaaattttaaaaaatacatagagataatagtaaaagacgagaagtaaaaacacaccactgtga

SEQ ID NO: 51039 - DNA, 201 bp, Homo sapiens
gggttttcactgtgttagccaggatggtctcgatcttctgacctcgtgatccacctgcctgggcctcccaaagtgctgggattacaggcatgagccaccaygcctggcctgaatgtgctatgttattaatggcagcctctattggtttcatttaaaggtataatgcattgtattggcaaaacttgtacacgctttcttcaa

SEQ ID NO: 51040 - DNA, 201 bp, Homo sapiens
tagacaaaataaaaatatatatttgatctctggccctgattcccagcacagagctcctaacttcttggaatttcctgggtgatgggagtcttttgttctartgaagctcctgggaggagaatggtcactagaaagaacagattagaagcttgggaatttcagtcctacccccatcctctgggaagacctggaggctggaga

SEQ ID NO: 51041 - DNA, 201 bp, Homo sapiens
agtagctgggactataggcgcctgccaccatgccctgctaactttttgtatttttagtagagatgggttttcactgtgttagccaggatggtctcgatctyctgacctcgtgatccacctgcctgggcctcccaaagtgctgggattacaggcatgagccaccatgcctggcctgaatgtgctatgttattaatggcagcc

SEQ ID NO: 51042 - DNA, 201 bp, Homo sapiens
aacatgtggagggtagcccacccggagagggcaaggaagcgcacttcccctcccatacacctcgccctgcatatctcttcatctggctgtcttctgtatcmtttattgtattctttattacatagtaagctgggaaatgtgtttccctgaggtctgtgagccatcccagcaaattatgaaatccaaggatggggtcgtagg

SEQ ID NO: 51043 - DNA, 201 bp, Homo sapiens
taccaggttgcagtcagccaacagacacagaacaggttaatagaaatatatatatttttcttatcaggttttcttttattggaacaggttgcatatatatwcacacatatacacatatatgtgcatatatgtatgtatatttccattgatataatattctagaaaatgcagactaatcactagtaacagaaaagcagatca

SEQ ID NO: 51044 - DNA, 201 bp, Homo sapiens
atgggagggtaatggcggtaaacactgtaacttcatgctgacgttaggtggtaacttctcttcgataattcaagctacctagtgataatgtaagttctttwttgcacttcaaaagtatttctctgtccatggagggcatttcttctcaaaacactttgtacttccttatgaagttggaatatttgctatggaaaccaaatt

SEQ ID NO: 51045 - DNA, 201 bp, Homo sapiens
accttcttccatgattgcaagcttcctgaggctgctccagctatgtggaactgtgggtcaattaaacctctttccttcgtaaattactcagttctttctttatagcagtgtgaaaatggactaatatacccatgttgtcatttcagcaaatgttcacagcatcttcaccaagagtggattccatgtcaagaaatcactttc

SEQ ID NO: 51046 - DNA, 201 bp, Homo sapiens
attcttcttgcaaaattcttaggtttggcaaccctggaaatagtagatttgatctttagctgtctccctcactcttatctttcctctttccttgacagctrttctttccttttcactcttggtggcacaagcttgggaggttttccatccaggctggtgcctcttaacttctctctctgcctctagggcctgacagctgcc

SEQ ID NO: 51047 - DNA, 201 bp, Homo sapiens
caccttcttccatgattgcaagcttcctgaggctgctccagctatgtggaactgtgggtcaattaaacctctttccttcgtaaattactcagttctttctttatagcagtgtgaaaatggactaatatacccatgttgtcatttcagcaaatgttcacagcatcttcaccaagagtggattccatgtcaagaaatcacttt

SEQ ID NO: 51048 - DNA, 201 bp, Homo sapiens
tcttcactgatgaacttcagaaactgtgtcagtagatttctgatgccagccaggattgagtaataggccctagatttactttctcataagaaacaactaarttactctacaaaatatgcaaaaccagggtttttaagaattggacatcagctaaggaaggatagtgatccctgagaggcagaaaacaaagccctgtgactt

SEQ ID NO: 51049 - DNA, 201 bp, Homo sapiens
tcaccttcttccatgattgcaagcttcctgaggctgctccagctatgtggaactgtgggtcaattaaacctctttccttcgtaaattactcagttctttctttatagcagtgtgaaaatggactaatatacccatgttgtcatttcagcaaatgttcacagcatcttcaccaagagtggattccatgtcaagaaatcactt

SEQ ID NO: 51050 - DNA, 201 bp, Homo sapiens
gggcagatgagcttctgctgctcattccttcatcttttcctccagcctggatttgtccgggggcagctgaggctcaggttacctcaattcttgagtttctraagaggcatatccaggggtgggttacgagaacaagagcctgcccagtctgaaagggatgcaggaaggggcggtgtgtactagaaggaaggaagctatcat

SEQ ID NO: 51051 - DNA, 201 bp, Homo sapiens
ttcaccttcttccatgattgcaagcttcctgaggctgctccagctatgtggaactgtgggtcaattaaacctctttccttcgtaaattactcagttctttctttatagcagtgtgaaaatggactaatatacccatgttgtcatttcagcaaatgttcacagcatcttcaccaagagtggattccatgtcaagaaatcact

SEQ ID NO: 51052 - DNA, 201 bp, Homo sapiens
gagaaaggtctctggttctcagtcaactttttgacaagtccagtgcaatagtggccttggcatcgtagaccctggtggctggagaggagatgtgttggagktataggggaggctgggaagcacaaggcagggcatttagaaaggggacaaaggacaagagatgaggcccatccctgtctctgggttctggttctgttgtcc

SEQ ID NO: 51053 - DNA, 201 bp, Homo sapiens
tgtgttgctatcaggtggaaatgtagaaagtgcagtgaggattttcttgtaaatctcagatttggggcttggctatgtcaggtccctggaagaaggaggartcatttactgccgtctgttctctcctcttgggcctctgtagagatttggccctatgccttggcgggctctgctctgcagcttggccagacacatccctca

SEQ ID NO: 51054 - DNA, 201 bp, Homo sapiens
ggtggaaatgtagaaagtgcagtgaggattttcttgtaaatctcagatttggggcttggctatgtcaggtccctggaagaaggaggagtcatttactgccrtctgttctctcctcttgggcctctgtagagatttggccctatgccttggcgggctctgctctgcagcttggccagacacatccctcagcatggcaagaag

SEQ ID NO: 51055 - DNA, 201 bp, Homo sapiens
tcccatggactcaactgcctggttcatagactggccagggctgtacagagggggatagacacaggtggacttcgacacctacctgtgtgcatgctcagggycccttccaatatggaagggagctggggagaggctagagacagaggaatggagattaatgtagctagacacagcaggagccatgcggtgggactgctccgt

SEQ ID NO: 51056 - DNA, 201 bp, Homo sapiens
attaaaaacatgggaaactcctttaattttaagtaagacaagaaaaaggcattaggagccatacggttgtgaaaagccttgtgtggctttggttcaggagrgaatgatgataaatagaattttacttactatattgtgcttcctgtttttcagacattgttgaggtcattaatgaaaacgtaaagaaaagcagaagactga

SEQ ID NO: 51057 - DNA, 201 bp, Homo sapiens
aactcttcttggaggatggcccatgaagacctccaaacaagctggaggggccagtcacttgctgaagactagcgaagtggagggggaaagcccgagggagytgcagactcgaccactgcgccctcccctcctctccctgcaaggagcccaaggtgtgatcctgccaggcgttcgttcgctgcatgaccttggccatccttc

SEQ ID NO: 51058 - DNA, 201 bp, Homo sapiens
agacctccaaacaagctggaggggccagtcacttgctgaagactagcgaagtggagggggaaagcccgagggagctgcagactcgaccactgcgccctccyctcctctccctgcaaggagcccaaggtgtgatcctgccaggcgttcgttcgctgcatgaccttggccatccttccattcccctgggtgtgaattctcatt

SEQ ID NO: 51059 - DNA, 201 bp, Homo sapiens
caggcgttcgttcgctgcatgaccttggccatccttccattcccctgggtgtgaattctcattggcaaagtgagctggtgggcataagtgggttttaagtytaaaaatttaaaaaccctgtctgcccccaagtgtggtatcaagattttatagtatgacacttaaattgcttttttcatccgggcgcgtaacagcaacaat

SEQ ID NO: 51060 - DNA, 201 bp, Homo sapiens
catcagcctgcaccaagtctgtctgccttctgagtccatgtgccacactggcctggacaactgagtgctgatgtacttggttcttccatccaaaggtgccragagtccagttctactgcatttggaggtgttgaacctggaaaactcagccacaacaacccctcaacttggggatcaggcagggctcagcctcagcttctc

SEQ ID NO: 51061 - DNA, 201 bp, Homo sapiens
gggtttctaaaatgaaaagtggcatatacaagaatactagttattcttacacagaattatagttttagaactcattaggctgaatatcattgttttctaarttcctgcctcaacattcatattggtagaataaacaggtatttagagcatctgtttataaattcagttatgcacaagccattggtaggccttgctctgtga

SEQ ID NO: 51062 - DNA, 201 bp, Homo sapiens
agccgcgcccggcagttcccggccgcgagggcgggcgcagcttgtggccggcggccggagccgactcggagcgcgcggcgccggccgggaggagccggagmgcggccgggccgggcggtgggggcgccggcctgccccgcgcgccccagggagcggcaggaatgtgacaatcgcgcgcccgcgcaccgaagcactcctcgc

SEQ ID NO: 51063 - DNA, 201 bp, Homo sapiens
ataggtgcaagtgtcatggatttggcatgaatatcaaaaactttaaggaggcatcgattttcactctgactcccagctcagtgctgggctgcaaaaatcargaccaaactgacatttagtaatggtttgaacttggtactgaataataataataataataataataataataataataataaaagctaatatgtaatacag

SEQ ID NO: 51064 - DNA, 201 bp, Homo sapiens
agattaactatgaaacatatgggaaatatactttataactgtatattacttataaaccatgaatagttacatgacttttggtatgtggtgagagatgttawgtgaaaggtgttgtaaatgaagtcgttttataagactgttgttactgtaagaattgagacttattttatcacttcccattaagcttctacagtgttagag

SEQ ID NO: 51065 - DNA, 201 bp, Homo sapiens
tgtttctgtatttttttccctcctttttttgggtttactttcacattaatgaggtatttaggaaagacaaatggaatctgataaaaggtaacgttatattktttgtcgaaacaacattttaaggatttcttgaagttatatggctctgtaggcatgtttcactttaagatgtgtttctgagtcatattaggagaacgactg

SEQ ID NO: 51066 - DNA, 201 bp, Homo sapiens
caaatgccccaaggatgaagaacggagacggtaagatgattaattgcactgcaggttttttgtttctgtatttttttccctcctttttttgggtttacttwcacattaatgaggtatttaggaaagacaaatggaatctgataaaaggtaacgttatattgtttgtcgaaacaacattttaaggatttcttgaagttatat

SEQ ID NO: 51067 - DNA, 201 bp, Homo sapiens
taataaccaacatcagctcagcaggcttcatttgggaaaagaaaccttgtcggattaccccgacattctccacctcctgggaggccagccattcccaaatkccccaaggatgaagaacggagacggtaagatgattaattgcactgcaggttttttgtttctgtatttttttccctcctttttttgggtttactttcacat

SEQ ID NO: 51068 - DNA, 201 bp, Homo sapiens
tgtgtcacggccgagggattaaagccctaagaggctgtgacacagccatctccaaaaccccactttctccttcctttgagcctccgtaccagctggggcgyccggcaagatgtgagttgtcactctgctgcggcacagacctgaattaacaactctagctagggctgacttcaaaaagcactttcgttttttaataaccaa

SEQ ID NO: 51069 - DNA, 201 bp, Homo sapiens
agacgtgccttgcttcctcttcaccttcttccatgattgcaagcttcctgaggctgctccagctatgtggaactgtgggtcaattaaacctctttccttcrtaaattactcagttctttctttatagcagtgtgaaaatggactaatatacccatgttgtcatttcagcaaatgttcacagcatcttcaccaagagtggat

SEQ ID NO: 51070 - DNA, 201 bp, Homo sapiens
aattgcttgaacctgggaggcagaggttgcagtgagccgagatcacgccactgcactccagcttaagcgactgagcaagactccgcctcaaaaaaaaaaaagtggaaatagcaatatgtgctttagctaaatattaattttgtttttgccctgccttttagctctgtggtcttgaccaaggcctcatagcgactctgaatc

SEQ ID NO: 51071 - DNA, 201 bp, Homo sapiens
tttctattgcttcgtattcttttttttttttttgagatggaatctcactctgtcgcctaggctggaatgcagtggtgtgatctcggctcactgcaagctcygcctcccaggttcacaccattctcctgcctcagcctcccaagtagctgggactacaggcgcctgccaccatgcctggttaatattttgtatttttagtag

SEQ ID NO: 51072 - DNA, 201 bp, Homo sapiens
tttttttttccaagttgtcttttctatgcaaaagttttcgcttttttgtaggtgaaactatgagaaattttcctttaccatttccgagtttaatgtcatgmtaagtccttcctgtcttgggaagatgtgttcacagcccactgactgaaggcccttcccggccagttctgagcttgagctgagtcaaatgtaaacagctcc

SEQ ID NO: 51073 - DNA, 201 bp, Homo sapiens
tggcaaaactcaagctctgttttcacggagatgatgcactgagccatggcatccctaggtggtttgattcatttctgcaccccggtgtctagcaaagtgcyacgtgcatgtgtttaatcaaaatagcttgtggttgtcaagctctttgtattcttccctccctccctgtgatttgatttcctgaaagtatcctttccccaa

SEQ ID NO: 51074 - DNA, 201 bp, Homo sapiens
ttccaacagctaacatttaggagtgaccatttgccaggcactgttctaagccctttgcatgtggccattcatttcacccacatagcgccatcaatgacatrctgtcactgcattgcttgtcaaaagggggaactgaggcacggaggctgagcttttactcaacatgccatctatgttgagggacttctgacttggatagcc

SEQ ID NO: 51075 - DNA, 201 bp, Homo sapiens
ctgtcactgcattgcttgtcaaaagggggaactgaggcacggaggctgagcttttactcaacatgccatctatgttgagggacttctgacttggatagccrttcaactgcgagcactatggaggccagtcaggcctggccctgccttggaatttctgtgttattcagggacataatggggtttgtgttgatttttgttggg

SEQ ID NO: 51076 - DNA, 201 bp, Homo sapiens
aataaattggccttcacttcatagtacaagtctcatagacttgaaaacttaatgtcataggaatatagttaactgtttccaaaaagccagtattaaaactwactatatgtaaggaacttttccagtcactttctaaaaatataacatttgctaaggtgaaaaaaatggagctcctttggcggtagattggggaaagttatt

SEQ ID NO: 51077 - DNA, 201 bp, Homo sapiens
aaaagtatttttccaagttagtgaacattttttattcaagagtaaagaaagaaccccacaagcatctagctctgcactgtttagtgcagtagttactaggygcatggagttatggacatgtacaattaaattaagtcaattgattcatttagttaaattaaaaattagttcctctgtcacattagccatatttcaagggct

SEQ ID NO: 51078 - DNA, 201 bp, Homo sapiens
ccacaagcatctagctctgcactgtttagtgcagtagttactaggcgcatggagttatggacatgtacaattaaattaagtcaattgattcatttagttamattaaaaattagttcctctgtcacattagccatatttcaagggcttaatagccacatgtgacaagtgactactgtacagacaagcacaaatatagaacat

SEQ ID NO: 51079 - DNA, 201 bp, Homo sapiens
tatttgctgatatactgtggccctttggagtaccacaaaccatgtaatatctaaggttttcttgcctcttccccaagaaccagtttttgccctgctggccwcagcccctgttgaaaatgcctgccctagaagtgtgtaattgagagctctgatgcctaggctgcattgatctctcaatctacaaaaaaaagcttcaaatta

SEQ ID NO: 51080 - DNA, 201 bp, Homo sapiens
agaattttacttactatattgtgcttcctgtttttcagacattgttgaggtcattaatgaaaacgtaaagaaaagcagaagactgattatcattttagtcmgagaaacatcaggcttcagctggctgggtggttcatctgaagagcaaatagccatgtataatgctcttgttcaggatggaattaaagttgtcctgcttga

SEQ ID NO: 51081 - DNA, 201 bp, Homo sapiens
attttaagtaagacaagaaaaaggcattaggagccatacggttgtgaaaagccttgtgtggctttggttcaggagagaatgatgataaatagaattttacktactatattgtgcttcctgtttttcagacattgttgaggtcattaatgaaaacgtaaagaaaagcagaagactgattatcattttagtcagagaaacatc

SEQ ID NO: 51082 - DNA, 201 bp, Homo sapiens; identical to SEQ ID NO: 14707

SEQ ID NO: 51083 - DNA, 201 bp, Homo sapiens; identical to SEQ ID NO: 14708

SEQ ID NO: 51084 - DNA, 201 bp, Homo sapiens
atgtagcacaacttagttttcacactgtgtcctattcagcgtgtaaatatactgtaattgacgcattcattttccactcaatgaatttggggacttttacrggattttttgctattatgaaaaatgtttctctgagtgttcctctactcgcctcatagggtgtgtactcatgatattctttagacaaagtttaagctgaac

SEQ ID NO: 51085 - DNA, 201 bp, Homo sapiens
tacaagctattcttgctaacagtacaaattctgtcctgtaagtattagtattttcaggttttttcttttctatgaaacggttgaaaggaaaactttagtaygctataactcataggctactttgtgtatttatcattttataaacaaatgtcttgacaattaagttgtgtatgaaggccatcatcaagtcattaactctta

SEQ ID NO: 51086 - DNA, 201 bp, Homo sapiens
ggttcaaactttccataatagccatcctaagaggtatatagtggtaccgcattctggattaatttgcatttccccaaggactagtgatattgagcattttwtcgtgtgcttatttgccatccatatatatcttccttggtgaaggatctgtttatatttcttgcccatttttcaattggcttatttattttcttgtattgc

SEQ ID NO: 51087 - DNA, 201 bp, Homo sapiens
atgagaggacaatagaggcttcggctaatgttattaatgatcagggagtttcttcttttctgttcagtagatgcaatgaggtattggtaaactcagtccarccagaattttccattttagtaaaacacattagaacttggtttacttgtgtttctcaattgagacttttctgggcttttcatagagagccttgtgagtctc

SEQ ID NO: 51088 - DNA, 201 bp, Homo sapiens; identical to SEQ ID NO: 14697

SEQ ID NO: 51089 - DNA, 201 bp, Homo sapiens
aacttacctattttattttattttagaaattcatcttactgcctcagaattaaaataagtgcaaaatttgtggagaatgagcctaacttatgttataatgsacaagccatatttaagcagaaactacccgttgcaggagacggaggacttgtgtgcccttatatggagttttttaaaaatgaaaataatgagttacctaaa

SEQ ID NO: 51090 - DNA, 201 bp, Homo sapiens
tatatttttcagttctagattgtctattagattcctttttatagatttcaatccattgttggtattttttatccttttacctgtttagttcatgtttttcygcatcttcttgagggtattaatcacagttatttacagtcttagtttgctaactataatttcttgattacatgtgagctgcttccatattctgcttttttc

SEQ ID NO: 51091 - DNA, 201 bp, Homo sapiens; identical to SEQ ID NO: 14698

SEQ ID NO: 51092 - DNA, 201 bp, Homo sapiens
tcattgccacttttgcccttaaaatccacatgccttagttgaaaccaccaatcttgtggcttttcgccttgtattagctgaataattgagatttcatagcracacttgaaacctcttgggaaatttttactttatcttcatatccttgtgcatcctcaatgataaaaataaaactttccttctcccatttacatgggtaaa

SEQ ID NO: 51093 - DNA, 201 bp, Homo sapiens
tatgtaataacaaataagtcaatcagatcaaatattattttcccaccaacttggaatttgctaagccccatgaaaatgtggttcaccagttttgaaaaacrtttggccactatctcttcaactgttgcttctgatttgctctttctgtcttcttctaagattaattatacatatgttagacttcttgagtatatcatgcat

SEQ ID NO: 51094 - DNA, 201 bp, Homo sapiens; identical to SEQ ID NO: 14699

SEQ ID NO: 51095 - DNA, 201 bp, Homo sapiens
gcatgagccactgcgcccagcctatcctttttttttcaattttttttttttttttgtaatttggccttctagtcctttgtcccctcctcatcaccaccacsacctaccatggggagttttgggtgcaggaacctaaatccccacaaaggttctatgttgggggtatgtaataacaaataagtcaatcagatcaaatattat

SEQ ID NO: 51096 - DNA, 201 bp, Homo sapiens; identical to SEQ ID NO: 14700

SEQ ID NO: 51097 - DNA, 201 bp, Homo sapiens; identical to SEQ ID NO: 14701

SEQ ID NO: 51098 - DNA, 201 bp, Homo sapiens
atcttcatcagagcccttggatgaccagttcccttgccaatgaacagtgatatttttacaggaatctttttttttttcccctgagaactagctctcaacartgggcttaaaatattcagtaaaccatgctgtaaacagatgtgctgtcattcaggctttgttgttaagtttatagcgcataggtagagtagatgtagccta

SEQ ID NO: 51099 - DNA, 201 bp, Homo sapiens
tactgtggaatgctctatcctgtggtcttcggtattatttcccatgttattgtatattatgctatttaggtagaaacttcatagaatgcaccttagttttmtcattgctttgtacattagtatccattacaaagtgataataatgaatgagttaatattgtctgaatgcaggccattcccagatatgggctctctgagacg

SEQ ID NO: 51100 - DNA, 201 bp, Homo sapiens
cgagtgctcaattttatagtttctcatagtttcttcatggccacagataaacccctgaaaccaatcttttcataaataagtcagattaatttctggggctycttgatacttttttgcctattttaataaattacagcattattccataaccctgtagttctcactattgggtcattaacacagtcattaaatgcaagcagg

SEQ ID NO: 51101 - DNA, 201 bp, Homo sapiens
ttgggaagattagagatatggggtacacgaaacttgtgtacctggtgcaaagaaatgcttggtgcaaaacagctatgcaattaataggtgtaggatgattkttcttgttaattttcttgtgtctttcaattctgcgttaaccatgtttcatattgaaaactatatcacagcaaaatgaaacaaaatgcacaaattgccagg

SEQ ID NO: 51102 - DNA, 201 bp, Homo sapiens
taggccttgctctgtgatgaataggacagacagagatcataccttaatgaaagaaatgaaatgactagatcttcatgcatcagggaggttctctctctctcctttgtttaaactttgcgaaaaaaaaaaaaggaataccacaatatctaaaaaaaaatgaatggatagaattcagggctgagacctctggggaagaagatg

SEQ ID NO: 51103 - DNA, 201 bp, Homo sapiens
gtaggccttgctctgtgatgaataggacagacagagatcataccttaatgaaagaaatgaaatgactagatcttcatgcatcagggaggttctctctctctcctttgtttaaactttgcgaaaaaaaaaaaaggaataccacaatatctaaaaaaaaatgaatggatagaattcagggctgagacctctggggaagaagat

SEQ ID NO: 51104 - DNA, 201 bp, Homo sapiens; identical to SEQ ID NO: 14705

SEQ ID NO: 51105 - DNA, 201 bp, Homo sapiens
agggggtgaaggatgttaaataacttgccaggggtacagcacacaggcagtaagtgatgcagctggacttgaatatgcttctcagactccccagataatgrtcttatcacaaggctgtaaagcttttatatgtaatgtgaattgatgtatttaataatcaatgtgtttcttcgtagatattaaatcaagacacactggcag

SEQ ID NO: 51106 - DNA, 201 bp, Homo sapiens
cctcatgacactcatgaagatataccatggctgtctttattttctaggtgggaatctcaggcttgagggttggggtggcttggggaaggtgtgtatctaasaggtagctcttatttatttttacttctagagattaagacacattctttttcaagatagacatggaactgtcaaaaaggattaaaagttaaataaggataa

SEQ ID NO: 51107 - DNA, 201 bp, Homo sapiens
catttctccagaagaatatgaaagtgttactcagacttatttgtttcatagctctactgatttcttctctggaggctggtaagttaagtatttctttgtgytcttgtctgctaagaaaatctgttatttagaatacatgaagtaccttccctaacagagtcatttctcatactcgtctctgttgaatctctgggcacagag

SEQ ID NO: 51108 - DNA, 201 bp, Homo sapiens
agtgtgacttgtgggtgagggtggggacagggccggtgttggtatatttagttttagagatttgctggaaaagtaacatttttgcttttgtctttctttcrttcctccatttctccagaagaatatgaaagtgttactcagacttatttgtttcatagctctactgatttcttctctggaggctggtaagttaagtatttc

SEQ ID NO: 51109 - DNA, 201 bp, Homo sapiens
tggccagtgatgaagcctggctgggtctggtgggccagcaggtcccgctaaggaggctcatggtgcatacagtttgtccttgttaagtggcgatggggatgggggggttcattgtttttccttaagattattaggtggctttacagaattgaagtctgtgtccgaaggctccccattccaaccccgaaatagagacagagg

SEQ ID NO: 51110 - DNA, 201 bp, Homo sapiens
ggggctcatgctggcgttcatatcgattccccagtgagccaaccccactgagaagccctgttctgtaaactcttcttcaaccttccctcacctctgcttcycttcttcagccccacagtgaagaacatctgagctcaaatccagataagtgacataagtgacctgctttgtaaagccatagagatggcctgtccttggaaa

SEQ ID NO: 51111 - DNA, 201 bp, Homo sapiens
agtttctgcttgggcagaaggagcaacttgcagcctctctaagtccctttcaacgttcctcagctccgcgcttacagagggtggatctcagaaccaggagracaaacagctgctcattgagtcctgagagtgcctgagtgggggcgtccaaggaggccgtggtgtgggcggagcagctggtacagtttgcgcatgggcagt

SEQ ID NO: 51112 - DNA, 201 bp, Homo sapiens
ggtgctgcaagatgtgttgttttcctccaatgcttgaattcttggctccaagagaacattttatttagcctagcctcctaggccatctttttgttggggartcatttgttgcaggataatatcaaaagcacttggacagagaaatcgattagaactgccagtgaaaccaactctggctgtgtagtatgtgctggtgtggga

SEQ ID NO: 51113 - DNA, 201 bp, Homo sapiens
agtgttcccggagaaagtctttggaaggagcactggagtaggagtcagggaagctgagctgtccacctgattccaccacgacctgagtgacctttttcaartcacttttcctctccccgtctcagtttctgcttgggcagaaggagcaacttgcagcctctctaagtccctttcaacgttcctcagctccgcgcttacaga

SEQ ID NO: 51114 - DNA, 201 bp, Homo sapiens
ctgccagtgaaaccaactctggctgtgtagtatgtgctggtgtgggaaaggacctagcctggggctgtggcaatcccgattcatggtgctttcaagtcagrttttcttggaattctgggtttgctggggtcttctgagtggggttgcctgtgctcccctagagggcagccatgaaatgggagcggtggtgcagatgggagg

SEQ ID NO: 51115 - DNA, 201 bp, Homo sapiens
ccacatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttcc

SEQ ID NO: 51116 - DNA, 201 bp, Homo sapiens
cacatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttcct

SEQ ID NO: 51117 - DNA, 201 bp, Homo sapiens
acatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttcctt

SEQ ID NO: 51118 - DNA, 201 bp, Homo sapiens
agtataagaaaagttaaattgcctatgatcttatcacttaatgctagtcactgttaacatttactaacattccctcgaggtgtttttctgtgcttgtacgmacacacacacacacagccagcatcagactgtgtatacagtttaaggcattatttatatgagggcaaaactagacacagtctaacatccagccatggacaa

SEQ ID NO: 51119 - DNA, 201 bp, Homo sapiens
ttaaaacggtttccccactcctggatgtctcagagtcttggatgtggtaatgtgcatcattaatctggaagagaaggaaagacttgtgtgcagggattccmaaacttacacagtagatgagtttttcatggtgttctggagaacacagtttgagaaacactttcacaatgaatccaggcctcaacatacatcagctgctct

SEQ ID NO: 51120 - DNA, 201 bp, Homo sapiens
gcctggggacaggcaccacacaatggcggatccactttggatccactcagtatctccatagctctttattgctgtgattgccccagtcatttagggaactygtcactcatgcagagcgtcactcagcggtggtgcttaggagcatcagcttgcatcggggcaggcttggttccaaagcccaggcctcctccatgtggctcc

SEQ ID NO: 51121 - DNA, 201 bp, Homo sapiens
acttctgtgacgtccagcgctacaacatcctggaggtaacccagccagcccagctggccagatgaaggtgtgggcctgggggtggcttcagggaccgactygccgctatcactctgcctctgtaggaagtgggcaggagaatgggcctggaaacgcacaagctggcctcgctctggaaagaccaggctgtcgttgagatca

SEQ ID NO: 51122 - DNA, 201 bp, Homo sapiens
caaccagccggccctggtccaaggcatcctggagcgagtggtggatggccccacaccccaccagacagtgcgcctggaggccctggatgagagtggtgagycccgggctagaaagccagtgctgcctggcaccctctggccgccccacctggctgaggggctgagcctgggcctgccggtgacagccatccctgtccttcc

SEQ ID NO: 51123 - DNA, 201 bp, Homo sapiens
ggcatttctccacagcagcctcggaacctctatcgccaccctccggggggcccacctgtcccccgcctgcccttcaaggtgctctttgatttctccccagmagaattcacctgctgcatccatcatcagaagaggccaggaatgcggcctgctgggtgggcagggccaagaagaaggcagccgtgcaggcccaggaagccg

SEQ ID NO: 51124 - DNA, 201 bp, Homo sapiens
ggggggcccacctgtcccccgcctgcccttcaaggtgctctttgatttctccccagcagaattcacctgctgcatccatcatcagaagaggccaggaatgyggcctgctgggtgggcagggccaagaagaaggcagccgtgcaggcccaggaagccgtaggagacttgccaacctccaggagggggccagccctggaccct

SEQ ID NO: 51125 - DNA, 201 bp, Homo sapiens
tttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttt

SEQ ID NO: 51126 - DNA, 201 bp, Homo sapiens
ttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttcctttttttt

SEQ ID NO: 51127 - DNA, 201 bp, Homo sapiens
accttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttcctttttttttt

SEQ ID NO: 51128 - DNA, 201 bp, Homo sapiens
ccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttg

SEQ ID NO: 51129 - DNA, 201 bp, Homo sapiens
ttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttgag

SEQ ID NO: 51130 - DNA, 201 bp, Homo sapiens
tctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttgaga

SEQ ID NO: 51131 - DNA, 201 bp, Homo sapiens
ctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttgagac

SEQ ID NO: 51132 - DNA, 201 bp, Homo sapiens
ggcaggacgagaagcggagacccaagagaagagagattccattgaaagtcttggtcaagtgagtggcagtggcagtggctagtagtgatgtgtgaactatmtctctcccttctagtcagcctctgcctccagtccttgaagggcaagaacacaaggaatggttatgctttttgcttttgtttttgagacagggtcttactc

SEQ ID NO: 51133 - DNA, 201 bp, Homo sapiens
gccctcccttgtgggagttcagtgacaggggtggggcgcaggccagccttctctcccaggctcatgatgggtgtgaagggtcctctaccactccagcatcygcgagccgagccaagccaggaccccgccctgccctcacatctcctttcttttctgaaggtagaggcctggaaaacccatgtctggcaggacgagaagcgg

SEQ ID NO: 51134 - DNA, 201 bp, Homo sapiens
agtcaccatcctctttgcgacagagacaggaaaatcagaggcgctggcctgggacctgggggccttattcagctgtgccttcaaccccaaggtactggctyagtgggatggctgttgttttttctgcttgtgtgcaggggagtctaggaaaagttaaaacggtttccccactcctggatgtctcagagtcttggatgtggt

SEQ ID NO: 51135 - DNA, 201 bp, Homo sapiens
gactcacagcctttggacctcagcaaaggtacctgcttctctgcagcacatggggcttgtttgtgttggggtctgagccctaagcccatggtcaaggagamccccaggtctttctgaacagagacagctggcctcggggcctccctctcactgcatgcaagagcctgttagggcataatactcaaggtgctgagggaggct

SEQ ID NO: 51136 - DNA, 201 bp, Homo sapiens
gtagctttggctcagctctgctcatgcccttttggctctgcgggaggaagaagataagaggaagagggaagatggggatggggaggcagttggtcagaccraccatgaacaattcactcccaccctctggactcagtttccctatttgtcaaatgaggttactggcagagggaactccaagatgcccctccacccttggat

SEQ ID NO: 51137 - DNA, 201 bp, Homo sapiens
gtcaagtgagtggcagtggcagtggctagtagtgatgtgtgaactatatctctcccttctagtcagcctctgcctccagtccttgaagggcaagaacacarggaatggttatgctttttgcttttgtttttgagacagggtcttactctgtcacccaggctggggtgtagtggtgccatcacagctcactgcagcctctgc

SEQ ID NO: 51138 - DNA, 201 bp, Homo sapiens
agtgacctttttcaagtcacttttcctctccccgtctcagtttctgcttgggcagaaggagcaacttgcagcctctctaagtccctttcaacgttcctcasctccgcgcttacagagggtggatctcagaaccaggaggacaaacagctgctcattgagtcctgagagtgcctgagtgggggcgtccaaggaggccgtggt

SEQ ID NO: 51139 - DNA, 201 bp, Homo sapiens
cccccatctacacaagaccaccacatagccacacaaccccaccgccccagaggagcctttcccatggactacaaagggtagggcgccccctggatgtgtgragcatgacggccctgagtgtatctgtcagaggcggcaaaaaatgccagtggctaagaggatgggcttggggatgagcaagtggctttgccactcagtagc

SEQ ID NO: 51140 - DNA, 201 bp, Homo sapiens
caggtctatggggctataagttcttttctttctttccctctttccttcctttccttcctgtcctttcctcccttcccctcccttcccttccctttctttcttttttttttttggaaacagccttgactgcccagcctcaagcaatccttctgcctcagcctcccgagtagctgggactacaggcacaagacaccatgcctg

SEQ ID NO: 51141 - DNA, 201 bp, Homo sapiens
tccacagaaaggccattttgttcagagttacccactctccttaatcaggagttcattctttaaatagttttgatgctgtttcaaaaggctttggtgctgaytggaaatctcaaggttgttgttgttggtggtggtggtagtgtgtgtgtgtgtgtgtgtgtgtgtgtttcaaagcctttctgactgagtccctccctccct

SEQ ID NO: 51142 - DNA, 201 bp, Homo sapiens
acccactctccttaatcaggagttcattctttaaatagttttgatgctgtttcaaaaggctttggtgctgactggaaatctcaaggttgttgttgttggtggtggtggtagtgtgtgtgtgtgtgtgtgtgtgtgtgtttcaaagcctttctgactgagtccctccctccctttgggatatttttgaagtctgggagggga

SEQ ID NO: 51143 - DNA, 201 bp, Homo sapiens
gaacttgaaccccagctttctgacactggagtccttaattgctctgttgtgttgcattctcagcatttagcacagagcctggcacatacttgaagcttaayataggtttgcatgaatgaatgagtgcatgaatgcataatttaataaatggcatcctatgtgtccaatacgtctctctggctgggattaactcagaatcaa

SEQ ID NO: 51144 - DNA, 201 bp, Homo sapiens
ggtagttcacacctgtaattccagcactttgggaggctgaggcaggaggattacttgaggccagtagttcgagaccagcctgggcaacatagtgagactctataaaataataataataataataataataataataataaggaaaaaaattagctgagcaagatggcacatgcctgcagtcctagctacttgggaggctga

SEQ ID NO: 51145 - DNA, 201 bp, Homo sapiens
tcgcgcccttccgcagtttctggcagcaacggctccatgactcccagcacaagggtaaggctggaggcttcccaggtgggaggggcaccagggggccagcrcctgcctaggagcagaactgcagccccacaaacggttcctgacctctctcgagggaaggcctcccaagtttgcttccctgtgcgggcctctgcgggttag

SEQ ID NO: 51146 - DNA, 201 bp, Homo sapiens
gtagttcacacctgtaattccagcactttgggaggctgaggcaggaggattacttgaggccagtagttcgagaccagcctgggcaacatagtgagactctataaaataataataataataataataataataataataaggaaaaaaattagctgagcaagatggcacatgcctgcagtcctagctacttgggaggctgag

SEQ ID NO: 51147 - DNA, 201 bp, Homo sapiens
acctgtaattccagcactttgggaggctgaggcaggaggattacttgaggccagtagttcgagaccagcctgggcaacatagtgagactctataaaataataataataataataataataataataataaggaaaaaaattagctgagcaagatggcacatgcctgcagtcctagctacttgggaggctgaggcaggagga

SEQ ID NO: 51148 - DNA, 201 bp, Homo sapiens
ccctcagccccctagaagagctccaccttgtgcacacaactctgggggagaaggtggcacagatacccccctgcccttagggagcttctagtttaaggtckttcctccagtgactacctaggtcacctcttaactactgtgtctgtttcagtctcacagccatagagagcctggggacaggcaccacacaatggcggatcc

SEQ ID NO: 51149 - DNA, 201 bp, Homo sapiens
cagggtttgtcctggcaacaaggaaaggtttcttctgatatccatgtatgtccaaggcggatgctttctttaggcagaggctgtagccaagccctcggggrgctccaagggctgctgggaaggggtgggcccccctcctccccagagggaagctcctggggccctcttaagcacccctgcctgtggggatgcctcatccca

SEQ ID NO: 51150 - DNA, 201 bp, Homo sapiens
gtctcagctacaggtacgggactgaggcgggaggattgcttgagcccaggtggttggggcttcagtgagctatgatggcaccactgtactccagcctgggygactgagtgagaccctgtctcaaaacaaaaacaaagcaatatttataatagtagcaatagctactatgtgccaagcccagacacctctttgagtccttgc

SEQ ID NO: 51151 - DNA, 201 bp, Homo sapiens
gtatgttggccagtctggtctcaaactcctgacctccagtaatccacccaccgcggcctccaaaagtgctgggattacaggcatgagccaccatgcccggyctggaccaaggatctttatttgtggaataaaaggaagaaaaagaaaaacccaacggccacctcagcaggatgccccaagggtggtgttcagatgtcactg

SEQ ID NO: 51152 - DNA, 201 bp, Homo sapiens
gctgctagcctgtggccatgttggggtctgagccccagccttccagctgcgaaggcagccaagtgtcgtagagaaggtgtcacagaggcgattccaggctktagtggtgaactctccactctgcacccccaggtgctgtgccctgtgccctgtctaagatagtcctgaaggtttctgcatatttaagatatccccaatgtc

SEQ ID NO: 51153 - DNA, 201 bp, Homo sapiens
gccagagactgagtccggagtagggagaaaaacctgactcacacccactggggttcagccagtggaagagaggagatctaggtgggagaaagccaggtggwccccaaggaggaggtgccacaggggtggagaagaggtgcagggagccggagcagccagagaggagccaggtggccaggagagctggccccagaggagggt

SEQ ID NO: 51154 - DNA, 201 bp, Homo sapiens
cttcgatgcccgcagctgttccactgcccgggaaatgtttgaacacatctgcagacacgtgcgttactccaccaacaatggcaacatcaggtcggtgcacrtttcccagggctgcagaggggcttgccttgcctgagaatcttagccaaaagatgcagcacttgggtctaggggaggcatctccagctccaggagaaacca

SEQ ID NO: 51155 - DNA, 201 bp, Homo sapiens
ctttcctatgacatatttaatatatttctgtgaatggcctacctgtttgtatttacaaattcatatttaaaggaaacttgtatcactctcacaaatggaargcagcaaaacataaattcaatgaaaacaaaatgaagttaatgaattttagctagatactattccctggccaaggcctgctctttgtttgttttgtttgtt

SEQ ID NO: 51156 - DNA, 201 bp, Homo sapiens
accagccccgggctctgaggatctgacagtgggtggcgcagagccaggccttgcccttggggagctctccagcatacaccccaccctcccctcccagcgcyctgcaaagcaggcgtcaatgccattgttaatgcacagaggaggaacctgactgttagacaggttgatgggttttccagggtcgcacggcttctgggagat

SEQ ID NO: 51157 - DNA, 201 bp, Homo sapiens
ttataatagtagcaatagctactatgtgccaagcccagacacctctttgagtccttgctgtcaccctatcaggtaagtgtgcttcgaagttacacgaaacmcacggctcagtgtttggcccatggtaagggcctaaaaagtggtagccccagtggtggggatgctgctgctgctgaccattaaccgcagtctgctccacct

SEQ ID NO: 51158 - DNA, 201 bp, Homo sapiens; identical to SEQ ID NO: 14745

SEQ ID NO: 51159 - DNA, 201 bp, Homo sapiens
gcccagacacctctttgagtccttgctgtcaccctatcaggtaagtgtgcttcgaagttacacgaaacacacggctcagtgtttggcccatggtaagggcytaaaaagtggtagccccagtggtggggatgctgctgctgctgaccattaaccgcagtctgctccaccttcttccaggcagcctgtgagacgtttgatgtc

SEQ ID NO: 51160 - DNA, 201 bp, Homo sapiens
agggcctaaaaagtggtagccccagtggtggggatgctgctgctgctgaccattaaccgcagtctgctccaccttcttccaggcagcctgtgagacgtttsatgtccgaggcaaacagcacattcagatccccaagctctacacctccaatgtgacctgggacccgcaccactacaggctcgtgcaggactcacagccttt

SEQ ID NO: 51161 - DNA, 201 bp, Homo sapiens
ccatagagatggcctgtccttggaaatttctgttcaagaccaaattccaccagtatgcaatgaatggggaaaaagacatcaacaacaatgtggagaaagcyccctgtgccacctccaggtgagttttccctgggggaacctcctgcttgtctccttgggcacccatgccctgtcggcaccgatgactcagaattcctctct

SEQ ID NO: 51162 - DNA, 201 bp, Homo sapiens
aagggctggctttgcaccacacatcctgactcctggggactcccagcaccagccctgatgctggcaggatgtggatacgtcccagaaaatctgtgagcctytgctgtctcctcaccgtggctgactgtgtccttccactgcctgagcgtctccaggacttcctcaccaccctccttcagggtaaacttcaaaagatgggcc

SEQ ID NO: 51163 - DNA, 201 bp, Homo sapiens
tcctggtggaactctcctgtgaggatggccaaggcctgaactacctgccgggggagcaccttggggtttgcccaggcaaccagccggccctggtccaaggyatcctggagcgagtggtggatggccccacaccccaccagacagtgcgcctggaggccctggatgagagtggtgagtcccgggctagaaagccagtgctgc

SEQ ID NO: 51164 - DNA, 201 bp, Homo sapiens
cccctgtggggccgccgacccctgggagttccgggaggaaagggagggatctggggtttaggagacgctcggagccccttggcccataaagaaggcactgrggtcacactggtgtggctgcctgtagcagggacagcgatgacaggtgggtctcaagagtccagtgagcttggccctttttcagaaggacctgggggaggt

SEQ ID NO: 51165 - DNA, 201 bp, Homo sapiens
tgcccccctgctcactcagccaggccctcacctacttcctggacatcaccacacccccacccagctgctgctccaaaagctggcccaggtggccacagaaragcctgagagacgaggctggaggccctgtgccaggtgaagatcagggctggtgggcagtgggggtatgtggggggtcccagcatgtggggagccagagtc

SEQ ID NO: 51166 - DNA, 201 bp, Homo sapiens
cggagccccttggcccataaagaaggcactggggtcacactggtgtggctgcctgtagcagggacagcgatgacaggtgggtctcaagagtccagtgagcwtggccctttttcagaaggacctgggggaggtgctggtgcctggacagaagtgaagcagcctgcaggacgtgggaaatcaaataggagcttcttgtcctct

SEQ ID NO: 51167 - DNA, 201 bp, Homo sapiens
cgtgtttcaccaggagatgctgaactacgtcctgtcccctttctactactatcaggttaggggccttcctcttctctccttcctgggggctcagatgtggytgtatgtgtgtgtgtgtgtgtgcacctcattgttacacatgtagggcacgacgggaagcaggagtatgttgttagagctttccaggccccactcaaggat

SEQ ID NO: 51168 - DNA, 201 bp, Homo sapiens
ccgctggcccatgtctaggacacagttgtgttgagtgaactgaatttttccaagtgtctgcaggatgcaaccagagtgcactgccttgaacattagctagraaggggagccgcccttatccgtctttgctttccccaaaactggaataaacttgtcacttaagatgtattgggggatggatgatgtggatgaatggataaa

SEQ ID NO: 51169 - DNA, 201 bp, Homo sapiens
aactaacttgcacccctctcacaagtctcccttcctctcaggagctgctcccgaaattcgccaactcaccctgggcctctgtctggcgttgtatcctctcytctgcccttccccagcacctttgcctgcctccatcagagtttctatcaggccgtgtgaaaatgactgattttccttggcttccccacccagttagactag

SEQ ID NO: 51170 - DNA, 201 bp, Homo sapiens
tcgtctcagcaccatggacagtgcctggcacatggacttgtttgttgagtgagtgaatgaatgaatgaatactgggttgtgacagtcttttccccaaagcrggacaggcgccctgagtcactgacatcacccttggcttttagccctcagagtacagcaagtggaagttcaccaacagccccacattcctggaggtgctag

SEQ ID NO: 51171 - DNA, 201 bp, Homo sapiens
caaagcgggacaggcgccctgagtcactgacatcacccttggcttttagccctcagagtacagcaagtggaagttcaccaacagccccacattcctggagytgctagaggagttcccgtccctgcgggtgtctgctggcttcctgctttcccagctccccattctgaagcccaggttctactccatcagctcctcccggga

SEQ ID NO: 51172 - DNA, 201 bp, Homo sapiens
ccacacatcctgactcctggggactcccagcaccagccctgatgctggcaggatgtggatacgtcccagaaaatctgtgagcctctgctgtctcctcaccrtggctgactgtgtccttccactgcctgagcgtctccaggacttcctcaccaccctccttcagggtaaacttcaaaagatgggcccttgtttcctcctctg

SEQ ID NO: 51173 - DNA, 201 bp, Homo sapiens
atctgttcatcaactcagattcagctccctcatcagttcaaggagggagggaacacccacagcccagagttgttaacagtattaggaggtgtgtgggagasatctctaggaaccaggcactaaaccaagccttctgtatgtatatgatcagttacattgtggggtaggcactgtgtgcattttacaggtggcacagaaagt

SEQ ID NO: 51174 - DNA, 201 bp, Homo sapiens
aatttttatatttttagtagagatggtgtttttccatgttgcccaggttggttccgaactcctggcctcaagtgatccgcttgcctcagcctcccaaagcrctgggattataggcataagccacggtgccgggccagctttctttattgtttggtttcctccactagaatgtaagctccatggggcagggaccttgtctgt

SEQ ID NO: 51175 - DNA, 201 bp, Homo sapiens
tggccaacatgctgcttgaggtgggcggcctggagttcccagggtgccccttcaatggctggtacatgggcacagagatcggagtccgggacttctgtgaygtccagcgctacaacatcctggaggtaacccagccagcccagctggccagatgaaggtgtgggcctgggggtggcttcagggaccgactcgccgctatca

SEQ ID NO: 51176 - DNA, 201 bp, Homo sapiens
atgataacatccccctcaatgcagtggccaaagtcagaaagtgggatgagctgggtgtggtggctcacgcctgtaatctcagcactttgggaggccgtggygggtggatcacttgaggtcaggagtctgagacaatcctggccaacatggcaaaaccccgtctctactaaaaatacaaaaataattagacaggaatggtgg

SEQ ID NO: 51177 - DNA, 201 bp, Homo sapiens
cctctgcgtattgagatttactctgtagcagacattgggctgggctcttcttcctggccgttgaatgaaccaaattcagtcctgactcacagcctttgtaytccctgttccctttgcatgacatgccttttcctcagaatttttctaggctcatttcttcttgtcaaaaggtatttcctataatgtcacctcctctgagaa

SEQ ID NO: 51178 - DNA, 201 bp, Homo sapiens
agattctagaaaggagcagcccaggcctcttctgccctcctgccaatgctcttagctgtccctctcctgtcgggatcatatagggctgcagtgacttcaaragtcctactggcccagcccctgctctaggcagttctcataattgcaaaaatacctctgcgtattgagatttactctgtagcagacattgggctgggctct

SEQ ID NO: 51179 - DNA, 201 bp, Homo sapiens
gttgaactcactttttgtctgcgccccctgggcctgggtgggaaacagacagactgggagaatggcaccgtggagaaggcaggctgaacagggactgtgcrggggttctgttaaaacaaaaggcaccgggcagtgaggagaagcattaatagagccaaggagaagccgaaaggcagaggcaagggcaagagggagagacca

SEQ ID NO: 51180 - DNA, 201 bp, Homo sapiens
ttacccactctccttaatcaggagttcattctttaaatagttttgatgctgtttcaaaaggctttggtgctgactggaaatctcaaggttgttgttgttgktggtggtggtagtgtgtgtgtgtgtgtgtgtgtgtgtgtttcaaagcctttctgactgagtccctccctccctttgggatatttttgaagtctgggaggg

SEQ ID NO: 51181 - DNA, 201 bp, Homo sapiens
cccactctccttaatcaggagttcattctttaaatagttttgatgctgtttcaaaaggctttggtgctgactggaaatctcaaggttgttgttgttggtgktggtggtagtgtgtgtgtgtgtgtgtgtgtgtgtgtttcaaagcctttctgactgagtccctccctccctttgggatatttttgaagtctgggaggggag

SEQ ID NO: 51182 - DNA, 201 bp, Homo sapiens
ccttaatcaggagttcattctttaaatagttttgatgctgtttcaaaaggctttggtgctgactggaaatctcaaggttgttgttgttggtggtggtggtrgtgtgtgtgtgtgtgtgtgtgtgtgtgtttcaaagcctttctgactgagtccctccctccctttgggatatttttgaagtctgggaggggaggagagaag

SEQ ID NO: 51183 - DNA, 201 bp, Homo sapiens
acacaagttgctacagtttagttggagtgagagacaagctaaacttgtcagctgacaaccaggtccttggccaggtagccccatatgtaaaccaacttccrtggtgggctgtgagccttctcctgcaagctgtggccaggtttccagaagaaaggaaaaaacagtgtttttattcatcctggcttgagaactctgtcattc

SEQ ID NO: 51184 - DNA, 201 bp, Homo sapiens
cccaagctctacacctccaatgtgacctgggacccgcaccactacaggctcgtgcaggactcacagcctttggacctcagcaaaggtacctgcttctctgyagcacatggggcttgtttgtgttggggtctgagccctaagcccatggtcaaggagacccccaggtctttctgaacagagacagctggcctcggggcctcc

SEQ ID NO: 51185 - DNA, 201 bp, Homo sapiens
ttcatcaactcagattcagctccctcatcagttcaaggagggagggaacacccacagcccagagttgttaacagtattaggaggtgtgtgggagagatctstaggaaccaggcactaaaccaagccttctgtatgtatatgatcagttacattgtggggtaggcactgtgtgcattttacaggtggcacagaaagtcacac

SEQ ID NO: 51186 - DNA, 201 bp, Homo sapiens
agtcctccaccactccactgtcccactactcttgggacaatttaatgagatcagatgtgaagagcactcaacccttggtaggaggccagtggttcttagtsttcccaatcatgcagcctgaacgcaggggagattctgcattgattattcattcactcactcagctattcagtgggtgcctggcactggggtgggtatgga

SEQ ID NO: 51187 - DNA, 201 bp, Homo sapiens
ggccacccatagatccttccccactctaagacaaggcagggcctggggtctaggagagacctgagagaaaaccctgttttttccccttgcagaagtctccrgaatctctggtcaagctggatgcaaccccattgtcctccccacggcatgtgaggatcaaaaactggggcagcgggatgactttccaagacacacttcacc

SEQ ID NO: 51188 - DNA, 201 bp, Homo sapiens
acaatttaatgagatcagatgtgaagagcactcaacccttggtaggaggccagtggttcttagtcttcccaatcatgcagcctgaacgcaggggagattcygcattgattattcattcactcactcagctattcagtgggtgcctggcactggggtgggtatggaaatacaacagagatcagccctgccctcagggagcat

SEQ ID NO: 51189 - DNA, 201 bp, Homo sapiens
tagtcttcccaatcatgcagcctgaacgcaggggagattctgcattgattattcattcactcactcagctattcagtgggtgcctggcactggggtgggtrtggaaatacaacagagatcagccctgccctcagggagcatctagaggcggcagtggagagataggcatagaaataattagatgattttcattgtgctgaa

SEQ ID NO: 51190 - DNA, 201 bp, Homo sapiens
cacctgggggcctctcagctcaccccgatgggagaaggggatgagctcagtgggcaggaggacgccttccgcagctgggccgtgcaaaccttcaaggtcakttcccagccagagctgccccacagcagggacatgacagggtgcattcatgcctaggacatctgtgctgggcgtcccaggtggcatgacctctgcctgtgg

SEQ ID NO: 51191 - DNA, 201 bp, Homo sapiens
ccccaaagccagccctggagggagctgtctctggtgagaggcatcttgcccttctgatgtcctatttcagttcctgcttctgtggattgaattaatccccrtgtaaggccatctcattgttgatcttcctgctgtcttcctgtcccccagggcaaaaatagaggaacatctggccagggtggaagcggtaacaaaggagat

SEQ ID NO: 51192 - DNA, 201 bp, Homo sapiens
tattcattcactcactcagctattcagtgggtgcctggcactggggtgggtatggaaatacaacagagatcagccctgccctcagggagcatctagaggcrgcagtggagagataggcatagaaataattagatgattttcattgtgctgaagccaagaaggaaaggtcagggtcactgagggaagcagagcagggggtga

SEQ ID NO: 51193 - DNA, 201 bp, Homo sapiens
agctcatccgctatgctggctaccagatgccagatggcagcatcagaggggaccctgccaacgtggaattcactcaggtacccggcccagcctcagccgcyggccattggggcggggagccccgtggtgagcgagtgacagagtggagcccagaggagacacgcagcccgggcttacagactcacagggcccgtcttgttc

SEQ ID NO: 51194 - DNA, 201 bp, Homo sapiens
cactggggtgggtatggaaatacaacagagatcagccctgccctcagggagcatctagaggcggcagtggagagataggcatagaaataattagatgattytcattgtgctgaagccaagaaggaaaggtcagggtcactgagggaagcagagcagggggtgacgctgccatagagcgggaggccaacatctcgtccaggt

SEQ ID NO: 51195 - DNA, 201 bp, Homo sapiens
tgccatagagcgggaggccaacatctcgtccaggtggtctcggctccaccactggccgctgccccctgccctgccctctgtaactgagcattgcctgggtkggcaaagctgggagctgcccacacttccgagccctctgtcctcaagaagcaaaaacacagtttctaaaaccttggcagagactctatttgccctgctaga

SEQ ID NO: 51196 - DNA, 201 bp, Homo sapiens
atctcgtccaggtggtctcggctccaccactggccgctgccccctgccctgccctctgtaactgagcattgcctgggttggcaaagctgggagctgcccayacttccgagccctctgtcctcaagaagcaaaaacacagtttctaaaaccttggcagagactctatttgccctgctagagaacagccacccagaccaggag

SEQ ID NO: 51197 - DNA, 201 bp, Homo sapiens
gccacccagaccaggagaggagaggcagacgtgtcctgtgagatcaaagtttaatcccgaggaaaaccagggggacctctgcagttggttggaggccttcytcaagtgctgggccattgtaaagggaacacaacccagagagacctcctgggtttctacaagcccaggagggcccactgaggaggaaagcaaggtgccaga

SEQ ID NO: 51198 - DNA, 201 bp, Homo sapiens
acttctgatcagcctcaaagcctctgtctacccagtctttgatgggcatggtctggatgggctgttgcaggtcttcgatgcccgcagctgttccactgccygggaaatgtttgaacacatctgcagacacgtgcgttactccaccaacaatggcaacatcaggtcggtgcacgtttcccagggctgcagaggggcttgcct

SEQ ID NO: 51199 - DNA, 201 bp, Homo sapiens
gtgggcaggccctcaacatctttgggcttactgtccccgtagggtggaagatggaaggtcacgttgctgacagttaagaacctgggcttggcatcagggcracctgggtctgagtcctgactttgctctttcctgtacttatgttcctgggcctggtgcttaacctcctagagccttgagatccttggctataaaatagat

SEQ ID NO: 51200 - DNA, 201 bp, Homo sapiens
gctcagctatctttgtttttaaaaaagactaataggcaatgagagaggtattaaaggtctattagcaccaatatgagactgtctctccagtgctccgaagratgaaaatgtaattgaaggggaataactaaaaaataaattatgaaaagggagtaaatactcaccatgggatttgacgctagttctgctgggtcacatacc

SEQ ID NO: 51201 - DNA, 201 bp, Homo sapiens
agctgtggccaggtttccagaagaaaggaaaaaacagtgtttttattcatcctggcttgagaactctgtcattccctctctttctagaaactgaagaaatygctcttcatgctgaaagagctcaacaacaaattcaggtaaagctttttccgttgtcctactcctagccctgccctgtggacccaaagtctgggttcaggg

SEQ ID NO: 51202 - DNA, 201 bp, Homo sapiens; identical to SEQ ID NO: 14760

SEQ ID NO: 51203 - DNA, 201 bp, Homo sapiens
acaacaaattcaggtaaagctttttccgttgtcctactcctagccctgccctgtggacccaaagtctgggttcaggggatggaactgggtgtgcacagggkgtcttctcagaaccgtgcaggcacagagacctgggtctaaggtctgtactcagaatgtgtcgagggtcaaaccacagaaaccaagtccctctcacaggtc

SEQ ID NO: 51204 - DNA, 201 bp, Homo sapiens
gtcacgttgctgacagttaagaacctgggcttggcatcagggcgacctgggtctgagtcctgactttgctctttcctgtacttatgttcctgggcctggtrcttaacctcctagagccttgagatccttggctataaaatagatgcaaaaatacctccctcccagactcagtgagaccctgcctgtgggttgcttcaccca

SEQ ID NO: 51205 - DNA, 201 bp, Homo sapiens
ttactgttgtcatgctcaggtgcagaggggggaatattgctggaagctttgtttggggagggaggtctcccagcagtggggtggttcccacctcacccagyagctccttatggcaggggtgtccttggggataaatatcatcagtgttttgtctttgtgctttttttctctaatcaaggaaaagttgtcgagacactcttc

SEQ ID NO: 51206 - DNA, 201 bp, Homo sapiens
acctctttgagtccttgctgtcaccctatcaggtaagtgtgcttcgaagttacacgaaacacacggctcagtgtttggcccatggtaagggcctaaaaagkggtagccccagtggtggggatgctgctgctgctgaccattaaccgcagtctgctccaccttcttccaggcagcctgtgagacgtttgatgtccgaggcaa

SEQ ID NO: 51207 - DNA, 201 bp, Homo sapiens
gcttggtggtgttggaacccatttgcttctcccagaggaaaattgtatttttccaagtcacaagtacataccttgaacccctgcttccctgagcaagagawcctgggggtgtgaacggggaatggcagcctctcctcacagggaccctggcaatctaagacatgaccagctgagcaggttcagtggccttttgtatctgaa

SEQ ID NO: 51208 - DNA, 201 bp, Homo sapiens
aaattcgccaactcaccctgggcctctgtctggcgttgtatcctctcttctgcccttccccagcacctttgcctgcctccatcagagtttctatcaggccrtgtgaaaatgactgattttccttggcttccccacccagttagactagactctaatgcagagaaagggctgtgtctttcccttctataacgccgatgcctt

SEQ ID NO: 51209 - DNA, 201 bp, Homo sapiens
gggtgaaggagcattttccagatcctctatgggctgctgtttgggccagtagctttggctcagctctgctcatgcccttttggctctgcgggaggaagaakataagaggaagagggaagatggggatggggaggcagttggtcagaccgaccatgaacaattcactcccaccctctggactcagtttccctatttgtcaaa

SEQ ID NO: 51210 - DNA, 201 bp, Homo sapiens
tctgtaatagaaatgtagaataagtaaataaaccaagataaatcacgtgttttaaataaagcttaagtcatgaaaaacaagtggctggggctgggcgcggyggctcctgcctgtaatcccagcactttgggaggctaaggtgggaggatcacttgaggccaggagtttgaggccagcctgggcaacatggtgaaaccccat

SEQ ID NO: 51211 - DNA, 201 bp, Homo sapiens
cccgcgcagagccaggtaccccgcgggccgaagtccgccctgggagggaagcggtgggctccgagcccgggcggggccccatctctctctgggagaaatcsgagggcggggatgtgcgctctgtgggattcctgagggtttactaaaagcgttttcctcttttagaacgcttgagaggtcgcaattcaggagcccaggcgg

SEQ ID NO: 51212 - DNA, 201 bp, Homo sapiens
ccgcgagccgagccaagccaggaccccgccctgccctcacatctcctttcttttctgaaggtagaggcctggaaaacccatgtctggcaggacgagaagcrgagacccaagagaagagagattccattgaaagtcttggtcaagtgagtggcagtggcagtggctagtagtgatgtgtgaactatatctctcccttctagt

SEQ ID NO: 51213 - DNA, 201 bp, Homo sapiens
tatgctggcattagcagccacactgtcggtaggaccggcccacctggtaacctgcggccacctgtgcttttacgtctactcttggttaaccacgagccacktttccagcttggactctaagcatctgctccacttcctctccttcctcattgaactctttcactaaaaggagagtgcaagagagacttaaactgtttgatt

SEQ ID NO: 51214 - DNA, 201 bp, Homo sapiens
cagatgccagatggcagcatcagaggggaccctgccaacgtggaattcactcaggtacccggcccagcctcagccgccggccattggggcggggagccccrtggtgagcgagtgacagagtggagcccagaggagacacgcagcccgggcttacagactcacagggcccgtcttgttccccagctgtgcatcgacctgggc

SEQ ID NO: 51215 - DNA, 201 bp, Homo sapiens
ttccccagctgtgcatcgacctgggctggaagcccaagtacggccgcttcgatgtggtccccctggtcctgcaggccaatggccgtgaccctgagctcttygaaatcccacctgaccttgtgcttgaggtggccatggaacatcccaagtaagtaggctgagggtgctgggggcaagggcgagtcaacacacagcccttct

SEQ ID NO: 51216 - DNA, 201 bp, Homo sapiens
gctggagggcggccgatgcttccaccacggccatcagaggggctcttctgtccccagggccgcgttaccccctgagcctggggtgtcagaatagactctcrgccttcacacatttgtcccatcagggcacctcttgggcccagtgctctgtgcccagtgctggggccactgggcatcctgtgtggagcaggagcagagagt

SEQ ID NO: 51217 - DNA, 201 bp, Homo sapiens
ggagcaagtgggaatttatagccaaggatcagggtggggtctgtggatggaaaattaccaagaaaaacttcaggcatagggggaattctgcctcacccaayctaacaggattcttgcttaggacaggctaaggtgatcagacatcgcctgggggaggatggaggatgaggaccctgatcagatggggaggacgacaagcta

SEQ ID NO: 51218 - DNA, 201 bp, Homo sapiens
atggagatgtcccgggactttccatttttaggttcctaaattgaatttcccaacacctagaagcaacacttagaagctgccctgtatcagatcaaggagcttttttttttttttttttttttttgagacggagtctcggtctgtcgtccaggctggagtgcagtggcgcgattcccgcttactgcaacctccgtctcctgg

SEQ ID NO: 51219 - DNA, 201 bp, Homo sapiens
tcagctcatccgctatgctggctaccagatgccagatggcagcatcagaggggaccctgccaacgtggaattcactcaggtacccggcccagcctcagccrccggccattggggcggggagccccgtggtgagcgagtgacagagtggagcccagaggagacacgcagcccgggcttacagactcacagggcccgtcttgt

SEQ ID NO: 51220 - DNA, 201 bp, Homo sapiens
cacactgtcggtaggaccggcccacctggtaacctgcggccacctgtgcttttacgtctactcttggttaaccacgagccacttttccagcttggactctragcatctgctccacttcctctccttcctcattgaactctttcactaaaaggagagtgcaagagagacttaaactgtttgattcattcttaagaactttca

SEQ ID NO: 51221 - DNA, 201 bp, Homo sapiens
agcacacactgttccccatgactgggtcaccccataggcagatcaggcctgtgcttgacgggggaggggaagatggaacaggaagagccccccggtgtttsgggaagggctggctttgcaccacacatcctgactcctggggactcccagcaccagccctgatgctggcaggatgtggatacgtcccagaaaatctgtgag

SEQ ID NO: 51222 - DNA, 201 bp, Homo sapiens
ctcacgaccgcctcccacaggcccagctccccagccatcctgtgtgtgcgtgggcctggggtgtctgaggactggccccctcttctcctgtcctcttcagygccagcggcttccacctccccgaggatccctcccatccttgcatcctcatcgggcctggcacaggcatcgcgcccttccgcagtttctggcagcaacggc

SEQ ID NO: 51223 - DNA, 201 bp, Homo sapiens
ggcccataaagaaggcactggggtcacactggtgtggctgcctgtagcagggacagcgatgacaggtgggtctcaagagtccagtgagcttggcccttttwcagaaggacctgggggaggtgctggtgcctggacagaagtgaagcagcctgcaggacgtgggaaatcaaataggagcttcttgtcctctccaccccctca

SEQ ID NO: 51224 - DNA, 201 bp, Homo sapiens
cttgtgggagttcagtgacaggggtggggcgcaggccagccttctctcccaggctcatgatgggtgtgaagggtcctctaccactccagcatccgcgagcygagccaagccaggaccccgccctgccctcacatctcctttcttttctgaaggtagaggcctggaaaacccatgtctggcaggacgagaagcggagaccca

SEQ ID NO: 51225 - DNA, 201 bp, Homo sapiens
tgtgtgtgcgtgggcctggggtgtctgaggactggccccctcttctcctgtcctcttcagtgccagcggcttccacctccccgaggatccctcccatcctygcatcctcatcgggcctggcacaggcatcgcgcccttccgcagtttctggcagcaacggctccatgactcccagcacaagggtaaggctggaggcttccc

SEQ ID NO: 51226 - DNA, 201 bp, Homo sapiens
tccgattggctgagggaattctgcatccgcactttcagttctgtgactatggatgagtgatctgaatgcgctgggcctcagtttcctcatctgtaaagtgrggataatgctattaaatagctagtgggagtgaagtgagaattccagttgggcttggagccctggcgccctctggtggccaacatggtaacaacagcccgg

SEQ ID NO: 51227 - DNA, 201 bp, Homo sapiens
tggcaggtagacccaggggaatcaggcccagaaaggttctggaccccaagagaatcttagcagtggctgagatctgagctgggtgggctgtcagatggccytactgcacatcctggaccagttggcagctttgagaagtcgggtgaatgtgttccatttttccatctgtagaatgggggcaggagagtctccctggcctct

SEQ ID NO: 51228 - DNA, 201 bp, Homo sapiens
ggaggagttggggggaggaggtgggtccacccagagtgcaacatccactcaggtgagggaggggtgatgttactggaagaggaagcagccgtgcaaagggratttcatcctgaaagcaatgagagccaatgaatatattttgattttaaaaagtaattttctaatctgttcaggtgtcatgaaaccaagagcctattctaa

SEQ ID NO: 51229 - DNA, 201 bp, Homo sapiens
agcaggaaacagcccagggaacgctggggagtgtaattttaaatagggtggccagggaaggcagagctggaaggtggcatctgagaataaacctgagatgrtgaggaggagccctgtggatactgaaggaaacactctgggctgttctggaggggcagcaggtacaaaggccccgggggtgggagttaagctggcgtgttt

SEQ ID NO: 51230 - DNA, 201 bp, Homo sapiens
ggcggaaaggatccagtcagatagaagaggggatgaagaaaaaaatatcacacatcaattcattcaactctcccaacgatccacaaggaaggaattttagytatcccattttaaagatgaggaccctgaagcccagaaagttaaagtaattttcaagatctcataattagcaaatgacagagctgggattcagatccaggc

SEQ ID NO: 51231 - DNA, 201 bp, Homo sapiens
agtatcttgggtgggggatgaacgctgggcaggaaatgggtatgctaagtaaagctttggagatggttagagggcccgcaccagagcaggtgctgagcagsgttagggtctaaaccagattcaagcacaatctaagtataacagttgggaagacagatggctcatgaaggtccatgtgatagggaagctgggcaaccccag

SEQ ID NO: 51232 - DNA, 201 bp, Homo sapiens
gcccccatctacacaagaccaccacatagccacacaaccccaccgccccagaggagcctttcccatggactacaaagggtagggcgccccctggatgtgtrcagcatgacggccctgagtgtatctgtcagaggcggcaaaaaatgccagtggctaagaggatgggcttggggatgagcaagtggctttgccactcagtag

SEQ ID NO: 51233 - DNA, 201 bp, Homo sapiens; identical to SEQ ID NO: 14761

SEQ ID NO: 51234 - DNA, 201 bp, Homo sapiens
cagttaatgaacaagtcaagggacaggcttgaggctcgctcaggtggaaagacaaagcaatctgcaataacgcaatagtgcaactgaaaccaaagcccccrtctacacaagaccaccacatagccacacaaccccaccgccccagaggagcctttcccatggactacaaagggtagggcgccccctggatgtgtgcagcat

SEQ ID NO: 51235 - DNA, 201 bp, Homo sapiens
cacataataaaagaggagcaagtaataatgctgagttagaacaacaactgcaaaatctttaaaagaaaggtagctacagcttgagtgctttccccagtaayagacctaaaactacagttgataatgagagctgctgggaagtgtctttcagggtcaggcaaaggcacccctgtttcaacgacctccgggctcttcctcacc

SEQ ID NO: 51236 - DNA, 201 bp, Homo sapiens
aagccagtgctgcctggcaccctctggccgccccacctggctgaggggctgagcctgggcctgccggtgacagccatccctgtccttcctgctgagagggygggccaccaaagcttatgtgaaagcagctgtggaaacagtcccagcccataaggcatggccccctggccttagtttccctaatgataacatccccctcaa

SEQ ID NO: 51237 - DNA, 201 bp, Homo sapiens
tcccgtccctgcgggtgtctgctggcttcctgctttcccagctccccattctgaagcccaggttctactccatcagctcctcccgggatcacacgcccacrgagatccacctgactgtggccgtggtcacctaccacacccgaggtgagccaggggcagaggctctggaacagccccgctccgcccattattggacatctg

SEQ ID NO: 51238 - DNA, 201 bp, Homo sapiens
cccttcgcttttcattttgcaaggctagtggatacccccgaagtggcccttcacccccagcctgcccaccacaaacagaacctccgccctccctgagaaaycacttacataggtggggtgggggtacatcataggtgggttggcgggagtctgctgaaaagaaaccaggaaattcaatgggagagcgcatgtgtgcgcgag

SEQ ID NO: 51239 - DNA, 201 bp, Homo sapiens
ttgcaggtcttcgatgcccgcagctgttccactgcccgggaaatgtttgaacacatctgcagacacgtgcgttactccaccaacaatggcaacatcaggtyggtgcacgtttcccagggctgcagaggggcttgccttgcctgagaatcttagccaaaagatgcagcacttgggtctaggggaggcatctccagctccagg

SEQ ID NO: 51240 - DNA, 201 bp, Homo sapiens
ctcctccatgtggctccacaccaggaacataagagcaatcagacctcttccagtgtgggcatgaggatacaacaagatcatgtcaatattggcattcatartggtcgggcacagtggagcatgcctgcaatccaagcactttaggaggctgaggtgggcagattgcttgagcccaggagcttgaaactagcctgagtaaca

SEQ ID NO: 51241 - DNA, 201 bp, Homo sapiens
gagtggcctgctggctggggccagcctctcagaccctcggtccttcctactgtctgctcggccacccagggcctctgtgttgaactcactttttgtctgcrccccctgggcctgggtgggaaacagacagactgggagaatggcaccgtggagaaggcaggctgaacagggactgtgcgggggttctgttaaaacaaaagg

SEQ ID NO: 51242 - DNA, 201 bp, Homo sapiens
agccagctgtgggggagcccgctgaggtcacgaccacggtgctggtgaggagagatcaccatggagccaatttctcgtgccgcactgaactggacctgcgsccccaagggctggagctgtttgagaacacctcggccccctaccagctccagacctttggtgaggattgaagaagccagcagggagaaggtgggggtgggg

SEQ ID NO: 51243 - DNA, 201 bp, Homo sapiens
gccagctgtgggggagcccgctgaggtcacgaccacggtgctggtgaggagagatcaccatggagccaatttctcgtgccgcactgaactggacctgcggscccaagggctggagctgtttgagaacacctcggccccctaccagctccagacctttggtgaggattgaagaagccagcagggagaaggtgggggtggggt

SEQ ID NO: 51244 - DNA, 201 bp, Homo sapiens
ggctgacgtgtgcagtaatactggggaaccagagccaggagacactgcagacagtgaccatctacagtaagaaggggcaggggcggagtggggcttcttgrgggtgtgacctgaacccggggcggggctcactgtgtgcctattccaggctttccggcgcccaacgtgattctgacgaagccagaggtctcagaagggacc

SEQ ID NO: 51245 - DNA, 201 bp, Homo sapiens
acatagcgagaccctgtctctaagaaaaaataaaaaaattagggtacagtggcatatgcttgtattctcaactactctggaggctcaagtgggaggatcayttgaacccaggaatttttttgtttttgtttttgtttttttgagatggagtctcactctgtggcccaggctggagtgcagtggtgccatcttggctcactg

SEQ ID NO: 51246 - DNA, 201 bp, Homo sapiens
atcccttaagcccacgaggctgaggttgcagtgaaccaagattgtgccactgcactccagcctgggagacatagcgagattctgtctcaaaaaacaaagcrttctgatccggactcagacccagatcgcactgctttctagctgagtaaccatttctctctatgaaatgggaatggtcccagaatctcccttggagaatgt

SEQ ID NO: 51247 - DNA, 201 bp, Homo sapiens
ctcctgagtagctgggactacaggcgcccaccaccacgcctggctaattttttgtatttttagtagagacggggtttcaccgtgttagccaggatggtctygatctcctgacctcgtgatccgcccgccttggcctcccaaagtgctgggattacaggcgtgagccaccatgtctggcctggccaggctggtcttgaactc

SEQ ID NO: 51248 - DNA, 201 bp, Homo sapiens
gatcttgagggcacctacctctgtcgggccaggagcactcaaggggaggtcacccgcaaggtgaccgtgaatgtgctctgtgagtgagccggcgggcagarctgggtgggggcaggggccatggacctaatgcaatcctcaccgcctgttgtatcctccccacagccccccggtatgagattgtcatcatcactgtggtag

SEQ ID NO: 51249 - DNA, 201 bp, Homo sapiens
cagcaccgccccttggcccccaggtggctagcgctataaaggatcacgcgccccagtcgacgctgagctcctctgctactcagagttgcaacctcagcctmgctatggctcccagcagcccccggcccgcgctgcccgcactcctggtcctgctcggggctctgttcccaggtgagtcggggtggggattgccgtcgggcc

SEQ ID NO: 51250 - DNA, 201 bp, Homo sapiens
cagcccccggggtcatcgccctgccaccgccgcccgattgctttagcttggaaattccggagctgaagcggccagcgagggaggatgaccctctcggcccsggcaccctgtcagtccggaaataactgcagcatttgttccggaggggaaggcgcgaggtttccgggaaagcagcaccgccccttggcccccaggtggcta

SEQ ID NO: 51251 - DNA, 201 bp, Homo sapiens
tctcaagtagctgggactacaggcacacaacaccacgcctggctaatttttgtatttttaggtagagacggggtttcactatattggccaggctggtcttsaactcctgacctcaggtgatccgcctgcctcggccccccaaagtgttgggattacaggcgtgagccaccacacgcagcctttttgttattagactctgtc

SEQ ID NO: 51252 - DNA, 201 bp, Homo sapiens
tacaggcgtgagccaccacacgcagcctttttgttattagactctgtcattactgactttttttttttttttaatagaaacagggtctttctttcccaggstaaagtacagtggcatgatcacagttcactatagccttaaactcctgggctcaagtgatcctcctgcctcagcctcccaagtagcagggactacaggtgt

SEQ ID NO: 51253 - DNA, 201 bp, Homo sapiens
tgtaatctcagctcactgcaacctctccctcccgggttcaagcaattctcctgcctcagcctcccaagtagctggaattacaggcgcccagcaccacgccyggctaatttttgtatttttagtagagacgggatttcatcatgttggccaggctggtcttgatctcctgaccttgtgatctgcccgcctcggcctcccaaa

SEQ ID NO: 51254 - DNA, 201 bp, Homo sapiens
actgtcctttccccatccagtgcctcccaaatctctcttagtccccaaatgtatccccgccctaaggggcgctggtgggaggagctaaatgtgggggcggrgctcggagtccagcttattatcatggcatctcagccagggctggggtaggggtttgggaagggcaacccagcatcccccgatcccagagtcgcggccggg

SEQ ID NO: 51255 - DNA, 201 bp, Homo sapiens
cgaacattcccagcagcttctggaaaccccagggaaacctctttgaaggtcttttctgcatctctgcctgataggtctttttttttttttttttttttttytttttttgacacacagtcttgctctgtcgcccaggctggatcactgcaacctccatctcccgggttcaagcagttctcctgcctcatcctctccagtagc

SEQ ID NO: 51256 - DNA, 201 bp, Homo sapiens
aggcattctgggcaggaggaacagcctgggcaaaagttgggagcagggagaaatcttgatggaggcaggaggaggaggaggtaggttggtgtaggccaggygcagtggctcacacctgtaatcccagtgctttgggaggccaaagcaagaggattgtttgagcccaggagttcgagaccagcctgggcaacatagcgagac

SEQ ID NO: 51257 - DNA, 201 bp, Homo sapiens
ggaccagaatctgagtcctgatgtcaccctcgaaggggacgcattcgtggccactgccacagccacagctagcgcagagcaggagggtgccaggcagctgrtctgcaacgtcaccctggggggcgaaaaccgggagacccgggagaacgtgaccatctacagtaaggaaggaggcggggtctccgcggctccgaggtggga

SEQ ID NO: 51258 - DNA, 201 bp, Homo sapiens
cacaagtaaacctcagcctctcaagtagctgggactacaggcacacaacaccacgcctggctaatttttgtatttttaggtagagacggggtttcactatrttggccaggctggtcttgaactcctgacctcaggtgatccgcctgcctcggccccccaaagtgttgggattacaggcgtgagccaccacacgcagccttt

SEQ ID NO: 51259 - DNA, 201 bp, Homo sapiens
cctcaggtgatccgcctgcctcggccccccaaagtgttgggattacaggcgtgagccaccacacgcagcctttttgttattagactctgtcattactgactttttttttttttttaatagaaacagggtctttctttcccaggctaaagtacagtggcatgatcacagttcactatagccttaaactcctgggctcaagtg

SEQ ID NO: 51260 - DNA, 201 bp, Homo sapiens
ctcaggtgatccgcctgcctcggccccccaaagtgttgggattacaggcgtgagccaccacacgcagcctttttgttattagactctgtcattactgactttttttttttttttaatagaaacagggtctttctttcccaggctaaagtacagtggcatgatcacagttcactatagccttaaactcctgggctcaagtga

SEQ ID NO: 51261 - DNA, 201 bp, Homo sapiens; identical to SEQ ID NO: 14808

SEQ ID NO: 51262 - DNA, 201 bp, Homo sapiens
ggcttatctcgaactcctgacttcgtggatccaccctccttggcctcccaaagtgctgggattaaaggcgtgagccaccgcgccctgccaacctttttttratttttcttagagatgggggtctccctatgttgcccaggcttgtcttgaactcctggcctcaagtgaccctcttgccttggcctcacaaagtgctaggat

SEQ ID NO: 51263 - DNA, 201 bp, Homo sapiens; identical to SEQ ID NO: 14809

SEQ ID NO: 51264 - DNA, 201 bp, Homo sapiens; identical to SEQ ID NO: 14813

SEQ ID NO: 51265 - DNA, 201 bp, Homo sapiens; identical to SEQ ID NO: 14814

SEQ ID NO: 51266 - DNA, 201 bp, Homo sapiens; identical to SEQ ID NO: 14815

SEQ ID NO: 51267 - DNA, 201 bp, Homo sapiens
accttttgggctcaagtgatcctcccacctcagcctcctgagtagctgggaccataggctcacaacaccacacctggcaaatttgattttttttttttttycagagacggggtctcgcaacattgcccagacttcctttgtgttagttaataaagctttctcaactgcctcagccttgtgtgagttgaggggaggtgtcac

SEQ ID NO: 51268 - DNA, 201 bp, Homo sapiens
gggctcaagtgatcctcccacctcagcctcctgagtagctgggaccataggctcacaacaccacacctggcaaatttgatttttttttttttttcagagayggggtctcgcaacattgcccagacttcctttgtgttagttaataaagctttctcaactgcctcagccttgtgtgagttgaggggaggtgtcacatccagc

SEQ ID NO: 51269 - DNA, 201 bp, Homo sapiens
ctattaaaaatacaaaaattagctgggcgtggtggtgcttgcctgtaatcccagatactctggaggctgaggcaggagaatcacttgaacccgggaggcaraggttgcagtgagctgagattgcgccactgcactccagtctgagtgacaaagcgagactccatctcaaaaaaaaaaaaaataaaagaacacatctttagc

SEQ ID NO: 51270 - DNA, 201 bp, Homo sapiens; identical to SEQ ID NO: 14818

SEQ ID NO: 51271 - DNA, 201 bp, Homo sapiens; identical to SEQ ID NO: 14820

SEQ ID NO: 51272 - DNA, 201 bp, Homo sapiens; identical to SEQ ID NO: 14821

SEQ ID NO: 51273 - DNA, 201 bp, Homo sapiens
aggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagtaagaaggggcaggggcgga

SEQ ID NO: 51274 - DNA, 201 bp, Homo sapiens
agccgggaaggggtgatcagatggtccacagggaatatcacaaactcgaattctgacgatgttctggtagtcacccagccagatgagcgcatggagttggsggtggggggtgtcaaagcttggggcccggaagcggagtcaaaagcatcaccctcggtcccttgttctcgcgtggatgtcagggcccccacccaccgagca

SEQ ID NO: 51275 - DNA, 201 bp, Homo sapiens
gtgatcctcccacctcagcctcctgagtagctgggaccataggctcacaacaccacacctggcaaatttgatttttttttttttttcagagacggggtctygcaacattgcccagacttcctttgtgttagttaataaagctttctcaactgcctcagccttgtgtgagttgaggggaggtgtcacatccagctggagtcc

SEQ ID NO: 51276 - DNA, 201 bp, Homo sapiens
catccctgtctgctcacacctttcttctctccctagtcctgccagcgactcccccacaacttgtcagcccccgggtcctagaggtggacacgcaggggacmgtggtctgttccctggacgggctgttcccagtctcggaggcccaggtccacctggcactgggggaccagaggttgaaccccacagtcacctatggcaacg

SEQ ID NO: 51277 - DNA, 201 bp, Homo sapiens
tgaggcaggagaatcacttgaacccgggaggcaaaggttgcagtgagctgagattgcgccactgcactccagtctgagtgacaaagcgagactccatctcaaaaaaaaaaaaaataaaagaacacatctttagcatggccttcagtgctcacgggatcttcctgaattaatctccccctcttcatccttgctcactcagct

SEQ ID NO: 51278 - DNA, 201 bp, Homo sapiens
ctttcttctctccctagtcctgccagcgactcccccacaacttgtcagcccccgggtcctagaggtggacacgcaggggaccgtggtctgttccctggacrggctgttcccagtctcggaggcccaggtccacctggcactgggggaccagaggttgaaccccacagtcacctatggcaacgactccttctcggccaaggc

SEQ ID NO: 51279 - DNA, 201 bp, Homo sapiens
cattaccctgtcaccaaagcactgtctattctatcaccctgttttgtttttgtcaaagctcatattaacatcagttattaattatcttgtttgctcataatttttttttttttttttttggagacagagtctcgttctgttgctcaggctggagtgcagtggcacaatcttggctcactgtaacctccacctcccaggttc

SEQ ID NO: 51280 - DNA, 201 bp, Homo sapiens
tgactcagaggcgctgttcccgctccacccagagccctggcaaccgggtccctcagctgttcccgcggttccttccatgagcccagccttgcgtcccggckccgtgttcttcaccgggtgtagggtccttcctgatccttgacccagcctcgtctctcctttgcccttgccgcaaacgcactctcctcgtatcccggcatt

SEQ ID NO: 51281 - DNA, 201 bp, Homo sapiens
accatggtccacggactggcatcttccccactcgcggtccgcgaagactccatctctccaactaccctgactcagaggcgctgttcccgctccacccagarccctggcaaccgggtccctcagctgttcccgcggttccttccatgagcccagccttgcgtcccggctccgtgttcttcaccgggtgtagggtccttcctg

SEQ ID NO: 51282 - DNA, 201 bp, Homo sapiens; identical to SEQ ID NO: 14802

SEQ ID NO: 51283 - DNA, 201 bp, Homo sapiens
gtaaggaaggaggcggggtctccgcggctccgaggtgggaccagaggaatgcgaaggcggggcgaagagtgggcgggacctcagtaccggaacaggcgtgkcccgagggggcggggcaggtgggggcggagacgtaatcgctggggaggaggagcctgtacagcctgagaggcggggcgccgtaccctagttcgttctcag

SEQ ID NO: 51284 - DNA, 201 bp, Homo sapiens
cactttcccactgcccatcggggaatcagtgactgtcactcgagatcttgagggcacctacctctgtcgggccaggagcactcaaggggaggtcacccgcraggtgaccgtgaatgtgctctgtgagtgagccggcgggcagagctgggtgggggcaggggccatggacctaatgcaatcctcaccgcctgttgtatcctc

SEQ ID NO: 51285 - DNA, 201 bp, Homo sapiens; identical to SEQ ID NO: 14804

SEQ ID NO: 51286 - DNA, 201 bp, Homo sapiens
cgtggatgtcagggcccccacccaccgagcagaaggcggactcaggggcgctccagggtggctcgagctcacacacgctgagtagacacgtgcccgctgcmccctgggtaaatacagacccggagccgagcggattctaatttagacgcccgcgaacgctgcgcgcacgcacacgtgtcctcggctcgctggcactttcgt

SEQ ID NO: 51287 - DNA, 201 bp, Homo sapiens
acgtggcgaaaccccgtctctattaaaaatacaaaaattagctgggcgtggtggtgcttgcctgtaatcccagatactctggaggctgaggcaggagaatmacttgaacccgggaggcaaaggttgcagtgagctgagattgcgccactgcactccagtctgagtgacaaagcgagactccatctcaaaaaaaaaaaaaat

SEQ ID NO: 51288 - DNA, 201 bp, Homo sapiens
agcggtctcgcaggagcccttctgggcggacctgcagcctcgcgtggcgttcgtggagcgcgggggctcgctgtggctgaattgcagcaccaactgccctyggccggagcgcggtggcctggagacctcgctgcgccgaaacgggacccagaggggtttgcgttggttggcgcggcagctggtggacattcgcgagccgga

SEQ ID NO: 51289 - DNA, 201 bp, Homo sapiens
ttagcgcacgctcgcctcccgcccccccgccgcctctgccgccgccccctccttggaaaccaagttaccaacgttaaaccaatccccaagcgcaactctgyctcccccacaccccacccgccgcgccgcgcggagccgtcctctagcccagctcctcggctcgcgctctcctcgcctcctgtgctttccccgccgcggcga

SEQ ID NO: 51290 - DNA, 201 bp, Homo sapiens
ccttttgggctcaagtgatcctcccacctcagcctcctgagtagctgggaccataggctcacaacaccacacctggcaaatttgatttttttttttttttyagagacggggtctcgcaacattgcccagacttcctttgtgttagttaataaagctttctcaactgcctcagccttgtgtgagttgaggggaggtgtcaca

SEQ ID NO: 51291 - DNA, 201 bp, Homo sapiens
ccaaggcccaatctccctgaaggtcccataaggtcttgcctccaagtcctgcccccacccacctccatgtcatctcatcgtgtttttccagatggcccccractggacgagagggattgtccgggaaactggacgtggccagaaaattcccagcagactccaatgtgccaggcttgggggaacccattgcccgagctcaag

SEQ ID NO: 51292 - DNA, 201 bp, Homo sapiens
ctggtcaatggcccctatcccccaaggcccaatctccctgaaggtcccataaggtcttgcctccaagtcctgcccccacccacctccatgtcatctcatcrtgtttttccagatggcccccgactggacgagagggattgtccgggaaactggacgtggccagaaaattcccagcagactccaatgtgccaggcttggggg

SEQ ID NO: 51293 - DNA, 201 bp, Homo sapiens
agtaagaaggggcaggggcggagtggggcttcttgggggtgtgacctgaacccggggcggggctcactgtgtgcctattccaggctttccggcgcccaacrtgattctgacgaagccagaggtctcagaagggaccgaggtgacagtgaagtgtgaggcccaccctagagccaaggtgacgctgaatggggttccagccca

SEQ ID NO: 51294 - DNA, 201 bp, Homo sapiens
ttcttctctccctagtcctgccagcgactcccccacaacttgtcagcccccgggtcctagaggtggacacgcaggggaccgtggtctgttccctggacggkctgttcccagtctcggaggcccaggtccacctggcactgggggaccagaggttgaaccccacagtcacctatggcaacgactccttctcggccaaggcct

SEQ ID NO: 51295 - DNA, 201 bp, Homo sapiens
cgagggcccagctcctgctgaaggccaccccagaggacaacgggcgcagcttctcctgctctgcaaccctggaggtggccggccagcttatacacaagaaycagacccgggagcttcgtgtcctgtgtgagtggggctgctggtcaatggcccctatcccccaaggcccaatctccctgaaggtcccataaggtcttgcct

SEQ ID NO: 51296 - DNA, 201 bp, Homo sapiens; identical to SEQ ID NO: 14811

SEQ ID NO: 51297 - DNA, 201 bp, Homo sapiens
tgctgagattacaggcatgagccaccgtgcccggcctttttttttttttttttttttgagacagagtctcactctgtcgcccaggcaggagtgcagtggtkcgatctgggctcactgcaagctccgcctcccgggttcactccatcctcctgccttagcctcctgagtagctgggactacaggcgcccaccaccacgcctg

SEQ ID NO: 51298 - DNA, 201 bp, Homo sapiens
gaaagcagcaccgccccttggcccccaggtggctagcgctataaaggatcacgcgccccagtcgacgctgagctcctctgctactcagagttgcaacctcmgcctcgctatggctcccagcagcccccggcccgcgctgcccgcactcctggtcctgctcggggctctgttcccaggtgagtcggggtggggattgccgtc

SEQ ID NO: 51299 - DNA, 201 bp, Homo sapiens
ataaggacaggcattctgggcaggaggaacagcctgggcaaaagttgggagcagggagaaatcttgatggaggcaggaggaggaggaggtaggttggtgtrggccaggtgcagtggctcacacctgtaatcccagtgctttgggaggccaaagcaagaggattgtttgagcccaggagttcgagaccagcctgggcaacat

SEQ ID NO: 51300 - DNA, 201 bp, Homo sapiens; identical to SEQ ID NO: 14823

SEQ ID NO: 51301 - DNA, 201 bp, Homo sapiens
ttgattgatgggaggaagggtgaggttggcagagccttgaatgccaggtggaggagctgggactttccttcttggggtgatagggagtcatggagggtttstgagcaggccagggattagatagctgaaggctggatttactggaagccaatgagcagttggctatggtccttgtccacgcggcccatgttgtgggcagtg

SEQ ID NO: 51302 - DNA, 201 bp, Homo sapiens
aataccataagattcatcccttttaagcacataattcaatgacttctgtacaaacaaccatgactacaatctaattttaaaatatttcaatcactctaaamaagaaacctcctgcttatgtacagcgactctgtctacctcttaagtgaattctcctacctttaatagccctattttacagttcaggaaactgaggttcag

SEQ ID NO: 51303 - DNA, 201 bp, Homo sapiens
aatgtgctattcaaactgccctgatgggcagtcaacagctaaaaccttcctcaccgtgtactgtgagtaactgagcccggagggctggactaggcagaccsggtgggagagacgtgcaggggcacctgcagaggcctgggggaatctttgccacttgctcgtagggtcaaggaggggctccttgcagggcaggtggggaca

SEQ ID NO: 51304 - DNA, 201 bp, Homo sapiens
tggccaagtgaaagtcagggagaggagggaatggtgtttcaggaagatggaacagcatacacaaaggcccagaggtgagagggatgtggctgtgtgccatygaaagagttttagcttggtaagagtgtgacagtatttcaaagtagggagaggtggtgagaaaagagtatagagaccaggtgtggtgactcacacctgtga

SEQ ID NO: 51305 - DNA, 201 bp, Homo sapiens
cagttattaagggcccattttgtgttagtcactgttcttggctccgggcatgcaagagataacaagacagattcctatcctcaccaggcttagagtcagaygggcagtcatcagacaatgacaggacacagtgatatgtgtttccatgggggacatacaagtagggactcatttgctagccatgttggggtgactggggtc

SEQ ID NO: 51306 - DNA, 201 bp, Homo sapiens
tattttagtagagaccgggtttcaccgtgttagccaggatcgtgatccacccgcctcagcctcccagagtgctgggattacaggcatgagccactgcgccyggccagcaaacagttattaagggcccattttgtgttagtcactgttcttggctccgggcatgcaagagataacaagacagattcctatcctcaccaggct

SEQ ID NO: 51307 - DNA, 201 bp, Homo sapiens; identical to SEQ ID NO: 14845

SEQ ID NO: 51308 - DNA, 201 bp, Homo sapiens
agagagagagagagaaacgtgagctgaggctcagctaggatgataataacaaagacctgccaggtcctgcaaaaagctcagatagatgatagatagatggdtagatagatagatagatagatagatagatagatagatagatagataggatctgttttacagatgcggaaactgaggcctagggaggtgaagtgtgaacca

SEQ ID NO: 51309 - DNA, 201 bp, Homo sapiens; identical to SEQ ID NO: 14846

SEQ ID NO: 51310 - DNA, 201 bp, Homo sapiens
agagagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgtt

SEQ ID NO: 51311 - DNA, 201 bp, Homo sapiens; identical to SEQ ID NO: 14847

SEQ ID NO: 51312 - DNA, 201 bp, Homo sapiens
gagagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgtta

SEQ ID NO: 51313 - DNA, 201 bp, Homo sapiens
agagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttac

SEQ ID NO: 51314 - DNA, 201 bp, Homo sapiens
gagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttact

SEQ ID NO: 51315 - DNA, 201 bp, Homo sapiens
agaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttactc

SEQ ID NO: 51316 - DNA, 201 bp, Homo sapiens; identical to SEQ ID NO: 14852

SEQ ID NO: 51317 - DNA, 201 bp, Homo sapiens; identical to SEQ ID NO: 14853

SEQ ID NO: 51318 - DNA, 201 bp, Homo sapiens
aaggagaagggaggccgtagcccagtgacaacccttccttcctaccccatggggcctgcccctcctgataccaggagtcagggtttctcctgtgacgcacycccaggcctgaaggggcacctcttgaggaggcatggcccctggagccagtgagagggcaggggtgtcccctggtcctgctcccgtctttccaacctgggt

SEQ ID NO: 51319 - DNA, 201 bp, Homo sapiens
aggggatcgcggccggggcgagggcgcgggggcagaagcggccgccgaaggggcgtagggagaaaacgtgggaacaagaggagagagatggagcgatgagrggccgccagggaagagatgacgaacagatgcgggctggggaatggaggcgcgggggtccgaggccatggaaacgggcgagttgccgggggaacgcccgag

SEQ ID NO: 51320 - DNA, 201 bp, Homo sapiens; identical to SEQ ID NO: 14856

SEQ ID NO: 51321 - DNA, 201 bp, Homo sapiens
tagatagatagatagatagatagatagatagataggatctgttttacagatgcggaaactgaggcctagggaggtgaagtgtgaaccagagttgttactcrgctgtctgactctagagccactctttgttctgtggcaggcctgaattgtgggctcaatcatttggattttattctgtagtcaatagagagccactgaagc

SEQ ID NO: 51322 - DNA, 201 bp, Homo sapiens; identical to SEQ ID NO: 14841

SEQ ID NO: 51323 - DNA, 201 bp, Homo sapiens
tctaccacgaggtgcacaggccctctcacttcctcaactttgctctcctgcaggagggggaggtttactctgcggatcgggaggacctgtatgcctgaccrtttccctgcctcctgcttcagcctcccgaggccgaagcctcagcccctccagacaggccgctgacattcagcagtttggcctctttccctctgtctgtgc

SEQ ID NO: 51324 - DNA, 201 bp, Homo sapiens
tattctgtagtcaatagagagccactgaagccactgaagtagaggcagtcaccctgtcacaccctgccaaggtgacccaggtcaccgtgggtctcatgtaytgaccagtgtccctaccctcctccctcaggccagcgagagatggagctaccgtgtccaggatgaagctgcaggtctgggggacactgaccagcttgggct

SEQ ID NO: 51325 - DNA, 201 bp, Homo sapiens
ccccttcaaccacagcttcatcgagccgccctctgccggctgggccactgatgactccttctcatccgatcctgagtctggagaggcagatgaggttcctrcctactgtgtgccaccccaagaaggtagccccccaacagcccacatagcccctgagcagccctgcccaccacgaccccctctttagtcctccagcaaagt

SEQ ID NO: 51326 - DNA, 201 bp, Homo sapiens
agccctgccattgcctttctttccctttctttttttgagtgtcagtctttccagccaccccctccctctcagggaggtgcctcgtggcagcccgcccctcyggcctggtttcctcaggaaaagccctgagaggaagcagggagggggttgggagctgtgggggccagacgaacccgagcgctcccaccgagctgcctgcca

SEQ ID NO: 51327 - DNA, 201 bp, Homo sapiens; identical to SEQ ID NO: 14849

SEQ ID NO: 51328 - DNA, 201 bp, Homo sapiens
tctgtactcctctttacctataggagatggaacccttaggttggatccacactcagcccaatgagtccccgcagttatcaccccaggatgtcaccacccaygccaagatcatggctgacaacccatcttgggatggcgagaagaccattatcatcacatgcaggtgggcctgggctccttgggaggaagtatggtggggca

SEQ ID NO: 51329 - DNA, 201 bp, Homo sapiens
ggcatctccactgctggcatccccatggctggcatcaccagggctttctccctccctgccccttttctttagggagctgctcacagaccaccgggtccccrgccttctgctcgaggccatgaaggtggctgtccggaagcagcggaagaagatcaaggccaagatgttagggacaccagaggaagcagagagcaggtaggt

SEQ ID NO: 51330 - DNA, 201 bp, Homo sapiens; identical to SEQ ID NO: 14850

SEQ ID NO: 51331 - DNA, 201 bp, Homo sapiens
tggcatctccactgctggcatccccatggctggcatcaccagggctttctccctccctgccccttttctttagggagctgctcacagaccaccgggtcccyggccttctgctcgaggccatgaaggtggctgtccggaagcagcggaagaagatcaaggccaagatgttagggacaccagaggaagcagagagcaggtagg

SEQ ID NO: 51332 - DNA, 201 bp, Homo sapiens
cttgatcaatggccctcacttctcctctctcctctgtctcagtgaggatgaggctggcccatggatcctgctctccgatgacaagggagaccatcccccayccccggagtccaaaatacagagtttgtatgttggggaaaggggaaaggcaagagtgtggggagggaggaagggccctggctggtccttctcaggatcccc

SEQ ID NO: 51333 - DNA, 201 bp, Homo sapiens
agagtgggaacaagggaaggcttcctggagggggtgtcatttgagacaggtgggccgggcgcagtgactcacgcctgtaatcccagcactttgggaggccraggtgagtggatcacctgaggtcaggagttcaagaccagcctggccaacatggtgaaaccccgtctctactaaaaatacaaaattagccgggtgtggtgg

SEQ ID NO: 51334 - DNA, 201 bp, Homo sapiens
aggaacagtgaagagcagagcagtctcctccacatgtgggggtagagcagagtgggaacaagggaaggcttcctggagggggtgtcatttgagacaggtgsgccgggcgcagtgactcacgcctgtaatcccagcactttgggaggccgaggtgagtggatcacctgaggtcaggagttcaagaccagcctggccaacatg

SEQ ID NO: 51335 - DNA, 201 bp, Homo sapiens; identical to SEQ ID NO: 14855

SEQ ID NO: 51336 - DNA, 201 bp, Homo sapiens
cagttcagctccagccaagctcttctgtctcctctgccagggatggtccctgtggcccaggcagggtcgtcagaggccagcctggctgcaggtgctttccygccccctgaggacgcctccacgccattcgccatcccgcgcacctccagcctagctcgggccaagcggccatcggtctccttcgcggaaggtaccaagttt

SEQ ID NO: 51337 - DNA, 201 bp, Homo sapiens
gaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttactca

SEQ ID NO: 51338 - DNA, 201 bp, Homo sapiens
gtgccgctagtggtgcgggcgctggagctcttggaacaggctgccgtggggcccgccccggactcggtgagtcatggccctcccttcgccacccacggggycggcagggccgaagcctgagacccgggtctccccagctgcaggtgtcggcgcagccggcggagcaggagctgcggcggctgcgggaggagaacgagcgcc

SEQ ID NO: 51339 - DNA, 201 bp, Homo sapiens
tgtcagtctttccagccaccccctccctctcagggaggtgcctcgtggcagcccgcccctccggcctggtttcctcaggaaaagccctgagaggaagcagkgagggggttgggagctgtgggggccagacgaacccgagcgctcccaccgagctgcctgccatggggctggggctgctgctcccgctgctgctgctctgga

SEQ ID NO: 51340 - DNA, 201 bp, Homo sapiens
tagtcaatagagagccactgaagccactgaagtagaggcagtcaccctgtcacaccctgccaaggtgacccaggtcaccgtgggtctcatgtactgaccartgtccctaccctcctccctcaggccagcgagagatggagctaccgtgtccaggatgaagctgcaggtctgggggacactgaccagcttgggctccacgct

SEQ ID NO: 51341 - DNA, 201 bp, Homo sapiens
ctgccctgccgttccctcagctcccacaagctaccctgggtgacaggtcagtgggcgctgggggccggggtctgggattggacagggctttgcatcaggtyctgcaggcgcctgatctggagtctctacagtctcacatcacgacccggaggtccccttcaaccacagcttcatcgagccgccctctgccggctgggccac

SEQ ID NO: 51342 - DNA, 201 bp, Homo sapiens
ggcgagaagaccattatcatcacatgcaggtgggcctgggctccttgggaggaagtatggtggggcagggattgcaggccagggcccagaacagtggcctragctgttactctgtcctcgttcctcccccagcttcacgccaggctcctgtacactgacggcctacaagctgacccccagtggctacgaatggggccgcca

SEQ ID NO: 51343 - DNA, 201 bp, Homo sapiens
catccgtgagtagccaggacagaccctcagccaaggagaagggaggccgtagcccagtgacaacccttccttcctaccccatggggcctgcccctcctgawaccaggagtcagggtttctcctgtgacgcacccccaggcctgaaggggcacctcttgaggaggcatggcccctggagccagtgagagggcaggggtgtcc

SEQ ID NO: 51344 - DNA, 201 bp, Homo sapiens; identical to SEQ ID NO: 14842

SEQ ID NO: 51345 - DNA, 201 bp, Homo sapiens
tgccccacctgtgttcaggggtcctgtgatactgtgacaggggactgtgtctgcagtgccggctactgggggcccaggtaaggatggggatcccgggggcrggagagtgccaggggcctaggtcagggctctgtgcagcatttcctgaacttccctggacagtgcccagaaatctccctgcccgtctcctgcctgcctccc

SEQ ID NO: 51346 - DNA, 201 bp, Homo sapiens
gaaggctgcggggtgcagtagccagggaaaggcgggcccttcacatgggctccagggcaagttcctcaccagggagtctgggcccacttcagagatattcttttttttttttttttttcccttaagacgaggtcttgctctgtcacccaggccagagtgcagtggtgtgatgtcagctcactgcaacctccacctcccagg

SEQ ID NO: 51347 - DNA, 201 bp, Homo sapiens
ttccctcagctcccacaagctaccctgggtgacaggtcagtgggcgctgggggccggggtctgggattggacagggctttgcatcaggtcctgcaggcgcytgatctggagtctctacagtctcacatcacgacccggaggtccccttcaaccacagcttcatcgagccgccctctgccggctgggccactgatgactcct

SEQ ID NO: 51348 - DNA, 201 bp, Homo sapiens
ggattggacagggctttgcatcaggtcctgcaggcgcctgatctggagtctctacagtctcacatcacgacccggaggtccccttcaaccacagcttcatygagccgccctctgccggctgggccactgatgactccttctcatccgatcctgagtctggagaggcagatgaggttcctgcctactgtgtgccaccccaag

SEQ ID NO: 51349 - DNA, 201 bp, Homo sapiens
aactcagagcaaagacaggatgtgtaggagacaggaaggcctgaatatcccccgtttctggctcccccaggctctggcagtcgggacactgccctcatcgygggcagccttgtgcctctgctgctgctcttcctgggtcttgcctgctgtgcctgctgctgctgggccccccgatcagacctcaaggacaggtgaacgcca

SEQ ID NO: 51350 - DNA, 201 bp, Homo sapiens
ggcccgccccggactcggtgagtcatggccctcccttcgccacccacggggccggcagggccgaagcctgagacccgggtctccccagctgcaggtgtcgrcgcagccggcggagcaggagctgcggcggctgcgggaggagaacgagcgcctccgcagggagctgcgcgcggggccacagggtaagcgcagccccggcca

SEQ ID NO: 51351 - DNA, 201 bp, Homo sapiens
ctgcggctggcatctccactgctggcatccccatggctggcatcaccagggctttctccctccctgccccttttctttagggagctgctcacagaccaccrggtccccggccttctgctcgaggccatgaaggtggctgtccggaagcagcggaagaagatcaaggccaagatgttagggacaccagaggaagcagagagc

SEQ ID NO: 51352 - DNA, 201 bp, Homo sapiens
ggcctgaatatcccccgtttctggctcccccaggctctggcagtcgggacactgccctcatcgtgggcagccttgtgcctctgctgctgctcttcctgggycttgcctgctgtgcctgctgctgctgggccccccgatcagacctcaaggacaggtgaacgccagcccgtcccttccccacacagctcaggccacagggtg

SEQ ID NO: 51353 - DNA, 201 bp, Homo sapiens; identical to SEQ ID NO: 14854

SEQ ID NO: 51354 - DNA, 201 bp, Homo sapiens
ctgtcacccctgagtgtggccctggcgctgtctcacctggcactaggtaccctggcaccacttgtccagaccaagagagctggaggccagtaggaactcastactccagtggttctccgcgggcggttcctccaccagggtcacgtggctgtttggtaaaaatgcagattcctaggccggggcggtggctcacgcctgtaa

SEQ ID NO: 51355 - DNA, 201 bp, Homo sapiens; identical to SEQ ID NO: 14879

SEQ ID NO: 51356 - DNA, 201 bp, Homo sapiens
gggacaaggccctgctgtcctcaggcacaggggctgtgacaaggccttcaacacagaacctggagctgaccccttgacctccctgacccctgatctgtccytgcaggagcctggtggccagactgccctgaagagtcccccaggagtctgcagcagagaccccaccccagagcagacccacaggctggcccgggccatgat

SEQ ID NO: 51357 - DNA, 201 bp, Homo sapiens
acctgccccaacctcatcctgtcacccctgagtgtggccctggcgctgtctcacctggcactaggtaccctggcaccacttgtccagaccaagagagctggaggccagtaggaactcactactccagtggttctccgcgggcggttcctccaccagggtcacgtggctgtttggtaaaaatgcagattcctaggccggggc

SEQ ID NO: 51358 - DNA, 201 bp, Homo sapiens; identical to SEQ ID NO: 14857

SEQ ID NO: 51359 - DNA, 201 bp, Homo sapiens
agtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtaccctggcaccacttgtccagacc

SEQ ID NO: 51360 - DNA, 201 bp, Homo sapiens
ggaattccagacgctgggaagcgctgtggagggaaagctgaaaaagaaggtgattttggccgggagcggtggctcacgcctgtaatcccagcactttgggwggcccaggcaggtggatcataaggtcaggagtttgagaccagcctggccaagatttgaaaccccgtttctactaaaaatacaaaaattagccaggcgtgg

SEQ ID NO: 51361 - DNA, 201 bp, Homo sapiens; identical to SEQ ID NO: 14882

SEQ ID NO: 51362 - DNA, 201 bp, Homo sapiens
ccatctcaaaaaaaaattataataactaaaataaataaataaagcatctatccttcagccatttgctaagcagctgctgtattccaggcactgtaccaggyaccgggagcccaccatgtacaaacagctgagtctaatggggtgggcagacgagcaatcacatacttactacagcataagcgataagacagagagggcttc

SEQ ID NO: 51363 - DNA, 201 bp, Homo sapiens
ctacgggaaagagaccttagatcaattggatgccagctagcattccctggggtcttggcctccaccgctgtctcatccttgaatggattctgggtgggacrggcaacgggctgggggtgcagagcccaagctggtccccatcgacgtgacccctgccctctgccccaagctggtccccgtcgacgtgacccctgccctctg

SEQ ID NO: 51364 - DNA, 201 bp, Homo sapiens
ggtggctcacgtctgtaatcctagcactttgggaggccaaagagggtggatcacctgaggtcatgagtttgagaccagcctggccaacatggccaaacccrtctccactaaaaatacaaaaattagccgggcgtggtggcgcatgcccataatcccagctacttgggaggctgaggcaggagaattgcttgaacctgggag

SEQ ID NO: 51365 - DNA, 201 bp, Homo sapiens
gaagcagaaagatggccagtgtgaccagagtgtgacaaagtcagagaaaaccaggaagatggagctggagacacaggcggggccagatcacgagggtcctygcagaccagagcaagggtttggattttattccaagtatgaagggaagctgctgaagtgtgttttcctttacaatttgtagttgaaatataatatgcaaag

SEQ ID NO: 51366 - DNA, 201 bp, Homo sapiens
ctaaaaaaaaaaaaagatccaggaggaggttcctaggagaattgcaggggttggggaaaacacaagcccagatttcaaaaatgctacgggaaagagacctyagatcaattggatgccagctagcattccctggggtcttggcctccaccgctgtctcatccttgaatggattctgggtgggacaggcaacgggctgggggt

SEQ ID NO: 51367 - DNA, 201 bp, Homo sapiens
ccaggatgtacctgcagaaaggtaggcgctgatggcagggagctccctcagtcctgccctgggtggaggagggtgagagcaaggggctgggcctctggtakcgagtaggggcgtgtctggctgtggagcctggagccctgggaacagcttgtgctgcctccgtgcaggatttcccatcaaagaagatttcctggaacaatc

SEQ ID NO: 51368 - DNA, 201 bp, Homo sapiens
ctccgtctcaaaaaataaacaacaaaaaatcccaaaaagacggtcttattttggtcctcaccatgcatgtgagaagagtgagggacttgtgccaccgtttkacaaggtaaggccaagcctggtggagttacgggaaatgccgaggtcctttggcaagaggtagcctggattcagacacagatctgattcacagcgcagggc

SEQ ID NO: 51369 - DNA, 201 bp, Homo sapiens
ctggtgattcttatgcaagagtttgctagctacactctttcccactgtgctggagggtctcactgtgggaaacggaagcccagagagggaaggtaacttgyggggggtgaggtcacccagcctgtcagccacaggggtgagagccacgcagaacagatccgtggctgtggaaggatggcgtgtggtcccgtggacgtcctc

SEQ ID NO: 51370 - DNA, 201 bp, Homo sapiens
gacagtgcgagactccaactcaaaagaaaagaaaaaaaaagaaatcttaagccaaatcacaatatatttacacagctggcaaagtcacaagagggaggtgwgggagggtggggcgggcagcactcggcagtggctcacccacagaacccagctgtggtatgacagccagtgaccctgtctgtggtacatctggagaagctg

SEQ ID NO: 51371 - DNA, 201 bp, Homo sapiens
gagggttgaatatgagcccccagaccctctgtcctagaggaagttggggtggcccggggaatggggctctgctttgctgcccaagacctcgcattgcaaggagagtctgggtagagagcctgggatggcatgtgagcctcgctggcttccctggaaggggaaggaggagaagctggggtgtcacactgttaaagaaatgct

SEQ ID NO: 51372 - DNA, 201 bp, Homo sapiens
acccccgtctctgctaaaaatacaaaaaaattagctgggcgtagtggcgggcacctgtagtcccagctactcgggaggctgacgcaggagaatggcgtgarcccgggaggcggtggagcttgcagtgagcggaggtcgtgccactgcactccagcctgggcgacagagcgagactccgtctaaaaaaaaaaaaagatccag

SEQ ID NO: 51373 - DNA, 201 bp, Homo sapiens
tcgcccagactggagtgcagtggtgcaatctcggttcactgcaatctctacctcccgggttcaagggattctcctgcctcagcctcccgagtagcttggamtacaggcgcccgccaccatgcccagctaatttttgtatttttagtagagacggggtttcaccatattggccaggatggtctcaatctcctgacctcgtga

SEQ ID NO: 51374 - DNA, 201 bp, Homo sapiens
cctggctaacacggtgaaacccccgtctctgctaaaaatacaaaaaaattagctgggcgtagtggcgggcacctgtagtcccagctactcgggaggctgasgcaggagaatggcgtgaacccgggaggcggtggagcttgcagtgagcggaggtcgtgccactgcactccagcctgggcgacagagcgagactccgtctaa

SEQ ID NO: 51375 - DNA, 201 bp, Homo sapiens
actacaggcatgcaccaccacgcctggctaattttgttcgtttgtttgtttgtttttgagacggagtttctctctatcgcccagactggagtgcagtggtrcaatctcggttcactgcaatctctacctcccgggttcaagggattctcctgcctcagcctcccgagtagcttggaatacaggcgcccgccaccatgccca

SEQ ID NO: 51376 - DNA, 201 bp, Homo sapiens
cctgagtgtggccctggcgctgtctcacctggcactaggtaccctggcaccacttgtccagaccaagagagctggaggccagtaggaactcactactccartggttctccgcgggcggttcctccaccagggtcacgtggctgtttggtaaaaatgcagattcctaggccggggcggtggctcacgcctgtaatcccagca

SEQ ID NO: 51377 - DNA, 201 bp, Homo sapiens
actgtgctggagggtctcactgtgggaaacggaagcccagagagggaaggtaacttgtggggggtgaggtcacccagcctgtcagccacaggggtgagagycacgcagaacagatccgtggctgtggaaggatggcgtgtggtcccgtggacgtcctcgtcacgggtatccaggagggactggagtgggcagtgggggtga

SEQ ID NO: 51378 - DNA, 201 bp, Homo sapiens
ctgaccattccttgaccgtctggaaggagctggagcagaagcccacccatcactacaagtcagcatccgaccccatccacacctttgacctgtacggcagygaggtggtcactggcaccgtgtccaacaagattggcgtctgctccctgcttgagccaccctcgcaggccaccacgaagctcagctctgagaacttccgcg

SEQ ID NO: 51379 - DNA, 201 bp, Homo sapiens
ggggcgttggcatggagggagggcttggctccgaggggacctcctatcctcatccctttctccacagttctcccctgtgagcgccatggagcccttgggcyggcaggtactggggagtgaggagcctgtgatggggggaaggtcccgggggtctcactggtggcttgggcagggtggggggcctgtgggaagggtcggtct

SEQ ID NO: 51380 - DNA, 201 bp, Homo sapiens
gctgctcggcctgctccttgggtaggagaggaggagggagctgcctccctggctgaggggtctgggatttattcaggaggcctgtcactccccagcctctyctgggacttgaaaaactggagcctgttcttggcaagaagattctaatgcccaggtcggagtcggggccctggccaagggctcttgtgtgggatgggggtg

SEQ ID NO: 51381 - DNA, 201 bp, Homo sapiens
ggtggatcacgaggtcaggagttcaagaccagcctggccaacatggtgaaactctctctactaaaaatacaaaaaatttagctgtgcgtggtggtgcgcasctgtaattccagctactcaggaggctgaggcagagaactgtttgaacctgggagttggaggttacagtgagccgagatggcgccactgcactccagcctg

SEQ ID NO: 51382 - DNA, 201 bp, Homo sapiens
cagtggttctccgcgggcggttcctccaccagggtcacgtggctgtttggtaaaaatgcagattcctaggccggggcggtggctcacgcctgtaatcccarcactttgggaggctgaggcgggtggatcacgaggtcaggagttcaagaccagcctggccaacatggtgaaactctctctactaaaaatacaaaaaattta

SEQ ID NO: 51383 - DNA, 201 bp, Homo sapiens
aggacttggcgttatctgtgatcgcgtgggtaggattccctggcgggcgtggggatgtgagatgggaacagagctttctgtccctgccacaggaacatggygctgctctgggggctcctggtgctcagctggtcctgcctgcaaggcccctgctccgtggtgaggctgggctgaagtcaaggtggggtggggtggaggggg

SEQ ID NO: 51384 - DNA, 201 bp, Homo sapiens
gctggagtgcagtggcttgatcttggctcatggcaacctctgcctcccgggttcaagcaattctcctgcctcagcctcccgagttgctgcgattacaagckcccgtcaccacagaagcccagctcatttttgtatttttagtagagatgaggttttgccatgttggtcaggctggtcttgaactcctgacctcaggtgatc

SEQ ID NO: 51385 - DNA, 201 bp, Homo sapiens
ggtcaggctgggcagggcgggtaaggaggaagcgtctggctggcagtggagctgagtcagagctgtcctgtgtcctgctcttttccagggcttcgggagcrgggagagggttgaatatgagcccccagaccctctgtcctagaggaagttggggtggcccggggaatggggctctgctttgctgcccaagacctcgcattg

SEQ ID NO: 51386 - DNA, 201 bp, Homo sapiens
cctcctggccacaaaccatccccaaggatgagccatcacagaaaccatgggcacactgacgggcctaaaggccaaacaggaaaggggagagatagagagasaaggagagaagaagggaggagaggaggaggaaaacggaatggcccacgggagggaagtggaagacagtccatggggctctcggcacctgttggaaaaaat

SEQ ID NO: 51387 - DNA, 201 bp, Homo sapiens
agtgtgatttcattgcccgaaaagtcctccgtgctccgtctgttcgtccctctctgaggtgctttcagtggaaagccccctagctgctgtgggaagaattsggggaggggttccctgatgtggcctcccccggcctcgctgcagctttctcccttgtttcacagtgctggcctacatgcagttgctggaggactactcgga

SEQ ID NO: 51388 - DNA, 201 bp, Homo sapiens
ttgactctcagggatgtattagtttgcttttgctgcataacaaaccacccaaaacttggtggcttaaaataatagtgagcatttgtcactgcttaggacasggggtagcaggatgggtgtgctgctctggcccaggcttggccaattttggctgaactcactgacatccctgggacctgagctgagacaatggggctgatt

SEQ ID NO: 51389 - DNA, 201 bp, Homo sapiens
tgctccgtctgttcgtccctctctgaggtgctttcagtggaaagccccctagctgctgtgggaagaattgggggaggggttccctgatgtggcctcccccrgcctcgctgcagctttctcccttgtttcacagtgctggcctacatgcagttgctggaggactactcggagccgcagccctctatgttctaccagacgcca

SEQ ID NO: 51390 - DNA, 201 bp, Homo sapiens
tggcagggccctggttttgggcgtggaaggcaccatctcccacacagatgcttttacttcctccttagatgctcaccagcagcccagcgcccactccaccwcctccccaccctggggtgcagggacctttcttttccacagcagccccgcgcagcagggacaggcttgtactcagggtgtttgctctctctgctgacagtc

SEQ ID NO: 51391 - DNA, 201 bp, Homo sapiens
gttctgagagtttccttccctcgtggctgcccaaggtgacctcttacctcacgtgctagcgggtctccccgagccagtcctgcatcacacaaggaacttgyccagccccctggtacttggggcccatgcttgtcaggaaaggctctgctttcatcctcccatgctccacctgcagattcgaagccccctttgggccttcac

SEQ ID NO: 51392 - DNA, 201 bp, Homo sapiens
atgtgcagccatgcttgtgacagatgtatggctcctctccccacacatggcatcacacagtattccagtgtcctcacacgtggctgcgcattagaacaacytgaggatgcacggccacccagggaccttgagagccttggtgtaaagaagttcagaaagtgcttcctgagcgtggaccatgggcgagaggaaatatgtgtt

SEQ ID NO: 51393 - DNA, 201 bp, Homo sapiens
aagcaccctgtggcaggtaacaaagcaagctccttgggcaggtgcatcctgcaagccagagactgcaccagcatcacgagcagctgggagccccgtggctyaggcccgtggagcccagcctgccaagcagggcttggcagggagaggccgtgtgggggtgctttgtggttgcacggctctgctctcaggtgtcaggacctg

SEQ ID NO: 51394 - DNA, 201 bp, Homo sapiens
cgaacagggccaggcaggagcccatcttccgggatgtcgtatacacgcaagcgctggctgcccaggcacaatgagtactgtggggtgtttctccacaaaayggcctgaagtcccctgtgaccaggggttgggctgacactcgttgaaaaggacagaatccctgctggccagggccaggacccacacctggctgggtgtttg

SEQ ID NO: 51395 - DNA, 201 bp, Homo sapiens
ggggggttgtcctggacctctgttcctggccctagtcacagctctttttggctctacgctgggtggcctctgtttgcccacatggaagcaagacttgcttcttaagaggcaggtgggttggtggcaggtgtgcagcgtcagaagtcattgaatatttctgtctgtaatgctttgctctcctttaaggaagggccccacaga

SEQ ID NO: 51396 - DNA, 201 bp, Homo sapiens
caggagagaagccacccagccctggggagggcgaggtcacatgctatctttagttggtcctccctgagtacagggcagagcaaaggcagctccgagtcagragtgacgccactcagtgtgtgcctgggaagctcctctggctgcaccgccgaacagggccaggcaggagcccatcttccgggatgtcgtatacacgcaagc

SEQ ID NO: 51397 - DNA, 201 bp, Homo sapiens
tcattgcatttagtcattacagctctttaatgtcttataactttttttttttttttttttttttttgagacggagtctcactctgtcgcccaggctagagygcagtggcgcgatctcggctcactgcaacttccgcctcccgggctcaagcgattctcccgcctcagcttcccaagtagctgggactacaggcatgtgcca

SEQ ID NO: 51398 - DNA, 201 bp, Homo sapiens
gagtgtgatttcattgcccgaaaagtcctccgtgctccgtctgttcgtccctctctgaggtgctttcagtggaaagccccctagctgctgtgggaagaatbgggggaggggttccctgatgtggcctcccccggcctcgctgcagctttctcccttgtttcacagtgctggcctacatgcagttgctggaggactactcgg

SEQ ID NO: 51399 - DNA, 201 bp, Homo sapiens
gtctctccaccctgcacccaggccctggatttcctcatgaggtccctcctggaccctcaggagagaacccgcccaacgcacctgctcccatggtatcttargtccagtctccagcaggccgtgctctcagccgccagccatggtggaggctgtgtggaggctggaatgggagaggccacctctccctcgctcctcagtgtt

SEQ ID NO: 51400 - DNA, 201 bp, Homo sapiens
acaaaatgctactagctttccatttacttgtctgtttttagggaaaggtacaaagccctttgcaagtgtggaggtgacagattcaggacaagtgtctgttyggttgcatgtggtgccgatgacagaagcctggtctctagcctgttaaagtgcctgtagcgcttcgtccaactcagagaaatgctgccttgcagattggag

SEQ ID NO: 51401 - DNA, 201 bp, Homo sapiens
tgcctgctcaggaggtagctgagacttgccatccctgcacccgccatgtgccctcgcttgagtccccagttcacattagggttccccattggtgttgcgcrtctgccggtctggacgtgtctcctccgttagcgcatcagacagagtgtgatttcattgcccgaaaagtcctccgtgctccgtctgttcgtccctctctga

SEQ ID NO: 51402 - DNA, 201 bp, Homo sapiens
ttctggatgccagtgctttacatgcaggaagatgggcacattgtgagcgctcagtgagtggtcaccaggagtcagtcctccactccacgaccctcagccgrccacatggctatttctttaacccgtgctccacatatgagaaattctctccctttgccgacacattcaagaagcgcgtcagcaagaacacgttcttcgtgc

SEQ ID NO: 51403 - DNA, 201 bp, Homo sapiens
tgggctcaagcaatccacctgccttggcctcccaaagagctgagactgcaggtgtgagccaccatgcccagcctacttcatttgttaaaaaaaaaaaaaaagaaagaaagaaagaaaaaaatggggtaggaagagaaatggactcagacatcgttagcatttccatagtgcagcttgccagccacgcttaaggtttgtgcc

SEQ ID NO: 51404 - DNA, 201 bp, Homo sapiens
tcagctccacctggcagctgctcgtggcacttgcgacatgcctcgaggggaaagtgcctgctcaggaggtagctgagacttgccatccctgcacccgccakgtgccctcgcttgagtccccagttcacattagggttccccattggtgttgcgcgtctgccggtctggacgtgtctcctccgttagcgcatcagacagagt

SEQ ID NO: 51405 - DNA, 201 bp, Homo sapiens
ccgtgccctcgtttctggatgccagtgctttacatgcaggaagatgggcacattgtgagcgctcagtgagtggtcaccaggagtcagtcctccactccacsaccctcagccggccacatggctatttctttaacccgtgctccacatatgagaaattctctccctttgccgacacattcaagaagcgcgtcagcaagaaca

SEQ ID NO: 51406 - DNA, 201 bp, Homo sapiens
cagcttcaggcagctttgccttttaatgaattggccacacgctcgcatatgaggtcatcagcctccagcatcgtttcgactccggggcccagtggctttcrggggtgtgtttccaaaggagctggttactgattccaccttttccctgcctgtcctgccacactctggccagtgcacccctctctccatcctggcttatgg

SEQ ID NO: 51407 - DNA, 201 bp, Homo sapiens
tagagacgggggtctcactatgttgcccaggctggtgttgaactagcctcaagtgaccctcctccctcagcctcccaaagcactgggattgtaggcatgakccagtgcgcccggtcatatttagtctttttagggagcagtttgtgggtgcttgggatcaccttcctaggcttgcctcttcgtctggagcctggtgacatt

SEQ ID NO: 51408 - DNA, 201 bp, Homo sapiens
ggctcttctatcccagccctctgcatgcttgggtgtcatgtcagaacatgaggaggagaaagggctgagggaggcgagttgacgctttctcctccagttcrgaggaaggagcctgaactgccctcgttcaggggcaggggggcctgggtggtaaactgggcctcctcctgaccccagcaccttgcaagtgctttgcgtgta

SEQ ID NO: 51409 - DNA, 201 bp, Homo sapiens
tcagtcctcgtgggggaagccgagcagcatattgggtggcagtgtgattgaagtagggacacaggagccccatggaccgaggttcccacctctaccctccygcattccagctttgagctcaggcaagttcctcatctctaaaagggccgagtgaaatgatgtgaagaggctggaacatagtctgggaatgtgtgtctggtg

SEQ ID NO: 51410 - DNA, 201 bp, Homo sapiens
aggggtcctctgagctcagacactgggcaggatggcatccttgcaagctgcagcagatgccagagagccttacccttccagctcctagaacaagtgtgggyggcggtcctcatgcagggtctatagaggggagaaggaaagggaggggtagccattgtttcctttcaaacagtctcaagtggctgaaaatccctattaatt

SEQ ID NO: 51411 - DNA, 201 bp, Homo sapiens
tgtttttcctctggaggcccagagggtggcctgtcaaactgtgagttctcagagtctctgagcagggctagcgcagcagaggtgggggccgtctgctgccrcctcctgcctgcaggcccatggggctccatcaccacgacccagccccagctagacaggccttcctgcccccagactggctgctttgctggtggcactgca

SEQ ID NO: 51412 - DNA, 201 bp, Homo sapiens
gcaccatcatcggtagaaagtgcccatgagataaaaccctttcctgtttcccctctctgatctgccgtttcctttgagagatggacagagaggacgtgtgwcttctctgggacatgcaggcggagacaccagagggggttcccaagccctcggctccctcgcccatcccactccccgtgccatctcccctgcctctctcag

SEQ ID NO: 51413 - DNA, 201 bp, Homo sapiens
gtgtaaggaaatgaaggagggtgccctttcatgcagatggccttcggcagctggttttagtccctgaactgggcccagaagccatccctctccagaacgtmtgttagaggatgtggagagcaacctccacggcctttccctgcacggacctgactgttctctgcttctctccctccttccctgccttctctctcctcccct

SEQ ID NO: 51414 - DNA, 201 bp, Homo sapiens
agggctcccgcagaggggtgtgcaatggcactgccagaagcatttccttctcttcccctccctctgcatggacaagtgtttaaagagctgttggcctcccyctccacccctgttatcttgggctgcgtgccattcaggttcaccccctttccttccctaggggaggggtcctctgagctcagacactgggcaggatggcat

SEQ ID NO: 51415 - DNA, 201 bp, Homo sapiens
atcctaacaggcaggttcctctgagccacggaggctgccccaaacaactccacctaaaagacaaaggccgggggagggctctgcctccagatgatgagatrtaccctggcctctgctctgtggtttactcagaataaactgttattttaccatcactctttttttcattttgcctctgaaaataaagctgagaaatgacta

SEQ ID NO: 51416 - DNA, 201 bp, Homo sapiens
tcagagtctaatccagggctggctcctacctggaacaggcatgccaccgggttttgatgcctagggcaggcgtcactcgtcagcctaagtgcccttttccsctgggaccagagttggcctcagctcccacagcacggttctccaggcagcaccatcatcggtagaaagtgcccatgagataaaaccctttcctgtttcccc

SEQ ID NO: 51417 - DNA, 201 bp, Homo sapiens
gctggctgcgtggtccacagaaggcagcggctgcgatgatgtcatgtatccccagctcctcagtgggtgttgcccagcttgtgtgatggcctcagcagtgkggtcccccagctagagggagagctggctctgtgggactaatgatgtcatccccatctgtcgtgtatatttgctcatcagaaaccagggctcccgcagagg

SEQ ID NO: 51418 - DNA, 201 bp, Homo sapiens
cagcttagagctgggccccattctcaaagaagggaagacctggcttggttcagtccagcaaggatcgccctgagggctggctgcgtggtccacagaaggcrgcggctgcgatgatgtcatgtatccccagctcctcagtgggtgttgcccagcttgtgtgatggcctcagcagtgtggtcccccagctagagggagagctg

SEQ ID NO: 51419 - DNA, 201 bp, Homo sapiens
ctgagctcgggggacggagcaggcaaagatgtgcggacaggaaatggattggcagctgccaggggctgggggtcgaggggaatgcggagcttccttatggrgtgatgagaagtcctaaaattgattgtgttgatggtcacacaactctgtgaacagactaaaaaccactgaatcgtacactttaaatgggtgaatttaatg

SEQ ID NO: 51420 - DNA, 201 bp, Homo sapiens
caggcttccctggcctcagttgacacatccagcagagaacttctatgacctagaaatggaatctctactccaaattcccaaatgagagcttctgagcccascttagagctgggccccattctcaaagaagggaagacctggcttggttcagtccagcaaggatcgccctgagggctggctgcgtggtccacagaaggcagc

SEQ ID NO: 51421 - DNA, 201 bp, Homo sapiens
caaatcagtggcctcattatttcataaaagataggccagccaggtatgtggacacttctgggagccaggttttgtcattacacgtgatcatttttaaagcytcatcagctgacctctcctttacagtttctatacaatctcaggtccggtctccatgtagcctgagggattctcctctttagatggcagcagttgaccttc

SEQ ID NO: 51422 - DNA, 201 bp, Homo sapiens
tcgagaccatcctggctaacacggtgacaccccgtctctactaaaaatacaaaaaaattagccaggcgtggtggcagtcgcccaggctggagtgcagtggygcaatcttgcactgcatgctctgcctcctggattcacgccattctcctgcctcagcctcccgagtagctgggactataggcatgtaccaccaggcctggc

SEQ ID NO: 51423 - DNA, 201 bp, Homo sapiens
aaattatgtccaggctgacgctcaagcaggaggtgagaacttcccgggctggggctttgcagcctggccccacagaggagagcaggtggggcagagaagartgtgatcttgtcataagcagaacaaccctaggaggcttagagaccaagtctttcaatgcccctggtgagcctctgggctgtgggctctggaggggtagac

SEQ ID NO: 51424 - DNA, 201 bp, Homo sapiens
ataaatgggtaagcacaaggcagatggaattaacagactgtggctgctgtttttaaacagggtttgccaatatctgtgtgtctcttgggaggatgaggccrtctttctgcaacaagggagaacagaatcacaagatctttagggggggaccttgacatttcctgtggcagatttcagtattgctggtcagaactcatttca

SEQ ID NO: 51425 - DNA, 201 bp, Homo sapiens
cctatgggcagtctgctacttcgtatgtgtatatggccttcctgaaagcatgtctgaaaattgaatatcaaacctgtatcttaacaatacactgtcagccrgacactcacacagtccgatgagttacctgagtgaggatgaagatctacagctttggcatggccactcacctctgtcttctctcggcagtagtattttatg

SEQ ID NO: 51426 - DNA, 201 bp, Homo sapiens
gttccagtgtggatgaaccttgaggacattatgctaagtaaaataagctagtcacaaaaagacaagtaccatatgattccactagaccgtgaggtgcctaygctagacaaaattatagcaaccgaaaggcgctgaggtggctgccaggggctggaaggagggaggaatggggactatttcagttttgcaaggtagaaaagt

SEQ ID NO: 51427 - DNA, 201 bp, Homo sapiens
gcctgaggttggttgaatccacagatgcagaacccatggctacagagggccaaatgtctgtgacttagaatcagggagatacagtataagccactgacccrtcttcgagctgaattcttcggcgactattccatacagttggtggcaatagatgcctggaacactggtaaagaagtcaggtctcctgccctcatggagctt

SEQ ID NO: 51428 - DNA, 201 bp, Homo sapiens
tggttcaagaaacataaacatgtacatataacaaccagatcacattatcttaaggtaaaaatcacatcaaatctcaaattgttattctttggaatggatamaaaggatattagtatttttgtcaatttaagttttatagagaaagttggaaaaataattatatagggacacttgtcttggttaacttggacagagattttt

SEQ ID NO: 51429 - DNA, 201 bp, Homo sapiens
ttcaagaaacataaacatgtacatataacaaccagatcacattatcttaaggtaaaaatcacatcaaatctcaaattgttattctttggaatggataaaarggatattagtatttttgtcaatttaagttttatagagaaagttggaaaaataattatatagggacacttgtcttggttaacttggacagagatttttttt

SEQ ID NO: 51430 - DNA, 201 bp, Homo sapiens
aacaagtaaacagcttcttcagaaggctggatgctgagccctgattgcccttcagtgaaccagcctcatccatgaagcttcttgaaaagccagaaactgtmtcattgggggggtccttgaaatctgaagcaagggacaggttctgagcccctgtgttttgcagattaggttgcacaagaaagatgggctggtgactttgca

SEQ ID NO: 51431 - DNA, 201 bp, Homo sapiens
tgcccggccattcttaacctcttgaaactccttaagactttggtgaaagccatagacctctcttcccagaagaatgaacacgtggtttgccggcaccttargaacccccaaagcccatgagacaaagccctggatctataaggccctgtcccatctgacccccggccttcccctgggcacatacctccagctacacagggc

SEQ ID NO: 51432 - DNA, 201 bp, Homo sapiens
gaggctcgaggatcacctgaggccatgagtttgagaccagcctggcaaccaagcaagatgctatctctacaaaaaataattttactaattaaccaggcatsgtggcaagtgcgtatagtcccagctagtcaggaggctgagacaggaggattgcttgagcccagcagttggaggctgcagtgagctgtgattgcaccactg

SEQ ID NO: 51433 - DNA, 201 bp, Homo sapiens
gtgcctgctcaggaggtagctgagacttgccatccctgcacccgccatgtgccctcgcttgagtccccagttcacattagggttccccattggtgttgcgygtctgccggtctggacgtgtctcctccgttagcgcatcagacagagtgtgatttcattgcccgaaaagtcctccgtgctccgtctgttcgtccctctctg

SEQ ID NO: 51434 - DNA, 201 bp, Homo sapiens
atcccttgacaactgtgtgccaagcctgtcacttagccccggagcttccgattccttaggaggaaaatgagggacaatttcggggccttttagggctgtcwcaaagaccaggtgagccagggcgcacagagtgctcaggaccgcatcgagagtcctgtgatctctagaggggtggcacagcactgcccgtcccagaagcca

SEQ ID NO: 51435 - DNA, 201 bp, Homo sapiens
ctgtggcaggtaacaaagcaagctccttgggcaggtgcatcctgcaagccagagactgcaccagcatcacgagcagctgggagccccgtggctcaggcccrtggagcccagcctgccaagcagggcttggcagggagaggccgtgtgggggtgctttgtggttgcacggctctgctctcaggtgtcaggacctgcatggga

SEQ ID NO: 51436 - DNA, 201 bp, Homo sapiens
acgcctgtaatcccagcactttgggaggccaagctgagtgaatcacttgaggccaagagtttgagactagcctggccaacatggtgaaaccttgtctctaytaaaatcagccaggcgtagtggcgcgtgcctgtggtcccagctactcgggaggcttgaggcaggagaatcacttgaacccaggaggcagaggtggcagtg

SEQ ID NO: 51437 - DNA, 201 bp, Homo sapiens
ctcacgcctgtaatcccagcactttgggaggccaagctgagtgaatcacttgaggccaagagtttgagactagcctggccaacatggtgaaaccttgtctstactaaaatcagccaggcgtagtggcgcgtgcctgtggtcccagctactcgggaggcttgaggcaggagaatcacttgaacccaggaggcagaggtggca

SEQ ID NO: 51438 - DNA, 201 bp, Homo sapiens
tcattgaggcactcagggcttctgtttgtgggcgctggcatcacagtgtagctggtagcgtggtctctctctcacacacacacacacacacacacacacamtcacctgcgttcccatcctcacatccccaccaccatcacaggccccgtcacccctgatttgctattctcaaaatagtcttcattcgtgcgctcctgacgt

SEQ ID NO: 51439 - DNA, 201 bp, Homo sapiens
aacttaagataacatgcaggtaccttttgattcctttcctgactgctgagtcactctattgttgcagaccattagaccggacttcactcacatactccacraggaaattcttgaaggtttgttctgtccaggaaccttcaattctgtagcagtggcctcagtttcacagcacacagctgccccaccctaccacgcattcag

SEQ ID NO: 51440 - DNA, 201 bp, Homo sapiens
acagtgataggctggcctccaacaagcagctggctcttagcatgagctttgaatggaggattcccgagtgaggcacgcagaggcccatgtgagagcgagagtcacactcgtcacatgcggagggctttgctccattgtggaactgagccagcagctgggcctcagatggcattttttatagtcctcaactttccttccttt

SEQ ID NO: 51441 - DNA, 201 bp, Homo sapiens
gccaagcaaagggtcccgtggcaagtcggtccttggagaagacttggggagcagcctcaagagcaatgcagctttctctcccattctgcttgccccttagstcctcctctccctaaatgctaactgtgcggtgggccttggcagggagtggctgagaccatcactcaaacagcttaatggaacctttttattttcccagcg

SEQ ID NO: 51442 - DNA, 201 bp, Homo sapiens
agtcatttaaggaaatacttcaaaatgtaaatagaaagtacagttagattatggtactgtgggtgatttttattttcttgatgtaatttgccacggtttcygtaatggttgtgtattttttttttaaataagaaatgtaaaaaataaaagtatagcaaacagccatattcccatctggtttgcttttataatcagggagaa

SEQ ID NO: 51443 - DNA, 201 bp, Homo sapiens
gacagtgataggctggcctccaacaagcagctggctcttagcatgagctttgaatggaggattcccgagtgaggcacgcagaggcccatgtgagagcgagagtcacactcgtcacatgcggagggctttgctccattgtggaactgagccagcagctgggcctcagatggcattttttatagtcctcaactttccttcctt

SEQ ID NO: 51444 - DNA, 201 bp, Homo sapiens
ggtgacagagcgagactccgtctcaaaaaaaaaaaaaaaagcaaataaataaattctgtctcctgctcgactgaaccctcagggacaagaggctatgtctkcttggttcacagctctttcttagcgccaagcaaagggtcccgtggcaagtcggtccttggagaagacttggggagcagcctcaagagcaatgcagctttc

SEQ ID NO: 51445 - DNA, 201 bp, Homo sapiens
caaaaaagtcatttaaggaaatacttcaaaatgtaaatagaaagtacagttagattatggtactgtgggtgatttttattttcttgatgtaatttgccacrgtttccgtaatggttgtgtattttttttttaaataagaaatgtaaaaaataaaagtatagcaaacagccatattcccatctggtttgcttttataatcag

SEQ ID NO: 51446 - DNA, 201 bp, Homo sapiens
acccctcttaatttgcactagacatgtaatcgactacttgagtacactgtccattttgggatttatccattctgtagactactctttttttttttttttttaaaggacagcctcccaaaccagaacaggttcagagactccacttctgtagattactcttagcctccttttcctgccagccagctgagacctggatcattg

SEQ ID NO: 51447 - DNA, 201 bp, Homo sapiens
ggacgtagtggcatgtgcctgtaatcccagctactcaggaggctgaggcaggagaatcacttgaacccaggaggtggaggttgtgatgagccaagattgcrccactgcactccagcctgggtgacagagcgagactccgtctcaaaaaaaaaaaaaaaagcaaataaataaattctgtctcctgctcgactgaaccctcag

SEQ ID NO: 51448 - DNA, 201 bp, Homo sapiens
accaggctggtcttgaactcctgacctcaggtgatctgcccacctcagcctcccaaagtgggccagcgtgcccagccaatttttgtatttttagtagagayggggttttgccacattggccaggctggtattgaactcctggcctcaactgatcggcccgcctcggcctcacagagtgctgggattacaggcgtgagccac

SEQ ID NO: 51449 - DNA, 201 bp, Homo sapiens
catgttggccaggctggtctcaaactcctgacctcaagtgatctgcccgcctcatcctctcaaagtgctgggattacaggcatgagccaccgcacccagcygggattttcccctttattcatttttccaagagaggtcacagagaaaaattcagtgctaaagtaccgctcatttagtggggtgcctgtaaaccccaggggc

SEQ ID NO: 51450 - DNA, 201 bp, Homo sapiens
ttcaagcttttcctccctccttaggtcaagctttagccacctctggggtctttggtgaccttagagcaagggagtgcccacttgtcattatcagggctcarcatgaatggttgaagaggcagttaataaaaatagcaaaagaaagaaaaagaaatgagaaggcattgcatagggacctgttgaagagggccacctgcccag

SEQ ID NO: 51451 - DNA, 201 bp, Homo sapiens
tccgcctcccgggttcaagtgattctcctgcctcagcctcccaagcagctgggattacaggtgtgtgccaccacgcccggctaatttttttgtctttttartagagacgggatttcaccatgttgaccaggctggtcttgaactcctgacctcaggtgatctgcccacctcagcctcccaaagtgggccagcgtgcccagc

SEQ ID NO: 51452 - DNA, 201 bp, Homo sapiens
gttgcccaggctggagcgcagtgctcactgtagcctctaactcctgggctcaagcagtcctcccacctcagcctcctgagtagctgggactacaggtctgyaccaccatgcccagctaatattttgtaggtagagacaaagtctcactctgttgcctaggctccaactcctgggctcaagtgatcctcccgccccagcctc

SEQ ID NO: 51453 - DNA, 201 bp, Homo sapiens
agccatgatgcctggccacatttttcaatattagcataaaccaaacctgaccaagtgtagaaatacgtagtagatttccccagtatgcacctgtgaaataygatgtgtaggatctgcaaatgggcactcccacctgcaacttcacattgacttccccttctctatgaaatgttccatgtgttcaagcttttcctccctcct

SEQ ID NO: 51454 - DNA, 201 bp, Homo sapiens
ctggtcatttccctgagcctccctccccagtgtctggacctgaacccatgcagtgggtgaagttcgtctcttacccatccacactcaaaactgagacgctkctgtgagtcaggtaatattctagacaccttaattaatacagtgcctagactatgtattaggtgcctactaaaatacgtatcagcaaatatgtattaggcc

SEQ ID NO: 51455 - DNA, 201 bp, Homo sapiens
tttgtcacatcgaggagtgcgagaccttgtacccatccctctctctccaggacacggtccaagttcccatatggggataagggtcagggcagggagggcasagccaaagggcgtctcctggggataggtgagtccagccccagggccctccctggccacaccccccacaaactccagatggctgcttctcagctgtatgtg

SEQ ID NO: 51456 - DNA, 201 bp, Homo sapiens
tgacggcgcagttgtgaatcttgccagctcctcagccccatgcctgcctgaacagcaactcagggcagtagacagtggagaaagcggaagttggctcacccagcctgaagatctttgagcaccagagaacccacgcatcctgcccagacttccccatttgtgtctgctttccctgcttcagtcctactcaacaggatacaa

SEQ ID NO: 51457 - DNA, 201 bp, Homo sapiens
gaccttgcagtcagccgctgccctgtgccgtctcccggaagaggcaccatgctgtgggagtctgcccctcaccttgttgaattaaaaccggctaaacacaytatatgattggttaggaagacacttctccaacttggtacattttgtgatgacacaaaagccatttgtgtatgtgtaaatcaggtgctcagttattgcagg

SEQ ID NO: 51458 - DNA, 201 bp, Homo sapiens
ggttgtaaaggtttatattcatctctactccaagctcctggtaaaaatataaaacataaatttggagcttttttttttgtttttgagacagagtctctgtkgctcaggctggagtgcagtggtgcgatctgggctcattgcagcctcctcctctcagattagagcaattctcttgcctcagcctttcaagtagttgggact

SEQ ID NO: 51459 - DNA, 201 bp, Homo sapiens
tctcaagataaaataaataaatagatttaaaaaaaaagccacagacttcagctctgctgcctcctgtgcccatagccctctgtctccatctttaccttgcrgtccacaaaatcctagacaagtgaaaagacttttaaaaaattggaaatcctcatctttaaaaaagcttttcctaatgtcctcaatcacgcctccactcca

SEQ ID NO: 51460 - DNA, 201 bp, Homo sapiens
aaatcaggtgctcagttattgcagggcacgtggaagcacaaagtgactttacacgggggcgccgatgaggctatttcaagactccagaaggagtcagcgcrgaacatgactccttaaactaggcagcagcaaggcaaggtgagggggatctgtttagcaaatctcgtggcagtgtctgggcattgggaatgaacatctggc

SEQ ID NO: 51461 - DNA, 201 bp, Homo sapiens
gtgctttgacttgagagcactcttgtttgatcaagagtaaactgaggatgacatggatggttgtaaaggtttatattcatctctactccaagctcctggtraaaatataaaacataaatttggagcttttttttttgtttttgagacagagtctctgttgctcaggctggagtgcagtggtgcgatctgggctcattgcag

SEQ ID NO: 51462 - DNA, 201 bp, Homo sapiens
aaatacactgtggttgccgtccagcagagcatcatgcagccattaactgcactcacatgggaaaatgcccacaatggcttgttgtttaaaaaaaaaaaaaagtgaaaaaatatttctgctgtgtgtggaattatgagaaatgtttaccgtctacgttatatatttttacagtgcttggatttttataatgagattgtttga

SEQ ID NO: 51463 - DNA, 201 bp, Homo sapiens
tgcaggcatcctccagagatcgatggaaaacccagaaagccaagcccttcaccccactgccatcccaggaaggcccagagcgagctcccaggcctgcagcrccatcctgggtaattgctgtgaaacgttgaagtgttgcgtggagcctgctgtgagggtgtaggtgagggcggcaagccagggtgtaccaagcagggtgtc

SEQ ID NO: 51464 - DNA, 201 bp, Homo sapiens
gctgagcgtggtggctcacacctgtaatcccagcactttgggaggccaaagtaggaggatcacttgagcccaagagtttgatatatgcatttaattttggrgggcggggttgcttgtttaattattatttcagaagtaatatatgttcatttcagaaaatttagaaaatagaaaaagaacaagataaaagggtgtttcata

SEQ ID NO: 51465 - DNA, 201 bp, Homo sapiens
taaatacactgtggttgccgtccagcagagcatcatgcagccattaactgcactcacatgggaaaatgcccacaatggcttgttgtttaaaaaaaaaaaaaagtgaaaaaatatttctgctgtgtgtggaattatgagaaatgtttaccgtctacgttatatatttttacagtgcttggatttttataatgagattgtttg

SEQ ID NO: 51466 - DNA, 201 bp, Homo sapiens
gagatggggttttgccatgttgcccaggctggcctcaaactcctgggctcaagcaatccacctgccttggcctcccaaagagctgagactgcaggtgtgarccaccatgcccagcctacttcatttgttaaaaaaaaaaaaaaagaaagaaagaaagaaaaaaatggggtaggaagagaaatggactcagacatcgttagc

SEQ ID NO: 51467 - DNA, 201 bp, Homo sapiens
ttgccattgttcattagttgagttcacagctgcctctccagaaagatgacgatctaattataattgctcatgaatcaatgaagaaccaggaatgttttccygtatcaacagatgcaaacaacacagacttctctctgttccttttgccctgcttgtaaagaagagtgaatctgaaagtggggcatccagggcactgtgttc

SEQ ID NO: 51468 - DNA, 201 bp, Homo sapiens
cagtttccagtcactgctgtagacatagactctagagtagtctcttcttctttttgttctgagacagtctcactctatcgcccaggctggagtgcaacaayggcacaatcttgctcactgcaacctccgccttctggattcaagcaatcctccagcctcagcctccggagtagctgggaccacaggtgcatgccaccacgt

SEQ ID NO: 51469 - DNA, 201 bp, Homo sapiens
agggacaggcactccttaaaatgtttcctacttcagtggccacaatattacccctctggcttatgtcatgttccacaatcaaaatatcattcctcctggartccagctactcgggaggctgaggcaggaggatcacttgagcctaggagtttgaggccacctgggcaatatagggagaccctgtctcttaaaaaaaaaaat

SEQ ID NO: 51470 - DNA, 201 bp, Homo sapiens
cacttccagggctcactggctccttgccttgaagcactctttctgtatttgtcctgccccagttctccatcaggctcagcagcagaccagggatgttggcrggccatgttgtcactgagtagggccagcccagggacccaggaggaagcaagtctgccggaggaagaggggactggcaccccagggcctgagagctggccc

SEQ ID NO: 51471 - DNA, 201 bp, Homo sapiens
attgttgtctgtgtgcacaggcgccaggaggagctgccccagacacggctcctgacttcaggggcttcgcactcctgatagggaagaaattccagggcccrgagtggcctgagctaaggagtggggaagtggaggaaacagcgccccagccgcccataccctctgactcttgctaggagaggagaggttgtttatggatta

SEQ ID NO: 51472 - DNA, 201 bp, Homo sapiens
gtctcagtgcaggacagtctgttgacgcactcagcggccttttatcacagttattgacccaggagaccggccggctggcaggcatgccagagatgacataygcgagacttcaccaggtctttgcctcctcttgccagaagaagttgcggtagcatttgatcagtagcaagacagttttttcacaactgcatatatgggtgt

SEQ ID NO: 51473 - DNA, 201 bp, Homo sapiens
atgtcagggcaccaccatgaccctgatctgcagcccacattcaacgtggttgtgaaatcttggtgggtggatgatggccccaggttccagggcaaagtagsatggtctgtgtctagtttaggaacaagtgaatgggaatcctgggcatatcgttatgtggatttgctacagacagttgggacagaccaggcggcccctgat

SEQ ID NO: 51474 - DNA, 201 bp, Homo sapiens
ggacaggggaagagggttgttagttttacatgtgatggaaagggagagtgatcagaaataaggagcagaatcctgtgtgttgcagatgtctgggcaggcgygctccggaaaaggaagaggtggcgcagaggccctgacctgggaatgtgtgactagggcggaggctggagacccatggcagatgaagccaggccttgagat

SEQ ID NO: 51475 - DNA, 201 bp, Homo sapiens
gggctcctggtcttgcctagggttcctcaagtgtctacaatcagctgctgggagggcttatccctgggcctccagcaggctagcccagggtccctcccgtrgtggggttgctcacctggtcggggaaggggggcagccctgaggccccaggtcagaagccgcacagttacctctactttatttcattggctaaagcaggcc

SEQ ID NO: 51476 - DNA, 201 bp, Homo sapiens
ctctttggatagagggagcagagcagtgagtaattaggttcaatcacccatttcaagtctctgtgaccttgcttacatagggagcccggagctgggccctycttggagtccctgggttgggatcccagccagctgagtgtgaggaagggagggagcgagaagggatggaggagaagcctgggccagcagagggctgctgtc

SEQ ID NO: 51477 - DNA, 201 bp, Homo sapiens
gccccgcggagggcccctgtccagaactcagcacccactcctctttccaggagccaccggctgggaaagacggacatcccagagatccctcagcggtcagyggcgtccctgggaaggacagcagagacggcagtgagaggtaggaagtggacccagaggagctgggtcccccgagagcagtgcgcccactcatgaggcctg

SEQ ID NO: 51478 - DNA, 201 bp, Homo sapiens
ggaatttgaaaccggacacagggaagcattctaatcattggcggggatttgagctaaagaatctacagaattggaaccaggcagtccctgtgtgcttccgrattatgagagagtggtaactcagaagaagcacgttcatgcatttatctaatgaacattgattagacatgtgctgcatgccaggcattgttttagccactt

SEQ ID NO: 51479 - DNA, 201 bp, Homo sapiens
cacatggacacaggaaggggaacatcacacacgggggcctgttgtgggtggggggagggggaagggatagcattaggagatatacctaatgttaaatgacragttaatgggtgcagcacaccaacatggcacatgtatacaaatgtaactaacctgcacgttgtgcacatgtaccctaaaacttaaagtataaaaaaaaaa

SEQ ID NO: 51480 - DNA, 201 bp, Homo sapiens
cccgggctggggctttgcagcctggccccacagaggagagcaggtggggcagagaagaatgtgatcttgtcataagcagaacaaccctaggaggcttagaraccaagtctttcaatgcccctggtgagcctctgggctgtgggctctggaggggtagactccaggggaagtgtgctgtctccttctgatgcttatagaaag

SEQ ID NO: 51481 - DNA, 201 bp, Homo sapiens
ttcctaaactgattctctgaagggcatactctgcctcataccttccttggctgtgttcattacagggtgatgacgggccggacgtccgcggaggatctggrgacatcttactggtccatgctactgagactgacaggaaaggtagggtgtcagtgagctcactagattggggctggtcctgccccgggtgccactcggcct

SEQ ID NO: 51482 - DNA, 201 bp, Homo sapiens
ggagacaccagagggggttcccaagccctcggctccctcgcccatcccactccccgtgccatctcccctgcctctctcagagcaaggactcaaatccaccstggctaccaccccccagcactctgcacccagacaagcagtttgcattgtttttccctctagatttggtgttgtactgcgaggcattcctgaccacctaca

SEQ ID NO: 51483 - DNA, 201 bp, Homo sapiens
catgagcactgacaggctgaggacaggggcagggacaggatggggcttgctggaagtggccacctggtcgaggaggctcagcagggaagagtgccagggtygaggagcgatgtctgccataggtggtgttgggaagggcgtgagtttgccctcctgccctggtcactgccaggcaatctcaagctgatgctcacactgact

SEQ ID NO: 51484 - DNA, 201 bp, Homo sapiens
agaaggagctgcctctttcattccgctaagctcctgggggttcccatgagcactgacaggctgaggacaggggcagggacaggatggggcttgctggaagyggccacctggtcgaggaggctcagcagggaagagtgccagggtcgaggagcgatgtctgccataggtggtgttgggaagggcgtgagtttgccctcctgc

SEQ ID NO: 51485 - DNA, 201 bp, Homo sapiens
gtggcacgtctgggtgggctctgcgttttcctttgcagggagctagaatggtaggagaaggagctgcctctttcattccgctaagctcctgggggttcccrtgagcactgacaggctgaggacaggggcagggacaggatggggcttgctggaagtggccacctggtcgaggaggctcagcagggaagagtgccagggtcg

SEQ ID NO: 51486 - DNA, 201 bp, Homo sapiens
gtgattcatgcttgtaatcccagctactcaggaggctgaggcaggagaatcacttgaaccaggaaggcagtgagccgagatcgtgccactgcactccagcyttggtgacagagtgagactccatctcaaaaaaaaaaaaaacaaaataaaacaaaaaattagccaggcatagtggcgcatgcctgtagtcccagctcctca

SEQ ID NO: 51487 - DNA, 201 bp, Homo sapiens
gaagagccccaacttgacccagttcacggagcacttcaacaacatgtcctactggtaagagaggcccagcgccaagccctgttgctctggatggtggcacrtctgggtgggctctgcgttttcctttgcagggagctagaatggtaggagaaggagctgcctctttcattccgctaagctcctgggggttcccatgagcac

SEQ ID NO: 51488 - DNA, 201 bp, Homo sapiens
ataccagcctgaccaacatggtgaaaccccatctctactaaaaatacaaaacttagccaggcgtggtggcaggcacctgtaatcccagctactagggaggmcaaggcaggagaatcacttgaacccgtgagatggagatggcagtgagccgagttcgtgccactgcactccgcctgggtgacagagtgagactctgtctcc

SEQ ID NO: 51489 - DNA, 201 bp, Homo sapiens
atgaccttttgaaatcggtaccccacctcttcccaacttcaccaggtaatttactgtgttacttgagcaccagagctgtattttgacttgtcaactgttayttaagcccttccttctctgtgatcattttcttttttttttttttttttttttttttgagacggagtctcactcttgttgcccaggctggagtgcaatggc

SEQ ID NO: 51490 - DNA, 201 bp, Homo sapiens
atttcctctatggagtcattacagcaccacttcattagtagaaaggcatgtctgaaagaaaaatttccttgatttttcaaagtgactggggaaaaaaaaargagagagaaacctataggttatgaacttgtcaatgtcagagcaaataacttttccacaattgctttaaaaatattttagccagaacaaagattctctagg

SEQ ID NO: 51491 - DNA, 201 bp, Homo sapiens
atatttttgttttgatgaaaaatttaaaaacactgctctcaacccccaccacaaagaacacgaaaatattattataaagaaactagatatatcccaatccctgctctgcagtggtggttcaatttgtaaagcaaaagttagaaccaaaaatgctttcaaaggtggcttcgaacaatgttcataactctctgctcgcatcat

SEQ ID NO: 51492 - DNA, 201 bp, Homo sapiens
caggcatcgggagctgagccggtttgacacttgcaacacaaaccacttctccccgcagggccccaaagtcaccagatgctctggagtcggctcagtcggargaggaagtggacgagctgtccctcattgaccacaacgaaattatgtccaggctgacgctcaagcaggaggtgagaacttcccgggctggggctttgcagc

SEQ ID NO: 51493 - DNA, 201 bp, Homo sapiens
aagatgcctcacctggccttgccaggaagcagagcgaggtccagcccagccgttagaagcacattcccctgcaggatcagatcagctctggtccaaccccmggagagactgcagggtctttgttttcccctctccgtcctctttcctaagagagtagttccaacaacaaatacttttcatccatataatcttctaaaatac

SEQ ID NO: 51494 - DNA, 201 bp, Homo sapiens
tagagaaaaatgtagctagagcttggctaggatagcctggggcattattgttttaatagaagctggaatgcccatcaccgcaaaacactgcaaaaggtgaygtttaacacaggcagaagactctcctgattggcatgtagcccagacaaagtgagaaaaggtgtccacacatacatgtacataagctagtctcccaaacaa

SEQ ID NO: 51495 - DNA, 201 bp, Homo sapiens
tactgtcctagttagtgctgtcctcgatttccagcgttgagaaggttggttgtcatttgaaagaatctcttctctctgcctgatttatggcttcttgtgcyagagctggctgtgctgaggtggataccctgaggagggagatttattggtaggcattgcactgtctttaggtgctgacatgttttcccagccttgcccaag

SEQ ID NO: 51496 - DNA, 201 bp, Homo sapiens
cttgatggtatccaaatcggctgttgattttgggctggagaaatacaagcataacctctactccaagttattattttacctatttcccaactttttgttaycggatctctccactaaatcagttgttctgcttctgtctttgcagctgttctgtagatgctgttcagctgctgataacatctggcctttgggcaggctcaa

SEQ ID NO: 51497 - DNA, 201 bp, Homo sapiens
tcttagccccttgacacaggaatattctgcttccaagctaatgacgggaaggctggacataattccagcaccttccgggaaacgttagcatccaatgcagrtagaaaggaagtagtgaataaaagtgtttcccctctttcacctcactgttaccagcagtgtgacagtgagatgctttctccggtggaatcctcctacagc

SEQ ID NO: 51498 - DNA, 201 bp, Homo sapiens
aaaggcatagtgtgaatgaccttgagaatcacctgaagcctgtgctgctaacccaaggtttcaagaaggatgtgacaaacatactgtcctagttagtgctrtcctcgatttccagcgttgagaaggttggttgtcatttgaaagaatctcttctctctgcctgatttatggcttcttgtgctagagctggctgtgctgagg

SEQ ID NO: 51499 - DNA, 201 bp, Homo sapiens
atctgtccccaggtgggtggctgtgttcgacgggtgttgctcatgacagttggggtcctcctcagcatcagtctcgacatggctgcaactgaggggtcctygggatcctcccggaatctcttcctcggcatctggctcatgataaggtttcaggtgtcttgatggtatccaaatcggctgttgattttgggctggagaaat

SEQ ID NO: 51500 - DNA, 201 bp, Homo sapiens
tttagatgctttgcattatctctttcctccctaagtgcagtttgcgagctggaaggtcctttctcgtttcttccgtggggcagggagtggggggtccttgsaaacaggccctttgccgccctcacctcggttcctgagacagtgataggctggcctccaacaagcagctggctcttagcatgagctttgaatggaggattc

SEQ ID NO: 51501 - DNA, 201 bp, Homo sapiens
taagttaaactgtatatgtcgatataaactatcctgaaaagtaagggatgataagtctgaaagtcagagtcgggctgcctgtagggaagagatgtggctgyagaggagcacatggcagcaccagtggaatccatccgcttctcgagctgcaccatccagtgtgccagtcaccagccccaggggctgtttacacagttaact

SEQ ID NO: 51502 - DNA, 201 bp, Homo sapiens
ctgcccaaagacagattctcagaagaactcagctgtcatcagtccctcctctgccccatcatcttacattattttatttttgttgacaaacaagacaggtrtaaaaaaaatcacagaatcaaagaaacagaagttaaatatgattctttatatttcaaaccattaatctttccattttctgttccatcaccctaagcagtt

SEQ ID NO: 51503 - DNA, 201 bp, Homo sapiens
cctagagcatggacgagaggggaacagtgggaagaggcgactgatcaccctgcaccctcaggcgctaagcctctttgggagagtccaggatagcgtcccckggaccctcacacccagagtgtattgctgctaggagtgttgcttcccagagccaggctctgcttggaggtcacttgcaaaccctgggtaagaactgatgaa

SEQ ID NO: 51504 - DNA, 201 bp, Homo sapiens
aagctcatataagccacccttcctctggaaggaatgactagcagattagtcactgggagtctctgaccttggggtaaatgtaacatggagcaagagtctgmggctttctgttctcaagttcaggtgaacttgaagttgctctcacagattagatagatcacaataaaatacaccagcatatggcatttccaggtgaaggag

SEQ ID NO: 51505 - DNA, 201 bp, Homo sapiens
cttttcttataaaggttaaagcagaggggactttcttatcatgccagctacaactggcctgtttggggatttggctattctctctctctcctgatttctckgaaggtcagataaaaatcttattttggcttagtggtatggaacttgagcgtgagtgacaccattttggtttggtctattgggcatattgcaggagctcag

SEQ ID NO: 51506 - DNA, 201 bp, Homo sapiens
aataatagtatccacttcacagggtggttgtaacctttaaacaaaatagcctatataaaatccatagcacagtgggtgcctccatgtccccgatgagtggyagctacgatctggcctctttcttccctttcagatgttcccatcctaggccctctttctctgctttattactggcaggtatatggtctctggtgttggtat

SEQ ID NO: 51507 - DNA, 201 bp, Homo sapiens
ttgaaaaattgatgagattgccctggctgcagtgggagaaagccttggaatggcaagaatggaattcttaagctgccttgtatttgcaggcagataagggtggtggcagtgggacagattccctggatataatggaaactccaagaggacttgggaatggatgggatctggggtttggaaaggtattgtcaaaagacaaca

SEQ ID NO: 51508 - DNA, 201 bp, Homo sapiens
tcctgtggcagcacatggctgtggagccacagcctgggcgtcagaaatgaatatggcccacggggcaggaaaggcgatgggggttttatgtccatctctgycatcggggtcttagtttactcgtttgttaaatgagatctttttgaccaggggatctcaagtaaactttttaacttcagcacatttctgatctggtcttta

SEQ ID NO: 51509 - DNA, 201 bp, Homo sapiens
accctcttccccgccatctcctgtggcagcacatggctgtggagccacagcctgggcgtcagaaatgaatatggcccacggggcaggaaaggcgatggggrttttatgtccatctctgccatcggggtcttagtttactcgtttgttaaatgagatctttttgaccaggggatctcaagtaaactttttaacttcagcaca

SEQ ID NO: 51510 - DNA, 201 bp, Homo sapiens
gtggcccacatatcaggtatgagacctgtccctcataatatacatggagttgtcaagctccagcttgtagggcttctgggacagagcagttcttgtgtgtwtttggagagttgtagccagatgtttccaaataggaaagtagaagaattctggatccgttccagcctacaaatagtaaaaactcaaaaacaacgaacaggg

SEQ ID NO: 51511 - DNA, 201 bp, Homo sapiens
tgagtcaaggatgccaccaggttcctggcttatgttaatgggtagttaacatccactgagataagaaatacaggacacttgttgctgtttatttggtttaygtataaacagtgaattgtggttcttttattcaacaccagagtgtaaaccattgactggaggtgttcacagactcggaataattgacttcagttcttcctg

SEQ ID NO: 51512 - DNA, 201 bp, Homo sapiens
ttattaaactattgagacccatgtgatggtggagtatcaagattgacaggttaatttcccatttatatagaacattatatgaaaattgatttttttaaggyatgggggtggaggatcctgggatgtgtggcgtggtgagagagaagattaagcatttagtgttttcagctacatttaaacttgtcctccttggcaccaacc

SEQ ID NO: 51513 - DNA, 201 bp, Homo sapiens
agattgacaggttaatttcccatttatatagaacattatatgaaaattgatttttttaaggcatgggggtggaggatcctgggatgtgtggcgtggtgagmgagaagattaagcatttagtgttttcagctacatttaaacttgtcctccttggcaccaacctaggggctgctctgagttctaaaggaatcacaggaggct

SEQ ID NO: 51514 - DNA, 201 bp, Homo sapiens
ttgatttttttaaggcatgggggtggaggatcctgggatgtgtggcgtggtgagagagaagattaagcatttagtgttttcagctacatttaaacttgtcytccttggcaccaacctaggggctgctctgagttctaaaggaatcacaggaggctggttgtacaagtggctgcattgcctccatgcgtttcctttgcttct

SEQ ID NO: 51515 - DNA, 201 bp, Homo sapiens
agtcaggatccacatctgcagactgtacaaagacaacacagattaaaagcacaatcatcattgaaatcacagagcttccaagtgtttttatccattttaaygggttactagataaatatgtccagtaagtataattgttctctgtgtcagcccttgttgaaggaatactcacggcagtggtgataacctctatcatagcta

SEQ ID NO: 51516 - DNA, 201 bp, Homo sapiens
tggacagagaggacgtgtgtcttctctgggacatgcaggcggagacaccagagggggttcccaagccctcggctccctcgcccatcccactccccgtgccrtctcccctgcctctctcagagcaaggactcaaatccaccctggctaccaccccccagcactctgcacccagacaagcagtttgcattgtttttccctcta

SEQ ID NO: 51517 - DNA, 201 bp, Homo sapiens
tgcgaggcattcctgaccacctacaggaccttcatctccccagaggagctcatcaagaagctgcagtacagatatcctttccttcctgacccagggccccygcaccatgggcattttggagagagagggaccctcttgcccttcagtcctcgtgggggaagccgagcagcatattgggtggcagtgtgattgaagtaggga

SEQ ID NO: 51518 - DNA, 201 bp, Homo sapiens
atcccaggctctcgtctcctgctctcttcccatgagaaatttcccagccagctctgtgccggtcacagccccgtgccctttgtgtgtctcaaggcaaagasagactctgcctgggccttgcgttcctgctcctcaccttgtgctcttttgtccttcagcctggtggagttgacagaagagatcctgaagctgctgatggaa

SEQ ID NO: 51519 - DNA, 201 bp, Homo sapiens
gagaggcaggaggccattagggccccagggagccttttggggcttccccgccctgtagcctccacgctcctgctgggcagagaggctctcctgctctgackcccgcagcccgggcctgctcagccctccccaccggcctccccacccctgacggctcttctcacacctctgtcttccaggccggggaccttgcacgacttt

SEQ ID NO: 51520 - DNA, 201 bp, Homo sapiens
ctatggctttcctctaggtgaggaaccggaggctcgggtaaaaagtttgcccaggttagtggccgagctgaagttaaaacaaagacacacaggcctggcgtgatggctcacacctgtagtcccagcactttgggaggctgagatgggaggatcccttgagcccaggagttcgagaccaacctaggcaacatggcgaaaccc

SEQ ID NO: 51521 - DNA, 201 bp, Homo sapiens
ggcaggagaatcacttgaacctgggaagcagaggttgcagtgagccaagatcacgccattgcactccagcctgggcaacaagagcaaaactgcacctcagraaaaaaaaaaaaaaaaaagtgtcagtggagtgttgggtgtgaaagtgtcaaagaatgagcagaggagaattggccacagggagcatgggcgttcttggag

SEQ ID NO: 51522 - DNA, 201 bp, Homo sapiens
aagtacattgtgatgaacttctaaacttttttgcaaccttttaacaagtctagcagtgagctgcagagtgttgaagttgtagaggaaatttagccatataytgggtgtccaaaggtataattacaatgagcagtgagcagggggtcctgggaggtgttaatgccccatctctgagggcatttggacagagattggatccga

SEQ ID NO: 51523 - DNA, 201 bp, Homo sapiens
ttgagcccagcagttggaggctgcagtgagctgtgattgcaccactgcactccaacctggacaacagagggagactgtctcaaaaaaaaaaaaaaaaaaaaggcagagtctagaggaccccagaagacagaagagtgcctcccagactttctgcctcagtgctttgctaggcctgacctccaggctggtcatcgcttttgt

SEQ ID NO: 51524 - DNA, 201 bp, Homo sapiens
ctgagaaacctgttctgtagcagggagctgtaggtgtgatcttcacccaagaaggaatgttacccctttttcatcattgctcattaggaagggttggatgwctgtgttctgtcccaagccacctgcgtgggacaagtaaatgcgaacctcttgcttcgtggaggcccatggacagaaccagaagcattgagaaacttccca

SEQ ID NO: 51525 - DNA, 201 bp, Homo sapiens
tggtactgcatgggctaagtgcctaatgaacatcagcttactactatctctccgggtgacagagtgagactgtctcaaaaaaaaaaaaaaaaaaaaaaaaagccctgaagggtttatgtgacttgtccagctgggttgaagagctaggttgaagccgctgcccagtattgaaacaaacccttataaaatagagaagtagct

SEQ ID NO: 51526 - DNA, 201 bp, Homo sapiens
agtagtgccaaggctgagaaacctgttctgtagcagggagctgtaggtgtgatcttcacccaagaaggaatgttacccctttttcatcattgctcattagraagggttggatgtctgtgttctgtcccaagccacctgcgtgggacaagtaaatgcgaacctcttgcttcgtggaggcccatggacagaaccagaagcatt

SEQ ID NO: 51527 - DNA, 201 bp, Homo sapiens
cttgaacccagaagggggaggttgcagtgagctgagatcgtgccactgtacttcagcctgggtgacagagtgagactcttgtctcaaaaaaaaaaaaaaaagaaagaaagaaaagaagaaaatatagctgtgtgggcaatagtcagatgaactattcccctaactttgccccaattcggtgtatgactatgtacaaatctt

SEQ ID NO: 51528 - DNA, 201 bp, Homo sapiens
ttcatctatttttgggttttatgttgaccagcagaatatcttaaaattttagttaaaagtggaggaaaataaaggttttaaatctaaaagtcttttgttgraaagtggtttttcctgccccctcttttaacgaaaggtgactgacaagcaagagggaaacagtcagtgtttgccagattgatctaaattccagattgaaga

SEQ ID NO: 51529 - DNA, 201 bp, Homo sapiens
tctgcctggcattcgggtggttgataataggtaattaccttcctatttgtccagtgcctcccatggcagaatgagaaagaaagggaggaagacagggctcrggccctttcccctcagcgctgagggcttggccccccttgggaggctgactctggagctgtccccaccccgccggccctcgctggccaccctgagctctcc

SEQ ID NO: 51530 - DNA, 201 bp, Homo sapiens
gcagggccagtcaagccagatatgttgaaacagctattgactttcatcaacccctcccttcggcctcaaacagccatttcaaactctgtaggaatccaggyttcctctcttccaggaggcaacagacagatttctaccagagggctaccctctccccttggatctggagcagcaggcagtagaatttatgtccaccagtgc

SEQ ID NO: 51531 - DNA, 201 bp, Homo sapiens
ctctgcataacgacatttcagttagtgacagaccacattataacatatgtagggcagaccacattataatcttatggtcccataagataatcataaagctraaaaattcctgtcgcctcgcctgatgtagccatcattacatccagcgcaatgcattactcacctgtttgtggtgatgctggtgtaaatatatagcacata

SEQ ID NO: 51532 - DNA, 201 bp, Homo sapiens
ttatttttaaaactacaggtatttatttttccattgcgtaggacagtgttttgttgcttaattttcagccaatttcaagtatttctgctgttactaaaagmagcagtcttcttcctgggatatttttgttgttggttggtttcttcatttgttgaatatatgtttactgattatcttctatgggccaactgccatgtcagc

SEQ ID NO: 51533 - DNA, 201 bp, Homo sapiens
gtggctcacacctgtaatcccagcactttgggaggctgaggcgggtgaatcacgaggtcaggagattgagaccatcctggctaacatggtgaaaccccgtstctactaaaaaatacaaaaaattagctgggcatggtggcacgcgcctgtagtcccagctactcgggaggctgaggcaggagaatggcatgaacctgggag

SEQ ID NO: 51534 - DNA, 201 bp, Homo sapiens
gacagtgtcgtcccggagagaggcaggaggccattagggccccagggagccttttggggcttccccgccctgtagcctccacgctcctgctgggcagagargctctcctgctctgacgcccgcagcccgggcctgctcagccctccccaccggcctccccacccctgacggctcttctcacacctctgtcttccaggccgg

SEQ ID NO: 51535 - DNA, 201 bp, Homo sapiens
tgtcaagagtgccttgcaaatattaattctctgagctcatcagaagaccaaaggcatagatcaaaagcatgcttttctgcatgatctgtccttgtttttttctgttcatgaggagctttctctattaattaccctaaatatgcaaggttgtagaatgaagcttttatatttgacaagtaagaattgggctagggacctgga

SEQ ID NO: 51536 - DNA, 201 bp, Homo sapiens
gtaaatgttggatagcacttaactaatcatcaaaatagcttttgaaacatttttgtacacattagtttctttgttgttttgggctttgttaatttgtttcyttttttttttttttttttttttgagagggagtctcgctctgttgcccaggctggggtgcagtgatgcagtctcggctcactgcaagctccacctcccggg

SEQ ID NO: 51537 - DNA, 201 bp, Homo sapiens
tttttaaaaaaaggaaaaagttgcctgtcatcccatgagctgcccaaaccgctgggaatgaaatgactcttcatttgagttctctgctatttgggagaaakacctgaggccagttcatttcagcatagtttgtccttgggccttttctgggcaccgccttctgctagggggttgtagatgaaagtgcctgctcccagagaa

SEQ ID NO: 51538 - DNA, 201 bp, Homo sapiens
gcaggaggatcacttgagcccaggagtttgaaacaagcctgggcaaaatggcgagacctcattgctactttaaaaaaaattttttttttttttttgagacrgagtcttgctctgttgcccaggctggagtgcagtggtgcgatctcggctcactgcaagctccgcctcctgggttcacgccattctcctgcctcagcctcc

SEQ ID NO: 51539 - DNA, 201 bp, Homo sapiens
cccggcctcgctgcagctttctcccttgtttcacagtgctggcctacatgcagttgctggaggactactcggagccgcagccctctatgttctaccagacrccacagaacgagcacatctaccagcagaagaacaagctcctcatggaggtatacggcttcagcgactccttcagtggggtggactccgtgcaggagctgg

SEQ ID NO: 51540 - DNA, 201 bp, Homo sapiens
taatgatattcgtgtagcaattctgaagaaattttgtgtttattgtaggataaggcaaatgaatagattgatgatgttagaaaccagggttctcactgatwggaagggagctgcaaatatggaatcaaggaaggaggaagaacctggtggtgttggcttgcagtaagaaataacagtattaacttatgatttaaaaatata

SEQ ID NO: 51541 - DNA, 201 bp, Homo sapiens
gttaatgatattcgtgtagcaattctgaagaaattttgtgtttattgtaggataaggcaaatgaatagattgatgatgttagaaaccagggttctcactgwtaggaagggagctgcaaatatggaatcaaggaaggaggaagaacctggtggtgttggcttgcagtaagaaataacagtattaacttatgatttaaaaata

SEQ ID NO: 51542 - DNA, 201 bp, Homo sapiens
acagtacttgctatatgcccatcacaggatatattctaaggactaaaagaattgctaagaaatcttgaacttttacctttagtagttgttaatgatattcrtgtagcaattctgaagaaattttgtgtttattgtaggataaggcaaatgaatagattgatgatgttagaaaccagggttctcactgataggaagggagct

SEQ ID NO: 51543 - DNA, 201 bp, Homo sapiens
cagtgggatttgacccagtccatgggagctgtctcctctgctgacatgtgcatctggcaccccccggctcagcctccccatggtgaagtccacgtgcaggkagaggccagcttcgcatggctctctccctccactgtgacacttccagggctcactggctccttgccttgaagcactctttctgtatttgtcctgccccag

SEQ ID NO: 51544 - DNA, 201 bp, Homo sapiens
tcagagcctggccagatgggtcatctagaaatctctgggaccagcgtggcacgggccccggctgtgtatctagtgctctctgtggggttccttcctccctyatcttctggtgttggcttcatcttctgtccctcatgcagagggagggactcttcttcccatagggcctttcagaccttcatctccctccccagcatgtcc

SEQ ID NO: 51545 - DNA, 201 bp, Homo sapiens
tggctgtgtgacttgggtgaaaatgagccttcatgtttccagggacccctctgccacagaggcagctgctgcactaacaggacaccccatcatcctgaggrttccttcagaagacagctctcctcctgactgtcctgctggagctcacagggggctgcggaagccttgcttctggctgggtgaccgtgggcaaattgctta

SEQ ID NO: 51546 - DNA, 201 bp, Homo sapiens
ccagaccccctcccatgtgacactgatgccgtcatctgatgcccagtcccttttcagctgaacgaaggatgaagacacaatgttgtcctaaaattgattcmgtgaaatagcaagtagtgaaaaagtaaaatagaatttaaatctttagatttttgacatattttgtgtacttggttgtaatataaaatacgtttcttaccg

SEQ ID NO: 51547 - DNA, 201 bp, Homo sapiens; identical to SEQ ID NO: 14886

SEQ ID NO: 51548 - DNA, 201 bp, Homo sapiens
tgccattgttcattagttgagttcacagctgcctctccagaaagatgacgatctaattataattgctcatgaatcaatgaagaaccaggaatgttttcctktatcaacagatgcaaacaacacagacttctctctgttccttttgccctgcttgtaaagaagagtgaatctgaaagtggggcatccagggcactgtgttct

SEQ ID NO: 51549 - DNA, 201 bp, Homo sapiens
gaggcgactgatcaccctgcaccctcaggcgctaagcctctttgggagagtccaggatagcgtcccctggaccctcacacccagagtgtattgctgctagragtgttgcttcccagagccaggctctgcttggaggtcacttgcaaaccctgggtaagaactgatgaagtcacatggtaatggctgggggtattttttgtc

SEQ ID NO: 51550 - DNA, 201 bp, Homo sapiens
tcccctctgatgttagcatgaggaccaggcatatgccaagagctccccacatattagaagccccactcctggcttctaaggggatttcttaaattgtaagytttttaaaaatctaaattttaatatctaatttaaaaatttctgagaggaagtttaaaaacagccgctgctgatttaaccacttgattgggctccgggagg

SEQ ID NO: 51551 - DNA, 201 bp, Homo sapiens
gattcccatgtcccatggtgggcactgagattggggtgaggggagcacacttgagggacccttcacttcctcacagcccttgcccctttcctcagggtgcrctgggaagaacccccagcggctgcccatgcccacctcagaagctgttcagtttgggcagaaggaggttattgtggccaccttctgtccacggttttcttt

SEQ ID NO: 51552 - DNA, 201 bp, Homo sapiens
tcctccagaaccccccagtgtccctgcacatcccaggagtctgcttctggggaaccggaccaaggtttaagcattcaccttggggaggccacccccacccstctctccagacttggttaggggtctttggcctcacttgtgtagcacttgtcccctgacctcggtagcgatgcttcaggtctgccctccccgcgcctccac

SEQ ID NO: 51553 - DNA, 201 bp, Homo sapiens
ctagggatccctcttcaggttgggttggtgggaaggccgtctgaactggagcaggtgggctgtgtcagggaggcggtcaccggactggactctagccagcrgttcccacctccacgcgcccaccgcccaagcagccagagctccagccctagccgcccaaaacaatgcagggcaacggttttctcctgagccaagtgtgga

SEQ ID NO: 51554 - DNA, 201 bp, Homo sapiens
aggccacgtgtagagatgagtgccacttctgtttgccccatgtcatagccataggacatggtggcagttcccctttgaatgactgtggtccctaccttcaragaaaatcagtctggaatgttgggaagctgtgatggtagagatttcttctcttgaaacaatagaagactgcctctttttccatgcattccatcaccagac

SEQ ID NO: 51555 - DNA, 201 bp, Homo sapiens
agtttacctgacgagggctgtgggttctgtttaaatcctaggagatgcttaagttattagaatttttctctatttttaaagccagttgtgttaagaaatarcagctgtccactgaagatggtggcatttatcccaaaaaggagtatatttttgaacggtctggtggccacagatgacatttatgaatgttaactaagtgcc

SEQ ID NO: 51556 - DNA, 201 bp, Homo sapiens
tcagcatcctgagtagctggggctacaggcatgtaccaccacacctggctaattgttatatttttagtagagacagggtttcactatgttggctaggctgstctcaaactcctgatgtcaagtgatctgccagcctcagcctcccaaagtgctgggattacaggcgtgagccaccatgcctgccccccgccccgttgtttt

SEQ ID NO: 51557 - DNA, 201 bp, Homo sapiens
gtggaccagaagaagctactcaggtgtgccacctccagccagcccctggcagcccggggggtagcagccaggtgagaagcccacctctccagccctgcctsttccccaggagccgtgcctttctcagtttaccctccctccctgccagccccacagccccatcctggttctgcacaggccctttgatgaggtgcctcagga

SEQ ID NO: 51558 - DNA, 201 bp, Homo sapiens
attttgatgttgactgttacgcacagaggcgactgtcaggaggcagccactcatatggtggagagtcgccccgcctctccccctgcagcagcataggcaarctcagcaagtcagacgagcagctgtcctctctggacagggacagtgggcagtgctcccggaacacaagctgtgaaacactaggtgagccgccaccatcct

SEQ ID NO: 51559 - DNA, 201 bp, Homo sapiens
atcattgaggcactcagggcttctgtttgtgggcgctggcatcacagtgtagctggtagcgtggtctctctctcacacacacacacacacacacacacacactcacctgcgttcccatcctcacatccccaccaccatcacaggccccgtcacccctgatttgctattctcaaaatagtcttcattcgtgcgctcctgacg

SEQ ID NO: 51560 - DNA, 201 bp, Homo sapiens
aaggcagcaggcttctttcaagatgcctcacctggccttgccaggaagcagagcgaggtccagcccagccgttagaagcacattcccctgcaggatcagawcagctctggtccaacccccggagagactgcagggtctttgttttcccctctccgtcctctttcctaagagagtagttccaacaacaaatacttttcatcc

SEQ ID NO: 51561 - DNA, 201 bp, Homo sapiens
tctctactccaaattcccaaatgagagcttctgagcccagcttagagctgggccccattctcaaagaagggaagacctggcttggttcagtccagcaaggrtcgccctgagggctggctgcgtggtccacagaaggcagcggctgcgatgatgtcatgtatccccagctcctcagtgggtgttgcccagcttgtgtgatgg

SEQ ID NO: 51562 - DNA, 201 bp, Homo sapiens
tcgcttgaacccatgaggtggaggttgcagtgagccgagattgcaccactacactccagcctgggcaacaagagcgaaactctgtctcaaaaaaaaaaaaaggaagtgtgagacaagctcaaggggctgtgagctgccctttcagtagcagcagctgacctcagaggggaaccatttcttcctgtgcatcttttacaacca

SEQ ID NO: 51563 - DNA, 201 bp, Homo sapiens
cattgttgtctgtgtgcacaggcgccaggaggagctgccccagacacggctcctgacttcaggggcttcgcactcctgatagggaagaaattccagggccyggagtggcctgagctaaggagtggggaagtggaggaaacagcgccccagccgcccataccctctgactcttgctaggagaggagaggttgtttatggatt

SEQ ID NO: 51564 - DNA, 201 bp, Homo sapiens
tttgacaagtaagaattgggctagggacctggattacagggactcgggctagggactgcctgtgctgcaggggtgcggagttccctggcctcagcttggcrggagaaatgcacgtactgctgaggaaattctgtaggctaaagtcatggggagcgtgtgagtcatgatcaccagaaatgcctggacctgtggcatctttgg

SEQ ID NO: 51565 - DNA, 201 bp, Homo sapiens
gagaaatgcacgtactgctgaggaaattctgtaggctaaagtcatggggagcgtgtgagtcatgatcaccagaaatgcctggacctgtggcatctttgggygatgaagagggaaccagcttagcactgccacagacacaccatgtcctctggggcaagccaggattccttcctgggcctctgaaccccactctataattgg

SEQ ID NO: 51566 - DNA, 201 bp, Homo sapiens
agaaatgcacgtactgctgaggaaattctgtaggctaaagtcatggggagcgtgtgagtcatgatcaccagaaatgcctggacctgtggcatctttgggcratgaagagggaaccagcttagcactgccacagacacaccatgtcctctggggcaagccaggattccttcctgggcctctgaaccccactctataattgga

SEQ ID NO: 51567 - DNA, 201 bp, Homo sapiens
ggttgccgtccagcagagcatcatgcagccattaactgcactcacatgggaaaatgcccacaatggcttgttgtttaaaaaaaaaaaaaagtgaaaaaatrtttctgctgtgtgtggaattatgagaaatgtttaccgtctacgttatatatttttacagtgcttggatttttataatgagattgtttgaaaattttttaa

SEQ ID NO: 51568 - DNA, 201 bp, Homo sapiens
ctttggaaagcgggcatggcagaatgttaacggttgacgaatctaggtgacgggtatgtggacgttcgcttcataatattttttcagcacatcagtagatwtgattttttttttccagaatacaacgttggaaccaggcgtggaggctcacacctgtgatctcagcactttgggagactgaggcaagaggatcacttgagc

SEQ ID NO: 51569 - DNA, 201 bp, Homo sapiens
aatgcttgacaatacttggcatagagttagccctcgataaatttcagctgttaatgttattatagcaccttcacatgttgttgtgtttatattgtaaatcrttggttaaagatatttttattgtcatgatagctccatactttcaagatgcgtctttgtagtatttcgtatccatttagtcattcattcactgagtttgta

SEQ ID NO: 51570 - DNA, 201 bp, Homo sapiens
aacaacatgtcctactggtaagagaggcccagcgccaagccctgttgctctggatggtggcacgtctgggtgggctctgcgttttcctttgcagggagctwgaatggtaggagaaggagctgcctctttcattccgctaagctcctgggggttcccatgagcactgacaggctgaggacaggggcagggacaggatggggc

SEQ ID NO: 51571 - DNA, 201 bp, Homo sapiens
cccgtctttggcccaagatgtggaaaatcttaatagctcaaccggttccctcagacctttgtcttctgaaacagtgcttctcacactccagcactgcaggsccacctgttgaagcccagtgtcctgggtcccttccccagagaccccagttcatcagattcttaggtttgcaccagggctaaagagctggcatccagaccc

SEQ ID NO: 51572 - DNA, 201 bp, Homo sapiens
aggaacccccaaagcccatgagacaaagccctggatctataaggccctgtcccatctgacccccggccttcccctgggcacatacctccagctacacaggkctttcatacacactgcccctttgcctggtccagctctgctcatccttcaagtctcacccttccctgacttccagcttagattaggtcgccctgctagaca

SEQ ID NO: 51573 - DNA, 201 bp, Homo sapiens
ctccatccatgagcaactcacatgatttacagaagaattgctatgctgtgtatcttcacgtgggtaacacacttgttcctcacagcccatagggttttgtyattaaactattgagacccatgtgatggtggagtatcaagattgacaggttaatttcccatttatatagaacattatatgaaaattgatttttttaaggca

SEQ ID NO: 51574 - DNA, 201 bp, Homo sapiens
tccatcagtgtgcactgttaatcaaaatttggggatgggagttttagttgcgtttagttataaatgtgctttgattttatagttgtaaaggagctagatgygtatggcagacagactttaaggtgacccctaggattcttgcctcctggagttgacgcctttgtctcattgtctcacctggagttggatgtggcctgtgac

SEQ ID NO: 51575 - DNA, 201 bp, Homo sapiens
ttaatccttacaataggagaaaggtactgttaactgttctcatcctacagaggaggagactaagacacagagcttttctttgagacctgaaagagttaacrtttgcacatagtcatatactgagttggggcaaagttaggactaaagcccatctgactattccccatgcatctatatttttattgattctgatattattct

SEQ ID NO: 51576 - DNA, 201 bp, Homo sapiens
aggattccaggctatcgccacgttcttgagaaggtatcactggcttgggggaggggaaaagagaggacgatctaggcaaaagcaagatcaaggccctctcyaagaattttccagcctggcaggccctgttaggtggcatggtaccgctgtgtgagtgggagcgccacctggagatggccacgatagggtctctgttcccac

SEQ ID NO: 51577 - DNA, 201 bp, Homo sapiens
cttaaggttcttgtaatacagttataatgcataatatacaatacatatatataatataatatataatgcttcttataatacagtttaaacagaaaagaagygctcaggtgaagaatacgggttctcctttcccagcccccagccccactctcatttccttctgtagcctgcccgtgagcatgtgcagccatgcttgtgaca

SEQ ID NO: 51578 - DNA, 201 bp, Homo sapiens
atgctattgttcgtggcttaagaatgcctttagtggttttctgccctgggtgggccaggtgttccttgccctcattcccgtaaacccacaaccttccagcrtgggcattatggccatcatgaacatgtcacagtgctgcagagattccgtttatggccagttttggggccaatttatggccagattttggggggcctgctc

SEQ ID NO: 51579 - DNA, 201 bp, Homo sapiens
ctctgatagcgctgctgcgctctggcctgggtgacagagtgagaccccgaaaaagaaaattagctgagcatggtggtgtgcgcctgtagtcccagctactyagggactaaggaggggactgaagcagggggattgcttgagcccaggagttctgggctgtagtgcaccatgcctacctggtgtctgtactaagttcagcat

SEQ ID NO: 51580 - DNA, 201 bp, Homo sapiens
tcgtcctcccattttacacaccagaagctggtgcccaccttgctgtgagaagggcctgacaaaccctggcctgcctgactctgaggcaccagagctcccccagggcgggccctggcatgcgttgttgggggcagtgggatcacctggggccccctccctgtgagcagcccagcctcagggccctgtttgtgctccatgtgc

SEQ ID NO: 51581 - DNA, 201 bp, Homo sapiens
agtttcaccatgttggccaggctagtctcaaactcttgacctcaggtgatccacctgccttggcctcccaaagtgctgggattacaggcaggagtcaccayacccagccagtttctttgtttaataaagacggagtctctgtcacccaggctggagtgcagtggtgcaatcatagctcactgcagccttgaactcctgggc

SEQ ID NO: 51582 - DNA, 201 bp, Homo sapiens
gagtagtcgatgggactacaggcatgcgcaaccacgcctggctaattttttttttttgtattttttttagtagagacggagtttcaccatgttggccaggstagtctcaaactcttgacctcaggtgatccacctgccttggcctcccaaagtgctgggattacaggcaggagtcaccacacccagccagtttctttgttt

SEQ ID NO: 51583 - DNA, 201 bp, Homo sapiens
ttgtttctttgtttgtgatggagtctcactctgtcacccaggctggtatgcagtggcatgatcttggctcactgcaatctctgcctcctgagttcaagcarttctcccacctcagcctcctgagtagtcgatgggactacaggcatgcgcaaccacgcctggctaattttttttttttgtattttttttagtagagacgga

SEQ ID NO: 51584 - DNA, 201 bp, Homo sapiens
agtctttcccactgtggctctacatctgctccctcaagctgagttctccctgagtggaggaactgcccctgtctttctcatctggccttaagtcctctgcrgtcagaagcacctattaagttactacaccttgtttgtttctttgtttctttgtttgtgatggagtctcactctgtcacccaggctggtatgcagtggcat

SEQ ID NO: 51585 - DNA, 201 bp, Homo sapiens
gtgtctccttcctccttgccctgccctgcctctctgtttgtccaaatgcacgtagctgaattcgcctgagttttctccatactccactatatgcccctctrccaagaccagctaggtcggggagaccctaacccagcggcgctagaggaattaaagacacacacacagaaatatagaggtgtgaagtgggaaatcaggggt

SEQ ID NO: 51586 - DNA, 201 bp, Homo sapiens
ccgtgccatctcccctgcctctctcagagcaaggactcaaatccaccctggctaccaccccccagcactctgcacccagacaagcagtttgcattgtttttccctctagatttggtgttgtactgcgaggcattcctgaccacctacaggaccttcatctccccagaggagctcatcaagaagctgcagtacagatatcct

SEQ ID NO: 51587 - DNA, 201 bp, Homo sapiens
cccattttgtaccatccaactctgtaaaataaatttactttggtgcttttgactaaattgaccgaagccagatatctgccacctaagctaatgtattttcygtctacaattataaaagtgatgaagggctgggcgtggtggctcacgcctgtaatcccagcactttgggaggccgaggcgggcggatcacttgaggtgagg

SEQ ID NO: 51588 - DNA, 201 bp, Homo sapiens
acttaacagagcattaagtgcctcttaaacttggtctctctggttctgtgggtcttttttggaatgttgtcccaaatattactccggttctatacttgctyccattttgtaccatccaactctgtaaaataaatttactttggtgcttttgactaaattgaccgaagccagatatctgccacctaagctaatgtattttcc

SEQ ID NO: 51589 - DNA, 201 bp, Homo sapiens
ctctttggccaggctggtcttgaactcctgaccttgtgatccgccgcctcagcctcccaaagtgctgggattacaggtgtgagccacctcccagcctaagsctggttctttgggagtctagactgcagtatgtggggtggacttattgaggcttgttttgttgatgatttttaatggcagtaaatgttggatagcacttaa

SEQ ID NO: 51590 - DNA, 201 bp, Homo sapiens
agatgtgggttcctcgagattcctctacccagcagctcgggaatgagggagaaggtgggagcaggtggtgtatgtccagagcacaagatttaagcagtgcrtgtttgcacccagcctcacagtgaggagcacagctgcggagcctccttgggcctcacacctcagcaggcacggggggtggctgcagggagtgagtctggc

SEQ ID NO: 51591 - DNA, 201 bp, Homo sapiens
acttgaacccaggaggtggaggttgtgatgagccaagattgcgccactgcactccagcctgggtgacagagcgagactccgtctcaaaaaaaaaaaaaaaagcaaataaataaattctgtctcctgctcgactgaaccctcagggacaagaggctatgtctgcttggttcacagctctttcttagcgccaagcaaagggtc

SEQ ID NO: 51592 - DNA, 201 bp, Homo sapiens
acctgggaagcagaggttgcagtgagccaagatcacgccattgcactccagcctgggcaacaagagcaaaactgcacctcagaaaaaaaaaaaaaaaaaaagtgtcagtggagtgttgggtgtgaaagtgtcaaagaatgagcagaggagaattggccacagggagcatgggcgttcttggagttttgctgaaagcgggag

SEQ ID NO: 51593 - DNA, 201 bp, Homo sapiens
ggatggcttgagcccaggaggtcagggctgcagtgagccaagatcgcaccactgcactccagcctgggctacagagggagactctgtctcaaaaaaaaaaacaaataagtggctgggcacggtggctcacacctataatcccagcactttgggaagccgaattgggcagatcacgaggacaggagttcgagaccagcctga

SEQ ID NO: 51594 - DNA, 201 bp, Homo sapiens
aagccaggaatggtgtggtttctaggttaatacctggggcagagtgtgtgggccaagcaaatgcagctcgtgggtatgccactagcttcactggaccccaragtatcgtcttcagagttccagatggttctcgtgaaagagaaggatgaacactttgactgctcagaaataattatgggatgttgtccctccatcaaggcc

SEQ ID NO: 51595 - DNA, 201 bp, Homo sapiens
cattcatctttaatttgttcacatctgagattgctccataggaacttgcactccacagccacttgcaggcaggaatgctgggaagacagagcagccccgcrgagggcccctgtccagaactcagcacccactcctctttccaggagccaccggctgggaaagacggacatcccagagatccctcagcggtcagcggcgtcc

SEQ ID NO: 51596 - DNA, 201 bp, Homo sapiens
tccgttctcccatgggcatctgctacttggcatgttccagtcactcctagaagcatcaaaatctgggatggtttggttcaagaaacataaacatgtacatrtaacaaccagatcacattatcttaaggtaaaaatcacatcaaatctcaaattgttattctttggaatggataaaaaggatattagtatttttgtcaattt

SEQ ID NO: 51597 - DNA, 201 bp, Homo sapiens
gaagcaggagagcttcagtggcacagattgtgggggatgattggggctgtgtgggtacagagtgagtttgaggtgcctgtcagagatctacaaggaggtgkccattaggccattaaaatctggagtataaaaatctggagttcagaaaagaagtgtaggcttttttgagagttgttgacataaagatggtgtttaaagcta

SEQ ID NO: 51598 - DNA, 201 bp, Homo sapiens
ggtggaaccgccgtgcatcccgtacctgtgagtagcagcccctccaggcccccagccccgcctgggtttgcctccattgctctggggaagatctgtcaggytccagcagagaaatcttaatttaggggtttctaacggagacatttgtacttggttttacttaaggttcttgtaatacagttataatgcataatatacaat

SEQ ID NO: 51599 - DNA, 201 bp, Homo sapiens
ctgccccagcattgccccagcactcgctcacccctgtccggtcctgtcctgtcctgtcctgccagggcctggccgagtactgcacactgatcgacagctcstcctccttccgagcctaccgggccgccctctcggaggtggaaccgccgtgcatcccgtacctgtgagtagcagcccctccaggcccccagccccgcctgg

SEQ ID NO: 51600 - DNA, 201 bp, Homo sapiens
ggacaccagaggaaaattaccctgaggatcaccgtgctgacagagcgcgtgacagatggagggatgagcacacttcccggcttctgcctgctgtcctggcrtcattattaacagagtcctccctacccccttcgaaatgtcctgatttggatgagaaaacactgagggagtaatcattaacatctatcgcgttccacaaat

SEQ ID NO: 51601 - DNA, 201 bp, Homo sapiens
ggacccacacctggctgggtgtttgtgcgtagtgggacctgtggagttgggcagagggtggttgaccctccagttagtgaggaggaccagggctctgcccyagcattgccccagcactcgctcacccctgtccggtcctgtcctgtcctgtcctgccagggcctggccgagtactgcacactgatcgacagctcgtcctcc

SEQ ID NO: 51602 - DNA, 201 bp, Homo sapiens
gcagcaccttgcagggcaaatgcgaattcttgggtctaaggtgaagtgggcgggtgctcctgggctcctgtactgggagcatgccctgtggtcataacccmggtagcaggttagcttggcggctgaatgagggaaagcagatttttagggagctgcaaaggaggtctgtggctttgattgtggaagttgcttatgtttcct

SEQ ID NO: 51603 - DNA, 201 bp, Homo sapiens
tagacatcaggaccaccagtacattggtaattcgtctcttagtggaaggtggcttgtgggtgtttggcttctcagcctgttggggaccatttttagatttstgaattaatcctttctcatggccggtgaagaaaaaaacacatggtgaaccctgtggacggcacgtcccggcacccgcaggaagctgccgggctccctgct

SEQ ID NO: 51604 - DNA, 201 bp, Homo sapiens
gagttcgagaccagcctggacaacatagagagacgccccccccctacaaaaaattaaaattagccaagagcagtggtgcacacctatagtcccagctactygggaagctggggcagaaggatcagttgagaacaggagttcaagactacagtgagatatactcacagcactgggtgacagatcaagaccctgtctcttaaa

SEQ ID NO: 51605 - DNA, 201 bp, Homo sapiens
tgcctccattgctctggggaagatctgtcaggctccagcagagaaatcttaatttaggggtttctaacggagacatttgtacttggttttacttaaggttmttgtaatacagttataatgcataatatacaatacatatatataatataatatataatgcttcttataatacagtttaaacagaaaagaagcgctcaggtg

SEQ ID NO: 51606 - DNA, 201 bp, Homo sapiens
aagaggtcgcgccccccaagcctcctctgcctggcattcgggtggttgataataggtaattaccttcctatttgtccagtgcctcccatggcagaatgagmaagaaagggaggaagacagggctcgggccctttcccctcagcgctgagggcttggccccccttgggaggctgactctggagctgtccccaccccgccggc

SEQ ID NO: 51607 - DNA, 201 bp, Homo sapiens
tgtggagttgggcagagggtggttgaccctccagttagtgaggaggaccagggctctgccccagcattgccccagcactcgctcacccctgtccggtcctktcctgtcctgtcctgccagggcctggccgagtactgcacactgatcgacagctcgtcctccttccgagcctaccgggccgccctctcggaggtggaaccg

SEQ ID NO: 51608 - DNA, 201 bp, Homo sapiens
cccattcagttgttcaagggagtctttcctctttttttttttttcaaatgattgaacatgggttgtaaaacaggattactttggttttgtccctgaatgcrtggtagcatttatcatttaaacctccacataaatgccacttgttcaagctgtataaccttgggcaagttacttccctgagtttcaagtaggttttaaaat

SEQ ID NO: 51609 - DNA, 201 bp, Homo sapiens; identical to SEQ ID NO: 14888

SEQ ID NO: 51610 - DNA, 201 bp, Homo sapiens
gaggccgaggcaggagggtcacttgagcgcaggagttcgagaccagcctggacaacatagagagacgccccccccctacaaaaaattaaaattagccaagwgcagtggtgcacacctatagtcccagctactcgggaagctggggcagaaggatcagttgagaacaggagttcaagactacagtgagatatactcacagca

SEQ ID NO: 51611 - DNA, 201 bp, Homo sapiens
caccttccaggagggtggcgccatcgggccatccagcccacacaggtgctcactgactgctccccatcccctgcaccaggcactatgacatgcggaggaaygacgacattataaacttcttcaatgacttcagtgaccacctggctgaggaggccctatgggaactgtctctgaaaattaaacccaggaacataacaagga

SEQ ID NO: 51612 - DNA, 201 bp, Homo sapiens
gctcacatctataatcccaggactttgggaggccgaggcaggagggtcacttgagcgcaggagttcgagaccagcctggacaacatagagagacgcccccyccctacaaaaaattaaaattagccaagagcagtggtgcacacctatagtcccagctactcgggaagctggggcagaaggatcagttgagaacaggagttc

SEQ ID NO: 51613 - DNA, 201 bp, Homo sapiens
gcagcatccgtttgctgcgaggctgtggggatggtccccgcggcaccttccaggagggtggcgccatcgggccatccagcccacacaggtgctcactgacygctccccatcccctgcaccaggcactatgacatgcggaggaacgacgacattataaacttcttcaatgacttcagtgaccacctggctgaggaggcccta

SEQ ID NO: 51614 - DNA, 201 bp, Homo sapiens
cacccacccactgttgcctccaggagaatgtctgatgtgttttaaaggccccgagatcatctcccgtttgcctatcttcctccccacagaagcactccatyctggggaaaagcatgtttagctatggcagtccagcgtagggttttgcccaacaggatgtggtttctaaagcagacggaagctgcacacaaggccccaagc

SEQ ID NO: 51615 - DNA, 201 bp, Homo sapiens
ctcaaaaaagaaaaaacaccttcctccatactgcacactactttcttgtacgttctttctttgctaactgaaagttatgggtatttactctcactaagagrtctatttgggtgctagaaatctgttgaaatatttctttaccatcttggcttccagaatgaatctggataattaaaactgctagcagacccaagttgtgag

SEQ ID NO: 51616 - DNA, 201 bp, Homo sapiens
aatgctttgctctcctttaaggaagggccccacagaagaaccttgtgccaatgcaagtaacttctacttccacctggggagacggatttagatgtagggcygcttgctgcagttttggggaacatgaacatgcttagaaatagtcctgctgcctccacaggcatcctgggcaaggctggggactgtcttgcccccaggggg

SEQ ID NO: 51617 - DNA, 201 bp, Homo sapiens
tgggcacactgacgggcctaaaggccaaacaggaaaggggagagatagagagagaaggagagaagaagggaggagaggaggaggaaaacggaatggcccaygggagggaagtggaagacagtccatggggctctcggcacctgttggaaaaaataagttcctgccatcctgacctttgtcctttgttcctccctgatgcca

SEQ ID NO: 51618 - DNA, 201 bp, Homo sapiens
cttgagccaagattatgcagtaatgaccaatttctggcaacttctcttcccaaacacttcaccatgccagtgaatccattcatttacatgaccacatttcrctgtaactggtggagctgacaattctccagggcttggagctcaagtcactgtggagcaaccattctgatcaaggttcctcagcctgtgtccctaaccctc

SEQ ID NO: 51619 - DNA, 201 bp, Homo sapiens
ttttgcattcacccatcttctcccaagcaacgcatttttgttcttttacatccttttttcttaggatattcaggtggtttttaaaaataagctccactaargagtttatttgaaaagggagaagatattttttggacccaacataatgctaatgttgcctttctttggtgagaagaatgccatcttgtcattcacacagtg

SEQ ID NO: 51620 - DNA, 201 bp, Homo sapiens
ctgttgaaatgcaaactgagtaaaaatagttgtcagacttctagaactgaatttgaatcatttttcagtctgtactaaatctttctataaagggttgatgytattcagatcaacacttagtgaattacagagcatcctagaatgtattggaggttttgcaagagttaatttgccatgaagccattggccaaaacgtagtat

SEQ ID NO: 51621 - DNA, 201 bp, Homo sapiens
ataagtataaattagagcccctgtcaggctgttgaaatgcaaactgagtaaaaatagttgtcagacttctagaactgaatttgaatcatttttcagtctgyactaaatctttctataaagggttgatgctattcagatcaacacttagtgaattacagagcatcctagaatgtattggaggttttgcaagagttaatttgc

SEQ ID NO: 51622 - DNA, 201 bp, Homo sapiens
cctgtgcttttccactcttcctaaaagacccagtgctgctctgaagtgtgaaggctggattagatcccactcagcttgacctggtcttgtggaaggaggtwcatgcagaccagagccccttccaggtcactgcgaccctcgggataacgtagagccacctatagagaaaggcccagctctggaggagacggcgttacctcc

SEQ ID NO: 51623 - DNA, 201 bp, Homo sapiens
cctgacaccaggcaaacaattgttgtgattggagttttgctgttttgttatctcaaagcaacagaaacgttgcttaaatatgttcataatctcctctccckgaaagtagaagaaccagcgtttttagttctcagtgcttaaggcatccagggttttttgggtaaacaggaaaccccttcacatcccgcatagtgtgcagct

SEQ ID NO: 51624 - DNA, 201 bp, Homo sapiens
ttctcatgcagcagtgcctggctggggcagggccttgaggggttcatccatacctatgtatatcctcagagaatacacaaggtcataggcctcacatttgkgggtcccaagtgccatggggaatcaagacagtctgggccagagggtggcacagggacaacttgctgggctggtgggggcctgtcaagtgaggcctggtgg

SEQ ID NO: 51625 - DNA, 201 bp, Homo sapiens
ttgaatttggagggccaggaacaagctgggatgcaggggaggctttctaaactctacagtgcttctagagatgacgaggaggtagggagtagaagagagcyggacagattagggagctcccagggtgagcttgtgggcaggcctgcagaggagaagaggctcttccctaggagctcagagggatttgttctggaagactga

SEQ ID NO: 51626 - DNA, 201 bp, Homo sapiens
ttaaaagcaccacttttagaatagaaatttaatatgtttacttacgtttggattgtctctggttctccttagaaaaccatgagttaaaatgtctgaagatkttcattggaagcagctgggtatacagacagacaggtttgatgttttattttgtggttttgtttagttgtgttcagtaatttaaatgagaagagtggtagg

SEQ ID NO: 51627 - DNA, 201 bp, Homo sapiens
agggagtagaagagagccggacagattagggagctcccagggtgagcttgtgggcaggcctgcagaggagaagaggctcttccctaggagctcagagggayttgttctggaagactgatgggagatgtatgcagctgtttagaggctgctttggagaacaaatgaacatggttctggttgtgcaagcagttactgtggttc

SEQ ID NO: 51628 - DNA, 201 bp, Homo sapiens
ccagtctcctggggtgggagcagaccaaggcctcctcagctgaagggaagaaggtccttggactgcatgtgtcagtttcagtcactcattcctttcttccytccttcagtggcttcactcatcgcctgcctcacggagcaacctcctgagggcctggagttgttcttgttcttgggacacagcaaagatcccggcctcctg

SEQ ID NO: 51629 - DNA, 201 bp, Homo sapiens
accttggagcagttcactgggcctgctaaagtggccacaggcttgcccagcacgctgcctgaagatggaataaataggtgtctcacgctcagtgtgctacrgtttcaaatgtgtgaagatgcttttattgtaaatcgaaaagaaatttataatgactgcatttcatggtcacatttttgtcatgatatattttctcagaac

SEQ ID NO: 51630 - DNA, 201 bp, Homo sapiens
aagcatgtattacccgaatctcatgacagggaacaggcagatccaacttacgggggacctcctccaagacaactggcaggcacttttcaaaatatgtcaaygtccaaaagccagtcccgtccctcctgcctccagactagataagggaaattggagagacatgacaaccagatgcaatgtatgctccttaattggatcttg

SEQ ID NO: 51631 - DNA, 201 bp, Homo sapiens
ggccctgtttgtgctccatgtgctggtggcaccgtctctgagcactggtgtcccctctgtcacattggtcaacggtagcccctgcagcatccgtttgctgygaggctgtggggatggtccccgcggcaccttccaggagggtggcgccatcgggccatccagcccacacaggtgctcactgactgctccccatcccctgca

SEQ ID NO: 51632 - DNA, 201 bp, Homo sapiens
gcccagctctggaggagacggcgttacctcctgagcccaggagcgagcctgccttgccttactgtgggcagtagggagtatgcccatctcagcagcaggaytggtcacagccttgacagcaggaacagagctgagagtgcctcgcattgggggctttcaaaagcaaccactctgatgcagctgtttccaacccctggttgt

SEQ ID NO: 51633 - DNA, 201 bp, Homo sapiens; identical to SEQ ID NO: 14892

SEQ ID NO: 51634 - DNA, 201 bp, Homo sapiens; identical to SEQ ID NO: 14896

SEQ ID NO: 51635 - DNA, 201 bp, Homo sapiens
gcagctttggtgcagcctagcctctagctcccatgtaacagatgcattggtcccaggctctggccaagaatccattttcttcctcattttccttccctacygacctgaggctctggctgctgtgtctgactcaagagtttcccaggtagttcctgtctgcagagcccttgaaacacagtttggctcctgcagtgcgttccc

SEQ ID NO: 51636 - DNA, 201 bp, Homo sapiens
gtcatggcttttggttttttgtttttgtttttgagatggagtcttgctctgttgcccagactggagttcagtggcacgatctcggctcactgcaacctccrcctcccaggttcaagcgttctcctgcctcagcctccggagtagctgggattacagccgccctccacaacgcccagctaattttttgtatttttagtagag

SEQ ID NO: 51637 - DNA, 201 bp, Homo sapiens
ggatgggtttaattcagcaagctcaggacatcaacttttccaggccgggttgcaaaagacatgcagttgaggaggatggccccgagcaaagcagggccacrggtcagcaggctgaggaagacgggcatgaagcctgcgcagaaccaaagaacatctgcacacatattaattaattttgggtctgagtgcgtcatggctttt

SEQ ID NO: 51638 - DNA, 201 bp, Homo sapiens; identical to SEQ ID NO: 14900

SEQ ID NO: 51639 - DNA, 201 bp, Homo sapiens
tactgagaagtattctcattcactccttccctgataccagggatgggtttaattcagcaagctcaggacatcaacttttccaggccgggttgcaaaagacwtgcagttgaggaggatggccccgagcaaagcagggccacaggtcagcaggctgaggaagacgggcatgaagcctgcgcagaaccaaagaacatctgcaca

SEQ ID NO: 51640 - DNA, 201 bp, Homo sapiens; identical to SEQ ID NO: 14902

SEQ ID NO: 51641 - DNA, 201 bp, Homo sapiens
ctcttgccagctgactccctctggggccattcttcctggctagctttgaggaagaggcccctgtggcagggagctgaaggtggcctcctgcctatatccarcaagaagctggggaccttagtcctacagctccaaggaaatcagttcttttgcccacaccccgagtgggcaacttgaatgaagacccttccctggcggagt

SEQ ID NO: 51642 - DNA, 201 bp, Homo sapiens; identical to SEQ ID NO: 14904

SEQ ID NO: 51643 - DNA, 201 bp, Homo sapiens
attacaggtacacgccaccatgcccagctaatttttgtattttttgtagggacgaggtcttgctatgttgcccaggctggtttcaaactctttttttttttctttttttgagacagagttacgttcttgttacccaggctggagttcttgttacgttcttgttacccaggcagtggcgcaatcttggctcactgcaacctc

SEQ ID NO: 51644 - DNA, 201 bp, Homo sapiens
atgtcattaaaaggagaatacctcaggaaccattagtaatggccaggtttgggacattcagcacccagtatgccggaacctcagagaagggattcagtacrgtgccaacatgtccttcatatatcctttggttaaattctgagatgagccccagacatagagctttggattactatcagagcggccctttattcctgactt

SEQ ID NO: 51645 - DNA, 201 bp, Homo sapiens
ctggggccattcttcctggctagctttgaggaagaggcccctgtggcagggagctgaaggtggcctcctgcctatatccaacaagaagctggggaccttaktcctacagctccaaggaaatcagttcttttgcccacaccccgagtgggcaacttgaatgaagacccttccctggcggagtccccgctgcgtagtaccctc

SEQ ID NO: 51646 - DNA, 201 bp, Homo sapiens
acaggtgtgcaccaccatgcccggctactttttgtatttttagtagagacagggtttcaccatgttggccaggttgatctcaaactcctgacctcaggtgrtcctcccaccttggcctcccaaaatgctgggattacaggtgtgagccaccacacccagcctagctgttctcaaactcttgagctcaatcctcctgcctta

SEQ ID NO: 51647 - DNA, 201 bp, Homo sapiens
caggctccagcagagaaatcttaatttaggggtttctaacggagacatttgtacttggttttacttaaggttcttgtaatacagttataatgcataatatmcaatacatatatataatataatatataatgcttcttataatacagtttaaacagaaaagaagcgctcaggtgaagaatacgggttctcctttcccagccc

SEQ ID NO: 51648 - DNA, 201 bp, Homo sapiens
ttctttccccttagagtttccacaatatcccttttgagcagttagggttagaggactatgaatgaactggactgttcgctacaaaattaaattcgaggacrttttaattaagtttggttatgagtacgtcatagtttttatccctgggacatacaagagccttaagacatcttgtgtctaaaacactgcattcttagcaaa

SEQ ID NO: 51649 - DNA, 201 bp, Homo sapiens
ttgccactaggaaacttagaaccaaacgaatacaactcagttgcagtaaatcttgagttctaagcttctgactctgtttgcttttaaagtgtctcatttgytgtgtgcttagtgttttctaaataaatacctaccattaggggaggaattgctttgtaactttgcacattagctccgtggtttgcgttgacctcgattcta

SEQ ID NO: 51650 - DNA, 201 bp, Homo sapiens
tgaagaggctggaacatagtctgggaatgtgtgtctggtggcagttgtggtcattggatgattctaaaaacgaattagacatgccccagactgggaggggyaagtgtgccggtcctgcagacgcctctgagagaccctcatggtcggctccggcagcttctcagagctgagccccagggcgttgggcacgaaggataccaa

SEQ ID NO: 51651 - DNA, 201 bp, Homo sapiens
tggtcctgcctgtctgaggaccttggagtgcattctcccaatgggtactgaggcctcacgccttagagcccccagcatccctactcatgctgggaagatgygctcccctcaccctgctgtggccacacagaagcccctggtttcctcagaggcacctctggcaagctcctttcacaaatcttgcgaaacttggcctttaga

SEQ ID NO: 51652 - DNA, 201 bp, Homo sapiens
tatggtagtgaccacatgcccatttctttcttgggatttcgtcccagcctgacaaccttggaacagaacaagaggacaggaggtgtcgttccaggtatgtrttagctgcaccagccactctttgtggcatctgctacccatcaaaggacgtggttgggctgggagccaagttaagttttctcattgtttggcagttgtgtc

SEQ ID NO: 51653 - DNA, 201 bp, Homo sapiens
tcctcccaacagccctgtacaggagacactagggttatccccattttacagatggaaaacctgaggcacggagacctttaagtagtgcccaaggccaaacrggtgagaaatggcagggtccagactcaaacccaggctgccggagccccgtctgagttctgaagacgtgtgaatgacacatggatccactccccacagagg

SEQ ID NO: 51654 - DNA, 201 bp, Homo sapiens
tgtttcccaatcatgctgtgactttgcacctagttcttttctctgagctttagtttcttcatctgcaaaatggcaattaatgtctgcctgtcagggctggygtatagtaagtgctcagtaaattacaggctatcttttgaggagcaagaagtagactagctcctgactaacccttgccttaaattcctcttctctaccttc

SEQ ID NO: 51655 - DNA, 201 bp, Homo sapiens
taactgtgtagagtgacttacaacccagccttggccggggagggcccaaggaaaacaagtgccattgaagtggaggatggctttaaacagagccactctgyttcagacatggcaccttcctcttctagaaaacactcgtgtgctaaggactcctgtgcatgtaaggaagcacgggccagcacagaaggcaagctgttccac

SEQ ID NO: 51656 - DNA, 201 bp, Homo sapiens
ttttccaggttcagcatttacagatttgtttcccaaccaggaggggcttatcctaaggaatgttctgatctgagatgagattagaacttcccctgctgtcraagtcaaagggtcccatctgcctgtcacttcccatgtgccctgggctgtgctgggctagtcatcagcccctccccgtctttggcccaagatgtggaaaat

SEQ ID NO: 51657 - DNA, 201 bp, Homo sapiens
catctatgacattgattttgggaagtgctaaatgggttggttgtgcatcgtaaacatcaacattgggagtaatccacaaatccacccctcaagtggccagraccagttcccacaactctccagggcacctgttctcccccagctcaactgccctgcactttccacagccagatcctgcaccgtctgccagtctcggttcca

SEQ ID NO: 51658 - DNA, 201 bp, Homo sapiens
gtggctggtgtgtgaagcagaactgattcaaatccagggtctgtcacttactcctcggcctcactctccctgtctgtggcatgaagacagtggtacctgtrttggagggtcacttcgaggcttcagtgagatgaggcctgttgagtgcctgcggtggtgctgggtgctcactgcacaagaagtggtcctagtcattgctgt

SEQ ID NO: 51659 - DNA, 201 bp, Homo sapiens
atggcagtaaatgttggatagcacttaactaatcatcaaaatagcttttgaaacatttttgtacacattagtttctttgttgttttgggctttgttaattwgtttctttttttttttttttttttttttgagagggagtctcgctctgttgcccaggctggggtgcagtgatgcagtctcggctcactgcaagctccacct

SEQ ID NO: 51660 - DNA, 201 bp, Homo sapiens
actgacagtcagccaccacctgcgttgtgtacaggagacttttgatcttggctctcacaccctcatccgtgttagaggcagcatgagcctgagctgagagktgggagacctgcctcatggcccctgggcctgcactgatgcactggatcagtgcccctccccaaccctgtctttccatctgtgcagtgagccagtacagaa

SEQ ID NO: 51661 - DNA, 201 bp, Homo sapiens
agatggcacaggaccaacaaaaaacaacccaattttggccgggtgcagtggctcacacctgtaatcccagcactttgggaggctgaggcgggtgaatcacraggtcaggagattgagaccatcctggctaacatggtgaaaccccgtctctactaaaaaatacaaaaaattagctgggcatggtggcacgcgcctgtagtc

SEQ ID NO: 51662 - DNA, 201 bp, Homo sapiens
tgggtgcagtggtgcgtgcctgtagtcccagctactcagaaggctgaagtgggaggattgctttagcccgcaaggtcaagactgcagtgagctctgatagygctgctgcgctctggcctgggtgacagagtgagaccccgaaaaagaaaattagctgagcatggtggtgtgcgcctgtagtcccagctactcagggactaa

SEQ ID NO: 51663 - DNA, 201 bp, Homo sapiens
tgggggtttagcagcacaatgtagtctacaagtctataccctcaagggtgtggtctaccagtctgtgcccttagggttagcatctaccagtccataccctyaggggcagagtctacaagttcataccctttgaggcagaatctacaagtccaaggttgagtctccacagatctccagctgtttgagtgcaggcttctctcc

SEQ ID NO: 51664 - DNA, 201 bp, Homo sapiens
gtgttggtgcacacactggtctgaccctccctttgcacggtccacatggagtgctcctctttggggaaaaggactgtgccgctgtccccatgttgtgaagyccccttgaggcctctccctcccactggtgcatgttcctccttggcctggcgtagctcacgtagtacgtaggtgcttcaggttatttcacaccgttgactc

SEQ ID NO: 51665 - DNA, 201 bp, Homo sapiens
agcccctccttggggggggggtgttggtgcacacactggtctgaccctccctttgcacggtccacatggagtgctcctctttggggaaaaggactgtgccrctgtccccatgttgtgaagcccccttgaggcctctccctcccactggtgcatgttcctccttggcctggcgtagctcacgtagtacgtaggtgcttcagg

SEQ ID NO: 51666 - DNA, 201 bp, Homo sapiens
agatcacattgagagagagagcagggagcatctgtgggcagaacccggtagccgggggtgggagaggggtttctcaaggcagcccctccttgggggggggktgttggtgcacacactggtctgaccctccctttgcacggtccacatggagtgctcctctttggggaaaaggactgtgccgctgtccccatgttgtgaagc

SEQ ID NO: 51667 - DNA, 201 bp, Homo sapiens
gggcacactgacgggcctaaaggccaaacaggaaaggggagagatagagagagaaggagagaagaagggaggagaggaggaggaaaacggaatggcccacrggagggaagtggaagacagtccatggggctctcggcacctgttggaaaaaataagttcctgccatcctgacctttgtcctttgttcctccctgatgccat

SEQ ID NO: 51668 - DNA, 201 bp, Homo sapiens
agtgagctgagattgcgccactgcactccagcctgtgcgacagagcaagactctgtctcaaaaaaaaaaaaaaaaaaaaaaatatatatatatatatatatgaatcaaaatacaagcacacagcaaatgccttacaattgaatgaagaaactgctaattctgagaaagcagaatctgccattataataaaaatgcagagaa

SEQ ID NO: 51669 - DNA, 201 bp, Homo sapiens
gagcttaacaaacccaaatcttcataatgagcaggaaacaaacctgacctttgctccagatggagacactatctccatcttgaaagattattcactattcraaaatccttcaagagatgttctggagaaattagcaactcagattcccatgcagaattggctaacagttttatatattacatacacatatgcaccaagcta

SEQ ID NO: 51670 - DNA, 201 bp, Homo sapiens
cagtgagctgagattgcgccactgcactccagcctgtgcgacagagcaagactctgtctcaaaaaaaaaaaaaaaaaaaaaaatatatatatatatatatatgaatcaaaatacaagcacacagcaaatgccttacaattgaatgaagaaactgctaattctgagaaagcagaatctgccattataataaaaatgcagaga

SEQ ID NO: 51671 - DNA, 201 bp, Homo sapiens
gggaggcggagcttgcagtgagctgagattgcgccactgcactccagcctgtgcgacagagcaagactctgtctcaaaaaaaaaaaaaaaaaaaaaaatatatatatatatatatatgaatcaaaatacaagcacacagcaaatgccttacaattgaatgaagaaactgctaattctgagaaagcagaatctgccattata

SEQ ID NO: 51672 - DNA, 201 bp, Homo sapiens
ccgggaggcggagcttgcagtgagctgagattgcgccactgcactccagcctgtgcgacagagcaagactctgtctcaaaaaaaaaaaaaaaaaaaaaaatatatatatatatatatatgaatcaaaatacaagcacacagcaaatgccttacaattgaatgaagaaactgctaattctgagaaagcagaatctgccatta

SEQ ID NO: 51673 - DNA, 201 bp, Homo sapiens
acccgggaggcggagcttgcagtgagctgagattgcgccactgcactccagcctgtgcgacagagcaagactctgtctcaaaaaaaaaaaaaaaaaaaaawatatatatatatatatatatgaatcaaaatacaagcacacagcaaatgccttacaattgaatgaagaaactgctaattctgagaaagcagaatctgccat

SEQ ID NO: 51674 - DNA, 201 bp, Homo sapiens
gctgggactacaggcacactccaccacgctcagctaatttttgtactttttgtagagatgaggcgctgctatgttgcccagagtggtcttgaactcctggrctcaagcaatccttccacctcagccttccaaagtgctgaaatttataggtatgagccaccacaccgggccaattacaagttgacaaaggaaaatgctcta

SEQ ID NO: 51675 - DNA, 201 bp, Homo sapiens
aaatttaaagattcgctttgaacctatttgatcagaaagtattaaatatcactaccacatgagttaaaacaaaaaatggaataaaaaacaaaagtggtgtctatgtaatcagtgaattacttgataggacattttaactattttacagttcttcttagcaccagaataaactggttccaaggttaaaaaaaaaaaagaaag

SEQ ID NO: 51676 - DNA, 201 bp, Homo sapiens
actttcaccttatttgactaattttgactaattgttgagaaaataagtctgaattaaagagtcaaaattgcagtttatttcagagaaatttttattctccratgcacatggtaactagtgttataccagaaagaatggtaactagtgttataccagaaagaatatcagcgagtggagctccttgaggtatcttgaggatta

SEQ ID NO: 51677 - DNA, 201 bp, Homo sapiens
tctgtgcttccactttctcatcagcaaacagtgataataatagcacaaactcatagggtgactgtgaggagtaagtgagctcatctgtataaagcacttargatagtgcctggagcacagtaagcaccatgtaagtatttgattgtgttattttttatcattattatttactaccaccaccatgacatagtcctccctgat

SEQ ID NO: 51678 - DNA, 201 bp, Homo sapiens
tgaaacccaaactaagaaagatcctgcctaatcttaggatttaggacccaaaacaaaaagttgtttgggcctcgtggtacaaatagtgtcagctgatcagracgagaacagtgaccacaagagcaaggccaagatgagaagtccataagagatggaaataaagaagaacccaaaagaaatttgtaaagctctaaacctgtg

SEQ ID NO: 51679 - DNA, 201 bp, Homo sapiens
atcatctcactgctttttcaccaaagccttgcatgaaaattagaggaggcctctttatattatctccaccttacagatggaagcttgaaagttaagcagcytaaggtcacccagctagtgattaacagagtctggaggcaaacctgtgtcttgtgattccaaattctgtgattttcccactatattcatgctccagtttgc

SEQ ID NO: 51680 - DNA, 201 bp, Homo sapiens
cagtggcccccaattctggaataaaccggtgttcttggctggtgtgagaccatgtattagactctaaagacggtcagaagcagtaaccacaacactctttrttctacaattctgagtgtgctgataatatgggcaggagttagaagggaactatttttctgactttttctcccaggctgtccctgcaatatctaccatttc

SEQ ID NO: 51681 - DNA, 201 bp, Homo sapiens; identical to SEQ ID NO: 14925

SEQ ID NO: 51682 - DNA, 201 bp, Homo sapiens; identical to SEQ ID NO: 14924

SEQ ID NO: 51683 - DNA, 201 bp, Homo sapiens
cctagagaatgtgaaggaggaaggcggtacgcaagggcgagcaggcgccagtttgcacaaagctagtaacactcattccaagtccagccttcacttgaccrtttaaatgccacaccggaatgatttcatttaatttgcctgccctttccccggcatcccggggaagattctcgcttcccaaaccccctcccctagggggca

SEQ ID NO: 51684 - DNA, 201 bp, Homo sapiens
atgaatttgtattgctttgcacaggcaaaactataaacagtagagccaaaaagtcagaaataactgtgctgttttccctatttcttactttcaagtccacractctaattcttgggtttcccaaagacctcaacttttataatcactgaacttatgatcaacgtaaggatgcagaccactttgctagagaacataaagcct

SEQ ID NO: 51685 - DNA, 201 bp, Homo sapiens
ttacatttatttggggccattcccctcaagctgtgacaccttacatagaatcctaaccttcctggacctaacctcttgccttcatgcagctcaaatagctrccttcctagacagtgcagatgtttcaggaagctttgaaggacagagaaaatgataaaatctcattgtagttttgtgttgatttagtatatgggggtttta

SEQ ID NO: 51686 - DNA, 201 bp, Homo sapiens
cacttagcacagcatagatgatccatggccactggaaactggtgagaataattaagaaacgatcaggtcataagaaagaaagaggtgccttctttttttttcttttttatttgagacagagtctccctctgtcacccaggctggagtgcagtggcaccattttggctcaccgcaacctctgcctcccaggatcaagtgatt

SEQ ID NO: 51687 - DNA, 201 bp, Homo sapiens
tctgctcgggttttagggacatagtttaagagcacgtgaaatatatctaaaatcaatatgaggttaggttgggtaaatttaaagacaaaatcatcttccarcctaaaaaaaacctctttacaaatatagtagagaaagaaagcagctttattattgaataaacgctaaactagaatatgatacacatagagggaatccact

SEQ ID NO: 51688 - DNA, 201 bp, Homo sapiens
tcaaaaccctgctgcattttctacctcttgaatttcataaacttgcagtgtatgaagaaacactttacatttttctccccacttgctttgttcagaaaaayaaaagtaattaggtttattgaagtgtcattaaaaagataaaacattgtacctaggtatttgcatttatttcaaatcttttctaagtggcatattagtttg

SEQ ID NO: 51689 - DNA, 201 bp, Homo sapiens
ctggagtgcagtggtgcaatcatggctcactgcgagctccgcctcccaggttcacgccattctcctggctcagcctcctgagtatctgggactacaggtaygcaccaccactcccagctaattttttgtatttttagtagagatgggttttcaccgtgttagccaggatggtcttgatctcctgacctcgtgatccgccca

SEQ ID NO: 51690 - DNA, 201 bp, Homo sapiens; identical to SEQ ID NO: 14922

SEQ ID NO: 51691 - DNA, 201 bp, Homo sapiens
aagcattattagatcattatttttcatttttacaaacagacatattcacaatctgaatttttagtcatttagtcatttgcactaatgcaatttattgccawcactgtatgggactggatggttataataatgactaagaggtgagactaaccttagggaaatacaatccagagaaatatgtgactaaatcctgacagtaca

SEQ ID NO: 51692 - DNA, 201 bp, Homo sapiens; identical to SEQ ID NO: 14923

SEQ ID NO: 51693 - DNA, 201 bp, Homo sapiens
tttaaacagacatgcttcctagatacaatgcaagacagtatctgtctattggtttctctctgaaaaccatgcatcagtgttcctgacttacatgggagaamacaaatatgtgtacatatatttaaccataaataggaactcaattatattgggtgaaggaatgactgaataagtgagaagagaagggagggaaaaagaaac

SEQ ID NO: 51694 - DNA, 201 bp, Homo sapiens
actcaggctatacatttaataaagaacttttggacatgacccagttgctacagaaatcaaaggtctgtctactcaggggtgttctttatttttctaatagrccaattaatccatctttctatgataagggtaattttgtattaaagttgtttcatttgagagaagatgttcaatcctgtctggaataaagagagttgatcc

SEQ ID NO: 51695 - DNA, 201 bp, Homo sapiens
ctcatctaagccgagttctgccgtattggaatacacatatcatctcagggcagtttttttgttctttaaattggatgcttttggaaaatatatataagaargggtacagtatagcttctagaggcctcatgggtctcatcataacagctactcattagtggagtccccacattccacagtctaggcatcaacttgtaagtt

SEQ ID NO: 51696 - DNA, 201 bp, Homo sapiens
catttgtgacaatcagcatcagttttagcccttccatcttatatttatattttaatagctcatttttaaatgaactatttcatttactgacttgcacaatrtcttaatttccttcctccaacccggttagtttgaattgttatgggactcttccattgctcttatgattacagtcccatttcaaatcatcacgttatttct

SEQ ID NO: 51697 - DNA, 201 bp, Homo sapiens
acacacaagtgctgagaatctgtcaaaagacttcacacttatcaagatgattaaattagaaagaatggcaggattgtcatctttttccttaagcatttctrtatagttttgtcacagttttgttttgttctgtttttatcttgagacagagtcttgctctgttgcccaggctggagtgcagtggtgcaatcatggctcact

SEQ ID NO: 51698 - DNA, 201 bp, Homo sapiens
gtagaggccttggcctcccaaagtgctgggattacaggcgtgagccacttcacccggcctgtcacaaatatttttattccaaagtgtttcagatgatccakaatgcagctgttataactgcatcatgggtcaaagacagcttcttggatgaggcggccaactttcaaagttagcaaggatctgacacattttcacctcggt

SEQ ID NO: 51699 - DNA, 201 bp, Homo sapiens
tacctctatttcatctcttactgtatattgcctcatcttttattctccagctgcaataaatttcccatcattctcatgtcatttcactcccacactttcaktttttaatcttctgcttgaaaagccttctcatcctcttgcctagctgccttctacttttctactttcctatgattttggcatcacctcttccaggaagcc

SEQ ID NO: 51700 - DNA, 201 bp, Homo sapiens
ctcgaaatattttcttatcttggctcctagaacaccacattcttcacttttcctccttcctcaccaaccccacggtctcctctgccacgtctttcttatcycccttacctctaactgttgaagaagctccagattcagtctttaaactgcttcttcctctactcggatatttagggaatcacattctacctcacagctttc

SEQ ID NO: 51701 - DNA, 201 bp, Homo sapiens
acccctccatatctctatattttcacatattcgattataatcattagtttattcccctactaggtcacaaattttcagagtgcaaggaatggaaagcaaarcagaaaatgtacttcatcttgagtacaaactatgtaatagaaaatgcctatccaggtacacctgcatataaaaattaatttctggagtctgactctgcaa

SEQ ID NO: 51702 - DNA, 201 bp, Homo sapiens
ggaaacagtttttgctcctagaaaatgcttgtagtttctgggactgtgcaagttggactcattctactaagagcaagaaagtgaagggccagtaaccactmaatcccaattacacataaaatgcccctgggaacattctgatttaattgcctagggtgaggccaggtgattctaaggggcagtcagagttgaagaccactg

SEQ ID NO: 51703 - DNA, 201 bp, Homo sapiens
ttctgtttttcttatcctaagcatctttattttgctttcatttcaaacacatttttgttcagtatagaattctaggttgacagtcatctttttttttttttcagcacttcataggtggcaaatccaacattccaggcttatattttttgtttgtaagaatccagctgtcagtcttatttttattccttcagaaacatcacc

SEQ ID NO: 51704 - DNA, 201 bp, Homo sapiens
tggtcagcgtgataagtaggagaatcaagattaatgcagagggagcaaatgaagctatttatttttaccctgatacactgtccatagttttaccccaatayactgtgccattggtgagacaaatgctgggaaggtcaaccatcttttcctcagccacactgactcccccatctcattcaggcttcatgataacaccagtag

SEQ ID NO: 51705 - DNA, 201 bp, Homo sapiens
gttctgtttttcttatcctaagcatctttattttgctttcatttcaaacacatttttgttcagtatagaattctaggttgacagtcatctttttttttttttcagcacttcataggtggcaaatccaacattccaggcttatattttttgtttgtaagaatccagctgtcagtcttatttttattccttcagaaacatcac

SEQ ID NO: 51706 - DNA, 201 bp, Homo sapiens
taacaaggcaagtctgggactcaaagccaggtcttgtgacttcaagtgcattactgtttacactgtgcaccatttacattcctcagctgctctctcccctraggcctgagttgattgcacagcccctcaggcagtacaggatagctctgcagagtggctgacagaccctaggacaggaagcaggcagagaagggaggaacc

SEQ ID NO: 51707 - DNA, 201 bp, Homo sapiens
cctccgcctcccgcattcaagctattctcctgcctcagcctcctgagtagctgggattacaggcatgtgccaccacgcccggctaattttgcatttttagyagagacaaggtttctccatgttggtcaggctagtctcgaactcccgacctcaggtgatccccctaccttggcctcccaaagtgctgggattacagtcatg

SEQ ID NO: 51708 - DNA, 201 bp, Homo sapiens
ctgtgttgtccaatagagtagccactagtcatatatattgccatttcatttttattttatcaacttaaatttaacattcaactgctctgtcacaccagccrcattttcagtggtcagtacacacatggctggtggctagtacattgggcagtagatatggaacccttccgtcacagaacgttccaatggacattgctgctc

SEQ ID NO: 51709 - DNA, 201 bp, Homo sapiens
gtagctgggattacaggcatgtgccaccacgcccggctaattttgcatttttagtagagacaaggtttctccatgttggtcaggctagtctcgaactcccracctcaggtgatccccctaccttggcctcccaaagtgctgggattacagtcatgagccactgcccccacatttgaccagtcttgtaatgtgcatctacta

SEQ ID NO: 51710 - DNA, 201 bp, Homo sapiens
accaacacacacagtcctcagcaccagaactagggcacactgggccaggtattaggccttaagttgtgggttgaggagaattctgagaattcctcgaaaarggcaaatagaagaatgagtaagggctgggggacttccagggctctgagcagaggttattaagtacagaaggactttgaattttaacaaccgacatggcca

SEQ ID NO: 51711 - DNA, 201 bp, Homo sapiens
ggaaacaaaagaataaaaaaaagttacatagaatctatactagaagtctgaggtgtgtgccctgaggagggggcaagcggaaaatgtaaaaaggaaaaagrcagatctaatgaaggacctacagagactcagcacaaatattctcttgagttttcttctagtgtttctgttttgattattttgctttgggtttagtttttt

SEQ ID NO: 51712 - DNA, 201 bp, Homo sapiens
catttagtcatttgcactaatgcaatttattgccatcactgtatgggactggatggttataataatgactaagaggtgagactaaccttagggaaatacartccagagaaatatgtgactaaatcctgacagtacagtgtgagaggtgctccagaagaggagccaaaacacaaattttgacataagccattaacaaaagaa

SEQ ID NO: 51713 - DNA, 201 bp, Homo sapiens
ttcttaattttaattcctacacttttagttctagattttttcatttaattctttataaattccaggtttttagaataattctccatgttttcatctatttycttaaatattaatcacaagttatctggatctctcttttctgggttgtgggattacctagggatttctcttttctgagttttggggttgtttttctcttca

SEQ ID NO: 51714 - DNA, 201 bp, Homo sapiens
gtttattgaagtgtcattaaaaagataaaacattgtacctaggtatttgcatttatttcaaatcttttctaagtggcatattagtttgattataaatctaygagggattgttttgctttgtattgtaatgaatttttagaaatttaaattgcgtactcttacaaaagataggagagcatattgtcagcaacgaagatgtac

SEQ ID NO: 51715 - DNA, 201 bp, Homo sapiens
tctatattcaaaaaaaagcaattaactgccataattagggaaaactgtttaaagcatactgcatttacttggccacagcgccatctcatggtaattttttwaagtgctaccgtagccaaattgaactaagtcactgtactgctttcagcaaagggtgctcctcccatttgtgcatcaatgagacatatttataaagtgcta

SEQ ID NO: 51716 - DNA, 201 bp, Homo sapiens
cataagccattaacaaaagaaatgttttgccaggcgtaagggggaagaaagagaacccccaaatagagaccatccaagcttaccgtgccacactcacatamctccagacactagaaattttcaaaccctgcattcatcagccagtgctagcttatcatagttaagtacagttgccagtgggcttttttcaaatactaaaaa

SEQ ID NO: 51717 - DNA, 201 bp, Homo sapiens
gttatctggatctctcttttctgggttgtgggattacctagggatttctcttttctgagttttggggttgtttttctcttcattctgtctgttgatatgtytggtaatttttttaattgagtactgtgtatgcctgataattttttttttttttttttgagacagagtctcactctgtcgcccccgctggagtgcagtggc

SEQ ID NO: 51718 - DNA, 201 bp, Homo sapiens
attgctgtttggaccatatcagtaggtaagtggcaacatatttcagagtctcatttgaaatgacagttcgtgctttctgaaaagacttgttccattttgtkgtactgaaacctgacatcctcaatctactgttttgggtggtgcaagatatgttacaacatcataattatcagattcgcttcaggaaagaaaaatctgttt

SEQ ID NO: 51719 - DNA, 201 bp, Homo sapiens
ttggaattgcatgtaacttcatgtatctactttctagaccttttgactggcatactttttgcactttttttggtcttattttttacttctttttttatgarcaacctcaaattctatatggaatgaagtgaatgtatacaagcaaatgtaactacataaaatctaagcacttaggttgaaaaaatagcatgctcatttagg

SEQ ID NO: 51720 - DNA, 201 bp, Homo sapiens
ggaattgcatgtaacttcatgtatctactttctagaccttttgactggcatactttttgcactttttttggtcttattttttacttctttttttatgagcracctcaaattctatatggaatgaagtgaatgtatacaagcaaatgtaactacataaaatctaagcacttaggttgaaaaaatagcatgctcatttaggtc

SEQ ID NO: 51721 - DNA, 201 bp, Homo sapiens
gaaacttgaattagtccaagtctcctttggtttctctatcttttcactttctctcctagggggaagaagtgaaattgcctccatttgttgtatctttattkttgttcctgccatacttcatttccctccccagaggtccagagagagatccaggcactgccccagcctgcagctgagtggcttggcatccaggaacagaga

SEQ ID NO: 51722 - DNA, 201 bp, Homo sapiens
  misc_feature (1)...(201): n = A,T,C or G, or insertion/deletion polymorphism (see Tables 1-2)
aaactccaaagttattttgcataataattactaattgagatgcaaagtattaaactaatgttttcatatatcctttttgcacatacgcttgttaatattancacttccatttgtaatatacagagtggtcaaataaaccatgcaatacagcatgctagattttataacctctcaaggacaggggctatgtcttatttgtct

SEQ ID NO: 51723 - DNA, 201 bp, Homo sapiens
gactattcaggcaaccaggacagaaagggctttgggttacctgtcctcacttccacttctgggagatcatatggtaagttagcatctaccagaatacaaayggaaacttgaattagtccaagtctcctttggtttctctatcttttcactttctctcctagggggaagaagtgaaattgcctccatttgttgtatctttat

SEQ ID NO: 51724 - DNA, 201 bp, Homo sapiens
ggaatgctaacacaatagaattgtcttatttcttctccttttcttgcctctgagcttttctcctcattcccctctgaatctagctgctttccgtttatgayttcagttcaatttcctaccagctattatgagataactaggaccttttaaagaataaatttgtattttcccacttagtcagctttccattcctgcctacaa

SEQ ID NO: 51725 - DNA, 201 bp, Homo sapiens
ctggaggacattcccagccccacagcctgaaacaaactatctgaggaatccacttgagattgtctctcctgggaccctccaggtttatgcccaactccttyatacggctattagtcagcctaagaagtacatgtcagagactattcaggcaaccaggacagaaagggctttgggttacctgtcctcacttccacttctggg

SEQ ID NO: 51726 - DNA, 201 bp, Homo sapiens
ttttattgcatttaatcgtcacaactcagagaggaaacttgttttgttagctaagaatcaaatcctagacttgacactaagtccactgtgctggtcccccygctatttgataatattccaaagcaaaatacccatgctaccgatgactaggaccccccagctcagtcgcttgggctagtttttcctgtagtctttcaggat

SEQ ID NO: 51727 - DNA, 201 bp, Homo sapiens
aaagtcactatttgaagtcctggctataaaaattagttccagcagctttcacctaaagctggcccaagtctgaaatgaaccaaattgcatgagctctattrtgtgcccctcttgtaatataaaaatctaataaaagtaaatagcaaagtctaatagataatcctaacagaggagcaagcactaaggtgtggtagctgagga

SEQ ID NO: 51728 - DNA, 201 bp, Homo sapiens
ttctccagccagtggggtggcttcaggagagggctgggactggggatctcaaccttagcagcacattagaatcatctggggaggtttaaaacagcctgatrcacttggcctcacctggaatgcacaaaatcagaatctctatggattcaattcactatcagtatttaaggctgccaggtgattccagtgtgctgccaacaa

SEQ ID NO: 51729 - DNA, 201 bp, Homo sapiens
agctaagaatcaaatcctagacttgacactaagtccactgtgctggtccccccgctatttgataatattccaaagcaaaatacccatgctaccgatgactrggaccccccagctcagtcgcttgggctagtttttcctgtagtctttcaggattggaagtagagtggagttgtcaggtcctgttacaaaagtagactaact

SEQ ID NO: 51730 - DNA, 201 bp, Homo sapiens
taaccttcattttcttacttgcacctccacccaatcactaaatcctgctgatgctccctgccactgtcttaggagtcccccacttttgtccccagtggcamtgtttctcatttcccaccttgcttactgcagcagcctctttactggtctagtttccctctaatccacccaccaaacagccaggctgtcatctgaatattt

SEQ ID NO: 51731 - DNA, 201 bp, Homo sapiens
gacttgacactaagtccactgtgctggtccccccgctatttgataatattccaaagcaaaatacccatgctaccgatgactaggaccccccagctcagtcrcttgggctagtttttcctgtagtctttcaggattggaagtagagtggagttgtcaggtcctgttacaaaagtagactaactggaactgtagacttttttc

SEQ ID NO: 51732 - DNA, 201 bp, Homo sapiens
ttattatttactaccaccaccatgacatagtcctccctgatgcactgttagcatgtaaagatggatgattattattaactaggatattagagaaagggctstgtctagggaaagtcctcaaattaactagctttaccttcaacttctataaagccctactttgtcagaattgttagcccccaaatgatctatatttgggca

SEQ ID NO: 51733 - DNA, 201 bp, Homo sapiens
gctgagagtcgtagatgctgccttggaagagtgtccacgctaccctggacaggggcctgcctgcccacccagtgaccatggcagggcagagaaaaagcaaygtcagcccagtatcttctccagccagtggggtggcttcaggagagggctgggactggggatctcaaccttagcagcacattagaatcatctggggaggtt

SEQ ID NO: 51734 - DNA, 201 bp, Homo sapiens
ccagtccagctcaagtgtagtaagaaaggaagggagtgagaagagagggggaaggagaggtcagcagagccacatctctgagggcctgcagccaaagtaargagtttggatggtattctcagtgcagtgcggggtctctgagggtcttaggctcagaggtacacaggtaaggatgggagccccttgagggcagtggggaag

SEQ ID NO: 51735 - DNA, 201 bp, Homo sapiens
aaccttagcagcacattagaatcatctggggaggtttaaaacagcctgatgcacttggcctcacctggaatgcacaaaatcagaatctctatggattcaaytcactatcagtatttaaggctgccaggtgattccagtgtgctgccaacaaccactgagagcacacagcaagggaagagagcaacctgctggcttctgagc

SEQ ID NO: 51736 - DNA, 201 bp, Homo sapiens
ttaaggctgccaggtgattccagtgtgctgccaacaaccactgagagcacacagcaagggaagagagcaacctgctggcttctgagctctttctcctcccmgcccaagggttaggggattgggagtcagagaagtggcccaggcagatgagtatggaggtgtccagcaagatgtggacagatggaggatctgggagcccac

SEQ ID NO: 51737 - DNA, 201 bp, Homo sapiens
ggaagggagtgagaagagagggggaaggagaggtcagcagagccacatctctgagggcctgcagccaaagtaaggagtttggatggtattctcagtgcagwgcggggtctctgagggtcttaggctcagaggtacacaggtaaggatgggagccccttgagggcagtggggaaggtcttgtggtaattcaggcaggagtcc

SEQ ID NO: 51738 - DNA, 201 bp, Homo sapiens
gttgccagtgggcttttttcaaatactaaaaatatattgtgttgccctttgccaccacctgtgcctgtcccagagctggaaattgtcataggatagggatmcatgtgctccaggaggcacagggttgctcactgacaccaaccttctgcctcatagggtaccggtggcctctgccgagcaagctttgtgcagtctggattt

SEQ ID NO: 51739 - DNA, 201 bp, Homo sapiens
ctgtgatcactggagagttttgtgcttcaaaacgcgtacatcctgtgtaaaaatgatcattggagagttttgtgcttcaaaacatgtacatttaatgtagraatttttataaattaccccatacagtcataaaccaataacttacccatcattctgaatctacttgatttttgcttctttatattcccaaccaatattcca

SEQ ID NO: 51740 - DNA, 201 bp, Homo sapiens
agatgtggacagatggaggatctgggagcccacatttcaatgctagaggccatctgccctaaggtccaccttccccttcttcctaatcaagatcaccaggwggcgcacaggctgtaaccccttctcctggtgtacgatattaatcacggcatcttatatcccctgaaggggatataaagtcacaagaaaaaatttctaggc

SEQ ID NO: 51741 - DNA, 201 bp, Homo sapiens; identical to SEQ ID NO: 14914

SEQ ID NO: 51742 - DNA, 201 bp, Homo sapiens
ggtaaaattaggatagattattaggtagacttattagaatgctggtgagtcttttgcaaaggcaggataatggaaagagactcctaagtttttaagctgtrtatctggatagatggtaggaccatttactgggataaggaaaggtggggggtgagcgagtgcaacccagagtcctagtgtgacggtgtaaggttagggatg

SEQ ID NO: 51743 - DNA, 201 bp, Homo sapiens
aaagaaaataagcattgtaagaaatagcagagaaaattgtaatttcaaaaaatgttgatcttggcattgtgcattaaagacttgcagtaaaacataactgstccttagcattaagttcttaaaagatggtttctatagccagtcttcccatagatagcatgtaaatggctctaaatgagaaacgtatagcccctgcaacac

SEQ ID NO: 51744 - DNA, 201 bp, Homo sapiens
tcggagacatccaaattgagaggccaaggaggcagctaaatgtctcagttgttcattacttattatgacaatgcttagcccttggggtggaggttttgttrttttcagtttcctatctcctgtttctattcctgcttcccacgtataagtaatatcagatagcagtaatttccatatgcatctcaaagttctttacgagta

SEQ ID NO: 51745 - DNA, 201 bp, Homo sapiens
ctatagccagtcttcccatagatagcatgtaaatggctctaaatgagaaacgtatagcccctgcaacacaagcacagataaaaggaggcctgtccccacaraaagatttcataggtaggacactgcatgaattccaggctccggatctaagagccagccttgagcagcaatgaagcagcaactcttcaagcagcaactttt

SEQ ID NO: 51746 - DNA, 201 bp, Homo sapiens
tatttactatataagggtagcaattctcatttatatttctcatgatcatctcttgaagggtacactgttaatccccattttatgggagaaaaaaaactccrattaaatgacttgcttaaaaccagaggggatccaaatttgggttttctcattgcaaactaatggctttttttctcctgtatcagtggctttccaaacata

SEQ ID NO: 51747 - DNA, 201 bp, Homo sapiens
gttttccagaggatacatgctatgtaacttcacaacagactgaagcagaagcagatatatttccctgtaagatcctagttttctgcttatatctctgtatmctctgcctccctagtctttttttcttttttttttttttttttggagtgatgaattaatgaatggtagtgaaggtgttagattgtaaagtaactgattata

SEQ ID NO: 51748 - DNA, 201 bp, Homo sapiens
ggagtgcagtggcaccattttggctcaccgcaacctctgcctcccaggatcaagtgattctcctgcctcagcctcctgagtagctgggattacaggtgccygccaccacacccagctaatttttctatttttattggagacggggtttcaccatgttagtcaggctagtctcgatctcctgacctcaggagatccgcctgc

SEQ ID NO: 51749 - DNA, 201 bp, Homo sapiens
caccaggtccctgtcccgacatgtggggattatgaggattacaattcaagatgagatttgggtggagacacagaatgaaaccatatcaattggtgtaattkagtgcttattagtcatattaggggctagaatttttctgcccatctaaggaaagatctatctccaaggaaatatacatatatacaaatttttcagatttta

SEQ ID NO: 51750 - DNA, 201 bp, Homo sapiens
ctgcatgctgccccttcatgcccaccctctgcccttgggctgcgtcaggatcctgtatgctcttgaggcttccactctctccagatcagtcttttctgggytaagagataggaatcgtcaccatgcaaggagctaaggtggatcttctgatcagtttattgtcaccagcatcctctgtgtcctagtatcctactccttcat

SEQ ID NO: 51751 - DNA, 201 bp, Homo sapiens
attagccacaataagtgtccttatgaacagctctgatgtcatttatctccaccttccaagaatcctggatgggcttgcataggcaagtgacaaatattgtyaattaagtctttgaagataatggcaaatgtcactaagaaagatttgtgttgaatattacatcaactcagcgttctttcctggccacgatggccaatgtga

SEQ ID NO: 51752 - DNA, 201 bp, Homo sapiens
aagcagaagcagatatatttccctgtaagatcctagttttctgcttatatctctgtatactctgcctccctagtctttttttcttttttttttttttttttggagtgatgaattaatgaatggtagtgaaggtgttagattgtaaagtaactgattatagactcaaccaccttcccctcaaattcctcaagtacctagctc

SEQ ID NO: 51753 - DNA, 201 bp, Homo sapiens
tggagtaaatgaaatctcagagagtagaggctttcatatcactcactgaaagacagtaaaaccaaaaggtcttcatcttgggctttcctgagctggatgggaagtttggaggtctcagccaaccagactgttgagtgataaaaagtgaaactgtgaagaagcttctagaatcctagaagctctaggaaacagtgggtaaga

SEQ ID NO: 51754 - DNA, 201 bp, Homo sapiens
gttcttcttagcaccagaataaactggttccaaggttaaaaaaaaaaaagaaagtaaaatagatgcaaaaataatcactcataactgaagatcatttcacytttgaatgagaatttgtctctgaaggctaacttttctaggcaaagtcaggaaacaatggcagtggccgggtgcggtggctcacgcccagctactgaggca

SEQ ID NO: 51755 - DNA, 201 bp, Homo sapiens
gaaatacatattctcagggcccattcccagagaatctgagtaggaactaatgggaagtccaaaaattgggacactctgagaagcactgcctacactatcartttaggattggagcagacttttaacatctactcatgaattatactgcatgtacacttttttaaatttcagggcttttgtatatagagatgcaaggtatta

SEQ ID NO: 51756 - DNA, 201 bp, Homo sapiens
ggcactcttctgaaatagttcagaaaatcatgtcttatgcaggatatgtctagaattaaattacattttgataattctttccagctctataattccatttyctactgttgggtttcaacacctaaaattgtcagcaagcctctgaacaaagatgcttttgttctgttggcagagattctacttctaagtttccacatgacc

SEQ ID NO: 51757 - DNA, 201 bp, Homo sapiens
gttcgtgctttctgaaaagacttgttccattttgttgtactgaaacctgacatcctcaatctactgttttgggtggtgcaagatatgttacaacatcatarttatcagattcgcttcaggaaagaaaaatctgtttatgtcactggctgacaacatgaatttgtattgctttgcacaggcaaaactataaacagtagagcc

SEQ ID NO: 51758 - DNA, 201 bp, Homo sapiens; identical to SEQ ID NO: 14917

SEQ ID NO: 51759 - DNA, 201 bp, Homo sapiens
ttgccttcatatacttaattccttaataatcatgtttcattttctgttcaactccaggtatatccatgccaataccagtctttgggctacaggacgattcraaggtctttaaggaggggagttgcttactcgccgatgataactttgtcctgatcggctcttttgtgtcatttttcattcccttaaccatcatggtgatca

SEQ ID NO: 51760 - DNA, 201 bp, Homo sapiens; identical to SEQ ID NO: 14919

SEQ ID NO: 51761 - DNA, 201 bp, Homo sapiens
gagctgtcaagtgtcaagtggccatctatgcttgtcactaccctgaaacaaaggatccgcagggccaccacttggcccaccccttctcttgtccctgagtrcagtgacccttcccctcctctgcccacagatgcaagagaatttagggacatctccttgcctggccagttgtctcatacttagaagcacaatacggtaaaa

SEQ ID NO: 51762 - DNA, 201 bp, Homo sapiens
gagtaagtgagctcatctgtataaagcacttaggatagtgcctggagcacagtaagcaccatgtaagtatttgattgtgttattttttatcattattattyactaccaccaccatgacatagtcctccctgatgcactgttagcatgtaaagatggatgattattattaactaggatattagagaaagggctctgtctagg

SEQ ID NO: 51763 - DNA, 201 bp, Homo sapiens
attgccgtaaagaaatacctgaggctgggtaatttataaagaaaagcggtttaatcggctcacggttctgcaggctgtacaggaagcatggtggcttctgsggaggcctcgggaaactttcaatcatggcagaaggggaagcaggcacaaattacatggcccagagcaggaggaaggtgagggaggtgctacacacttgca

SEQ ID NO: 51764 - DNA, 201 bp, Homo sapiens
gatccccaccatgtgtccacgtgttctcacgattcagctcccacatattagtgagaacatgcagtgttaaacacttctacattttgtacatttttctcctyttatttcttgagatagctttactgacttttcttcttctgttactagtcctctcatcagctacttctaatctgcctaagacccatctcttgttttcttaat

SEQ ID NO: 51765 - DNA, 201 bp, Homo sapiens; identical to SEQ ID NO: 14911

SEQ ID NO: 51766 - DNA, 201 bp, Homo sapiens
ctagtaccatcggcataaccaacaaaatgagatatagttaaacaagagtcccagtagttataaaacttttcttctttgtccaggacatttatcttcccgarcgctcaaaaaaaaccctgcaacctctatgctaaaagttcattctgcttttttgtcctcggtttggtgagaaaataataaaaccaaacagtggactctcct

SEQ ID NO: 51767 - DNA, 201 bp, Homo sapiens
ttggggacaagaaatgttttcttggtatccctgaaatgaccaacaacaacaacaaaaaaacaagtatcttcaaacacttcataacttatataaagttttakaacttaatattgaatttaatccacaataataatgatgattttgaaagaaacattcaagactttgaagatttcattctaaactaagaacattaatgatgca

SEQ ID NO: 51768 - DNA, 201 bp, Homo sapiens
ttgtctgctaatctttacttaagacttttttgttttccttttattagctaagcaacattataggagctgaaattcctgacagcagctgtggcaattcagcytaagaatggctgagaactgtaacccaaagtacatccaattactatgggattaacactggatgtatttttaattgactttcttaatgtagaatgtgtacat

SEQ ID NO: 51769 - DNA, 201 bp, Homo sapiens
tattatgctggtggaagatcaagaagaggggactctacaccagtttaattactgtgagagatgcagcgagtcacagaataacaaatgtatctcatgtgtgraccctgaagacaaatgtaagttctcatgccgctatattttattgctgtgtaattttctttccggtttgaaatcatgcttggccaacatgtaatcatttca

SEQ ID NO: 51770 - DNA, 201 bp, Homo sapiens
acacctaaaattgtcagcaagcctctgaacaaagatgcttttgttctgttggcagagattctacttctaagtttccacatgacccgcagagccatactcakccagttaggtgtcaaaaatgcagggaaagatactgaaacctcttactggcctgaccaatgcatgcagcgttatctgcaactcatgtctctgtgtgcctac

SEQ ID NO: 51771 - DNA, 201 bp, Homo sapiens
tttagtggcataaattacattcacaatcttgtgctaccatcaccactatctatttccaaattttttcgccttcacaaacaaattctgtaaccattaagcartaactccccactccttccaacccaactccctggtaacctctaatctgctgtctcttaattcatctgttccagatattttatacaagtgcaattatacaac

SEQ ID NO: 51772 - DNA, 201 bp, Homo sapiens
ctgttccagatattttatacaagtgcaattatacaacatttattctctttctgtctggcttatttcacttagcatactgttttcagggtctgtagtatagyacatatcagaacttcattttttatggctgaataatatttcattatatatatatgtacctcattttattcattcatctgttgatggatatgtggatttctg

SEQ ID NO: 51773 - DNA, 201 bp, Homo sapiens
tcactattcgaaaatccttcaagagatgttctggagaaattagcaactcagattcccatgcagaattggctaacagttttatatattacatacacatatgyaccaagctatctcataatattgctacaaattcatagtaaacagtggaacaagacagattcaaattgaaaatgatccctttcctgagatgcttttaacttg

SEQ ID NO: 51774 - DNA, 201 bp, Homo sapiens
tcgaaaatccttcaagagatgttctggagaaattagcaactcagattcccatgcagaattggctaacagttttatatattacatacacatatgcaccaagstatctcataatattgctacaaattcatagtaaacagtggaacaagacagattcaaattgaaaatgatccctttcctgagatgcttttaacttgtcaagtt

SEQ ID NO: 51775 - DNA, 201 bp, Homo sapiens
gctatctcataatattgctacaaattcatagtaaacagtggaacaagacagattcaaattgaaaatgatccctttcctgagatgcttttaacttgtcaagktatttggataaccttcattttccatgatgaaggaaatcagtcagcgtcagcctttaaatgtaagtaagtatttggcacctagcacatagtaggcatttta

SEQ ID NO: 51776 - DNA, 201 bp, Homo sapiens
gaacttgaaaataatgaaatatgtgaaaaatacagcaagaagtctcatgagatggctggagagaacccagaaaagcttacctcgtctcaagcacccaaatsttcccatcactgccaacaacatctaggaccacttcaactctagtatctgtacatcttccaatcagtgataaatgctgatcagtatcctacacaggagatt

SEQ ID NO: 51777 - DNA, 201 bp, Homo sapiens
tgggcaaaccgaccctcattagacactgaatctgctggtgctttcatcttggacattccagccttgagatctgtgggcaatgattttttttttttttttttaagatggagtcttgctctgtcaccaggctggagtgcagtggtatgatctcagctcactgaaacctccgcctctcaggttcaagtgattcttctgcctagc

SEQ ID NO: 51778 - DNA, 201 bp, Homo sapiens
agctcagcctctttcctccctatcacttgcagtctttctcagctagctgacacatgacttttaagacaatctacttgctgttatcacattatttgagataycataaaattaatcctctaatttaaattaaagctgcagaccattatcagtgataataccaggaagtgagtgaggaagggtggcaaaacatgttctagggtg

SEQ ID NO: 51779 - DNA, 201 bp, Homo sapiens
ttacaaatatagtagagaaagaaagcagctttattattgaataaacgctaaactagaatatgatacacatagagggaatccactgagggattgcaaagacraatctcactcttttatacagccaaacagatgcatcctattacataggcattctctagataaactagctagtcctcacataaggacttgacagcaccatgt

SEQ ID NO: 51780 - DNA, 201 bp, Homo sapiens
ttcataagaaattaagagttttgtataaccatttatactttcaccttatttgactaattttgactaattgttgagaaaataagtctgaattaaagagtcamaattgcagtttatttcagagaaatttttattctccaatgcacatggtaactagtgttataccagaaagaatggtaactagtgttataccagaaagaatat

SEQ ID NO: 51781 - DNA, 201 bp, Homo sapiens
agtgcaattatacaacatttattctctttctgtctggcttatttcacttagcatactgttttcagggtctgtagtatagtacatatcagaacttcattttytatggctgaataatatttcattatatatatatgtacctcattttattcattcatctgttgatggatatgtggatttctgcttttgactattctgaataat

SEQ ID NO: 51782 - DNA, 201 bp, Homo sapiens
tatatatatatatatgaatcaaaatacaagcacacagcaaatgccttacaattgaatgaagaaactgctaattctgagaaagcagaatctgccattataawaaaaatgcagagaactctggcaaaaattggggatcagagatggttgtgtcaagagggagatgcttgagttgaaccttgaaggatgggcagaatttcaaca

SEQ ID NO: 51783 - DNA, 201 bp, Homo sapiens
gacactctgagaagcactgcctacactatcagtttaggattggagcagacttttaacatctactcatgaattatactgcatgtacacttttttaaatttcrgggcttttgtatatagagatgcaaggtattaaactaacagagacacaaggtattaaaccaatgttttcatgtgtcctttttgcacgtacacttgttaatg

SEQ ID NO: 51784 - DNA, 201 bp, Homo sapiens
tgcctagccaccctgagcctatgtggccaatgtcagtaattccactctggacacaaacactgttggctttggatggaagtgccagacactcacagcactcygaggacatactgttttctagccttatttatgttctctcttcacccttcagcctaaaaaattaccacagtgccacttacctaccttaatgggaatctgcac

SEQ ID NO: 51785 - DNA, 201 bp, Homo sapiens
aataatgactaagaggtgagactaaccttagggaaatacaatccagagaaatatgtgactaaatcctgacagtacagtgtgagaggtgctccagaagaggrgccaaaacacaaattttgacataagccattaacaaaagaaatgttttgccaggcgtaagggggaagaaagagaacccccaaatagagaccatccaagctt

SEQ ID NO: 51786 - DNA, 201 bp, Homo sapiens
tcagctttccattcctgcctacaacaaaaacatctggtgagtctaattttaagtaatcaaccttttcagtttggtgattaagagatatatatctgaatttscatttcatttgtggaaattctgcctgggagccattcatttttcatcaagctccctgtgcttttcattactccctccctctcattttccctgtggtcagcc

SEQ ID NO: 51787 - DNA, 201 bp, Homo sapiens
cagagaaaatgataaaatctcattgtagttttgtgttgatttagtatatgggggttttagcatcgcttcatgttatgtttttattttctataattggctgyccatggtttttgctgtaggacttggtgaatataagcaaaatgtctggagccacactatctggatttgaatactggctctgtcccttctaagctgtgtgac

SEQ ID NO: 51788 - DNA, 201 bp, Homo sapiens
aataatattcattttaagcaaataaaatatgttctgattaagaattcattctgcccagttggagtccaattaagccagcttctggatggagtctcacccargatctctccacttaaggaatatattcgcagttgaagtttgacttttttcaataaagctcttctctctccttgaaagagatgaaactttgtcttcaatcca

SEQ ID NO: 51789 - DNA, 201 bp, Homo sapiens
tcaaggtcagccactgatggctgttaatggccactttgttgataaatcgggggtaactgcaataatattcattttaagcaaataaaatatgttctgattamgaattcattctgcccagttggagtccaattaagccagcttctggatggagtctcacccaggatctctccacttaaggaatatattcgcagttgaagtttg

SEQ ID NO: 51790 - DNA, 201 bp, Homo sapiens
ggacacagatccaaaccctatcaaccctgaaggaccttataatcatagtgggaagagagtaatatgtaaataaaaatatacttttaagctgatgaaatggyatggatgacaggacgtagagccatgatagtaataacaggacctgtttggagaaggtgttcagaaaatgcttttctgaccattttcatctcagctgaaact

SEQ ID NO: 51791 - DNA, 201 bp, Homo sapiens
tcctgtgaggatgcagtgagcaggtgccatttatgaaatgggcaaaccgaccctcattagacactgaatctgctggtgctttcatcttggacattccagcyttgagatctgtgggcaatgattttttttttttttttttaagatggagtcttgctctgtcaccaggctggagtgcagtggtatgatctcagctcactgaaa

SEQ ID NO: 51792 - DNA, 201 bp, Homo sapiens
ctgtgggcaatgattttttttttttttttttaagatggagtcttgctctgtcaccaggctggagtgcagtggtatgatctcagctcactgaaacctccgcytctcaggttcaagtgattcttctgcctagcctcctgagtagctgggactgcaggggagcacaatcacccccagctaatttttgtgtttttagtagagaca

SEQ ID NO: 51793 - DNA, 201 bp, Homo sapiens
cacctcagcctcccaaagtgctgagattacagtcgtgagccaccgcgcccagccagcaatgaatttctattgtttacaagccacctaggctgtggcagttsgttctagcagcctgaatggatgaagatgctagggctccccccagcaccttgcactgccctcatcctcacatggaattatagatgcctcctactcaactga

SEQ ID NO: 51794 - DNA, 201 bp, Homo sapiens
taataatcaccattctgactggcatgagatggtatctcattgtggttttgattttcaaatgatcagtgatgttgagcttttttcatatgactgtctttttytttttttttttcttttttttttttttttcattttgagggagtctcactctggtgcccaggctggagtgcagtggcagcttacttcatagctcacggcagc

SEQ ID NO: 51795 - DNA, 201 bp, Homo sapiens
tttatttcaaatcttttctaagtggcatattagtttgattataaatctatgagggattgttttgctttgtattgtaatgaatttttagaaatttaaattgygtactcttacaaaagataggagagcatattgtcagcaacgaagatgtacttgaatcttctccacccactgtccagagcactcttcgttttctaagatcaa

SEQ ID NO: 51796 - DNA, 201 bp, Homo sapiens
tataaatctatgagggattgttttgctttgtattgtaatgaatttttagaaatttaaattgcgtactcttacaaaagataggagagcatattgtcagcaasgaagatgtacttgaatcttctccacccactgtccagagcactcttcgttttctaagatcaacatataaccagggatgaagcagggtaagggattgcttta

SEQ ID NO: 51797 - DNA, 201 bp, Homo sapiens
aaaacttcccaatattaatatgtagcaaaaagagggagaagaaaaagcctgtttggtccgccctcctggctgttgctaccttgcagcttatgacatacacrtagagggaggtctgatgaaatgaacgagacagtcagagagctactccattcccgtggaaaccaggagtcccttggtgcagacagctcttcctactttccc

SEQ ID NO: 51798 - DNA, 201 bp, Homo sapiens
gggattgttttgctttgtattgtaatgaatttttagaaatttaaattgcgtactcttacaaaagataggagagcatattgtcagcaacgaagatgtacttsaatcttctccacccactgtccagagcactcttcgttttctaagatcaacatataaccagggatgaagcagggtaagggattgctttattctacctgttct

SEQ ID NO: 51799 - DNA, 201 bp, Homo sapiens
ggcgtcacccgcttggggagcaagggcgccccctggcggccgccgctctgagagcagcccgttccctccggagccccgcccctccctaggctgctcctccmgcctcccccagcccacggggcgtggggcatggggcttctcccacaaggaaatgccccctccttatcccgcatcagaaacacggactgaggcctgggccgc

SEQ ID NO: 51800 - DNA, 201 bp, Homo sapiens
agttgtctgctaatctttacttaagacttttttgttttccttttattagctaagcaacattataggagctgaaattcctgacagcagctgtggcaattcarcctaagaatggctgagaactgtaacccaaagtacatccaattactatgggattaacactggatgtatttttaattgactttcttaatgtagaatgtgtac

SEQ ID NO: 51801 - DNA, 201 bp, Homo sapiens
gcacgtacacttgttaatgttagcacttccattagtagtatacagagtggtcaaataaacagacataacaaatcataactaattgtagtccaatttagacrtaacaaatctatataataaaatagtatataattgatacaactctagaataaagagaagctagcctgaaactccaaagttattttgcataataattactaa

SEQ ID NO: 51802 - DNA, 201 bp, Homo sapiens
tcagataagaattaccaggaactttataggaaaaaaaaaaaaccctagaactattataggacagacaagacctaagtagataaaaatataacatgttcaarttattgagataacttacctttgttaactgtagaactaaggtgttcgttttccaccagattatctacagtttcaacagttttaatccaaaagttaaaattt

SEQ ID NO: 51803 - DNA, 201 bp, Homo sapiens
catcatagattagtcaagttttcctgcactcagtactcctgaaatgtactgctgctttccccttgctcaccattatcagtgtggtcacttcactgcttgcsaaggattccatctaattctgaggaaaaggaacataattgcaaatcattgtgttttctgtgtgggagcttctgagtaaagcagcaatgacaggagattgaa

SEQ ID NO: 51804 - DNA, 201 bp, Homo sapiens
gatgtatttttaattgactttcttaatgtagaatgtgtacatccccactgtttctgattgcatgctattttaataatactgttgctaaactagtaccatcrgcataaccaacaaaatgagatatagttaaacaagagtcccagtagttataaaacttttcttctttgtccaggacatttatcttcccgaacgctcaaaaaa

SEQ ID NO: 51805 - DNA, 201 bp, Homo sapiens
agaactattataggacagacaagacctaagtagataaaaatataacatgttcaagttattgagataacttacctttgttaactgtagaactaaggtgttcrttttccaccagattatctacagtttcaacagttttaatccaaaagttaaaattttttgaggagcatgactaagtgattttaaaatgtttatgggaaaaca

SEQ ID NO: 51806 - DNA, 201 bp, Homo sapiens
ccctggaccagcagcatcagcatcacccgggagcttgctaattcagatgcaaattctacagcctgctccctactaactgcatcagaacctctggacggagktccagcagtgtgtgttttaagaggtgtggcagagtctgatgctcactaaagtttgagaaatgcctccctaaaacaaagctcagagcaaggacaccttcct

SEQ ID NO: 51807 - DNA, 201 bp, Homo sapiens
aggtccagcagtgtgtgttttaagaggtgtggcagagtctgatgctcactaaagtttgagaaatgcctccctaaaacaaagctcagagcaaggacaccttyctttatttttcttcacccttgtcttcagctctccctacacataccccaaatttgagtttggcacccaaagcattattagatcattatttttcatttttac

SEQ ID NO: 51808 - DNA, 201 bp, Homo sapiens
tagcaaagtctaatagataatcctaacagaggagcaagcactaaggtgtggtagctgaggaacacctaagcttgtgctatttgtaatgctgcttattagakacatcgctgatcctcctgtcaactccagttaatgtttctgtcccattcaagttgaaaatgttcaaattcagctaatgtctatggcatctcctgaaagccc

SEQ ID NO: 51809 - DNA, 201 bp, Homo sapiens
gtgtaggctcaattactacttgattgatggatgaaggaacaaaactgattgctatcatagatagaggacctgctcaatgcttctggtaagtgataagcaaygtgtgcacttgctcctgagttcacagttgcataccagacaacagactgcctcagccccagcaagtccaggctcacctgggcccagggtggagagatcact

SEQ ID NO: 51810 - DNA, 201 bp, Homo sapiens
cagaaaatatatttgactacatcctgtgaaactgccccttctgaaggtcatagtggttacatatcagccttttcacatgtttcaaccgaaaaactgaaggrgttcccttgagtttgagcaatctatagtatcacttctcctggaaggcagagtgagagaaaagggggtgtactggtttcctagggctactgtaacaaagaa

SEQ ID NO: 51811 - DNA, 201 bp, Homo sapiens
ctaatttcaccccacctgtctacagccgtgaactgcattttaacagcacataaagaaatatactgcatgcaatgccgctcctcatatcatagaacaattaycttaatcataggaaagcttagaagttaacacatcagtctgaatggcatcatagctcatcgtttgtccctttgacaaagaacttttgtagcgaatgccact

SEQ ID NO: 51812 - DNA, 201 bp, Homo sapiens
ttacagttttggaagtgaaaagtccaaagttggtctcaccaggccaaaaccaaggtgtcagtagggctgcgttctttctggaggcactagggaaaaaataygtcactggcccctccagcttctagaaaccacctacactccttggcccacggtccttttcctgttatcttccaaggtagccagtacagattgaatcctgct

SEQ ID NO: 51813 - DNA, 201 bp, Homo sapiens
aattgagatgcaaagtattaaactaatgttttcatatatcctttttgcacatacgcttgttaatattaacacttccatttgtaatatacagagtggtcaaataaaccatgcaatacagcatgctagattttataacctctcaaggacaggggctatgtcttatttgtctttgagttcctcaccactagcaaaacaggtgct

SEQ ID NO: 51814 - DNA, 201 bp, Homo sapiens
gacggggtttcaccatgttagtcaggctagtctcgatctcctgacctcaggagatccgcctgcctcggcctcccaaagtgcagggattataggtgtgagcyaccatgcccggtcagaagtgcttcattttttgttagtctgttgatttggcctggcttatggactatgaatttctttattcttttgctaaatattctttct

SEQ ID NO: 51815 - DNA, 201 bp, Homo sapiens
tgcccggtcagaagtgcttcattttttgttagtctgttgatttggcctggcttatggactatgaatttctttattcttttgctaaatattctttctaagargaagagaagggacagggtacttgtgttgcttctggctatttaaagcagaggaataacatctgcatgctgccccttcatgcccaccctctgcccttgggct

SEQ ID NO: 51816 - DNA, 201 bp, Homo sapiens
aaataatcactcataactgaagatcatttcacttttgaatgagaatttgtctctgaaggctaacttttctaggcaaagtcaggaaacaatggcagtggccrggtgcggtggctcacgcccagctactgaggcagaagaatcacttgaaccgggaggcggaggtttcagtgagctgagatcacgccattgcactccagcctg

SEQ ID NO: 51817 - DNA, 201 bp, Homo sapiens
acgctttgacatttgatgtccacctcagcccaccctccaaacatgatttaattgggctgggtttggcatgggcatcaggaccttctctaaagctctccagytgatactgatgtgcagccaggggtgagagccactaccctaaagcagctattcacaaagcgtggtccctggaccagcagcatcagcatcacccgggagctt

SEQ ID NO: 51818 - DNA, 201 bp, Homo sapiens
tcctaaaacccaaatatgatcaggtttctcgcctgtctaaaatattatattagctctatctcattccttaggcataaaacatgacaggcaaaacccatcamgaattattccctgccttccatccacagccctctgtactacctgcaattcctcatggcatgtaagtctcatcatcattccccagcttccaagcatttcctg

SEQ ID NO: 51819 - DNA, 201 bp, Homo sapiens
aattggggtgaacatctgtgttagctaattagtgtcttataaagggaaaaacaaacttctcatatcttaatgacaagaagtagttttgcaagttggaggargaggatcctcggaagtttaggctcctaccttcttaccgaagccgcaagatagaagtgttgtctcctttacgtcagagagatggctccttggtcctagaaa

SEQ ID NO: 51820 - DNA, 201 bp, Homo sapiens
gcaaatgtaactacataaaatctaagcacttaggttgaaaaaatagcatgctcatttaggtccaagaggaatgacagcaaaatatattttcctatgatacygtatcttctggaaaaaaaatgcttgaaaaaataaatcaactgagtaaaccagactcaaaaccagatggtgttctgtcagcctttacactggaggacattc

SEQ ID NO: 51821 - DNA, 201 bp, Homo sapiens
cctttacgtcagagagatggctccttggtcctagaaaatgacactcctggcttgtaagacctgcgagggccttttaaaatatttttcatctcaaagagccraagaaagaatttataattacaagggttttatgaacttttaagttcaggggtacctgtgcaggtttgtcacgtaggtaaacttgtgtcatggcacaagttt

SEQ ID NO: 51822 - DNA, 201 bp, Homo sapiens
tggtcctagaaaatgacactcctggcttgtaagacctgcgagggccttttaaaatatttttcatctcaaagagccgaagaaagaatttataattacaaggrttttatgaacttttaagttcaggggtacctgtgcaggtttgtcacgtaggtaaacttgtgtcatggcacaagtttgttgtacagattatttcatcaccca

SEQ ID NO: 51823 - DNA, 201 bp, Homo sapiens
taaaacttttcttctttgtccaggacatttatcttcccgaacgctcaaaaaaaaccctgcaacctctatgctaaaagttcattctgcttttttgtcctcgstttggtgagaaaataataaaaccaaacagtggactctcctaaaattgtgaatgaagaaaacttacagccaccacagttcagttctttaactatcattgta

SEQ ID NO: 51824 - DNA, 201 bp, Homo sapiens; identical to SEQ ID NO: 14913

SEQ ID NO: 51825 - DNA, 201 bp, Homo sapiens; identical to SEQ ID NO: 14918

SEQ ID NO: 51826 - DNA, 201 bp, Homo sapiens
catgcacctctgcgccatctcgctggaccgctacgtcgccatccagaatcccatccaccacagccgcttcaactccagaactaaggcatttctgaaaatcrttgctgtttggaccatatcagtaggtaagtggcaacatatttcagagtctcatttgaaatgacagttcgtgctttctgaaaagacttgttccattttgtt

SEQ ID NO: 51827 - DNA, 201 bp, Homo sapiens
agcatccattagttattcttcctgatgctctccctcccacctccccccaccaacaggccccagtgtgtgttgatccccaccatgtgtccacgtgttctcaygattcagctcccacatattagtgagaacatgcagtgttaaacacttctacattttgtacatttttctcctcttatttcttgagatagctttactgacttt

SEQ ID NO: 51828 - DNA, 201 bp, Homo sapiens
ttgattattttgctttgggtttagttttttgtttgctttgtgtgtggtttcttttaatttagatccttagtctagctggaattttaaaatatgatctaacytgtttgcttctactagtaactaaagctttttttagactcaattgatattttctcttcaagctattgatatgttcactctcttggtaaatttctaaatgta

SEQ ID NO: 51829 - DNA, 201 bp, Homo sapiens
gtcctttttacagcctttgattgccactgtctaaggcagataatcatgtcccattcttccccaagaaaagaccatcatgcacaattgtttttttctactcscatcttccaattgtacccctgatcttctgtacttcctgtctctacctcctgtccttcccaagaatttgatttctctccatctctctccaacttatgttaa

SEQ ID NO: 51830 - DNA, 201 bp, Homo sapiens
actgccaagcaaagctccctcagatttcagcccttggagaatgccccttaattcccatccatgtgtatatccttttatcctgcatttcatgcagtttcctyaaaaccctgctgacatttgctgcagtttcttatatttgtttttgtcctttcttcaagttctgtttccctctaaaccagatcccatctgctgtcttccaga

SEQ ID NO: 51831 - DNA, 201 bp, Homo sapiens
atatatatatatgtatacatacacacacaaatacacacacaagtgctgagaatctgtcaaaagacttcacacttatcaagatgattaaattagaaagaatrgcaggattgtcatctttttccttaagcatttctatatagttttgtcacagttttgttttgttctgtttttatcttgagacagagtcttgctctgttgccc

SEQ ID NO: 51832 - DNA, 201 bp, Homo sapiens
ataatttctaaataacctagtggcagaatagatctttaaaagcaagtcaaaaaatgcagatgccataaagaagaatatatacataaacagttatataagtytgatacggctaaaatcagtgtaagcaaagttaaacgaaaaatatttgcaatgtatatgattggcagaccaagggttaataaccttaaaatacaaatagca

SEQ ID NO: 51833 - DNA, 201 bp, Homo sapiens
ctaaactagtaccatcggcataaccaacaaaatgagatatagttaaacaagagtcccagtagttataaaacttttcttctttgtccaggacatttatcttyccgaacgctcaaaaaaaaccctgcaacctctatgctaaaagttcattctgcttttttgtcctcggtttggtgagaaaataataaaaccaaacagtggact

SEQ ID NO: 51834 - DNA, 201 bp, Homo sapiens
agcagaagtaagacttggagactgagtgtgttcccgaatcatgggggtggatgagctagcataatctccctgtgtttttataatgatcactgatgaaactsccttgaagactgttttagatgaaaaggcaaaaatgggttttgtgctgacagatgtgcattttttctgtcttcagaaaagtcaggagaggagaaggtcatc

SEQ ID NO: 51835 - DNA, 201 bp, Homo sapiens
gtaattacatccaatgaatgaaggctgaaattctggaagtgcgctatttggaggctgtagtcccctctgcaccagcaacacacatctttctctgctttttytctccagagctaagtgaagcccaacagaagctgctggtgaaatccatggagaaaaagatcctacccgtgcagctaaagctggtgagggaaaaacagcaga

SEQ ID NO: 51836 - DNA, 201 bp, Homo sapiens
ttaggaactagaagtactggagttgagccagggtggtacattgtgactggaagccaagagaagccagcgttgcacggagggtttccacagcaggatcgagwattgcacagagttaggcgaggtcattgagactgataggtaagagatcattgtaatttcagctgagtagtggaaatacaaggcaaattataaagaatttag

SEQ ID NO: 51837 - DNA, 201 bp, Homo sapiens
tctgacaggactgacagggaaatagcagagcgaatctcagcaaataattgtccccgaaacatggcagaaattccaatagcttgggaaaaagcagtggaaaggggggagtctttgcccaggtggtctgacgcctgagacctttgtcctcaacagccttactagcagccaggcacagtgattcacacctataatcccagcact

SEQ ID NO: 51838 - DNA, 201 bp, Homo sapiens
gagccagggtggtacattgtgactggaagccaagagaagccagcgttgcacggagggtttccacagcaggatcgagtattgcacagagttaggcgaggtcrttgagactgataggtaagagatcattgtaatttcagctgagtagtggaaatacaaggcaaattataaagaatttaggtggaccgggcatggtggctcaca

SEQ ID NO: 51839 - DNA, 201 bp, Homo sapiens
ctgacctcaggtgatcctcccaccttggcctcccaaagtgctgggatcacaggtgtgagccactgagcctggcctagaaaaaaaaaaaaaaaattaagagwcttagtagctataacctgctacacacacatctgcaactcggccgcccagcaactggggccagagccactgagtcacagtaatgccaggaacaaggtagct

SEQ ID NO: 51840 - DNA, 201 bp, Homo sapiens
atttttttgatatatttgccaatgaaatgaaggaaaaaaatagggtagtaatttgagggagtggcatgatcaaagcaaacaaatttgttaggattagggacacgtttatatatggaagcagacagaaggagcaagtggagaggaggaactggtgttaacagcaagagagagcataagatgtggagagaaaggatcccagag

SEQ ID NO: 51841 - DNA, 201 bp, Homo sapiens
tttttttgatatatttgccaatgaaatgaaggaaaaaaatagggtagtaatttgagggagtggcatgatcaaagcaaacaaatttgttaggattagggacacgtttatatatggaagcagacagaaggagcaagtggagaggaggaactggtgttaacagcaagagagagcataagatgtggagagaaaggatcccagaga

SEQ ID NO: 51842 - DNA, 201 bp, Homo sapiens
ctgccaaaatcctccaccctctcctagcttatactataatcccccaaggagcctctgcttttgtttcccaagtccctaagaatacctagcctcaactttaggaaagacagatagaggcatataaatactgtcccagagagatatagaaactgacagacagagaccggaaggcacagtcagaagcagaagtaagacttggag

SEQ ID NO: 51843 - DNA, 201 bp, Homo sapiens
ttttttgatatatttgccaatgaaatgaaggaaaaaaatagggtagtaatttgagggagtggcatgatcaaagcaaacaaatttgttaggattagggacacgtttatatatggaagcagacagaaggagcaagtggagaggaggaactggtgttaacagcaagagagagcataagatgtggagagaaaggatcccagagag

SEQ ID NO: 51844 - DNA, 201 bp, Homo sapiens
ggaggaactggtgttaacagcaagagagagcataagatgtggagagaaaggatcccagagagatgaatggggaggaaagagggggggagcatctacccccrggatcccagagagatgaatggggaggaaagagggggggagcatctacccccgaactggaggaaaagggggtaagaagcacccaagaggccctgttcccgg

SEQ ID NO: 51845 - DNA, 201 bp, Homo sapiens
gaatggggaggaaagagggggggagcatctacccccgaactggaggaaaagggggtaagaagcacccaagaggccctgttcccggccaggtgctggcccarttaccgagtttatctctgagcaacccaggaggtcagcatcattatactcatttcatagatgaggcaattaagactcagagaagctgccctgccagtaagc

SEQ ID NO: 51846 - DNA, 201 bp, Homo sapiens
aagtccttcctcagagtccagaccagggacaccactgaaggcttccagcttcttatctccctgaaggctctcagccctgaccctgcacctcccccaactcrcgctcccaatatctcatacttaagatgtccagagattcacaaattctcattgtctaattctagggatccataaatcacaaggaggctgtaaccatcccca

SEQ ID NO: 51847 - DNA, 201 bp, Homo sapiens
ttcccaagtccctaagaatacctagcctcaactttaggaaagacagatagaggcatataaatactgtcccagagagatatagaaactgacagacagagacyggaaggcacagtcagaagcagaagtaagacttggagactgagtgtgttcccgaatcatgggggtggatgagctagcataatctccctgtgtttttataat

SEQ ID NO: 51848 - DNA, 201 bp, Homo sapiens
gcacgctcctacctatcggcactcccagcctgcagaaattgtatgccttatgttcagcactaaactcaaatctaaccaaggaagtccggatcccatagggktcttcctactctccagttcggtttattttaaggccaacagccctagcttcacgtccctccttcacagccttctttccttccctcctgccggatgcgcccg

SEQ ID NO: 51849 - DNA, 201 bp, Homo sapiens
acctgacaccacttgacagcctcatcgacttcaagcgcttccatcccttctgcctggtgctgaggaagaggaagagcacgctcttctggggggcccggtaygtccgcaccgactacacgctgctggatgtgcttgagcccggcagctcaccttcaggtcagcctcaagcggggctgggaactgagggatactgagggacag

SEQ ID NO: 51850 - DNA, 201 bp, Homo sapiens
gcctcatcgacttcaagcgcttccatcccttctgcctggtgctgaggaagaggaagagcacgctcttctggggggcccggtacgtccgcaccgactacacrctgctggatgtgcttgagcccggcagctcaccttcaggtcagcctcaagcggggctgggaactgagggatactgagggacaggggctgggcacctggcct

SEQ ID NO: 51851 - DNA, 201 bp, Homo sapiens
aggaagagcacgctcttctggggggcccggtacgtccgcaccgactacacgctgctggatgtgcttgagcccggcagctcaccttcaggtcagcctcaagyggggctgggaactgagggatactgagggacaggggctgggcacctggcctgcaaggaggacctcaaagctccctctggccagaggtgattagatgtcatc

SEQ ID NO: 51852 - DNA, 201 bp, Homo sapiens
gggtggccaggggagtccaccttagataccttccccaaggctggccacgtgccccaaggctgccaggccactgctcctccctttgtcccctggaaaagggyaaacagtgggttcccccaaggcacatgctccctctgatggccagaagggacttctgctggaggggctggaaccttctctttccagagtccaaaactcagg

SEQ ID NO: 51853 - DNA, 201 bp, Homo sapiens
tgtaccaaagacggtgaaggtgaagggaacggcagggctctcgcagaacagcactctggaggtccagacactcagtgtggctcccaaggccctggagaccktgcagaagaggtgagagtgggcgggaccgagggtctcccgggatgtgggtggggcagtgcatggaaatggtgcttggggccttgagctgaaaggtaggac

SEQ ID NO: 51854 - DNA, 201 bp, Homo sapiens
aaagacggtgaaggtgaagggaacggcagggctctcgcagaacagcactctggaggtccagacactcagtgtggctcccaaggccctggagaccttgcagragaggtgagagtgggcgggaccgagggtctcccgggatgtgggtggggcagtgcatggaaatggtgcttggggccttgagctgaaaggtaggacccttgc

SEQ ID NO: 51855 - DNA, 201 bp, Homo sapiens
acggcagggctctcgcagaacagcactctggaggtccagacactcagtgtggctcccaaggccctggagaccttgcagaagaggtgagagtgggcgggacygagggtctcccgggatgtgggtggggcagtgcatggaaatggtgcttggggccttgagctgaaaggtaggacccttgcactgacctttgccaatgtggtc

SEQ ID NO: 51856 - DNA, 201 bp, Homo sapiens
gctaaggcaggagaatcgcttgaacccaggagggggagggtgcagtgagccgagatcactccattgcactccagcctgggcaacagagcgagactccatcaaaaaaaaaaaaaattggtttcattcctaaggatttgcttggtcacattgggtagtctgagaagacagcctagtcttgctaatagaggttgaataacccta

SEQ ID NO: 51857 - DNA, 201 bp, Homo sapiens
ggatctcaggaagattaactgttgggttagatgatacatgcatcctggcccaccttctcgccccaaccctcaggttagggttggtggatagttctgtcacygcattccttggtaaagaaaaatggggccaggctcaaactggggggtagagcatgggtacctaaagggggctgagtgtaggagccctgcagggggaatgct

SEQ ID NO: 51858 - DNA, 201 bp, Homo sapiens
ccgggatcccagagagatgaatggggaggaaagagggggggagcatctacccccgaactggaggaaaagggggtaagaagcacccaagaggccctgttccyggccaggtgctggcccaattaccgagtttatctctgagcaacccaggaggtcagcatcattatactcatttcatagatgaggcaattaagactcagagaa

SEQ ID NO: 51859 - DNA, 201 bp, Homo sapiens
aagatgtggagagaaaggatcccagagagatgaatggggaggaaagagggggggagcatctacccccgggatcccagagagatgaatggggaggaaagagrgggggagcatctacccccgaactggaggaaaagggggtaagaagcacccaagaggccctgttcccggccaggtgctggcccaattaccgagtttatctct

SEQ ID NO: 51860 - DNA, 201 bp, Homo sapiens
aagcctcctgcctgaccccaatacacactaagcacgccctcgggaatgctgccccacagcacaaagggtgtggcaggtgccacattgatgctgggcaccaccggatgtttggcttgacacgggaactgacttttaagtagttaagtagtggttgaaagaaggaggtaaggactgtgaaggccagaaggaaaggctggggta

SEQ ID NO: 51861 - DNA, 201 bp, Homo sapiens
ccccacgaacccataaaggctcctccccgctccttcctcgaagctcctccttcatcctgcacctcggctgtggatttatttcccctttgttgactcggccrtcggcctgccgggcctggcgtttcccagaaggcccagcgccgggaaggggtttgcagctgctccgtcatcgtgcggcccgacgctatctcgcgctcgtgt

SEQ ID NO: 51862 - DNA, 201 bp, Homo sapiens
cagaaggagcaagtggagaggaggaactggtgttaacagcaagagagagcataagatgtggagagaaaggatcccagagagatgaatggggaggaaagagsgggggagcatctacccccgggatcccagagagatgaatggggaggaaagagggggggagcatctacccccgaactggaggaaaagggggtaagaagcacc

SEQ ID NO: 51863 - DNA, 201 bp, Homo sapiens
ggtggagacggtgcaggaggtcacactggagcgagccggcaaggcagaggcctgcttctccctccccttcttcgccccattggggctacaggtttgattcaaacacacacacacacacacactctcacactcacactcacacatacacatttacattcagcccctccttggaggcttcattagctttgcctgatcagcgcc

SEQ ID NO: 51864 - DNA, 201 bp, Homo sapiens
ttggcagccaccttgacactctcctgtctccccacctccacagagacaatgaccatgtttgaaaatgtcacccgggccctggccagacagctaaaccctcraggggacctgacaccacttgacagcctcatcgacttcaagcgcttccatcccttctgcctggtgctgaggaagaggaagagcacgctcttctggggggcc

SEQ ID NO: 51865 - DNA, 201 bp, Homo sapiens
aagtgctccagctgggctccgtggcagtgaagaaaatgagcgtggagtgagaaaaatgcccttgacaaagaaaagggaggtgtggctttgctggccatctrtgggactttggggcaactctttcaactctccagccctaggttcctcatcataaaatgcagactcccttgattctttccagctgtgacatgagacaatcca

SEQ ID NO: 51866 - DNA, 201 bp, Homo sapiens
ataagggcctggagctcaggaaagaggtcaaagtgaagatacacacaaggtaatcagcactataaagattaaaactgtaggagccaggggaggagtctcastcccgtaagcccagcactttgggaagccaaggcaggattgcttgagcccaggagttcaaaccagcctgggcaagagagtgaaacccccatctccacaaaa

SEQ ID NO: 51867 - DNA, 201 bp, Homo sapiens
gggtacctaaagggggctgagtgtaggagccctgcagggggaatgctgactggagaggaaggtgcccgatggagggctgtgtgtcccattattgtccccayaggggacgtacacgaaggcttcaggacactaaaagaagaagttcagagagagacccaacaagtggagaagctgagccgagtagggcaaagctccctgctc

SEQ ID NO: 51868 - DNA, 201 bp, Homo sapiens
tgggtacctaaagggggctgagtgtaggagccctgcagggggaatgctgactggagaggaaggtgcccgatggagggctgtgtgtcccattattgtccccmtaggggacgtacacgaaggcttcaggacactaaaagaagaagttcagagagagacccaacaagtggagaagctgagccgagtagggcaaagctccctgct

SEQ ID NO: 51869 - DNA, 201 bp, Homo sapiens
gtccgcaccgactacacgctgctggatgtgcttgagcccggcagctcaccttcaggtcagcctcaagcggggctgggaactgagggatactgagggacagrggctgggcacctggcctgcaaggaggacctcaaagctccctctggccagaggtgattagatgtcatctagcccaaagtcatcatcaggagctgaggaggc

SEQ ID NO: 51870 - DNA, 201 bp, Homo sapiens
tcccaatatctcatacttaagatgtccagagattcacaaattctcattgtctaattctagggatccataaatcacaaggaggctgtaaccatccccaaggrctgcgtcctggcctttcgagtgagacagctgatggtcaaaggcaaagatgagtggggtgagcagagacccgcatgttctccccacaagatgagaattacc

SEQ ID NO: 51871 - DNA, 201 bp, Homo sapiens
cagacccaacagacactgggaattttggctttaagaatatgctggacacccgagtggagggagatgtggatgtaccaaagacggtgaaggtgaagggaacrgcagggctctcgcagaacagcactctggaggtccagacactcagtgtggctcccaaggccctggagaccttgcagaagaggtgagagtgggcgggaccga

SEQ ID NO: 51872 - DNA, 201 bp, Homo sapiens
tcccagagagatatagaaactgacagacagagaccggaaggcacagtcagaagcagaagtaagacttggagactgagtgtgttcccgaatcatgggggtgratgagctagcataatctccctgtgtttttataatgatcactgatgaaactgccttgaagactgttttagatgaaaaggcaaaaatgggttttgtgctgac

SEQ ID NO: 51873 - DNA, 201 bp, Homo sapiens
atctgggtttcaacctcagccctagtccagagtcctcactccttccctgccaccacaatgtctagttcctgggaatgacagaaggaaagaggagggtgtgktacaggcaggaaggagctctgaacggttcccttatgtttctcctgcaacaggaagctggcagcagaccacccattcctgaaggagatgcaagatcaaggg

SEQ ID NO: 51874 - DNA, 201 bp, Homo sapiens
agtagagatggggtttcaccatgttggtcaggcaggtcttgaactcctgacctcaggtgatccacccacctcagcctcccaaagtattgggattacaggcrtgagccacggcgcctggccttttttttttttcttgagacagagtctcattctgttgcccagactggagtgcaaaggtgagatctccactcactgcaaact

SEQ ID NO: 51875 - DNA, 201 bp, Homo sapiens
cccaacaagtggagaagctgagccgagtagggcaaagctccctgctcagctccctcagcaaacttctagggaagaaaaaggagctacaagaccttgagctygcagtgaggacctagtggaagtggggaagggtgggagaaggcatgttttggtgaagatttggtgggggcgggtattgcagcaggtagggagatctgacgg

SEQ ID NO: 51876 - DNA, 201 bp, Homo sapiens
tgtgctgggccctgggttgggccctttcctatgttatcttcaatagtcgcccaccttcccccacagcttgaaggggctctagacaagggacatgaagtgamcctggaggcactcccaaaagatgtcctgctatcaaaggaggccgtgggcgccatcctctatttcgttggagccctaacaggtaagtggggaataaggtct

SEQ ID NO: 51877 - DNA, 201 bp, Homo sapiens
acactggagcgagccggcaaggcagaggcctgcttctccctccccttcttcgccccattggggctacaggtttgattcaaacacacacacacacacacacwctcacactcacactcacacatacacatttacattcagcccctccttggaggcttcattagctttgcctgatcagcgcccaccgaggatgctgaaaagggc

SEQ ID NO: 51878 - DNA, 201 bp, Homo sapiens
ggctggaaccttctctttccagagtccaaaactcaggaaacaaggaacccaggagtccagtactcttcaggacatgaggcctcgaaaaagaaatcaggaartggagagagtttccgcatgtcaaggggttattatgtgctgggccctgggttgggccctttcctatgttatcttcaatagtcgcccaccttcccccacagc

SEQ ID NO: 51879 - DNA, 201 bp, Homo sapiens
ggggccaggctcaaactggggggtagagcatgggtacctaaagggggctgagtgtaggagccctgcagggggaatgctgactggagaggaaggtgcccgayggagggctgtgtgtcccattattgtccccataggggacgtacacgaaggcttcaggacactaaaagaagaagttcagagagagacccaacaagtggagaa

SEQ ID NO: 51880 - DNA, 201 bp, Homo sapiens
cagcactttgggaggctgaggcaggaggatcccttgagctcaggagttcaagaccagcctgggcaacatagtgagacaatgtctctatttaaaaaaaaaawtttttttttggatggagtttcactcttgttgcccaggctggagtgtagtggcgcaatctcagtccactgcaacctccacctccccggttcaagtgattct

SEQ ID NO: 51881 - DNA, 201 bp, Homo sapiens
acatggcagaaattccaatagcttgggaaaaagcagtggaaaggggggagtctttgcccaggtggtctgacgcctgagacctttgtcctcaacagccttastagcagccaggcacagtgattcacacctataatcccagcactttgggaggctgaggcaggaggatcccttgagctcaggagttcaagaccagcctgggca

SEQ ID NO: 51882 - DNA, 201 bp, Homo sapiens
cccaatagtggacctcaggccctttcctctggcctccctctgcctcctcctgatggttcctgctggtctctccctggctgggaccctgggaggaggatccwggtcggactttctgcaagagatgcccgacctcttctgggctagttaggcaagggcagccctccttagccagactcagctgcccacagcctggctttgatg

SEQ ID NO: 51883 - DNA, 201 bp, Homo sapiens
caatatttaaaaatatatattatgtttacatataggatatcaaattcttaaatgaggtattggtgagtggtgggattatgggcaattattttccttcctaktgtttatttatgtgaagacaatgataaaccttgaaagaaaaaagtacccacaatctcacttgatgatgagtaattttgatttatttttatttttgcatac

SEQ ID NO: 51884 - DNA, 201 bp, Homo sapiens
gggttcccttcttctcttctctcagatgcatggtggacttaggaccttgctgggctgggggtctcactgcagagatgaagctgcttctggccctagcaggsctcctggccattctggccacgccccagccctctgaaggtgctgctccaggtaacagttcccaaggtgggagaagatggtgtgttggggtggttgtgttcc

SEQ ID NO: 51885 - DNA, 201 bp, Homo sapiens
ggttcccttcttctcttctctcagatgcatggtggacttaggaccttgctgggctgggggtctcactgcagagatgaagctgcttctggccctagcagggstcctggccattctggccacgccccagccctctgaaggtgctgctccaggtaacagttcccaaggtgggagaagatggtgtgttggggtggttgtgttcca

SEQ ID NO: 51886 - DNA, 201 bp, Homo sapiens
acatctggtgcttcattgcccccaccctctccctcagaggcagaggcagacatacacacactcacacacacacacacacacacacacacactcctagattytggaggagagagttttcggtgctaagggtgagtttttgatttgcactaagaactcaagtgaaattcatttacactccaaaataacttctagactctagaa

SEQ ID NO: 51887 - DNA, 201 bp, Homo sapiens; identical to SEQ ID NO: 14973

SEQ ID NO: 51888 - DNA, 201 bp, Homo sapiens
ccaaagcggaaggcgaaggtgaagacattggaaattctgggatccacagattcactgtagccttgatatgggggtatccacttctgcatgtggtcacctarcaaaatgggtaggtagtccctaaaggtgataatctggagggagaataaaatcaagaggaaagggtgtaagaaggtttaaacctctgcagagggaggctgt

SEQ ID NO: 51889 - DNA, 201 bp, Homo sapiens
gttggggtggttgtgttccagagaccccttttctcagagcaggccttcctagctctggggcctgatagggggttggggcccattcctgactttgtgatccytgctctgggcagctgtcctgggggaggtggacacctcgttggtgctgagctccatggaggaggccaagcagctggtggacaaggcctacaaggagcggcg

SEQ ID NO: 51890 - DNA, 201 bp, Homo sapiens; identical to SEQ ID NO: 14975

SEQ ID NO: 51891 - DNA, 201 bp, Homo sapiens; identical to SEQ ID NO: 14976

SEQ ID NO: 51892 - DNA, 201 bp, Homo sapiens
cgcccggggtcaagcgcaacggcttcccggtggctctggtgagcgccggcgggcagagggggcgaggcccggccacgcggtgcgcggacccaggcgccagstgatctccgtgtcccgcaggctcgcgcggtctccaacgagatcgtgcgcttccccactgatcagctgactccggaccaggagcgctcactcatgttcatg

SEQ ID NO: 51893 - DNA, 201 bp, Homo sapiens
agcacttccctgaaagggcataccatctttgaccatcctccaagtgttgaagaagagggtgtggagggggagttctggttctggcccccatggctgataaytctcatccaggcggaacatactagaggggacctccaagtggccaaagcggaaggcgaaggtgaagacattggaaattctgggatccacagattcactgta

SEQ ID NO: 51894 - DNA, 201 bp, Homo sapiens
gtgaaattcatttacactccaaaataacttctagactctagaatgtagagtgagactattccatgtcttcacttttcacagggaaaatcatgccagaatgscccttcgttccttcctgcctccctgctttccacaaacctaaactgagccttactgtgggcaggcacttggtgggcactgtgaagaatttcaacaacttca

SEQ ID NO: 51895 - DNA, 201 bp, Homo sapiens
tgaaattcatttacactccaaaataacttctagactctagaatgtagagtgagactattccatgtcttcacttttcacagggaaaatcatgccagaatggsccttcgttccttcctgcctccctgctttccacaaacctaaactgagccttactgtgggcaggcacttggtgggcactgtgaagaatttcaacaacttcaa

SEQ ID NO: 51896 - DNA, 201 bp, Homo sapiens
gcagcgcgggcccctaattcttcactgaggcccagggtgacaggtccagcttgtcgatggctgagcaatccacgaagtcataggggtagctgttggcccaraatgggtcccgtgggaccttggtgatgcgggtgttgtcacagacaaggcgtgagaaggacattttctgtagagagtccttctgctcgttcgtgaagaccc

SEQ ID NO: 51897 - DNA, 201 bp, Homo sapiens
gcatttgttgtggctttgttatatcctgggagcagcacaagcccatcgatgccctgccagcccagaatatccttgggcacagtgtccatgggtgttccccmtgcaggttttggtgggagaacgagggtgtgttcagcatgcagcagcgacaggccctggcccagatctcattgccccggatcatctgcgacaacacaggca

SEQ ID NO: 51898 - DNA, 201 bp, Homo sapiens
ctctgaagcgcaaaggccgcgtgggcccactcctcgcctgcatcatcggtacccagttcaggaagctccgggatggtgatcggtgaggaggggcaggcgtygtgggccgctgggtggctgtgggcccatccttgactctcttggagcccaaatttcctcctgtcagttgaaggactggagggagtcagtaattttccagtg

SEQ ID NO: 51899 - DNA, 201 bp, Homo sapiens
ttccagagaccccttttctcagagcaggccttcctagctctggggcctgatagggggttggggcccattcctgactttgtgatccctgctctgggcagctktcctgggggaggtggacacctcgttggtgctgagctccatggaggaggccaagcagctggtggacaaggcctacaaggagcggcgggaaaggtggggcac

SEQ ID NO: 51900 - DNA, 201 bp, Homo sapiens
aatccctcaggggcagggaactaaaggacagagaacgctgtggtgccctcaccctctagagcgacactatccaatgtggtagccactagctgcatgtggcwattttaattttagttattttaaattaaataaacccagtttctcagcggtgctaaccacatttcaaatgctcaattgccttacagtctagtggctccccct

SEQ ID NO: 51901 - DNA, 201 bp, Homo sapiens
aggcagagactctggccctcctgtgctgccaggcggcatttgctgtggaggagtgggtggagaggccattccaaatgacttgtctttagatcatcacttaycgggactacctgcccctggtgctggggccaacggccatgaggaagtacctgcccacgtaccgttcctacaatgactcagtggacccacgcatcgccaacg

SEQ ID NO: 51902 - DNA, 201 bp, Homo sapiens
ggaatcaagagaatcaatgaaccaagcagtgttcataagtctcatactttgtaccaggcactctgttaagccccatgtatccatatgtgtgctaggagggwgggtaaaatataaaaaggcacaagccttggtcctgtgctcaaggagctcccagtttcaggtacaggaaagtggcatgtcatgtgttggaagtgataccta

SEQ ID NO: 51903 - DNA, 201 bp, Homo sapiens
cggcttctctcttccctacggctggacgcccggggtcaagcgcaacggcttcccggtggctctggtgagcgccggcgggcagagggggcgaggcccggccrcgcggtgcgcggacccaggcgccagctgatctccgtgtcccgcaggctcgcgcggtctccaacgagatcgtgcgcttccccactgatcagctgactccgg

SEQ ID NO: 51904 - DNA, 201 bp, Homo sapiens
gagctcaagagcctgaaccctaggtgggatggggagaggctctaccaggaagcccggaagatcgtgggggccatggtccaggtaggccgtcttgaacaccrggcacacgggatccagatgtgtccctgcaacatcctagctgtgtgaccttgggcaagttcctaacgctcctgagccttgccttcttcatccatgaggctg

SEQ ID NO: 51905 - DNA, 201 bp, Homo sapiens
cggcatttgctgtggaggagtgggtggagaggccattccaaatgacttgtctttagatcatcacttaccgggactacctgcccctggtgctggggccaacrgccatgaggaagtacctgcccacgtaccgttcctacaatgactcagtggacccacgcatcgccaacgtcttcaccaatgccttccgctacggccacaccc

SEQ ID NO: 51906 - DNA, 201 bp, Homo sapiens
aatagtggacctcaggccctttcctctggcctccctctgcctcctcctgatggttcctgctggtctctccctggctgggaccctgggaggaggatccaggwcggactttctgcaagagatgcccgacctcttctgggctagttaggcaagggcagccctccttagccagactcagctgcccacagcctggctttgatgagc

SEQ ID NO: 51907 - DNA, 201 bp, Homo sapiens
gggtaagggaaaggccactgggcagctgtgctttactctgcacgatgagtggagcatcacttgtgtgaaagcccctgggctgcccaagggcctggggcccycctgtgcttccaggtggcatttgttgtggctttgttatatcctgggagcagcacaagcccatcgatgccctgccagcccagaatatccttgggcacagtg

SEQ ID NO: 51908 - DNA, 201 bp, Homo sapiens; identical to SEQ ID NO: 14970

SEQ ID NO: 51909 - DNA, 201 bp, Homo sapiens
ggaggccaagcagctggtggacaaggcctacaaggagcggcgggaaaggtggggcacgaggcactgcccagctctgggcaaggatgtcccaggcctttcasagaagcagcaggcagcagggagcttgaaggtgggagagggggactatggggacccatgtggactccctttctgtctgtctgtccctgtgtttctggatgg

SEQ ID NO: 51910 - DNA, 201 bp, Homo sapiens
acgcccggggtcaagcgcaacggcttcccggtggctctggtgagcgccggcgggcagagggggcgaggcccggccacgcggtgcgcggacccaggcgccasctgatctccgtgtcccgcaggctcgcgcggtctccaacgagatcgtgcgcttccccactgatcagctgactccggaccaggagcgctcactcatgttcat

SEQ ID NO: 51911 - DNA, 201 bp, Homo sapiens
gaagttatcacaatgactaaaaaagtgatttgctatttagtcctctaaggcagagggcaatataattatccttaatgtacatttgaggaactcaggctcasagaggttaataattggtccaaggtcacccagccagcaagcagtagaactctatttatgcctctcagtgccactctgttaggcccaggtccggtattgtgg

SEQ ID NO: 51912 - DNA, 201 bp, Homo sapiens
ctggctgaggacgcacttgcctgtctccatcacggatctgctggaactgcttgcccaagaggcaggccaggagaggccccacccgacccctttccaccagyggctcagcaatggcccctatccagatgtcgatgttgtcaggggtcccgtagagacccagtaacttcttggccagcatcttgctcttcagcactgtgttca

SEQ ID NO: 51913 - DNA, 201 bp, Homo sapiens; identical to SEQ ID NO: 14967

SEQ ID NO: 51914 - DNA, 201 bp, Homo sapiens
ccccagccctctgaaggtgctgctccaggtaacagttcccaaggtgggagaagatggtgtgttggggtggttgtgttccagagaccccttttctcagagcrggccttcctagctctggggcctgatagggggttggggcccattcctgactttgtgatccctgctctgggcagctgtcctgggggaggtggacacctcgtt

SEQ ID NO: 51915 - DNA, 201 bp, Homo sapiens
atatcctttttataaaaggaagccttcctcccacccgtgggcctgcctgcatggtcctgcatgtctgcccctgggctggggctctgctgggtgggtctgtrtcccttctctggccctcactcctcctttctccaagcagcatcaagcagcggcttcgcagcggctcagccagccccatggaactcctatcctacttcaagc

SEQ ID NO: 51916 - DNA, 201 bp, Homo sapiens
cgtctctcagtgatcccctcaacttcttcctccagggagtctcaggagtctccagggctcctcagcctcaggttgcctgggataggaagtgaggcggctcrgctcccccattgttctttcccccggcagatgtgctgacgcccgcccagctgaatgtgttgtccaagtcaagcggctgcgcctaccaggacgtgggggtga

SEQ ID NO: 51917 - DNA, 201 bp, Homo sapiens
cctcttctttttggctctgtcataatccacccaatgtccttagcctcatttacccctggggcaatgttcctggttccgtctctcaacatctggtgcttcawtgcccccaccctctccctcagaggcagaggcagacatacacacactcacacacacacacacacacacacacacactcctagattctggaggagagagttt

SEQ ID NO: 51918 - DNA, 201 bp, Homo sapiens
gctggaaggtaagcaggacctaggccaggagcgagtgggctgacagctaaaggtggggtagggatcaccttggctctagggagctagggtggggagcagtytgctttcctcccatcttggagatctggtctgactctctagcctcagttcctctgactctgcttccatatctgataataaacagtggggtggggatggccc

SEQ ID NO: 51919 - DNA, 201 bp, Homo sapiens
ggggtaagggaaaggccactgggcagctgtgctttactctgcacgatgagtggagcatcacttgtgtgaaagcccctgggctgcccaagggcctggggccytcctgtgcttccaggtggcatttgttgtggctttgttatatcctgggagcagcacaagcccatcgatgccctgccagcccagaatatccttgggcacagt

SEQ ID NO: 51920 - DNA, 201 bp, Homo sapiens
gctcctctggtccccaggtggcattgaccccatcctccggggcctcatggccacccctgccaagctgaatcgtcagaaccaaattgcagtggatgagatcygggagcgattgtttgagcaggtcatgaggattgggctggacctgcctgctctgaacatgcagcgcagcagggaccacggcctcccaggtgaggggctgca

SEQ ID NO: 51921 - DNA, 201 bp, Homo sapiens
gcgccagctgatctccgtgtcccgcaggctcgcgcggtctccaacgagatcgtgcgcttccccactgatcagctgactccggaccaggagcgctcactcaygttcatgcaatggggccagctgttggaccacgacctcgacttcacccctgagccggccgcccgggcctccttcgtcactggcgtcaactgcgagaccagc

SEQ ID NO: 51922 - DNA, 201 bp, Homo sapiens
atctcagggatttaattgatagaagccactagagaggaaaagggcttggactgtctagtgtaattaagctttaaaaccttaattctgagctcctttggggracaagggaaactagaagcagggttataataggaccactctcaaactccatgagttttattggaaaatgagacaggaatgaggctccaataaacagcaata

SEQ ID NO: 51923 - DNA, 201 bp, Homo sapiens
agggcttggactgtctagtgtaattaagctttaaaaccttaattctgagctcctttgggggacaagggaaactagaagcagggttataataggaccactcycaaactccatgagttttattggaaaatgagacaggaatgaggctccaataaacagcaataacaagcacacaaaacaacagccaaacaacagtgtgtttat

SEQ ID NO: 51924 - DNA, 201 bp, Homo sapiens
aagctatgtaattccctgttgtttttgccattcatgtgagtggcatggcatttaggaaagaggacttggattgatcattgatgctttcattcataaattamaacttctcaggtatctcctgggcttatgtgaagtcagtgcgtctaactacactggagagagaatggtttcacagatgctttaaaccacaagctctgtgtg

SEQ ID NO: 51925 - DNA, 201 bp, Homo sapiens
cttttgggttcaagtgattcttgtgcctcagccttccgagtagctgggattacaggtgccttccaccatgcccagctaattttttttttttttgtattttyagtaaagatggggtttcaccatgttggccaggctggtctcgaactcctgatctcaggtgatccgcctgcctcagcctcccaaagtgctgggattataggc

SEQ ID NO: 51926 - DNA, 201 bp, Homo sapiens
ctcagccttccgagtagctgggattacaggtgccttccaccatgcccagctaattttttttttttttgtatttttagtaaagatggggtttcaccatgttrgccaggctggtctcgaactcctgatctcaggtgatccgcctgcctcagcctcccaaagtgctgggattataggcgtaagcctccgtgcctggcctgagtg

SEQ ID NO: 51927 - DNA, 201 bp, Homo sapiens
ttgtggaagaaaccctattatgcacaaaacttgccccaagtttcagctcagagattgcataatcctgaaattgatgtcctccttgtctgctttttagtagwttcaattatctccatggtttactacattttaaaggttgtaaacttttaaagactcattttgtgttcaaggagtttgtttgttcctttgcttttttataga

SEQ ID NO: 51928 - DNA, 201 bp, Homo sapiens
tttttgatgcatgaggtcacaacagatgtgaaagagatcagctgtgccgagacctaatgcacacatgattctctttgcagtgtatccacagggacctggcrgcacgaaatatcctcttatcggagaagaacgtggttaaaatctgtgactttggcttggcccgggatatttataaagatccagattatgtcagaaaaggag

SEQ ID NO: 51929 - DNA, 201 bp, Homo sapiens
caccatgcccagctaattttttttttttttgtatttttagtaaagatggggtttcaccatgttggccaggctggtctcgaactcctgatctcaggtgatcygcctgcctcagcctcccaaagtgctgggattataggcgtaagcctccgtgcctggcctgagtgatattttagtgctctttttgggtggagctgtggtccc

SEQ ID NO: 51930 - DNA, 201 bp, Homo sapiens
gacaaccagacggacagtggtatggttcttgcctcagaagagctgaaaactttggaagacagaaccaaattatctccatcttttgggtaagactcagccayattaaaaagacaaatttcaataggaatttttggaaggaacttaggactttcagtgtaagtgcagaattttccctatggggtctttgttggttggagaaat

SEQ ID NO: 51931 - DNA, 201 bp, Homo sapiens; identical to SEQ ID NO: 15047

SEQ ID NO: 51932 - DNA, 201 bp, Homo sapiens
ggggtttcaccatgttggccaggctggtctcgaactcctgatctcaggtgatccgcctgcctcagcctcccaaagtgctgggattataggcgtaagcctcygtgcctggcctgagtgatattttagtgctctttttgggtggagctgtggtcccagcctaacttccaggacttcagccggctccaggacacactgtatttc

SEQ ID NO: 51933 - DNA, 201 bp, Homo sapiens
actgctggcacggggagcccagtcagagacccacgttttcagagttggtggaacatttgggaaatctcttgcaagctaatgctcagcaggtttgtcacctycatccaagaagcacctacaaagagtacttagatgtcaaggactttcctactgcctgaactgtctcatggctaccatgccatcctctcagccattgaataa

SEQ ID NO: 51934 - DNA, 201 bp, Homo sapiens
ttctcacttataagtgggagctgaacaatgtgaacacatagacacagggaagggaacaacacacactggggcctactgtgggttggggagaaggagagcaycaggaaaaatagctaatgcatgctgggcttaatacctaggagatggattaataggtgcagcaaatcaccatggcacatgtttacctgtgtaacaaacctg

SEQ ID NO: 51935 - DNA, 201 bp, Homo sapiens
gctgggcttaatacctaggagatggattaataggtgcagcaaatcaccatggcacatgtttacctgtgtaacaaacctgagcattctgcacatgtatcccrgaacttaaaagaaaaaaagaaggtcagtgggaagtcatagatacatcctgtggtttttgaagattagtttgtatcttatagacacacattcactttgaat

SEQ ID NO: 51936 - DNA, 201 bp, Homo sapiens
aggaaatcttggaactgcagctactcagaccctcaaggtctttgacgtttcacttgaaatgaaaaactaaatcaaatgaccatttacagtaagttgaccttttttttttttttattttcttccagaaaaaccttttgttgcttttggaagtggcatggaatctctggtggaagccacggtgggggagcgtgtcagaatccc

SEQ ID NO: 51937 - DNA, 201 bp, Homo sapiens
agggcaacgacagatgatttttaatattctttgtactttgtaaattttctcagtgagtatgtattcttttaaccagcaaacataattaatgttgttataaktctgcttgcatcacatttcctattcctgcagttcttattgtggaaaaattcttaatcaggcaggatgaatagcctcttctccctgattctgtctttgttt

SEQ ID NO: 51938 - DNA, 201 bp, Homo sapiens
ggattccgagttttaattggactagagataattaagattcacttgtgaacaatagaccattgctcttctgacatggaaaatttttggtttttatctcaatwcgtgtgtatgcagaagtgatgtgaaatctgtcattttcttagctaggaaaagtaatttgtggcagaatattttatcttaagaagtatattcctatggctt

SEQ ID NO: 51939 - DNA, 201 bp, Homo sapiens
gactttggagtcaaaaaagaaagaaaggaaaaagggagagaagaaagaaggaagtgagagaagggagaaggaagaaaggggaagagggaaagggagtggaragggagggaggaagagggagagagaatgaaaaactcagatgatggtggcaggaatgcattctctaaagatttacaccttcctttaacatgaggtggttta

SEQ ID NO: 51940 - DNA, 201 bp, Homo sapiens
atggtgatagaagggatcgatggatttctatgaactcatcctaacttgtctctcaaagtctagattttggtccctttactctgccaaatctatgatgccargtattgcatcgagatatgttgacatattttcaaatgtataagcttattagcatttcataaactacacttgcaaataaagatttcaaagaccatggcagtt

SEQ ID NO: 51941 - DNA, 201 bp, Homo sapiens
gagtgaggaaggaggacgaaggcctctacacctgccaggcatgcagtgttcttggctgtgcaaaagtggaggcatttttcataatagaaggtcagtgggakaaaaaaaaatgtggtacatatacaccatggaatgctatgcagccgtaaaaaggaatctgatcatgtcctttgcagctgcatggatggagctggaagccat

SEQ ID NO: 51942 - DNA, 201 bp, Homo sapiens
tgagcaatgttttgcaagctttaaattttccattaacaattctgtaggccaggtgtggtggcttatgcctgtaatccctgcactttgggaggccaaggcaggggggatggctagaggccaggagttcgagactagcctgggcaatgtagtgagaccctgtctctacagaaaataaaagaaaaattagctgggcttggtggt

SEQ ID NO: 51943 - DNA, 201 bp, Homo sapiens
ccaagtattgcatcgagatatgttgacatattttcaaatgtataagcttattagcatttcataaactacacttgcaaataaagatttcaaagaccatggcrgttttgtcatttccaaagtgattcatgttttagggcaaatccgcagaatgacgtctagattgtctctgatgctctgcattacctcttgttggtggcctgc

SEQ ID NO: 51944 - DNA, 201 bp, Homo sapiens
gaggcagttggaatgccttaaatgtagtgcaattcaggtgctatgcaaagattactgtcctctaggagattatgttgtaaactggtgcacacttcttcacygaaagtccttgaggaagaaagaagctaataataatgaaatgatatatcgaaaggagaaaataacaaaacctgatgatggagtaattcactagtatatgca

SEQ ID NO: 51945 - DNA, 201 bp, Homo sapiens
gggagaatcgcttgagcctaggaattggaggctgcaataagctatgattgtgtcatggtactccagcctggaacatagaaagaaaccctgtctctaaaaawaaataaataaataaataaataaataaataaataaataaataaattaaattcaaaaaaagaattctgtagactccattcaagttacgggtgtgtaactgtt

SEQ ID NO: 51946 - DNA, 201 bp, Homo sapiens
acatagaaaacagactctttgaactttttatcctctatgttcaactggacttttaaatctgtgtgtataaatagagaattacttccctaggaccaccagaraaacaaaatttactccaagcataattgtgcttgtctctcaatggttaagttaacttttattttgcaaaccaatttgttacttattttgcaaaccagtttc

SEQ ID NO: 51947 - DNA, 201 bp, Homo sapiens
ggctgcaataagctatgattgtgtcatggtactccagcctggaacatagaaagaaaccctgtctctaaaaataaataaataaataaataaataaataaatmaataaataaataaattaaattcaaaaaaagaattctgtagactccattcaagttacgggtgtgtaactgttgtcctctaggatttttccaagttggtaag

SEQ ID NO: 51948 - DNA, 201 bp, Homo sapiens
gttaacttttattttgcaaaccaatttgttacttattttgcaaaccagtttcttacttgtcttcttctctcttgaggccgtagtgggccatccgcacagcktgtggcccggtttgattctccttgcactcttctgatgggaggccccaagtgatgactgcttccttatcatctctttgctaatcactcttagtggaaagcc

SEQ ID NO: 51949 - DNA, 201 bp, Homo sapiens
acaaaaagtataagtttccaactgttgatactcattcaattgtgtctttccaggtgcccaggaaaagacgaacttggaaatcattattctagtaggcacgrcggtgattgccatgttcttctggctacttcttgtcatcatcctacggaccgttaagcgggtaaaaaaataatttcccttctgcccatgcacattggtttt

SEQ ID NO: 51950 - DNA, 201 bp, Homo sapiens
gcccttgtgcaaattggaaaaaggatcctcctttgtagctttatgccaggatgcatggtctggcaagcaaagttgggaatggctttcaccttcttgcctgrttaccctcgtgcagggctcagccaacacagttgtacttagtggttctgggtacagggaaaaaggactgtggttatattaaaattgtttcttaatatattg

SEQ ID NO: 51951 - DNA, 201 bp, Homo sapiens
atacatggtcattagtaactctcaggtcaaaaaattttgtttatttccctacttggtttcttatgtgatccttttgcaaactctgcacagatcaaaatatygactatcagtttaaaagaagacttttgttttcctcaaatagaaatatttttttttctctgtagagaatgatctgttttctttccatcaaagactgctctt

SEQ ID NO: 51952 - DNA, 201 bp, Homo sapiens
ctgctttgcttccctaaggactcctaacttgttttcctaaaacctattcttagaaataggctagaatccagtacatttgcttagacttcaatgtagtacgmtgttgaggtaatctcattttgctaagtgttgacgtggattttttcagcatgattccttttgatgttcagttggttgggacaagatatttccacagcactt

SEQ ID NO: 51953 - DNA, 201 bp, Homo sapiens
agggctcagccaacacagttgtacttagtggttctgggtacagggaaaaaggactgtggttatattaaaattgtttcttaatatattgtggaatcagatamttatagaccatctagagacatggaaaggaagatagtgaaatacaaaaatagcatgttctccagaattggaatatgtaaaagatgttcatatgtaaaagat

SEQ ID NO: 51954 - DNA, 201 bp, Homo sapiens
gttgtacttagtggttctgggtacagggaaaaaggactgtggttatattaaaattgtttcttaatatattgtggaatcagataattatagaccatctagaracatggaaaggaagatagtgaaatacaaaaatagcatgttctccagaattggaatatgtaaaagatgttcatatgtaaaagataatttgcaaaacaagaa

SEQ ID NO: 51955 - DNA, 201 bp, Homo sapiens
agcggcttatcaagtcttccttccaaccatacttcctcaggcgagtcttgataaatatcctggcctttattaagttatgtttccagtgatattttatttakttgtttttatgtttatttttatttttttgaggtggagtctcatgctgttgcccaggctggagtgcaatggtgcgatctcggctcactgaaaccttcgcct

SEQ ID NO: 51956 - DNA, 201 bp, Homo sapiens
ggctgcgttggaagttatttctaagaacagaataaccaaagtctgaatcttttccttactcttgactctaattaaagaaaaattaaatcataatatgcgckgttatctctttcttatagccaagctgtctcagtgacaaacccatacccttgtgaagaatggagaagtgtggaggacttccagggaggaaataaaattgaa

SEQ ID NO: 51957 - DNA, 201 bp, Homo sapiens
ttctctcaaaaattctgtacaattttgctggtgtttttatactattctctgccaacatgcatacacacacacacacacacacacgcacacaaatacacacmcacacccacattccaataaccagtacagccacctggcgtatagtagacatacgctcaataaatatgaatgaataaatgaagttgagggcatacatttaag

SEQ ID NO: 51958 - DNA, 201 bp, Homo sapiens
ccacctcccgggttcaagcaattctcatgcctcagcctcctgagtagctgggattacaggcatgcgccaccacacctggctcatttttgtatttttagtasagacagggttttaccatgttgcccagcctggtctcgaactcctggcctcaggtgatccatccgcctcggcctcccaaagtgctgggattataggcatgag

SEQ ID NO: 51959 - DNA, 201 bp, Homo sapiens
cagcatacaaaaagacatacttacaattaaggctaatacaactcttcaaattacttgcaggtaaggattcattctagatctagatttcttgtgttaagtamctgattgtttattgagtggaaataatttccagtagagcagaattataatagagcttgtagtaattgttcataagtggtgaggtttctaagaactgatgta

SEQ ID NO: 51960 - DNA, 201 bp, Homo sapiens
ccctttgccaataggttttgtgcatttcaaagctatctttctccatctgccttttttctcttgtggccaagggagtgtgtaattttgaggtggctcatcasagccttagatgtggaccatgcctgtgaattagtgggaagtgtagcagtccatacaggatcaaacacatagtcttagtgccatcagcctcatgtgccaact

SEQ ID NO: 51961 - DNA, 201 bp, Homo sapiens
agagatacggggctgcggtctccagggagatggcagccatatggagttgggaatggggtgagggtaaaaagcaaaagaattgtcttctctctgccaactcmtttgtttgccatttcttctgcagtggaatggtgcccagcaaaagcagggagtctgtggcatctgaaggctcaaaccagacaagcggctaccagtccggat

SEQ ID NO: 51962 - DNA, 201 bp, Homo sapiens; identical to SEQ ID NO: 15023

SEQ ID NO: 51963 - DNA, 201 bp, Homo sapiens
aactaaatgtggggattgacttcaactgggaatacccttcttcgaaggtaacgctaatgattcaaagccagacctccaaatacttagataataagccccartgaagtttgcttgagagataggggcctctttggccagataaaatgtaagagccttaaacacacacacatacacacccactcacacacacatacacacaca

SEQ ID NO: 51964 - DNA, 201 bp, Homo sapiens
atgtctcatttaagaagatagtgtctcctctgaatgcaaaccagaacctgcaggcccgtggtaatagccccctttagaagtcttggaggaaatgatgcgtytttgatggccgcaagaccagaatttggcagagtctcaatgaaatcagtctaccacattccctcccacacagcacttagaagtgccttaggttcacaaaaa

SEQ ID NO: 51965 - DNA, 201 bp, Homo sapiens
aatatatttcatggaggtttaattggcactagaattaaattattgtaaaactttctctgaattaagaaatgtcatgctactatgatacagtttgttacttrtgtaacagatgtccagagaagagtaaacttccctaaaacttgaaagcttaagggtagttacccccaaaatggaatcatatcaggagattgcactgaaaag

SEQ ID NO: 51966 - DNA, 201 bp, Homo sapiens
atatatttcatggaggtttaattggcactagaattaaattattgtaaaactttctctgaattaagaaatgtcatgctactatgatacagtttgttacttgwgtaacagatgtccagagaagagtaaacttccctaaaacttgaaagcttaagggtagttacccccaaaatggaatcatatcaggagattgcactgaaaagc

SEQ ID NO: 51967 - DNA, 201 bp, Homo sapiens
cctgaaattgatgtcctccttgtctgctttttagtagtttcaattatctccatggtttactacattttaaaggttgtaaacttttaaagactcattttgtrttcaaggagtttgtttgttcctttgcttttttatagaccaaaggggcacgattccgtcaagggaaagactacgttggagcaatccctgtggatctgaaac

SEQ ID NO: 51968 - DNA, 201 bp, Homo sapiens
ttgtaaacttttaaagactcattttgtgttcaaggagtttgtttgttcctttgcttttttatagaccaaaggggcacgattccgtcaagggaaagactacrttggagcaatccctgtggatctgaaacggcgcttggacagcatcaccagtagccagagctcagccagctctggatttgtggaggagaagtccctcagtga

SEQ ID NO: 51969 - DNA, 201 bp, Homo sapiens
tcctatttgttcatactctcttatttgcccagcaaggtcaatgccagtttaggcctagggagtcattttttcttagttgatatgacttagaaagcttgggwgcctgcccaacatcaattacttttttaaagctggtattttctaggtcttgatatttattaagaccctagcatagtggacaatttttctttctctcatgct

SEQ ID NO: 51970 - DNA, 201 bp, Homo sapiens
tgggtatttacttatactctctctatttattccgtctcatacttcgtcctatttgttcatactctcttatttgcccagcaaggtcaatgccagtttaggcytagggagtcattttttcttagttgatatgacttagaaagcttgggtgcctgcccaacatcaattacttttttaaagctggtattttctaggtcttgatat

SEQ ID NO: 51971 - DNA, 201 bp, Homo sapiens
gagtgcaatggtgcgatctcggctcactgaaaccttcgccttttgggttcaagtgattcttgtgcctcagccttccgagtagctgggattacaggtgcctkccaccatgcccagctaattttttttttttttgtatttttagtaaagatggggtttcaccatgttggccaggctggtctcgaactcctgatctcaggtgat

SEQ ID NO: 51972 - DNA, 201 bp, Homo sapiens
aacaaaaaactatgttggtctacaaatatgaatttgaagttattgagagccttgttgaatagatttttgttgtaaacgtgtctctagaatagtatggcatwgtctcagcttcctatgaatgaaggacataccttttcttttttaaaatatttgttacacaggaaagtgtgtctagaatgtgatctgtggcaataaattatg

SEQ ID NO: 51973 - DNA, 201 bp, Homo sapiens
tcggctcactgaaaccttcgccttttgggttcaagtgattcttgtgcctcagccttccgagtagctgggattacaggtgccttccaccatgcccagctaattttttttttttttgtatttttagtaaagatggggtttcaccatgttggccaggctggtctcgaactcctgatctcaggtgatccgcctgcctcagcctcc

SEQ ID NO: 51974 - DNA, 201 bp, Homo sapiens
tagagttcttgatatgaaactattgtttatccctctgggtacatgacaaaaaacagtgtaagtggcaaatttggaaatgtcctctttatttcccagattayctaggtcagtgttaccttattctacctcctggatttactggttcaatttggctaaaatggaaaaaccagtattgttcctaagggggtatgatgaaggcta

SEQ ID NO: 51975 - DNA, 201 bp, Homo sapiens
tagtgagcacttactttattagctcatctcatctttgaagctgagattggaactcaagttcctgactacaaagctatgctcttgacctctaggtcacgtgrcatccctagcaagaacttgaaaatttcttctgaatgaacaaaatagaaatcactaagtgtcctaaatttatttaaattatttcacttgccaagatgcact

SEQ ID NO: 51976 - DNA, 201 bp, Homo sapiens
acgtggcatccctagcaagaacttgaaaatttcttctgaatgaacaaaatagaaatcactaagtgtcctaaatttatttaaattatttcacttgccaagawgcacttgtcaaaatacacagagagagatgtgctctggcttatgtttttatagaattacttttgttctccagaatacttcagggaaataggggcagaaata

SEQ ID NO: 51977 - DNA, 201 bp, Homo sapiens
ttcagaggagagtgccatacagatttgaggtgtgggaaggtcagcaatgcctggcttacatgatcacttctccaatgatttaagaattctccttttggccrggtgtgttggctcatgcctgtaattccagcactttgggaggccaaggtgtgtggatcacctgaggtcaggagtttgagaccagcctggccaccatggtga

SEQ ID NO: 51978 - DNA, 201 bp, Homo sapiens
tgaccttttttttttttttattttcttccagaaaaaccttttgttgcttttggaagtggcatggaatctctggtggaagccacggtgggggagcgtgtcaraatccctgcgaagtaccttggttacccacccccagaaataaaatggtaactactggaaataaatgcaaagcatcatttcgtgtgagagcaaatcctttga

SEQ ID NO: 51979 - DNA, 201 bp, Homo sapiens
tttccttactcttgactctaattaaagaaaaattaaatcataatatgcgctgttatctctttcttatagccaagctgtctcagtgacaaacccataccctygtgaagaatggagaagtgtggaggacttccagggaggaaataaaattgaagttaataaaaatcaatttgctctaattgaaggaaaaaacaaagtgagttt

SEQ ID NO: 51980 - DNA, 201 bp, Homo sapiens
ttcttttgtgatgggattaccagctagtatcactaatatgaatgttaaaagccattaatctgtttgcagtgtcctgactgacttgtttcatttaactttayccagtgaccagtgtattttcccagaagttaatatatcaacaagttcctttttactaaatttaaactgtttaaaactttgctgataccagaaccatttcaa

SEQ ID NO: 51981 - DNA, 201 bp, Homo sapiens
gagaattttttttcataggtataaaaatggaataccccttgagtccaatcacacaattaaagcggggcatgtactgacgattatggaagtgagtgaaagaracacaggaaattacactgtcatccttaccaatcccatttcaaaggagaagcagagccatgtggtctctctggttgtgtatggtgagtccattcaattttc

SEQ ID NO: 51982 - DNA, 201 bp, Homo sapiens
attcttgaacacttattatccctttccaaaaactttgctttataagaaatttattactataattacttaggcagtaatatttaatagcaatttaatatttrgtgggtaatattactgagcgcatgatctacataaataatggacttcgggccctgccttgatattctggaatgcatctttccccacttgctagcaagaagt

SEQ ID NO: 51983 - DNA, 201 bp, Homo sapiens
ctagtaggcacggcggtgattgccatgttcttctggctacttcttgtcatcatcctacggaccgttaagcgggtaaaaaaataatttcccttctgcccatrcacattggttttcatgattaatgaaaactgactggggttctttgagttgtttcttcccattgttattggctcaatgggcacatttttatttcaatacaat

SEQ ID NO: 51984 - DNA, 201 bp, Homo sapiens
aagaacagaataaccaaagtctgaatcttttccttactcttgactctaattaaagaaaaattaaatcataatatgcgctgttatctctttcttatagccawgctgtctcagtgacaaacccatacccttgtgaagaatggagaagtgtggaggacttccagggaggaaataaaattgaagttaataaaaatcaatttgctc

SEQ ID NO: 51985 - DNA, 201 bp, Homo sapiens
gtagcccacgctgctgccacagcattgcctttaagaattccaagccctgcagctgcaatagctggaatgccacagtttgctaatttccagaataaagagaygagttttacaaagacatctgcatttaaattatccccgtgtatgcttttattaatgtgaattaaatggcttaggagagattcagaaaggaagagttctgtg

SEQ ID NO: 51986 - DNA, 201 bp, Homo sapiens
actttcctactgcctgaactgtctcatggctaccatgccatcctctcagccattgaataatctactgtattcttctacatctgagtaataatgcttttctraaagctgtaattacccttttagacagataggattctaatttataacccgggagcagaccactctgatttctacctacttatctttttgttatattttcaa

SEQ ID NO: 51987 - DNA, 201 bp, Homo sapiens
agatgttgctttaaatgttttctatacacattgagcctctggagtatgggactctgtgtcttacacagttttgtatccttatttagcatctcacctcgtcrgctctttacaaatgtgtactcatttaagtgcttattttcagcattcaggaagaaagaggcatttaatgaaatcagtgttttgcttctctaggtaccagac

SEQ ID NO: 51988 - DNA, 201 bp, Homo sapiens
ttcttagaaatagcctcacagtctggcacttcatattaatacctccctgaaattaatttttcaggggacagagggacttggactggctttggcccaataawcagagtggcagtgagcaaagggtggaggtgactgagtgcagcgatggcctcttctgtaagacactcacaattccaaaagtgatcggaaatgacactggag

SEQ ID NO: 51989 - DNA, 201 bp, Homo sapiens
agaaaagtaggccaaacaaaggctgagatggggacgtgacaagttacaactattccaaaggttgtaaacaccaagcggggagcaaggctggtggcagtgaytcccctggaaaggataaaaggtgtaattttatattaggtaacaatacttcaaattaaggatcaggaagaactatcagttgacagaatgtattcatgcagc

SEQ ID NO: 51990 - DNA, 201 bp, Homo sapiens
tttgagatctgtgaaggtagtgctttgtaaacctctgttggccattttcctgggagctaccaagtattggtgaggcctgcagggaaaaacaatgtggcatrttttaaagttgcattactttaaaaaataaatctgtgcaaagttataggcttatttgctctctcatgttctgttttttcaatttacttgctctagggtata

SEQ ID NO: 51991 - DNA, 201 bp, Homo sapiens
tcaccacgtgaggttttaaaaatcctaattcagttggttccatttatttctcctgaaacaaaatatatttgttgtctgcatgaggttaaaagttctggtgyccctgtttttagcattaaataatgtttaccaaagcccagatttaattctgtgtgttactagaagttattgggtaatgttatatgctgtgctttggaagtt

SEQ ID NO: 51992 - DNA, 201 bp, Homo sapiens
acatctattttagactgcagtataaagaataccctagccccttaccaatacccagcccttgggaaaaaacacagtagcaggtgctgtttctctagctttayttgtttaagacacatttcccattagattttccttttaccgaccctcgataacaaggttatttgaaatccccaaggatcccatgctccctttttaaaactc

SEQ ID NO: 51993 - DNA, 201 bp, Homo sapiens
gtccctcagtgatgtagaagaagaggaaggtactggctagtgcttcctgcatgctatggcatgctcttgtcagagcagacagggtgatagggtgttacaargaatttgatcatgggaaaagtccaatactacctcataatttgaaagagacctgaatttctataatagactgcctccattctgtctccccaaaagtgaagt

SEQ ID NO: 51994 - DNA, 201 bp, Homo sapiens
agctttcatatcattgagtgttagtgttaatgaagacctaattttaaaattctgttagaattagagattttgctttggatttttaatatattaaacattgygtagagctcatagtggagatgtggtaaatatctgaggaattcgtttacattttcaagtaatgtgtttggccaaataagatattttgggacctgaattgtc

SEQ ID NO: 51995 - DNA, 201 bp, Homo sapiens
atatgaaactattgtttatccctctgggtacatgacaaaaaacagtgtaagtggcaaatttggaaatgtcctctttatttcccagattatctaggtcagtrttaccttattctacctcctggatttactggttcaatttggctaaaatggaaaaaccagtattgttcctaagggggtatgatgaaggctaatgatactggg

SEQ ID NO: 51996 - DNA, 201 bp, Homo sapiens
ccccttctcatagcattaaaggcctcaggctctttgatgtttctgctaggtagctcttatgttctctctcccaaggggaaggaggagaactgggaccttayagggttttcccaaagagaaaggccctttacacttcttggagattatgacttattattaccatttttttatggccggaattcgccacttagtcagggttcc

SEQ ID NO: 51997 - DNA, 201 bp, Homo sapiens
gttcagaggagagtgccatacagatttgaggtgtgggaaggtcagcaatgcctggcttacatgatcacttctccaatgatttaagaattctccttttggcygggtgtgttggctcatgcctgtaattccagcactttgggaggccaaggtgtgtggatcacctgaggtcaggagtttgagaccagcctggccaccatggtg

SEQ ID NO: 51998 - DNA, 201 bp, Homo sapiens
gccgagtagtaggaagttagctgaagtttggaggatacagagaaaggagaaactgagaagctaaaaggaagagaaagaagtcaagatgaatctcattgtaytattaatgcactagaaaatcaacctgacttgtgataggctgaaattgccttaatagacctttataataacccagcactttgaaatcaggggaagccacat

SEQ ID NO: 51999 - DNA, 201 bp, Homo sapiens
ttccttcccgtctttgagctggaagggtaacagtgcacaaattaattaatattggttatgggatttgaacatagaagggctttttattgagtagtagcatrtgtacctcttacagttatttctttagaactttctgaagagtccagctcaagcttgccaatgaaaacgaatgacatttaatggagcaaaaacaaaaaacaa

SEQ ID NO: 52000 - DNA, 201 bp, Homo sapiens
agtgagctgcttaaaatcacatccttgagatgaatccagttcctctgacccctaagtccatgttgtttcctcccatgccaaggagggccctcagagagaawcagtaatgagatgagactacaattccactcctgtgtttacacatttccagttcaagttgagctggccttttagtgtgacagttgttcccacacaccatta

SEQ ID NO: 52001 - DNA, 201 bp, Homo sapiens
ctgatatccagatttccaccctttgcagggtgagaaaggggaaagggtcagagaaagaaaaaaaaaaagtcgaataattcagggaaaaaaatttcttactycctaagacaagaatcacatgtcttagaagacactcacacccacatacagtaccaggatcatctgtccatggttactgaattttctttataatgacttggt

SEQ ID NO: 52002 - DNA, 201 bp, Homo sapiens
tacaattccactcctgtgtttacacatttccagttcaagttgagctggccttttagtgtgacagttgttcccacacaccattattgcctccccctttatcrgaaagccatttgatcatgaactacattccatgtgttttctgtgaccaagtagagtgatgatccgagtcggcagcctcctggctcaccgggtgctttgcat

SEQ ID NO: 52003 - DNA, 201 bp, Homo sapiens
tttctatgccttggtttcctcatctgaagagttgggatagtaatactcacccctagagaggtaccgtggtgaacacatcatgagatgctgcttagacagcwtctggcacagtgtcaggcttgcggcagattatcagtgagggcttcctgaacaagtgaatgcaggaatgattgactacggtaccagtagtgtttgacaact

SEQ ID NO: 52004 - DNA, 201 bp, Homo sapiens
tttttttcagcatcagcataagaaacttgtaaaccgagacctaaaaacccagtctgggagtgagatgaagaaatttttgagcaccttaactatagatggtrtaacccggagtgaccaaggattgtacacctgtgcagcatccagtgggctgatgaccaagaagaacagcacatttgtcagggtccatggtaagctatggtc

SEQ ID NO: 52005 - DNA, 201 bp, Homo sapiens
tggatgtagagatgggtgacaggctggctccccttgaggcataagtctagaagaatagtggaagaaacccactctgtttcccttgacatgaggctacagaragaatttgcatttaactccttttccttagaagctgagaaggtagtgtgaggctgggacttggtctagaagcacatggggaggtggtctaggcttcattta

SEQ ID NO: 52006 - DNA, 201 bp, Homo sapiens
aaacaattccctatcagccttatttacagttcatgacacttcctcttccatgtctcatttaagaagatagtgtctcctctgaatgcaaaccagaacctgcwggcccgtggtaatagccccctttagaagtcttggaggaaatgatgcgtctttgatggccgcaagaccagaatttggcagagtctcaatgaaatcagtcta

SEQ ID NO: 52007 - DNA, 201 bp, Homo sapiens
gaccagctgatttctacactcctgtcccaatgaaaggttgtagccttcttctaaggtgtttttgggttcatcactatattaaacgcttagtgaggaatatragtgaaaacccattttccttcctggacatgctgcctgcagggccactcatggtgattgtggaattctgcaaatttggaaacctgtccacttacctgagga

SEQ ID NO: 52008 - DNA, 201 bp, Homo sapiens
tagacgaggaaggctttactaagaacttgacatttgagcaatgacctggaaaggggaggggctgagccttacagatatcttggcatgagaatcatttttartttattttacattcatcaacatccatcaaaaagtatttgttaggagtataattagaaacgaggaaggacaggcttcagatgagagcgattaaaagagcta

SEQ ID NO: 52009 - DNA, 201 bp, Homo sapiens
caatataaggggattgggaccagctgatttctacactcctgtcccaatgaaaggttgtagccttcttctaaggtgtttttgggttcatcactatattaaaygcttagtgaggaatatgagtgaaaacccattttccttcctggacatgctgcctgcagggccactcatggtgattgtggaattctgcaaatttggaaacct

SEQ ID NO: 52010 - DNA, 201 bp, Homo sapiens
gaagaagaggaaggtactggctagtgcttcctgcatgctatggcatgctcttgtcagagcagacagggtgatagggtgttacaaggaatttgatcatgggraaagtccaatactacctcataatttgaaagagacctgaatttctataatagactgcctccattctgtctccccaaaagtgaagtgtggaagccctagact

SEQ ID NO: 52011 - DNA, 201 bp, Homo sapiens
ttcaaaaaatgtttattcggcaagtatcatgtgcagagcaccatgccattgcttgagacacctacattagttttgttggggttgaattgaaagaaaaaatkgtatttctcattatttgaagtaacttttaaactatgtataaacacgagttactaaaattcccttttgcagttttaacatgaagaagttggggaaaacacc

SEQ ID NO: 52012 - DNA, 201 bp, Homo sapiens
tctttttgtccttccatccagactccaaagaggaagacaaaagttgtcttttcctctcctgtacttcatgtctatcaggcaaaacttctcggaagctttgaaaaaaaaaatagatacataggtgatgaggatgtgcaagattcaggctcagggttttctataagagaaaatcaaatcaaagaatgtctcctccctgtttta

SEQ ID NO: 52013 - DNA, 201 bp, Homo sapiens; identical to SEQ ID NO: 15050

SEQ ID NO: 52014 - DNA, 201 bp, Homo sapiens; identical to SEQ ID NO: 15026

SEQ ID NO: 52015 - DNA, 201 bp, Homo sapiens
gttttagatcaacacagcctgcatttctaggctttgacatgattaccgtctgtcaggattccatgccattgaaaacattttctagttgctgctgagtgacwggggttctcagtccttccaaggaatgtggttttgatgagtaaaaagcagcgtttgatatgtctggcttgactgcacacatgcttcaagttattaaagttt

SEQ ID NO: 52016 - DNA, 201 bp, Homo sapiens
acacatgccccgtaattcccaaattgccacaataggaaaagcacaagtgaaatttaagaacatcccaatttccttgaatatcatgcaagtggccctttggygcctgtcactgtatacaaatttgtcaatctgcgaggccataaacatgttccatcagttggggcctttgcataactcgagagaactgcctttcatctcatt

SEQ ID NO: 52017 - DNA, 201 bp, Homo sapiens
gcaagaagtcatgctattgatttttgataactggagaagtagacttctttgtcaagaagaagaggcctttaaattttgcctttcaacccttaccccaggaygaaagatagaagacccttgggtttaacatagtgatcacacacgaaaggcatggagccttcttaggacctgtgtgtttttggtagagactgtgacaagtgg

SEQ ID NO: 52018 - DNA, 201 bp, Homo sapiens
ctcattgattctggagcttgggccgtgttacctcttttttgcccagttagtttgggtctgatctttgtttccaaggtaaatctgtgttcactgttggccaytgagacttataaaaagtcttcctatgtttgagaagaaaacctaaaattcttgaaatcgaggaagatttgggggtgaattatggagaaatttctgtggaga

SEQ ID NO: 52019 - DNA, 201 bp, Homo sapiens
tgaactggaattaaattgaactggccttgagaaaatcaccttaattttttgtttattctctttcatttacataaatgtctgagtttacatggtaatttgtrtggcatcctacttataagccttggaaaggattttggagtttatattatgagaatgcatcaatacagtgaaattttaaaaataccttagataatgctattt

SEQ ID NO: 52020 - DNA, 201 bp, Homo sapiens
ggttaatttagcttccaaaggcttgctctgtaagcaagttatgtaatatttcataacatgtggatgaaaggtaggcaatattaagaagtggcaatccctagcactgtttattggtacactgcctgtctttgggtataccattaaattctgcttcctgtctaagcttaaagttctaggagttgggctgtccaagattttggc

SEQ ID NO: 52021 - DNA, 201 bp, Homo sapiens
cctaaatttatttaaattatttcacttgccaagatgcacttgtcaaaatacacagagagagatgtgctctggcttatgtttttatagaattacttttgttytccagaatacttcagggaaataggggcagaaataaggaggtcagttgggaggctaattgcagttatccaagtgagagttgaggggtggcttagacaaggg

SEQ ID NO: 52022 - DNA, 201 bp, Homo sapiens
cacgtctctttaccagttataaaagacaataggctcaaagaagaattgagtacaacaaagggcttgctctaaaggctgtttgccaagaggaatacacacarttcttctctcctgaggctttctctgagaaataagactcattgattctggagcttgggccgtgttacctcttttttgcccagttagtttgggtctgatctt

SEQ ID NO: 52023 - DNA, 201 bp, Homo sapiens
gtcaaaatacacagagagagatgtgctctggcttatgtttttatagaattacttttgttctccagaatacttcagggaaataggggcagaaataaggaggwcagttgggaggctaattgcagttatccaagtgagagttgaggggtggcttagacaagggtagttgaggtggaggtagtgagaggtgatctgcttctggat

SEQ ID NO: 52024 - DNA, 201 bp, Homo sapiens
gaggcctgcagggaaaaacaatgtggcatgttttaaagttgcattactttaaaaaataaatctgtgcaaagttataggcttatttgctctctcatgttctrttttttcaatttacttgctctagggtataggatttatgatgtggttctgagtccgtctcatggaattgaactatctgttggagaaaagcttgtcttaaat

SEQ ID NO: 52025 - DNA, 201 bp, Homo sapiens
tgtgctttccagctgggaaggaaatcaaacttctgctgttgcagggaattagctgcctttgtcccctgtggtttaattaactctttcttcactttgactgrctattatgaagcactctgagaatgcttgatgagatgtgttgggcatagcaatgtgaaatgttatctctctgagatttcaagcatgactccacaccacatc

SEQ ID NO: 52026 - DNA, 201 bp, Homo sapiens
gtgaggattaagtgaatgaattcatgcaaagcacttcaaacaatgcttggcacataataaatgtatttactgtgctatttcagctgttttctgtagccttyccctgatctcctaaacttgagaggacagagagaactatctctgtaatacagatgagaggcacaggatttcaacacttccataaagtcattcagcttgtta

SEQ ID NO: 52027 - DNA, 201 bp, Homo sapiens
gcatgactccacaccacatcatctctatctctgaggaatggactaggtttccagcagcatgttaacattgtatgagtaatgtttgattggccttgaaatctttttttttttttttttttgagacggagttttgctcttgttgcccaggctaaagtgcagtggtgctatctcagctcactgcaacttctgccccccggttca

SEQ ID NO: 52028 - DNA, 201 bp, Homo sapiens
ggaaaatgagaagaattttctctcaaaaattctgtacaattttgctggtgtttttatactattctctgccaacatgcatacacacacacacacacacacaygcacacaaatacacacacacacccacattccaataaccagtacagccacctggcgtatagtagacatacgctcaataaatatgaatgaataaatgaagtt

SEQ ID NO: 52029 - DNA, 201 bp, Homo sapiens
ttaattaatggaaaactcaggaatctttataagtgacttctgaagctgagtttataacttttcatcatatgtcaatctgacttgttggtagaagactttgtttttttttttttgaggcagggttgccctcttgcccaggctgaagtgcagtggtgtgattttggctcactgcaacctccacctcccgggttcaagcaattc

SEQ ID NO: 52030 - DNA, 201 bp, Homo sapiens
ctgctgttgcagggaattagctgcctttgtcccctgtggtttaattaactctttcttcactttgactgactattatgaagcactctgagaatgcttgatgrgatgtgttgggcatagcaatgtgaaatgttatctctctgagatttcaagcatgactccacaccacatcatctctatctctgaggaatggactaggtttcc

SEQ ID NO: 52031 - DNA, 201 bp, Homo sapiens
catgactccacaccacatcatctctatctctgaggaatggactaggtttccagcagcatgttaacattgtatgagtaatgtttgattggccttgaaatctttttttttttttttttttgagacggagttttgctcttgttgcccaggctaaagtgcagtggtgctatctcagctcactgcaacttctgccccccggttcaa

SEQ ID NO: 52032 - DNA, 201 bp, Homo sapiens
caggaaatcttggaactgcagctactcagaccctcaaggtctttgacgtttcacttgaaatgaaaaactaaatcaaatgaccatttacagtaagttgaccttttttttttttttattttcttccagaaaaaccttttgttgcttttggaagtggcatggaatctctggtggaagccacggtgggggagcgtgtcagaatcc

SEQ ID NO: 52033 - DNA, 201 bp, Homo sapiens
ttttaaattttcattttattgcaaggctgagaggcctacttgaataagcatgagctttgcaaactggggaaacatttagcaatatacagttgacctgtgarcaactcagggattgggggaactcaggggagttcccctaactttccctcctctgcagtcaaaaatccatgtataggccgggcgcggtggctcacgcctgta

SEQ ID NO: 52034 - DNA, 201 bp, Homo sapiens
catgcgccaccacacctggctcatttttgtatttttagtagagacagggttttaccatgttgcccagcctggtctcgaactcctggcctcaggtgatccayccgcctcggcctcccaaagtgctgggattataggcatgagccaccatgcctggccggtagaagactgactgtgtctgttgaagagtttatttaagtttca

SEQ ID NO: 52035 - DNA, 201 bp, Homo sapiens
cctctctgcccaagatttattatgatacattgtcttccaaatcagccaaaccaccgttcctctgcctcctgctgcttcactcatatcatggctgggcctgygtacaaaagtcatctggcgtggtgaagctgaagtgaaacgtaggaccatgtgctctggccatgtttgtttaagaggccgtgtaaatgagctttgtggtgg

SEQ ID NO: 52036 - DNA, 201 bp, Homo sapiens
aagttatactaccatgttcccctctcatggaattgcccacctggtacacagatgtgtaagacccttctccttagattttgtgcaaagcttctagtttgatrttgtagttgatgtatcagagatgtgcaggcacgttccaactctgaaggcttttgaagttgacactgttggcttggttgggagcttttcttttttcctttt

SEQ ID NO: 52037 - DNA, 201 bp, Homo sapiens
ttttataagaattgccaaataaatgtaaggcattattggttgaatgatactaaaatttggcacttccaagagaaatttgaagggattctagggtattattkactagaatcttcatgggagggaagttttcacctggggaggctgtgtctaattagaggaaaaatccataaaggtgaccctgaacctttcttttgtgatggg

SEQ ID NO: 52038 - DNA, 201 bp, Homo sapiens
gggctccacaaatgtgcagaaataccctaagaaagtaaaccctagatccaatgattcactggtcagaatgtcttttttagcaatagtcattgaaatgataygaaatttcttcagaatgatcaaccaatatttattgagcatcttctcagtagtaagcccttaacattctttcagatttcctaaattttgaaggggcttgtt

SEQ ID NO: 52039 - DNA, 201 bp, Homo sapiens
ttgtgggttcctcatactggagtgagccttggcaaaaatggtgtgtgtgtgtgtgtgtgtgtgtgagagagagagagagagagagagagagaggagacagragagaaggagaagaggggagaggggaggagggacagagagagagagaggtctcctacagagagcttggagctcaggctgctttgctcatttgagtgtaat

SEQ ID NO: 52040 - DNA, 201 bp, Homo sapiens
ctctgttgttattctccatttgttcattatatctatcttttctttgaaatccttgaaaatatttataatagctattttaaagtcctctgctaatcccgatrtctgggacatcttggcttctgttgatattgaatacttctttttttccccttaattaagggtttccttttcctgctttttcacatatctagtagattttta

SEQ ID NO: 52041 - DNA, 201 bp, Homo sapiens
ctgttacagatcctcagacaatgcttccttgaagaagacttgcctgtctaaactgccttcccatcccaatccctgttaccttctatcctttctctgctttrttttcatttgttatctctcttcttcccaagaatgtaagctccataagaacaggatcatattttgaatcccctagaaaagtgcctagtgtaatatttgttg

SEQ ID NO: 52042 - DNA, 201 bp, Homo sapiens
ccttgacctcccaggcttaggtgatcctcatacctcagcctcccgagcaactaggactacaggcccgtgccaccatgccgggccaagacggggtttggacrtgttgccccagctggtctccaactcctggcctcaagtgaccctcccgcctcggcctctcaaagtgctgggattataggcatgagccaccgcacctggcca

SEQ ID NO: 52043 - DNA, 201 bp, Homo sapiens
tttagcaatagtcattgaaatgatatgaaatttcttcagaatgatcaaccaatatttattgagcatcttctcagtagtaagcccttaacattctttcagayttcctaaattttgaaggggcttgttttccagcatttgactggatactctagtaagcacttattggatgtctagtgtgtccgaagccttgtgttagttgct

SEQ ID NO: 52044 - DNA, 201 bp, Homo sapiens
tcctgccccaaatcacaaaggtggagcctagaccttctcagtctccaccaactgtatttcggttagccacaatcctatctacccacatccaaatggacacygtggctctgcaacttctgtcaaaagggctctttggcaacaggaaaaacgtcatggctccattgtattgtagaggatgggaatgggtgttccggctaaatt

SEQ ID NO: 52045 - DNA, 201 bp, Homo sapiens
actgtggggtgacctacctttgaaataatgtattggttctagctgatttttatattgttagtcattaagttaggcttgatgagaaacagatataatctgakttggggattcaagtattatattgcatttctcctcacaactagagataaatttgccatggtttttctcttcataggctcatgccaaagtctggcatctcta

SEQ ID NO: 52046 - DNA, 201 bp, Homo sapiens
agcagtaagtgaggctcacaccggtcatagttagaggagtagggaatctaaacctaagtctcttctactccaaaccccaagttttatcagtatgtcacatygctactgtgggctgaattccttagcaggggttgtttcctccacctgcaatattcttccttttggtttgttcatcctctagagagagaagggatacgcatt

SEQ ID NO: 52047 - DNA, 201 bp, Homo sapiens
agaagtgagaacatgcagtgttcggttttctgtgaaacagaccttttaggtgcagatgactacaatttaaaatttttaaaacagacttcaaagtctaaatkaccatactttttaaaattggaaataactttaatataaaaaatcatgaaaaaaagtcaaaattatctgctttttttttcttatttttaacatgttggaaga

SEQ ID NO: 52048 - DNA, 201 bp, Homo sapiens
atgagattgaaccaacttttatcccaaattggtaccatgttaaatgtccttattttacctgtgcctgttatgggcctaacaatccaccaaaacaaacacartgtggggttactacgaccatcatgttgacaggatgagctgcaagattccagcagtgttggcaacatggctgcactggttcactcagacagagaggaagga

SEQ ID NO: 52049 - DNA, 201 bp, Homo sapiens
gatttcttagagacggtgccatgcctgggatgaccaccaagttaggatgctgtaaagagtaatcaaataagtttcaacagggttttggcatgaggtgagcmgttaatccaaatgatatctgaaatgctttctaatgctgcaagtgtattcctctgtaaaataatcaactacttaaaagacactctcacttgcattatgtca

SEQ ID NO: 52050 - DNA, 201 bp, Homo sapiens
tttcaatgtttggctattaaaaatagtatttagatgaatgttcttggccatacagttaatgacttcactgagtccttgtcaataactttattaaatcccawtcttaagacaacaagcctataagattaacataccaggaataattagaaagcattgcaagactatatgtaaccatctccctgttaatcatccttagttgtt

SEQ ID NO: 52051 - DNA, 201 bp, Homo sapiens
tacatggtaaacatatttgaatattagacatttcaattgttttcaatgtttggctattaaaaatagtatttagatgaatgttcttggccatacagttaatracttcactgagtccttgtcaataactttattaaatcccattcttaagacaacaagcctataagattaacataccaggaataattagaaagcattgcaaga

SEQ ID NO: 52052 - DNA, 201 bp, Homo sapiens
  misc_feature (1)...(201): n = A,T,C or G, or insertion/deletion polymorphism (see Tables 1-2)
taaggtcttggatagaggaccatcatagaaacacatagaacagacatttagtccatgctagggagagggaagatgtcaaggaatgcttcctggaggtggcnacatctaagctgagttttaaagtgggtgtaagagtgaaggaactgggaataggtaaaacataccttagagagctgcacctccaaagcatggaaggctaga

SEQ ID NO: 52053 - DNA, 201 bp, Homo sapiens
aatgatatacagaaaaggtcagttaccactttcttttatgattgcattaatttgcttcttttctctttttttctctagtcagtcttgctaaaggttggtckgttttgttgatttttttcaaagaaccaacttttgattttgttgattctataatttttctgctctgtattttgtgtatatccattctaatttttattagtt

SEQ ID NO: 52054 - DNA, 201 bp, Homo sapiens
tattttttgaagagcttgaaaagagtcgtgttaattcttctttaaatatttggtacaattcactattaaagccactagtcctgggcttttcttagtttgawagtttttgattactaattcaatctcttttacacctagattagattttgtattttttccttagccacttttggtaatgtgtgtgcttccgggaatttggcc

SEQ ID NO: 52055 - DNA, 201 bp, Homo sapiens
ccaagctgctgcctgttcacacatattcgtctaactgggtgtcagggaaagcagatatgagcccccttgcattggttaaatcctgagcaacttttaaggawctgcacacagagactactggctattttttgtggataaagttgtagatagttatttttgggaaattatttatgtgttctattaggtggttgttttgtggga

SEQ ID NO: 52056 - DNA, 201 bp, Homo sapiens
gtcaggctggtctcaaactcctgatctcatgatctgcccgccttggccccgcaaagtgccgggattacaggcgtgagccactgcgcctggcctctctctcrgactttctaccatcagtcagattgaatttgttaaattctgtcactgaccctaaacccaacaaaaggcaagagttatgtttatttagcacttcctctacct

SEQ ID NO: 52057 - DNA, 201 bp, Homo sapiens; identical to SEQ ID NO: 15070

SEQ ID NO: 52058 - DNA, 201 bp, Homo sapiens
ttgctttgaattacttcctcaggactgcccaggtgacgctaatgtttactctgcccttcacaggtagataccactctgtctcagtttaccgacctgaatgyttacctgtgggatgtccaccacagtaaaaggcttattaaagtggatggggttgtgaccaagaagaggaaatcctactgtgttgactttgctgccatccag

SEQ ID NO: 52059 - DNA, 201 bp, Homo sapiens; identical to SEQ ID NO: 15055

SEQ ID NO: 52060 - DNA, 201 bp, Homo sapiens
ttgaccctaagaatgtcacaaaaatgtttagcaactgtcaagattattacatacagagatgactattgtgttctcagatatgctgtatgtcttagttcatyttgtacagctataagagtagctgagactaggttatttatttatttatttatttattttttgagacggagtcttgctgtgttgcccaggctggagtgcagt

SEQ ID NO: 52061 - DNA, 201 bp, Homo sapiens
tctttttgaccctaagaatgtcacaaaaatgtttagcaactgtcaagattattacatacagagatgactattgtgttctcagatatgctgtatgtcttagytcatcttgtacagctataagagtagctgagactaggttatttatttatttatttatttattttttgagacggagtcttgctgtgttgcccaggctggagt

SEQ ID NO: 52062 - DNA, 201 bp, Homo sapiens
ttgctttccagaaagtgaatgagctggttccccaacccctcttgtgttagtttgagtcctgaaagaagtaaatgtcaagataggattagatgtacaagaamtttattggggaaagaattgtgaaggataaaggggaaggagctaggggaggcattgaacctttggatcatgatgtgtgtccaacaactatgaaggagagtg

SEQ ID NO: 52063 - DNA, 201 bp, Homo sapiens
tcagatttttgtaaaatgcttttcctgtgttaattgagataatcatatgggttttctccccctttactctattgatgtaatgcattacaacgatttttttwaatgtttacccatctttgcattcctggaataaatactagttgattgtgctgtataattcttaaaatatgctgctggatttgttttgttagtatttggttg

SEQ ID NO: 52064 - DNA, 201 bp, Homo sapiens
caattctccaaattgggggcggtctatttcacagcaataggtaactgacgtaaaaggaaaggaaacaatgaagtaattccagaaaatttcctatagctggwggacatgcattttcatattgaatgggaagaatggggtgggggggtcatacctctgtgttattgcagggtcctggctcctagggacctaggcacctcttca

SEQ ID NO: 52065 - DNA, 201 bp, Homo sapiens
aaaaataggtagtgggccctgctgctgggcttggcttgctgggcacacaaagtgagaagggcattgtgcctttctaggaaacatcccttgcaaagtcagtrcaggtgagacagtgtggccattcccaccacagcatgaggtcttttgaatggctgaagcgtcaggtgggaaaggatgaggagctgaagaagaaagcctggg

SEQ ID NO: 52066 - DNA, 201 bp, Homo sapiens
atgagaaactgacctggctgtagcaaaacagctaggctgggaagtgatgctgtttacatttatatgcgattctactggtcttcctgttactttgtagaagrctgtaaggcttggtgctcagagctagaaatgcaacttatttgatttgctaagaagtccaaagcaggtaggggtgccaagctgctgcctgttcacacatat

SEQ ID NO: 52067 - DNA, 201 bp, Homo sapiens
attacagtaaaatgtataaatgccttaagagaaataagtacttgcttaggaacctatttcaagaaaggagagataggttagcgttttggggaggtagtacrggagcagtcagggaaagcaatacttgtaagatcagaggctggcaatctttttctgtagagggctaagttttggactttgcagatcctacagtgtctgttg

SEQ ID NO: 52068 - DNA, 201 bp, Homo sapiens
gtggtacaagacatctttccagccctgtagaatatctattataaataaggaactattttttcaaggtgctcagaaatccaaaaaacatattagataggccrattttgagggcatttatttgtagagttatataggtttgattagagtctttcgtcaagaagaaaaatcattggcttaccaaacgagaagcattacacttta

SEQ ID NO: 52069 - DNA, 201 bp, Homo sapiens
ctatctggcatgggctgtgagggggctcctaacctagggggcctttttactccttcctggccagagctgccatttccaagtttctgcactgtcagaaaagrgggataaggtaagattcctgccctcatgtcacagattagtaggggagaggtaattgtcaaataattacagtaaaatgtataaatgccttaagagaaataa

SEQ ID NO: 52070 - DNA, 201 bp, Homo sapiens
tattgtctatttctcaaaagtagcatacgtcataatttcatgtgatttctaaaggagatctaatctcaaacttagttcttagagtaaaataaaaggttttrgcaatcatatacagcagtagactttaccttgaagatttaacaaaggtttgaaagcaaaatgctatgatactgaatatactaatgtttgagggcttgtgaa

SEQ ID NO: 52071 - DNA, 201 bp, Homo sapiens
agctgcaggggaggatgggggcatgggaggcaagcccgttgccctgtcagagcctcttggggatgctgctcttccccgcctgtcctctcttctctttgatktctcatcatgtggtcctctttcctctgccttttcctctcttcggtgtcccaagttcttccatagagacctgtgtccccttgttcccatcaggcctttatg

SEQ ID NO: 52072 - DNA, 201 bp, Homo sapiens; identical to SEQ ID NO: 15058

SEQ ID NO: 52073 - DNA, 201 bp, Homo sapiens
gtgtaagttatgaaatcttttttatttcatttgaaggaagtttttatttaaatacaaataaataagccctttattgtcacctactttggaaaagtccagakaaaacaatcttaagtaacaaaactccaaaattacaacatgattttcaaaaactaccctgacctttgtcttgcctggttgttacagtgtacttttaactaa

SEQ ID NO: 52074 - DNA, 201 bp, Homo sapiens; identical to SEQ ID NO: 15060

SEQ ID NO: 52075 - DNA, 201 bp, Homo sapiens
aaaaacccataccactggataatgcttgataatttctagagtcctttttttttgtattttggggcaggtaaattcattgagagacccagagagtttagctractttcctgtgggtaccaagggtcagagctggggtcaaaactcaggttttctgaacccctattcccagtgtacattccatgactccaggctgcctcccgc

SEQ ID NO: 52076 - DNA, 201 bp, Homo sapiens; identical to SEQ ID NO: 15062

SEQ ID NO: 52077 - DNA, 201 bp, Homo sapiens
gtattggttctagctgatttttatattgttagtcattaagttaggcttgatgagaaacagatataatctgagttggggattcaagtattatattgcatttstcctcacaactagagataaatttgccatggtttttctcttcataggctcatgccaaagtctggcatctctacaatacttctttccgtcccactcagggag

SEQ ID NO: 52078 - DNA, 201 bp, Homo sapiens
tttggtactatttgattttaaactatataaatgcatttattaatttaaagtaatttaaaaaacccataccactggataatgcttgataatttctagagtcmtttttttttgtattttggggcaggtaaattcattgagagacccagagagtttagctgactttcctgtgggtaccaagggtcagagctggggtcaaaactc

SEQ ID NO: 52079 - DNA, 201 bp, Homo sapiens
cctcactgtggggtgacctacctttgaaataatgtattggttctagctgatttttatattgttagtcattaagttaggcttgatgagaaacagatataatytgagttggggattcaagtattatattgcatttctcctcacaactagagataaatttgccatggtttttctcttcataggctcatgccaaagtctggcatc

SEQ ID NO: 52080 - DNA, 201 bp, Homo sapiens
ttcccttccatagtactgatgcatttttgttaaccattacctaattttgcttgagtctattatttctgaaattcacattatcttcccttttaaagttgagwaaattttcattcttcaagcgccttattttctataatctctcaaagtaactgatggctgttgcatgatcataagtgcaaattattttgctagaccacactt

SEQ ID NO: 52081 - DNA, 201 bp, Homo sapiens
ttaatactattacaatggcaattaaatttcaacatgagttttggaggggcaagcattcaaatcatagcaccatataatacaataaaaattttctgagctargtttggtaaatttattctaggaatccatgttgtctcctagttatcttcccttccatagtactgatgcatttttgttaaccattacctaattttgcttgag

SEQ ID NO: 52082 - DNA, 201 bp, Homo sapiens
tgagatattgaacccacttctatgataacagcattaattcattgatgaggacagagacctcattgcctaattggcctaaagtgagacctcttaaaggtctygcttaatactattacaatggcaattaaatttcaacatgagttttggaggggcaagcattcaaatcatagcaccatataatacaataaaaattttctgagc

SEQ ID NO: 52083 - DNA, 201 bp, Homo sapiens
tttattaacattttttgtttgaagtacagatgtcacgtcatccatgaaccggtatcattatagcttgataaaatactcaaactgaaagcagtgatgtacaytaattttaaatataatggttaagcaaatgttatttccatatctataagtgcattttatttgataattagaatgttagaatcagaaggaatttggaaaatc

SEQ ID NO: 52084 - DNA, 201 bp, Homo sapiens
tttcttgtaaatggaatattgtgcttgcagtctgctctcacacaatatctgggaaggagttttaaagagtgaggaagaacagtaaagattttcctaggcaratacgttatgtgacctttgttgatttccagagcacataatatcccaatttcatccagtggacaggaaaagagaggaagagggaaaaggtggcctctcaag

SEQ ID NO: 52085 - DNA, 201 bp, Homo sapiens
taagctattataacaaattcttttatttcattagcttttcaaaatgtggataactacacactcaacccaaggaatctacatttttccactgactgctaaaraccaatggaaataactctagtccccgtagcacctcactgtggggtgacctacctttgaaataatgtattggttctagctgatttttatattgttagtcat

SEQ ID NO: 52086 - DNA, 201 bp, Homo sapiens
aggaaagaaatacaatttttaataaaggcataagtggagaggtaaaatacatatttctggtttcaacgtgtccatattctttcttgtaaatggaatattgygcttgcagtctgctctcacacaatatctgggaaggagttttaaagagtgaggaagaacagtaaagattttcctaggcaaatacgttatgtgacctttgtt

SEQ ID NO: 52087 - DNA, 201 bp, Homo sapiens
attatcttatattctcaaaaatatcattgctctaaactagaattttattataattaatttgtgcaaaagttgtctttctttcaatgaatgttatctttttraggcataaaggaaattttaggtggaggaggagaatagaatacatgcttactgggaggacaagtaataataggtgagtaaaaacacacagcttattgaatt

SEQ ID NO: 52088 - DNA, 201 bp, Homo sapiens
tttaaaggaatttatttcctcacagttctgttggctgggaagtccaagggcaagtctctggcatctggtgagagacttcttgctgctttctcccatggtgraaggtgagagggcaagagagagacaaaaggaggctgaactcatccttttacaaggaacccatgcctgagatattgaacccacttctatgataacagcatt

SEQ ID NO: 52089 - DNA, 201 bp, Homo sapiens
ccttctgaattatcttatattctcaaaaatatcattgctctaaactagaattttattataattaatttgtgcaaaagttgtctttctttcaatgaatgttrtctttttaaggcataaaggaaattttaggtggaggaggagaatagaatacatgcttactgggaggacaagtaataataggtgagtaaaaacacacagctt

SEQ ID NO: 52090 - DNA, 201 bp, Homo sapiens
attggttattaaaatgttgatgtatgattattaaaaggcagcccatggtatgtctcttctgtatgaataagtatgtaaaaagtatgtaaagattactgtayagttcatgggtgggactgggctctctctagcctctgtccttcattctccctgccagtgccttttcccttgcagtgtcccttccctggctgcatactcaag

SEQ ID NO: 52091 - DNA, 201 bp, Homo sapiens
gaagagtggtctataattataaaaaattccattgtatgacttcagctacctgcaaaactgaccgagattaatgcattctttgtttgctttcactctttcaytccctgttcagcgcttattctacagaaaggtgcctggtagatttaggacatgactgttcataggcctcaaatgcggtcaaattaggaaagtcccctggtt

SEQ ID NO: 52092 - DNA, 201 bp, Homo sapiens
ctcctttttgaacacattgttttttgaaggttacggtcaagtccaagaaaaaattttaaaataggaaaagaattaatcaaatcatttcaaaatcatagcastgttttaacaatgccaattattttgagttgaagaaaagaaggaaaatgtaaactatgcattcaagtaatgtcaatgcaccttctcaggtgcaaaatgaat

SEQ ID NO: 52093 - DNA, 201 bp, Homo sapiens
tactactgaattcaatagtgcatttagtcagaaatagttaaaatatctcccaaacagcttgaatcactcctttttgaacacattgttttttgaaggttacrgtcaagtccaagaaaaaattttaaaataggaaaagaattaatcaaatcatttcaaaatcatagcactgttttaacaatgccaattattttgagttgaaga

SEQ ID NO: 52094 - DNA, 201 bp, Homo sapiens
aatccgttagaggaatgttggtacgcttatacagtggaatactaattggttattaaaatgttgatgtatgattattaaaaggcagcccatggtatgtctcytctgtatgaataagtatgtaaaaagtatgtaaagattactgtacagttcatgggtgggactgggctctctctagcctctgtccttcattctccctgccag

SEQ ID NO: 52095 - DNA, 201 bp, Homo sapiens
tgttaaggtaatccgttagaggaatgttggtacgcttatacagtggaatactaattggttattaaaatgttgatgtatgattattaaaaggcagcccatgktatgtctcttctgtatgaataagtatgtaaaaagtatgtaaagattactgtacagttcatgggtgggactgggctctctctagcctctgtccttcattct

SEQ ID NO: 52096 - DNA, 201 bp, Homo sapiens
cgcagtggctcacacctgtaatcccagcactttgggaggctgaggcgggtggatcacctgagatcaggagtttgagaacagcctggccaacatggtgaaaycccgtctctactaaaaatatggaaaattcaccagacgtggtggcaggtgcctgtaatcccagctacttgggaggctgaggcaggagaatcgtttgaacat

SEQ ID NO: 52097 - DNA, 201 bp, Homo sapiens
aagccaaacatccctgtcatctctttggtagtttattttcaaactttcaatcttattaaatttcatctccaatgtgcaaagataagaggaagtttaccgcwgatggtggtttattctttaaaactggacatcagctaaatgtgttaaggtaatccgttagaggaatgttggtacgcttatacagtggaatactaattggtt

SEQ ID NO: 52098 - DNA, 201 bp, Homo sapiens
taaccatctccctgttaatcatccttagttgttgcaacatcctaaatagtgaccttcccacactctgcctcataatatttaatctgtcaaatgtaccatcygcaaagggagtgaactggctcgtgaagaggtggtgaagctggttcaactcagtttaacagacaatgagggcctccgtgtgccagggagggagtgagggaa

SEQ ID NO: 52099 - DNA, 201 bp, Homo sapiens
ccaagttcttccatagagacctgtgtccccttgttcccatcaggcctttatgccagccctgcacaggtgcggggacagtggtaggggcgtctcactcccgrctcaactacattctcccagaaattgtctgcagtcaaacacaactcagcgtggacattgctcaccaaaggtatactgcttgggctgcacgagagattcagt

SEQ ID NO: 52100 - DNA, 201 bp, Homo sapiens
ccttctatggcatcctgcacaggacttcactttgctcagatgcctcctcccgcgctcttccctttatttaaccatttgtctccattttaccccttcgctakctggggtaatcctgttcccttcatctgtatctctgaaaatggcatcttgccctcccttggtgctcagaaggtggcttctggtttaccgaatagcctgatt

SEQ ID NO: 52101 - DNA, 201 bp, Homo sapiens
ttcaaatcccacctgttcttctggagccagctaacacgctcccttgggccccatgcctgaatgccatctcttccttctatggcatcctgcacaggacttcrctttgctcagatgcctcctcccgcgctcttccctttatttaaccatttgtctccattttaccccttcgctagctggggtaatcctgttcccttcatctgt

SEQ ID NO: 52102 - DNA, 201 bp, Homo sapiens
ctataagattaacataccaggaataattagaaagcattgcaagactatatgtaaccatctccctgttaatcatccttagttgttgcaacatcctaaatagygaccttcccacactctgcctcataatatttaatctgtcaaatgtaccatctgcaaagggagtgaactggctcgtgaagaggtggtgaagctggttcaact

SEQ ID NO: 52103 - DNA, 201 bp, Homo sapiens
cctacctccaggatgtgtccagaatcaaaccacttctccccttatctatgactacgatggaggtgcaagacaccatccaaccttgcctgggtaatgggaasagcctcactgctggggttcttatttctgccttgccccctgcagtgtgccatgatggatgctctacagggtgacattatgtgtggacaagacagagtcctt

SEQ ID NO: 52104 - DNA, 201 bp, Homo sapiens
tcacgtaaggaagtagggctaggagatattaatctgggcattgttgagcattagcatcagtgtgcaggtctcagcccatctgtctgcaatgtttgttgaarccatcacttcttgtcccttgaatccttcctcaacttggatttcaggctctggctctcccttgcttctcctctcagctccctggcgattccctcttagtct

SEQ ID NO: 52105 - DNA, 201 bp, Homo sapiens
aaccacactgtttatacattctcctgtgaatggacatttgtgttgttttcagttttctgctattgcgatttaagctactataagcatttttttttaattgygatggggtttcgctcttgttccccaggctggagtgcagtggcagcgatctcagctcactgcagcttctgccacgtgggtccaagcgattctcctgcctca

SEQ ID NO: 52106 - DNA, 201 bp, Homo sapiens
aaaagctgatagagaaaaatggcttccctcctttacctgaaaatcagcccctagaagggacatttccctgtgactttgcttggggagttgttgacaactayattcaagtaagtcagctgacaaaaccaatcagcagtctcaccaagccctatcactagtaagtagtgcttccttcctaggctgattgtcatggcacattgt

SEQ ID NO: 52107 - DNA, 201 bp, Homo sapiens
gaagaagacttgcctgtctaaactgccttcccatcccaatccctgttaccttctatcctttctctgctttattttcatttgttatctctcttcttcccaakaatgtaagctccataagaacaggatcatattttgaatcccctagaaaagtgcctagtgtaatatttgttgaatgaatatgatccctgcaattaaaagcta

SEQ ID NO: 52108 - DNA, 201 bp, Homo sapiens
agaagaaaaatcattggcttaccaaacgagaagcattacactttatttatttaagtaggaaacgctcagctgctcttgaaccatgatgcaagtgcccagcraagggtcatgttgctcttgtcccctcttccctttgcagccatcaagctggatggggtggatgtcatcgggtataccgcatggtccctcatggatggtttc

SEQ ID NO: 52109 - DNA, 201 bp, Homo sapiens
gtaattagtatgagcgatttgtctactgtatatatgctcaaattacatatactatgcacttttgagaaatactttacaagtttttctttcattaaaatgtrtttggggccgggcgcagtggctcacacctgtaatcccagcactttgggaggctgaggcgggtggatcacctgagatcaggagtttgagaacagcctggcc

SEQ ID NO: 52110 - DNA, 201 bp, Homo sapiens
gatgactggagattttgagtctccacccaggtttccccgagcatcagactggcatagacaaccgccttctccacgtggatgtctaatgggcatgtcacatygaacacatacatcccaaaccaaacccctgcttccccttctctattatgatgactttttactcttccagttgttggaccccgaatcttaactactcccctt

SEQ ID NO: 52111 - DNA, 201 bp, Homo sapiens
cattagcatcagtgtgcaggtctcagcccatctgtctgcaatgtttgttgaaaccatcacttcttgtcccttgaatccttcctcaacttggatttcaggcyctggctctcccttgcttctcctctcagctccctggcgattccctcttagtctcctttgcttgttcctcctcaccttgcctgtaaatagtggagggctcag

SEQ ID NO: 52112 - DNA, 201 bp, Homo sapiens
tcccattcttaagacaacaagcctataagattaacataccaggaataattagaaagcattgcaagactatatgtaaccatctccctgttaatcatccttakttgttgcaacatcctaaatagtgaccttcccacactctgcctcataatatttaatctgtcaaatgtaccatctgcaaagggagtgaactggctcgtgaag

SEQ ID NO: 52113 - DNA, 201 bp, Homo sapiens
aattgttattatagtgacttataggatcattttattataagataaagacttgcgtgctctctggtgctctggtgttttaaataatcaacatgttttagatmtttttgcccactcatggccctctgattaacttctcagttatatttttcaatgcttacacaaaaaatttgccaaacactaaccatccttcctagaaatgca

SEQ ID NO: 52114 - DNA, 201 bp, Homo sapiens
agctcttgaaacaaagttcttaatgtcccctgaaatcagcactagggactgtagttggggagttcagccccagcagtgcctctgagtctttgttctgtatrtgggttctaagaggattagaatcaagttggaaatacacgtgttcccatttcccaccttcaactcccctcaccgcctgagattcttgcaaacatttgtgca

SEQ ID NO: 52115 - DNA, 201 bp, Homo sapiens
aagttataaatccctccagatcaaagtgctactaaactctacttgctattttataacctttttctgttcagagtattttagaaacgtttttacatgttaaytgatattcttttgcattatcctgaataatggtatttctttagttatactatcatgtattaaaacattcatacatggtaaacatatttgaatattagacat

SEQ ID NO: 52116 - DNA, 201 bp, Homo sapiens
gttgaaagggttcctcacttatgacattgttagcctgataaaattaattgtaacacccttgtgcaaaatattttattaattttgacagcaggaaatattgmtatgccatggtaaagttgtctcaagtatttcttcctccttttttctccttagtgttcaaatttaggcaccattgttttggggattcatttataatcatgt

SEQ ID NO: 52117 - DNA, 201 bp, Homo sapiens
cagggtgagatgaagcagagacttttaataaccatcaagcaggcctgccatccaactgctatgagccattttccctttttgaattttatttttttaatctytagagcaatacatgtttatggtaggaaatgaaaaaaatatatagatgggtaaaatgaagtgaattataccacccacaatcctgctgtaaaacaggtttta

SEQ ID NO: 52118 - DNA, 201 bp, Homo sapiens
ttcaccggggtgtgaagaccgctttatacaatctcaaacaaagctagtcatagaaacacagaaacaactgcagggtgatatagattgttctaccacatctrtatttccacagtgctctctacagttgaaagggttcctcacttatgacattgttagcctgataaaattaattgtaacacccttgtgcaaaatattttatta

SEQ ID NO: 52119 - DNA, 201 bp, Homo sapiens
caggcagagaccatagggcaagttggagaacaggtgggcagggtgagatgaagcagagacttttaataaccatcaagcaggcctgccatccaactgctatsagccattttccctttttgaattttatttttttaatctttagagcaatacatgtttatggtaggaaatgaaaaaaatatatagatgggtaaaatgaagtga

SEQ ID NO: 52120 - DNA, 201 bp, Homo sapiens
gctattgttttagaatctgacctaaggtcagccactaattggccccagaggtctctctctcagatcacacggtccttttttcctcatcagcttggggaccycacccctcctcctggcagtctcctcctgtgcagaacccaacaaacacaaaattaagtcactctcaaacccacagcagatgagagcttctctggaagctcc

SEQ ID NO: 52121 - DNA, 201 bp, Homo sapiens
tgtgatttttgtgatttcatacttatgtatgtcttttcataaggatgttttagagcggtgattcttatactttttcaatccttttatggatctgaaaaacyctaaagaccaccagtgtatggctggtgatagaaaaactatgggaagaatggtctcactttttgaagaaaacataagcaagttatcagttcatactggaag

SEQ ID NO: 52122 - DNA, 201 bp, Homo sapiens
tcaatgtgcctgggacttggatttcaggcagagaccatagggcaagttggagaacaggtgggcagggtgagatgaagcagagacttttaataaccatcaarcaggcctgccatccaactgctatgagccattttccctttttgaattttatttttttaatctttagagcaatacatgtttatggtaggaaatgaaaaaaat

SEQ ID NO: 52123 - DNA, 201 bp, Homo sapiens
ttggatttgtttggaaacacattgtgatttttgtgatttcatacttatgtatgtcttttcataaggatgttttagagcggtgattcttatactttttcaayccttttatggatctgaaaaaccctaaagaccaccagtgtatggctggtgatagaaaaactatgggaagaatggtctcactttttgaagaaaacataagca

SEQ ID NO: 52124 - DNA, 201 bp, Homo sapiens
atgctagggagagggaagatgtcaaggaatgcttcctggaggtggcgacatctaagctgagttttaaagtgggtgtaagagtgaaggaactgggaataggyaaaacataccttagagagctgcacctccaaagcatggaaggctagataatcttagaacttcaagtggggttcaatgtgcctgggacttggatttcaggca

SEQ ID NO: 52125 - DNA, 201 bp, Homo sapiens
aagacttatttttaaatttagaattcagccacatattctgaacaaagtcagtactaaaaccatttctaaacacttttaattaaagccatagataatatggscagagcagtactgggttattgaggtgacttagtgctctgagctgctggtaatgttgtaataatggctaaattagattttatgtcagttccacaaaacctg

SEQ ID NO: 52126 - DNA, 201 bp, Homo sapiens
gctggagtggacctgaggttcatcacctgtttccttccacccaccatttaaaagcagcttatttgtgtgaaactttttgttgggttctgtgggggatacgwataggcaaatgacagggagcttataatttagccaaagagaaaatgtctatatgttctgtggaattcagagtattttcctcgacttccaaaattattttcc

SEQ ID NO: 52127 - DNA, 201 bp, Homo sapiens
tttgtacagagttttgtatcacaataaaatattttatgtacatgtataaacattttaataaaagtgtttaaatgtacaacttttggtacccaattctgatsacttgtgggcctactggaagacttatttttaaatttagaattcagccacatattctgaacaaagtcagtactaaaaccatttctaaacacttttaattaa

SEQ ID NO: 52128 - DNA, 201 bp, Homo sapiens
cttcttgtcccttgaatccttcctcaacttggatttcaggctctggctctcccttgcttctcctctcagctccctggcgattccctcttagtctcctttgmttgttcctcctcaccttgcctgtaaatagtggagggctcagggctctgtctagattcactccaggccattgctttgaatactgctgcatcccgatgactg

SEQ ID NO: 52129 - DNA, 201 bp, Homo sapiens
cttttcagctcagcaatactgctgtgtattgtgtgagcttcatttgcctcagccatacctagaacacaacccaaggcagaaagctggagtggacctgaggytcatcacctgtttccttccacccaccatttaaaagcagcttatttgtgtgaaactttttgttgggttctgtgggggatacgaataggcaaatgacaggga

SEQ ID NO: 52130 - DNA, 201 bp, Homo sapiens
ggggcgcgggcataaaggggcgcggcgcggggccccggagcctggctcccgcgcagcatgcccgccagcgccccgccgcgccgcccgcggccgccgccgcmgtcgctgtcgctgctgctggtgctgctgggcctgggcggccgccgcctgcgtgcggagccgggcgacggcgcgcagacctgggcccgtttctcgcggcct

SEQ ID NO: 52131 - DNA, 201 bp, Homo sapiens
ctttgtgtagatttcttctctccagtacgttgacctgcttcagagtcctcatcattgctttcttccttttcagctcagcaatactgctgtgtattgtgtgrgcttcatttgcctcagccatacctagaacacaacccaaggcagaaagctggagtggacctgaggttcatcacctgtttccttccacccaccatttaaaag

SEQ ID NO: 52132 - DNA, 201 bp, Homo sapiens
acctttggtattcatctcccagacctgtggctgcttctctttgctgagcctcacaaaatcttgtcctgtgcatggacagccacggatccttgggaaatctyatgcagacttctaggtccttcctttgtgtagatttcttctctccagtacgttgacctgcttcagagtcctcatcattgctttcttccttttcagctcagc

SEQ ID NO: 52133 - DNA, 201 bp, Homo sapiens; identical to SEQ ID NO: 15068

SEQ ID NO: 52134 - DNA, 201 bp, Homo sapiens
tgtgtgagagagagagagagagagagagagagaggagacaggagagaaggagaagaggggagaggggaggagggacagagagagagagaggtctcctacaragagcttggagctcaggctgctttgctcatttgagtgtaatccaggaggatgcaccttttctctcggacttgaagaccaactgctcagccttcacagctc

SEQ ID NO: 52135 - DNA, 201 bp, Homo sapiens
caaggaatctacatttttccactgactgctaaagaccaatggaaataactctagtccccgtagcacctcactgtggggtgacctacctttgaaataatgtrttggttctagctgatttttatattgttagtcattaagttaggcttgatgagaaacagatataatctgagttggggattcaagtattatattgcatttctc

SEQ ID NO: 52136 - DNA, 201 bp, Homo sapiens
tggaaaaaaatctctaagattatctaacataaatgatgtgaatttatatttttaaatcctaatggagacattcattttggcaatagtagaatgcattcatktaacacctttctcatttggagtcttgaggaacttgaattaatttttaaaaacccatttgtaaatgagaaactgggttataatatttgtaattacttaact

SEQ ID NO: 52137 - DNA, 201 bp, Homo sapiens
cggcatccggggcagcccgcggctcgggtacctggtggcgcacaacctcctcctggtgagtgcgaggggccaggcggagggccacgcaggggagacagagrgcctccacaggggccagggggaagtgtgggaactgagtctcccccagacgaggcttcacttggacacgtgtatgtggtcaccgggggaaactgagcagtt

SEQ ID NO: 52138 - DNA, 201 bp, Homo sapiens
attttccagacctacccaacctttggtattcatctcccagacctgtggctgcttctctttgctgagcctcacaaaatcttgtcctgtgcatggacagccamggatccttgggaaatctcatgcagacttctaggtccttcctttgtgtagatttcttctctccagtacgttgacctgcttcagagtcctcatcattgcttt

SEQ ID NO: 52139 - DNA, 201 bp, Homo sapiens
atagggagcctggtcaatattgtctctttttaaagggtgttgtatttagttctgccaagaagttaaattaccagatttacttgatgtggctttattctttsttagagctggtctattcctgctttgttcttacttctcaggtaatgaccttcctgagtttcagctggatgcctgaagtgctcagctgcatttttctactct

SEQ ID NO: 52140 - DNA, 201 bp, Homo sapiens
gatattatagggagcctggtcaatattgtctctttttaaagggtgttgtatttagttctgccaagaagttaaattaccagatttacttgatgtggctttaktctttcttagagctggtctattcctgctttgttcttacttctcaggtaatgaccttcctgagtttcagctggatgcctgaagtgctcagctgcatttttc

SEQ ID NO: 52141 - DNA, 201 bp, Homo sapiens
ttctttttttccccttaattaagggtttccttttcctgctttttcacatatctagtagatttttattatgctctgtgtgctatgaatgagatattataggragcctggtcaatattgtctctttttaaagggtgttgtatttagttctgccaagaagttaaattaccagatttacttgatgtggctttattctttcttaga

SEQ ID NO: 52142 - DNA, 201 bp, Homo sapiens
taatagctattttaaagtcctctgctaatcccgatatctgggacatcttggcttctgttgatattgaatacttctttttttccccttaattaagggtttcmttttcctgctttttcacatatctagtagatttttattatgctctgtgtgctatgaatgagatattatagggagcctggtcaatattgtctctttttaaag

SEQ ID NO: 52143 - DNA, 201 bp, Homo sapiens
tcgcttttcagttctagaattttcatgttttcttcagttgttgtttctctgttgttattctccatttgttcattatatctatcttttctttgaaatccttraaaatatttataatagctattttaaagtcctctgctaatcccgatatctgggacatcttggcttctgttgatattgaatacttctttttttccccttaat

SEQ ID NO: 52144 - DNA, 201 bp, Homo sapiens
tggctttttagagaaacctttaatatctttgtgagttttagggattacattatttattcttattattattccatttagaattaatattgttaatcccattmaaaaatttgtttatttcgcttttcagttctagaattttcatgttttcttcagttgttgtttctctgttgttattctccatttgttcattatatctatctt

SEQ ID NO: 52145 - DNA, 201 bp, Homo sapiens
cactttatatttatagtatatttcttgcacacagaatgtaattgaaacttacttttctaaaatctactttctttttttttttttgagatggagtcttgctstgttgcccaggctggagtgcagtggcacaatcttggctcactgcaatctctgcttcctgggttcaagcaattctcctgtctcagcctcccgagtagctgg

SEQ ID NO: 52146 - DNA, 201 bp, Homo sapiens; identical to SEQ ID NO: 15056

SEQ ID NO: 52147 - DNA, 201 bp, Homo sapiens
aagctggagtggacctgaggttcatcacctgtttccttccacccaccatttaaaagcagcttatttgtgtgaaactttttgttgggttctgtgggggataygaataggcaaatgacagggagcttataatttagccaaagagaaaatgtctatatgttctgtggaattcagagtattttcctcgacttccaaaattatttt

SEQ ID NO: 52148 - DNA, 201 bp, Homo sapiens
gagttgagattgtgccattgcactccagcctgggggacagagtgagaccaggtttttttaaaaaaaaagaaaaagaaaaaagaatcaccatatgactcagyattcctaattcctattacgggtatatatccaaaggaaatgaaatcggtatgccgaaggaatatgtgcattgtgttgtttactgtattaccattcacaata

SEQ ID NO: 52149 - DNA, 201 bp, Homo sapiens
gagttcccattgtcaaagaaagtatcttgaattaattttgttgtatgagatactttcattctgttttcaatgacctttctcggtgtgtatataggggttgsgggaagcgagaatagaaaaatttgagcttacctgaaaaagataaaacattctgcagattttgataaaagggcattttagctggggcttagatattgctgc

SEQ ID NO: 52150 - DNA, 201 bp, Homo sapiens
caaacactaaccatccttcctagaaatgcagtggactttgtatttagggaaattagtaacaggtgaatgctccattttgctgatgttgcaaacaaactgtyagttggtgtaaagtattaattttgctttcacatttcttttggtttggtgtttagtcattcttgtatcttatttagaagcgagttcccattgtcaaagaaa

SEQ ID NO: 52151 - DNA, 201 bp, Homo sapiens
ctcgacttccaaaatttggggctactagctagttggtaggaaggaattccagatccatttttcttctagatttttttcagactccatgtttcaaaatctaratggaaggtaagaaggaagcaaggagggcatcacatacgagagagacttataccccaaagtggatcattagcacattatgagataatatggtattattct

SEQ ID NO: 52152 - DNA, 201 bp, Homo sapiens
acttgagaaaaatgtatattctgatttttttaggtgggtggcatgttctattaatatatatgtctgttagctctagttgaattatagtgatgttcaaagcytccattttgttattaatataaccatgccagatttttaatgctgtccatttgcataatatgtctctttccattctttttcttttacatgatcactttatat

SEQ ID NO: 52153 - DNA, 201 bp, Homo sapiens
tatcctggaaaatgtatcatgtgcacttgagaaaaatgtatattctgatttttttaggtgggtggcatgttctattaatatatatgtctgttagctctagktgaattatagtgatgttcaaagcttccattttgttattaatataaccatgccagatttttaatgctgtccatttgcataatatgtctctttccattcttt

SEQ ID NO: 52154 - DNA, 201 bp, Homo sapiens
tttctctgttgttattctccatttgttcattatatctatcttttctttgaaatccttgaaaatatttataatagctattttaaagtcctctgctaatcccratatctgggacatcttggcttctgttgatattgaatacttctttttttccccttaattaagggtttccttttcctgctttttcacatatctagtagattt

SEQ ID NO: 52155 - DNA, 201 bp, Homo sapiens; identical to SEQ ID NO: 15063

SEQ ID NO: 52156 - DNA, 201 bp, Homo sapiens
tgcttttcttaatcatattaaggaagttcctttctagtcctagttttctgagtgtttttattatgaaagactttcagatttttgtaaaatgcttttcctgygttaattgagataatcatatgggttttctccccctttactctattgatgtaatgcattacaacgatttttttaaatgtttacccatctttgcattcctgg

SEQ ID NO: 52157 - DNA, 201 bp, Homo sapiens
ccgcctcggcctcccaaagtgctgggattacaggcatgagccaccacgcccggcccataaatgcttttcttaatcatattaaggaagttcctttctagtcstagttttctgagtgtttttattatgaaagactttcagatttttgtaaaatgcttttcctgtgttaattgagataatcatatgggttttctccccctttac

SEQ ID NO: 52158 - DNA, 201 bp, Homo sapiens
ttagtgggtgtgagtgctcgttggggttttaatttgcattttcctgatagtgttgatgttgaggacatttctatgtgtttactgagcattggtgaagattstcttgtgaaatatctattcaaatattttgctcatggtgggaaggggagttatttttcttttactactgataggtaggcttacgtatttatttcggatata

SEQ ID NO: 52159 - DNA, 201 bp, Homo sapiens
tatctccccagcggggagggtttagggttgtctgtgggacctgcctctgtctcatcatccatcaccattgtcctgctgatgggtgcagaggactgaggacragtggttggagttctccctgtgccggaccctgtagagagtccagagccctggctcccaaaggaggcatatttgtagggctcttttcgtgagggtccagag

SEQ ID NO: 52160 - DNA, 201 bp, Homo sapiens
ctctgcctggaatgcccttcccgtaccctctaccgcctctgcccaatcctccgggttctctgctccttccacacacccccatctcaggtcccagtcttttktagcattcttcactttttctgttacagatcctcagacaatgcttccttgaagaagacttgcctgtctaaactgccttcccatcccaatccctgttacctt

SEQ ID NO: 52161 - DNA, 201 bp, Homo sapiens
aagtggtctcagattagtagcctctgtacatggaaactagcttacctcccggcgagcatcccaagagaactaggaggaagtggtatggacttctttttttyttcttcttcttcttttcacttattcttgatatcatgtagcttcatttctatcagagcagtcacatgcccacagattcaagggggagggtccacagatccg

SEQ ID NO: 52162 - DNA, 201 bp, Homo sapiens
tgatccgcggttgagcctggctgtggaccagagcatctctgttggcctcgcttacacaagtggtctcagattagtagcctctgtacatggaaactagcttmcctcccggcgagcatcccaagagaactaggaggaagtggtatggacttcttttttttttcttcttcttcttttcacttattcttgatatcatgtagcttc

SEQ ID NO: 52163 - DNA, 201 bp, Homo sapiens
ctcactgcaacctccgcctcccgggttcaagtgattctcctgcctcagcctcctgagtagctgggattacaggtgcctgccaccatgttggtgaatttttstatttttagtagagacaggagtttcaccatgttggccaggctggtctcgaactcctgaccttaggtggtccacctgcctcggcctctcaaagtgctggga

SEQ ID NO: 52164 - DNA, 201 bp, Homo sapiens
attccagttttaaaaaatttgtgttttcttattcaaaaagcaatacatatttcgttacataaaagtcagaaaatcagagaagcagaagaacataataaatrcccactgtcctactcaatagagactataactgctatctctgtacaaatcctttaaaatcctgtcttatgtgtatttattttacatctgtacatatgattc

SEQ ID NO: 52165 - DNA, 201 bp, Homo sapiens
gcaggtgcctgtaatcccagctacttgggaggctgaggcaggagaatcgtttgaacatgggaggcagaggttgtagtgagctgagatcgcaccattgcacwccatcctgagcaacaagagcgaaactccatctcaaaaaaatgtattttgtacataactagaataatcaactggattgaaagttaatataaattttagaat

SEQ ID NO: 52166 - DNA, 201 bp, Homo sapiens
cacctgccgccatgcctggctaattttttgtatttttagtagagacggggtttcaccgtgttagtcgggatggtctcgatctcctgaccttgtgatccacycacctcggcctcccaaagtgctgggattacaggcgtgagccaccgcgcctggccctatttttttttttttaaaggaatttatttcctcacagttctgttg

SEQ ID NO: 52167 - DNA, 201 bp, Homo sapiens; identical to SEQ ID NO: 15077

SEQ ID NO: 52168 - DNA, 201 bp, Homo sapiens
aaatcccagttactagacttcccagtattaataattttggtatgccaggaatttttaaaacatttctaacaaattttttcagaaatcagaatgactgaaakgtataacaataggaaattaggaaatcaataagtaatcattgaaaagtgagtgattgaattagttggaacaatctatgccatccatcctgtgggggaaaaa

SEQ ID NO: 52169 - DNA, 201 bp, Homo sapiens
agtagagacggggtttcaccgtgttagtcgggatggtctcgatctcctgaccttgtgatccacccacctcggcctcccaaagtgctgggattacaggcgtkagccaccgcgcctggccctatttttttttttttaaaggaatttatttcctcacagttctgttggctgggaagtccaagggcaagtctctggcatctggtg

SEQ ID NO: 52170 - DNA, 201 bp, Homo sapiens
gattttgctcatttctgtattcttagcacttatatatccaacatataataggtgttggataatatttgttgaataaatgactaaataaatgtcttggcatragaattatgccatctacaaaaccgtcacttttaaaaaaaacaacaaagatttttgaacctgtagatccagccagaaagcaagaaatatcttcacctttcc

SEQ ID NO: 52171 - DNA, 201 bp, Homo sapiens
tgtttgtttttttgtttgagacggagtttctcttgttgcctgggctggagtgcagtggcgtgatctcggctcatcacaacctctgcctcctgggttcaagygattctcctgcctcagcctccagagtagctgggattacaggtgcctgccaccacaccgactaattttgtatttttagtagagacggggtttctcgatgtt

SEQ ID NO: 52172 - DNA, 201 bp, Homo sapiens
ggattacaggtgcctgccaccacaccgactaattttgtatttttagtagagacggggtttctcgatgttggtcaggctgctctcgaactcctgacctcagrtgatccgcccgcctcggcctcccaaagtgctgggattacaggcatgagccaccacgcccggcccataaatgcttttcttaatcatattaaggaagttcct

SEQ ID NO: 52173 - DNA, 201 bp, Homo sapiens
atcgatgacgggctgcatgctgaggacgaccagctgagggtgtattatatgcagaattacataaacgaagctctcaaaggtaaggagccctagctgcggcwatctcctgaaggttatgtcaccagagggcatgacacttgattaaatctccaacatcaacacacactgccacccttggaatggagggctatccattttgtg

SEQ ID NO: 52174 - DNA, 201 bp, Homo sapiens
actcccccagtcaggtggcggtagtgccctgggggttgcgcaaagtgctgaactggctgaagttcaagtacggagacctccccatgtacataatatccaayggaatcgatgacgggctgcatgctgaggacgaccagctgagggtgtattatatgcagaattacataaacgaagctctcaaaggtaaggagccctagctgc

SEQ ID NO: 52175 - DNA, 201 bp, Homo sapiens; identical to SEQ ID NO: 15059

SEQ ID NO: 52176 - DNA, 201 bp, Homo sapiens; identical to SEQ ID NO: 15061

SEQ ID NO: 52177 - DNA, 201 bp, Homo sapiens
ttccaaacatctctcagattgccctgttgttttgcttttcagtagtcatcacctttgtccagaaccttaattgtatctgcattttggcagtatcctgccarttttccacatccagctgttcacattctaatgcattctgcaatggatgattttgagcatatgactgatcatcactgtctcagaaatttatgctaatctatt

SEQ ID NO: 52178 - DNA, 201 bp, Homo sapiens
gcctgccaccacaccgactaattttgtatttttagtagagacggggtttctcgatgttggtcaggctgctctcgaactcctgacctcaggtgatccgcccrcctcggcctcccaaagtgctgggattacaggcatgagccaccacgcccggcccataaatgcttttcttaatcatattaaggaagttcctttctagtccta

SEQ ID NO: 52179 - DNA, 201 bp, Homo sapiens
aaaatctactttctttttttttttttgagatggagtcttgctgtgttgcccaggctggagtgcagtggcacaatcttggctcactgcaatctctgcttccygggttcaagcaattctcctgtctcagcctcccgagtagctgggattacaggcacctgtatttttagtagagacggggtttcaccatgttggtcaggctgg

SEQ ID NO: 52180 - DNA, 201 bp, Homo sapiens
tgtctcagcctcccgagtagctgggattacaggcacctgtatttttagtagagacggggtttcaccatgttggtcaggctggtcttgaactcctgacctcrtgatccacctgccttggcctcccaaagtgctgggattacaggcgtgagccactgcacccagcccctaaaatctgctttcatagcatctgtcttgtacttg

SEQ ID NO: 52181 - DNA, 201 bp, Homo sapiens
ctcccaaagtgctgggattacagtcttgagccactgtgcccggccagcatctttgaacatatcaatttgtaagttttatcttaatattgtacaagtctttkggggggcttatgttgtcatttctcttggtaaatacctaggtatgaacttgctagattatagagaaaatctatctttaattttataagaaactgtcaaata

SEQ ID NO: 52182 - DNA, 201 bp, Homo sapiens
atcattacatgataactcaaatagcagtcctgaaaaagtgcatttcaattcagatctctcttttttcttccttcacaattctcatttccgaaaaatgaaakaagccagaggatcctttatgaggagttacagtataacttatgcgtggctgtttcctgtgtttactgctactcagtgagaaatacgggagatgggagagtg

SEQ ID NO: 52183 - DNA, 201 bp, Homo sapiens
cacaagtggtctcagattagtagcctctgtacatggaaactagcttacctcccggcgagcatcccaagagaactaggaggaagtggtatggacttcttttytttttcttcttcttcttttcacttattcttgatatcatgtagcttcatttctatcagagcagtcacatgcccacagattcaagggggagggtccacagat

SEQ ID NO: 52184 - DNA, 201 bp, Homo sapiens
ttgagcctggctgtggaccagagcatctctgttggcctcgcttacacaagtggtctcagattagtagcctctgtacatggaaactagcttacctcccggcragcatcccaagagaactaggaggaagtggtatggacttcttttttttttcttcttcttcttttcacttattcttgatatcatgtagcttcatttctatca

SEQ ID NO: 52185 - DNA, 201 bp, Homo sapiens; identical to SEQ ID NO: 15066

SEQ ID NO: 52186 - DNA, 201 bp, Homo sapiens; identical to SEQ ID NO: 15069

SEQ ID NO: 52187 - DNA, 201 bp, Homo sapiens
aaaatatttagtaaaatatttgaaaagtaaggtcaaagcaatgctgtaaaagtagtacaagatgataaagaaatagaacacatttttgaaagggaaaaagmtttaaaggatattcataaagatccaacatcagactaatagaagttctggaaagagagaataaggaaatacaggtcaggaaatttgtaaagaaataatata

SEQ ID NO: 52188 - DNA, 201 bp, Homo sapiens
aaaaaaacagaaaaagaaaaaataaatgccatgctggagccttgtttggcctgcttgggtgctcatgccatctctttgggtaggttctggcccccagactytagctggggagccacatctgagagaataattgttccctctgagctcttggggacctaagatttggtctttctgtagttgaaggtcagtgcagagaacttg

SEQ ID NO: 52189 - DNA, 201 bp, Homo sapiens
ctgtacctggcacagttttggttctggggtcagagatgacaaactcctaccctgggagtccactgagcgaccataccaataggtcatggcctcagagccgygtggcccacggcccctgtgactctctctgctgtggacctttctcctagaacccgatcatcagccagttcttccccaccctcctgctctggtccttctcgg

SEQ ID NO: 52190 - DNA, 201 bp, Homo sapiens
tgcactcccccaccccatcctctctcgggctgctggggagcttggtgccagctggtactattattccgggtgttaatagtctgtgtgtttggagggtgttygttcacagagatcagttttgtttatcatcgcaagtttttgctgttatctgcagacagaagagcctgcaagtgacaaaggaagtgaggcagaggcccacat

SEQ ID NO: 52191 - DNA, 201 bp, Homo sapiens
aggacccctgagcacactcacctacggtgtcaggcttggtgcactggatgtgcatgtagccgctctccctcatcaggctgtagaataccttctccttgacrgggtacagcagctccacatccctctcagtgaggccaagaaacctcccgaaacgctgtcccaggaggagggtcagggtagagaagttgcttaaaaccaaag

SEQ ID NO: 52192 - DNA, 201 bp, Homo sapiens
gaaaggtcaacaacccagcctggagcagtgtttgctttggaaatgctgggccttgcagttagactgatggtacccaggaggggtatgtgtgtgtgaaagcrcagagctaggggacccagaggtccctgaggaggccctgggactcctgactccctccccgtccctaccctagaccaccccctttactttctcctctgtggc

SEQ ID NO: 52193 - DNA, 201 bp, Homo sapiens
ctgtctgtgtcctgttgggagaagggcaggaggggagggatgcagtgtggaagctcatgcctgtccaggccaagcacaaatccatttgctgacagccctaygtgcctcggattctgaacggcttggcctcggagaggacagcactgtctccgcagcagcagcagcagcagacctatggtgccatccacaacatcagcggga

SEQ ID NO: 52194 - DNA, 201 bp, Homo sapiens
gatcccctgagattgtcccacaatgcagccattctctgtggacactgccaggcacgcagaggtccaatgtctggctctcccggactccttgctgctggctyactgcccgatcagtccctgggaaacgcctgcctttggctctgccagcactggtgggaacctgcaagaaatttgagccctgaacgtctgccttgtcctgtt

SEQ ID NO: 52195 - DNA, 201 bp, Homo sapiens
ttggggcccaggtgaagtcctttgcttggggccctaccgtgagcccacaacctccagggtttctgtgggagagggctgctcccctagacccagcaggtccytgagccattggcaaagaggagagaggctggggccacaggtggtgctggccgaggaaggaggagtagggtcgcacagaggagcactgatggatggagaacc

SEQ ID NO: 52196 - DNA, 201 bp, Homo sapiens
cgaggctagaggaactttaggacttcttaagacagcagctgcagcaactctgtccctcctttgctccatgtcgccccctctggggatctgcccactgtgtyctggatgagccatccactctgaccatctgatcccctgagattgtcccacaatgcagccattctctgtggacactgccaggcacgcagaggtccaatgtct

SEQ ID NO: 52197 - DNA, 201 bp, Homo sapiens
gaggtcccagctctgacattctgtgagcagtgggagtgaggtgttgtctgtggctcgtggatggaccatcgtgaatacttggatgttcccttcttccctgkttgtttatcccggtgttttcctcttcctgcctttgtgtgcctttctccctctcctctgcctgtactctagatccgccagtggcttctgcaggagtgactt

SEQ ID NO: 52198 - DNA, 201 bp, Homo sapiens
gcaaactcattcctcagaaaaggggtatcttccccaagaaaagcctggagggcacttgtggggggaggtggcaggcggggggagaggggtgggtcattgcygctccagcaccgacaggaacttgcggatgtcctgggcgagcagctccggctcctcaaaggccgcaaagtggcccccacgaaccatgtaggaataggagat

SEQ ID NO: 52199 - DNA, 201 bp, Homo sapiens
gagagggcagacaggactggccacctgaccttacctctgtctcaggctgatagtatttgctagccacctccctgagttcatatcaaactttgtcaaaccaycctgggaagcctatttggcaagagacaagtaacttagaggcatgactggggctggagggagggggaagaggagccgcaggtgtttccctccgcagaggcc

SEQ ID NO: 52200 - DNA, 201 bp, Homo sapiens
tccggctcctcaaaggccgcaaagtggcccccacgaaccatgtaggaataggagatgagctttgggtacttgaacctcacccacttttcaggcgtgtgcartagctcaaaagggaaggcagagaagccagtgggcacatagaccttcatcctggaagtgaaagagccgacggaggggtgaggctgtggccctgcgcccctc

SEQ ID NO: 52201 - DNA, 201 bp, Homo sapiens
agctgaaaggtctgagagagattgtgggtccccagagctctaccctaacctgggtgctcatcggagagggcagacaggactggccacctgaccttacctcygtctcaggctgatagtatttgctagccacctccctgagttcatatcaaactttgtcaaaccaccctgggaagcctatttggcaagagacaagtaacttag

SEQ ID NO: 52202 - DNA, 201 bp, Homo sapiens
tttgggaggctgaggcaggcagatcacgaggtcaggagttcaagaccagcctggccaacatggtgaaactccgtctctactaaaaatacaaaaattagccrggcttggtggcgggtgcctgtaatcccagctactcgggaggctgaggcaggagaatcgcttgaaaccggaaggcggaggtcgcagtgagccaagatcacc

SEQ ID NO: 52203 - DNA, 201 bp, Homo sapiens
tccgcctttcccgggacgtgcgcgccaggtgtccggttccggaacggctcccagcctacgcagaccccagagcccccgaccccaagcagggggtgacgackcgggattgggtgggaggagagggtccgggcagcgcctccattccagccctgcgctccttgggaattcctggcggcttttcaggactttcctctccggctt

SEQ ID NO: 52204 - DNA, 201 bp, Homo sapiens
ccatgcccagctaatatttttgtatttttagtagagacagggtttctccatgttggtcacgtggatctccaactcccgacctcaggtgatctgcctgcctyggcctcccaaagtgctgggattataggcatgagccaccgcgcccggcccaggtgcatgttattttatatagcactaagaacaagaaaatgttgtcagcta

SEQ ID NO: 52205 - DNA, 201 bp, Homo sapiens
ctcagcctccagagtagctgagattacaggcatgcgccaccatgcccagctaatatttttgtatttttagtagagacagggtttctccatgttggtcacgyggatctccaactcccgacctcaggtgatctgcctgccttggcctcccaaagtgctgggattataggcatgagccaccgcgcccggcccaggtgcatgtta

SEQ ID NO: 52206 - DNA, 201 bp, Homo sapiens
catgacactgctatgagattgtgttcattaagtgtatctacctggcctgtaccaatagctgttctctttgctcttcaccacagacccatgaggtcagcctygctaccctcattgtgctcacaaaacaaaaaacaaaaacaaaaacccaggctcagatgctcagctccctcagggcttctgttgggccaaggctatgaacct

SEQ ID NO: 52207 - DNA, 201 bp, Homo sapiens
cgccaggagatgtacattgacctgcaggggatgaagtgggccgagaactgggtgctggagcccccgggcttcctggcttatgagtgtgtgggcacctgccrgcagcccccggaggccctggccttcaagtggccgtttctggggcctcgacagtgcatcgcctcggagactgactcgctgcccatgatcgtcagcatcaag

SEQ ID NO: 52208 - DNA, 201 bp, Homo sapiens
attgttgtaagatgcatgttttttttttttttcagaccgagtttcgctcttgtcgcccaggctggagtgcaatggcacgatctcggctcaccgcagcctcygcctcccgggttcaagcaattctcctgcctcagcctccagagtagctgagattacaggcatgcgccaccatgcccagctaatatttttgtatttttagta

SEQ ID NO: 52209 - DNA, 201 bp, Homo sapiens
acccgggtggcagagcttgcagtgagccaagatcaccccactgcacttccagcttgggtgacagagccagactctgtctcaaaaaaaaaaaaaaaaaaaaagaagaaaagcagtcacatatacgtattgcaaacacctcagatttatagcgcatggggtgtttttatgggggtactcgcaagaaaggatctgattaaaatg

SEQ ID NO: 52210 - DNA, 201 bp, Homo sapiens
ccaagagcggctctcagctcacagacctgggccctggtttccccaggtgcgtcttcctgcctgaccagggtgccttctttgtgaactatgtcatcgcctcrgccttcatcggcaatggcatggagctgctgcggctgccaggtctcatcctctataccttccgcatgatcatggccaagacggctgctgaccgcaggaatg

SEQ ID NO: 52211 - DNA, 201 bp, Homo sapiens
aacccgggtggcagagcttgcagtgagccaagatcaccccactgcacttccagcttgggtgacagagccagactctgtctcaaaaaaaaaaaaaaaaaaaaagaagaaaagcagtcacatatacgtattgcaaacacctcagatttatagcgcatggggtgtttttatgggggtactcgcaagaaaggatctgattaaaat

SEQ ID NO: 52212 - DNA, 201 bp, Homo sapiens
ccttccacttagggaaggcctcatcatggctttatttatctcaaggaaggaagtttctgttaaagcagactgtgacaggtcatgccgtagtaagtggcatygttgagaacaaaagtcaatctcgagctttggcctgtttttagagcaaaagaaaatgaaagcatgtgtagtgacaatatggaatgctggaaataaactctt

SEQ ID NO: 52213 - DNA, 201 bp, Homo sapiens
gaacccgggtggcagagcttgcagtgagccaagatcaccccactgcacttccagcttgggtgacagagccagactctgtctcaaaaaaaaaaaaaaaaaaaaagaagaaaagcagtcacatatacgtattgcaaacacctcagatttatagcgcatggggtgtttttatgggggtactcgcaagaaaggatctgattaaaa

SEQ ID NO: 52214 - DNA, 201 bp, Homo sapiens
gaaaaaaattttctgtaaagtgaagaaggatgctggttcctggggctgctctggggccagaccttaccctcctgctcggggccactgaaggcagagcagggcccgagactgggccttgtggtgttaccgctgccttgagagcaagagacagggctgacgtgcagaactaggcaggctccaggcaagcttggcgtcagcgct

SEQ ID NO: 52215 - DNA, 201 bp, Homo sapiens
agaattgcttgaacctgggaggcagagttgcaatgagccgagatcacgccactgcactccagcctgtgcaacaagagcgagacgctgtctcaaaaaaaaaaaaaaacaaaaaaaagaattagaagctgattcttagagcgtaccttcagcaggtggcctttctttaacgtagatctccttgttcacaaagatgccccatgg

SEQ ID NO: 52216 - DNA, 201 bp, Homo sapiens
gagaattgcttgaacctgggaggcagagttgcaatgagccgagatcacgccactgcactccagcctgtgcaacaagagcgagacgctgtctcaaaaaaaaaaaaaaacaaaaaaaagaattagaagctgattcttagagcgtaccttcagcaggtggcctttctttaacgtagatctccttgttcacaaagatgccccatg

SEQ ID NO: 52217 - DNA, 201 bp, Homo sapiens
cctcccaggggctttctgctcctgcccagcctaggggcccctcctctccctccaagagcggctctcagctcacagacctgggccctggtttccccaggtgygtcttcctgcctgaccagggtgccttctttgtgaactatgtcatcgcctcggccttcatcggcaatggcatggagctgctgcggctgccaggtctcatcc

SEQ ID NO: 52218 - DNA, 201 bp, Homo sapiens
tccaggactcacacaccactgagctgtcatgtctctttagacccttcttggctgtgacagttcaaactttttaaaaagacttagagaacataacttttaacaaaaatagaaccatacatacattctattttagaatctctttttttttaacttaacaatgtatcctgggtgtcctcctatgttgccaaatttactcctatt

SEQ ID NO: 52219 - DNA, 201 bp, Homo sapiens
tgggaaacgcctgcctttggctctgccagcactggtgggaacctgcaagaaatttgagccctgaacgtctgccttgtcctgttgtcctgtgctccagggargacaggcgcgatgatggactccccgttcctggagctgtggcagtccaaggcagtgtccatcagggagcagctgggactcggggaccggcccaacgactcc

SEQ ID NO: 52220 - DNA, 201 bp, Homo sapiens
ctgttctctttgctcttcaccacagacccatgaggtcagcctcgctaccctcattgtgctcacaaaacaaaaaacaaaaacaaaaacccaggctcagatgytcagctccctcagggcttctgttgggccaaggctatgaaccttgttggcttcagactggttgctttagatactgagggctttcgtcatcctctgaagagg

SEQ ID NO: 52221 - DNA, 201 bp, Homo sapiens
tcatacacattgacaaaatgtcacctttttctgattaccaaatgatattttctttaaagtggaggatttttgggcctggtgtggtggctcacgcctgtaaycccagcactttggaaggctgaggcgggtggatcacctaaggtcaggagctcaagaccagcctggccaacatggtgaaaccccgtctctactaaaaataca

SEQ ID NO: 52222 - DNA, 201 bp, Homo sapiens
ccagacatgctcctcctccccagagctccacaaaccaaggctgattggttacgccccctcctgcttccccacatgaccctggaactaagtatctgtgcttytctgcagacaaagacccgtatagttttgggaggacaacaatagcaaacctacagactgagtgagtatggagcccgtggggataggtgctgatgggtgaga

SEQ ID NO: 52223 - DNA, 201 bp, Homo sapiens
tatcccaccaccaagtgcccttcgtggagcccaagactggccgtccccctgcctccagcctcagaggcccctgttctcggctcagccaggctcaccgctcwtgcttctgggtcatccagccctgtcccaggttctccttgtagaagcgctgggaggagatgatggtgcctgttgtccagtagagcatgacgttggtcagca

SEQ ID NO: 52224 - DNA, 201 bp, Homo sapiens
ggtcaggagcccggggcaggccagaggtactccaaagggggccggctggtatctgaaggccccttgcagctagtgtgttgttgagctgtgggcatgaacaygccacaggcagacactgttttgccagggttttaagaaacacggagggtcctgtggatctggagttcatttgtcaggacagggatggggacccctctgaag

SEQ ID NO: 52225 - DNA, 201 bp, Homo sapiens
tactgagggccgcccgggagccaggcacctggtccctccatgagggctttctccaaacacctcgacctttagtgttcccatccaagggcccctggggcacytgcaggcaaggctatacttatcccaccaccaagtgcccttcgtggagcccaagactggccgtccccctgcctccagcctcagaggcccctgttctcggct

SEQ ID NO: 52226 - DNA, 201 bp, Homo sapiens
ttccctccaggggctcacatgcctgttgggtggaacgaagggagcacgagcaaacacgcatcaccatgcctcgggagggctgggtgcactgagtgaagcarggcaggctgggagggatgggaaggaccttgggaggcggggagccacgcatctcctatttccaaagtcctcctccaccctgctctcccatcaccacttaga

SEQ ID NO: 52227 - DNA, 201 bp, Homo sapiens
agtaaacaccactagagggtaattaacattgccgaccccctgaatagcgagcaatcatgcaccagtggatgatcaaaggttggtcttaggaccacatgagkaaacaagctatttaggtaaactcccccacattcctatgtatctgcaccctaagcttttaagagaattcagctgccttcagccaaaccctttactgaagct

SEQ ID NO: 52228 - DNA, 201 bp, Homo sapiens
aggcatgagccaccgcgcccggcccaggtgcatgttattttatatagcactaagaacaagaaaatgttgtcagctaagctaccatcaactataacgatagygtacacctcatttcagaggagttgaaatatggccggctgcggtggctgacgcctgtaatcccaacgctttgggaggctgaggcaggcagatcacgaggtc

SEQ ID NO: 52229 - DNA, 201 bp, Homo sapiens
accctatctctactaaaaatataaaaaattagccgggcatggtgtcaggcgcccgtagtcccagctacttgagaggctgaggcagaagaatggcatgaacycaggaggcggagcttgcagtgagccgagatcgcaccactgcactccagcctgggcaacagagactctgtctcaaaaaaacagacagacagacatacactg

SEQ ID NO: 52230 - DNA, 201 bp, Homo sapiens
cactgccgggtgcggtggctctcgcctgtaatcccagcactttgggaggcaaaggtgggcggatcacgaggtcaggagatcgagaccatcctggttaacawggtgaaaccctatctctactaaaaatataaaaaattagccgggcatggtgtcaggcgcccgtagtcccagctacttgagaggctgaggcagaagaatggc

SEQ ID NO: 52231 - DNA, 201 bp, Homo sapiens; identical to SEQ ID NO: 15090

SEQ ID NO: 52232 - DNA, 201 bp, Homo sapiens
ttttattgcagtaagttttgggggtgggggaggggggacacataagagccagagggccctggagagcatgggtttgtgggaagtgtctgcactgcacaggycagggcggcagccgctgtggacagagagggcaggcacctgctgagcaggtttcgtggttttcctacaacatgactcacctgcctttgaaaatatgtcacc

SEQ ID NO: 52233 - DNA, 201 bp, Homo sapiens
agtccatgagctcctcaccacctcctcctcccagaaccaggccttccagtacgagtttggagccatgtatgcatggatgctgtgtgtcttcactgtcatcrtggcctacagcatcacttgtcccatcatcgcgccatttggtgagtggccctggagcctgtcccagggtacatgggtacatggacggctgattgcaccaaa

SEQ ID NO: 52234 - DNA, 201 bp, Homo sapiens
ccgtccccctgcctccagcctcagaggcccctgttctcggctcagccaggctcaccgctcatgcttctgggtcatccagccctgtcccaggttctccttgkagaagcgctgggaggagatgatggtgcctgttgtccagtagagcatgacgttggtcagcaggtcgtccagggagaacttcctgggaacgcagaacacaaa

SEQ ID NO: 52235 - DNA, 201 bp, Homo sapiens
tgggagggatgggaaggaccttgggaggcggggagccacgcatctcctatttccaaagtcctcctccaccctgctctcccatcaccacttagagagcacaraagggtgtttgaggtggaacaagtccatgagctcctcaccacctcctcctcccagaaccaggccttccagtacgagtttggagccatgtatgcatggatg

SEQ ID NO: 52236 - DNA, 201 bp, Homo sapiens
gatcccctgctagaagggctggagtcactctacacctcttccctgaccacctcttccctccaggggctcacatgcctgttgggtggaacgaagggagcackagcaaacacgcatcaccatgcctcgggagggctgggtgcactgagtgaagcagggcaggctgggagggatgggaaggaccttgggaggcggggagccacg

SEQ ID NO: 52237 - DNA, 201 bp, Homo sapiens
ctcacgcctgtaatcccagcattttgggaggccaaggtgggcggatcacctgaggtcaggagttcgagactagcctggccaacatggcacaaccccatctytactgaaaatacaaaaattagctgggcgtgttggtgggcgcttataatcccagatagtcaggaggctgaggcaggagaatcgcttgaaccgggaggtgga

SEQ ID NO: 52238 - DNA, 201 bp, Homo sapiens
tggagccggcagtgggcgaggacccctgagcacactcacctacggtgtcaggcttggtgcactggatgtgcatgtagccgctctccctcatcaggctgtaraataccttctccttgacggggtacagcagctccacatccctctcagtgaggccaagaaacctcccgaaacgctgtcccaggaggagggtcagggtagaga

SEQ ID NO: 52239 - DNA, 201 bp, Homo sapiens
tgtgggtctgttctttgggatgagaggccagggcaggtgcaagctatgccttcactcctttgtccctgccttcctccttcctgtaccccagctacagcccygttgggaagaatgtgtcgttagtcacaaagcattgcagatgtgtctaagaaatgccacgctggggccgggcgtggtgctcacacctgtaatcccagcact

SEQ ID NO: 52240 - DNA, 201 bp, Homo sapiens
gaggataaaagacaaagagaagagaggtctccgctggcacagaaaccagcagcgagatcactctgccatcctttcccttggatccgtgggcacgtctcctkcttggggtgttttcttttccaacggtgtcttttgcctccttctctccctggccacagggacgcgtatcccacgtgtgaggtggttgatgtgcagctgtgc

SEQ ID NO: 52241 - DNA, 201 bp, Homo sapiens
tgctggccacacaacctctgtgggaggcatctcttgcagtgaagctgttggtcctcagttcagtgcccactgagggtaaccaggccccagctctgcacccscagctccctgcctgggatcccagccctgatggcaggtggtttccctctcagcaatgacctcctttggctgcacaccatctttgctgtcatttacctcttc

SEQ ID NO: 52242 - DNA, 201 bp, Homo sapiens
gcacagtcagggtggagggagagagaagaccctgcacggtcaggctctggcaccccccagagcctagatattgagtcctgccacccttagtgcccccgccsccccttcatggtattgacagtaataagggctgacactggtttcacactcacactgtgctccaggtgcacagatgtcctcactcagccttcacaacctccc

SEQ ID NO: 52243 - DNA, 201 bp, Homo sapiens
cctgccatgcaaagaaggctcatagagttgctttggaagtggattctttgtacagcctggaagaagacgctgtgtaaatgacatgctttgggggctccccyggccacagaaggagaaaactggagccttctgatttcctgttgtttactttccagaggctggagttgggtaggaaacctgagcataccggcacactggctt

SEQ ID NO: 52244 - DNA, 201 bp, Homo sapiens
gctccacatccctctcagtgaggccaagaaacctcccgaaacgctgtcccaggaggagggtcagggtagagaagttgcttaaaaccaaagccatgttcaartgcaggcctttcacgtggctgaaggcagagagaggggccggggtgaggctgggctggtgtcaaggacagggagagaggagagatggcggaggaacaggcc

SEQ ID NO: 52245 - DNA, 201 bp, Homo sapiens
ggatctgcccactgtgttctggatgagccatccactctgaccatctgatcccctgagattgtcccacaatgcagccattctctgtggacactgccaggcaygcagaggtccaatgtctggctctcccggactccttgctgctggcttactgcccgatcagtccctgggaaacgcctgcctttggctctgccagcactggtg

SEQ ID NO: 52246 - DNA, 201 bp, Homo sapiens
ttgatatactcataagccaaaatactgtacagtcattaaaaatggctggaacaggctgggggcattggctcatgcctgtaatcccagcactttgggagggygagaaaggtggatcacctgcggtaaggagttcgagactatcctggctgacatggtgaaaccccatctctattaaaaatacaaaaaaattagcagggcatg

SEQ ID NO: 52247 - DNA, 201 bp, Homo sapiens; identical to SEQ ID NO: 15088

SEQ ID NO: 52248 - DNA, 201 bp, Homo sapiens
acctgtatcccctctcccgctgcaggaagaacctctctatccagggcctccgctggtggctacagtggctgggcatcaacttcaccctcttcctggggctrtttttcctgaccacaccctccatcatcctgtccaccatggacaagtttaatgtcaccaaacccatccatgcgctgaatgtgagtaactgttctgcaaggc

SEQ ID NO: 52249 - DNA, 201 bp, Homo sapiens
cctggtgtcagaagcagacaggtaaagacatatcgcctaggctgtgagcatgcgtgtgcgtacgtgtgagtgtgtatatgtgcgtgagtgtgtatatgtgygtgtgtgcatatatgtgtgtatagtgtgtgtgtgtgtgtccctggaatgggctaggggcttatgaagccctccatgtgggcaggacccacacatgacact

SEQ ID NO: 52250 - DNA, 201 bp, Homo sapiens
aatcccagtaacaaacagcaggattgtggacacacacagtggagccctgatatgctgcagctggacagtgggagctgagcaggcagggcaccccccccccygcccgccggccaggactccaggccttcggtgttcagtcttgccatggcatcagtcattggttttgtatagggagcagagaaggttatttaatctggttag

SEQ ID NO: 52251 - DNA, 201 bp, Homo sapiens
ccagtaacaaacagcaggattgtggacacacacagtggagccctgatatgctgcagctggacagtgggagctgagcaggcagggcacccccccccccgcccgccggccaggactccaggccttcggtgttcagtcttgccatggcatcagtcattggttttgtatagggagcagagaaggttatttaatctggttagtcag
